United States Patent 9,487,797 (GENOMIC PLANT SEQUENCES AND USES THEREOF) - sequence listing, part 3

SEQ ID NO: 4126 - DNA, 1501 bp, Oryza sativa
cctgcatagtatcatcttcgtacctaggattacctccatcccaaaataacaaaggacaatgagtttatgtacgtgaatgtggacataatgagtttatttatttcgaaacggaaggagtattaaatcatcgaaagtgctacacataggccttgtaacctatgatccgatacatatgaatatcaaatctggtaccaataggtatcagaattggaagatttggtaccctatgaatatctatctatgggcttgttcggctgccctataccacggctgtacagcagcggcagctgccaccatatatcttcgggcctgttcactttgatgctattttcaaacataaaattttttttggtaaaattgctaaaattttggctacttttagtttgttgtcaaatttggtaaatacataagaagtcctgccaaaattttggcaatattgtcatcttgtcaaaattttagtattgctaagatttattttggctacaacctaaacatgctcttcattgtattatactgtggctggctgtccactagcagtaccgaacagaccctgtatttctaacgtcggtagttctgccggcttgtgattggtggatgtggcaagcaatagtttgttgacacgtgttgcttctcctctctcccaatttgtgtgaattgtatgacaagccggttcaaaaaaaaagaaaaataaataaattctagagactattgagtgtcaacataacatccagatccttcatatcctttcaatctggtttgatccaacaaccaattcaatgaaaaatctagaagcgaactaaaggggcaaaatccaccaggaaccaaaaaaaaaaaagtatctaccacctctcagacagaaaagagtccacctgaaaccagagccctatggtaacctcgagctgccgacacgagcgatctggtttgaggtggcttgttttatcgttaaatgaattttaagtctgatttatattttagcatatttaccctatttttttataaattgaatggtcaaacatcatgttaaaagtcaatggtgtcccttcatccaaaaaaaaaaaaacttaggtaagtatggtaaacaatctaatgacaacgaatctgacagccacctatccggatttgttgtcttaggaatttaaaatgcattaaaagaggtcagtttaaatgttttttctttaaaaatacaatctactacatgttaaattcaaaactaaaaccccacaagaggttcttccaaatgtatggtctttgtagaaatttaatttgaattgaatcaattctcaaataaaatgttttagaatggactgcaaagatgacgacgccaacaagcacgtcagatttgttaccctatgaatatcatcaatttgttgtaggttttgtacttaacaggcgccaatacctatatgtaccaatctagtaccaacaggcataagacttaatacctaggagtactacttatatcataccatcgtaccgttccagaacagaaaaccgtggtata

SEQ ID NO: 4127 - DNA, 1501 bp, Oryza sativa
aacaccccgaagaagtggtggccggggaggaaccccgggcaggcggagacggagtcctccatgtccctccggcgtccgcacaccgacgtaaagccgtacctagcgcgctccacctccctgtcctcctcgtccgtcgaggcctctcccccgccgccatcaagcctccgcctcttcccggaggtctcctcctccgccccacgctccgcgaccaccctgagccgccggatctccatccgccgccgcctcgccgctcggctcccggtgtcgcactccgggcccttcccctccgacgacgatccagccacaacctcgcagcaaatctccgccatgaactaacaaaatctccgaaagatcccttgcaacagagggagagaaggtgggagctcctctgctcagctcagctcagctcgtcaagcaagaaatgttttctctcctcgaagcggtgagagcgattgagaagaggtgatggcaagtagcggccggcgatataaaagtgggtgggggaaggggtgggggtgggagaggcgacgtgccacgcggcgggcgcgggccacacgtacagttgtgtgatcgcgccgggggccgttggatgcggctccacgtgacgcgcgcccgtggccggtacgtgccgcccggacgcgtgtcgaggctgggacgcgtccaccgggcggtcgcgagctgggaggcttcaccgcgcgccacgagttgggcgaggcgctagtagccgcggcggtgtttgctgttcggcgcgcgggatgggcggggcgacacgtaaacgaggcgaggcgcgagcgagccgcggttcggttcactcggctcggctgtgtgcggggtgcggagggggtgggggaccgtgtcgacgtggcctgagcgcggatccgtggagagataagagtaaccgcaatggaaaatggtaaagtaaggtgctctctataaaacatatacatcttagcaatagattcgattaataggaaaccacattaatagtatatctacattggtatctgtcggtgacatgggaccgggagtatcatgacttagagacttgaggcagacgcgatcacccacgtggcctaaccccctcgggggggtcgggcccgagggtgatacggccgcccttctctttgtctccccgaggggtcgggctgcacccggggccgaggcgccccgacccctcgtgggttttttgctccgcgtgtatgggttaggtgagcacagtggggctcacctaaccacatttattgcggtttggctgagcgtgtcacgccgcatgtaacgcagtgcagtgcactcatttatccggtctgtgaccagtcacagaccggtcagatcgcgggttaggtggcgacaggcggtctgacgcacgcctcgccccatcccgtcaggacgagggcttctaggcgctcgtccccagctggagctagcgtgttacctcccagagatggcacgttagtcctggtcagatatatgccaggcttcaccctaaccattacaggcaaga

SEQ ID NO: 4128 - DNA, 1501 bp, Oryza sativa
gagtcctgggggttagcatcttgagggagccaatgttccttccgctgagccgcacattgtctgcaaaatccgtggcgaagaacatggccttctccttggggtcgagcccccaccgctgaagcgcggccacgaagtccctggtcttgggacccgcggcgaactcctcgtcgaactcctccacgacgaatgcatcgtcggccacggcggcactggcgagcgcggtggagatggcgaggcgcttctccttgcggttgatcttgatggaccagtcgcggggcttgggcccgaatatgacgccgccgccggggcggagcggcgtgcgcatcgacccgcgccgcgccttccccgtcttcttctgctggtagggcttcctgccgcctcccctgacctcgccgcgggtgagcgtggaggccgtgccgcggcgcttgttctggcggtcggtgatgatggcgcggtgcacgacggcgcgcgcggtggagggcggcgccgacttgaggtcgagggcgacctccccgaccttctccccggtgaaggagagaaccgggagggtggccgcctcggcgcgaagggcgcggaggacggagatagccgccttctgcttgccggcggcgacggcgacgcgcggggaggaggaggcggcggcggcggcggatgggaggaaggagaccgaggtgggggagaggaagggcgaggaggaagaggagagcgagaggaggagagtcgaggccacggaggaggcggccattgcggcggcttcgctcgctgcggtgcgctgcgtgggctggacgacggggaggctttgccgctgcagctgcggagcggccgcttctctatctccttatccacccccacccgaccggaccggccacactctcgcgagtgtcagcttagtcggtcgcgccagaccagtaagatacacacactactatgtgtttggattttagaagaagcatctcttcattaaaaaaacttagatattgttaaagaaaaaccctcgaggcagtattagtctattagatggtgttttttttctaataaagatgaaataaaataggaaagcaaaatgaaaacggcccattagcttatgtttaattaagttttgattattttaaacttgaaattgatttatttgatattttaaaatatttttatgtaaaaaattcatatgaaacataccatttagcagtttaaaaaatgtgttaggaagaatttgcatcttagtaaagaaggaggcttagtttcaccaaaatgagtttgaaataatcaaattaaatttcatttcctttttgtcgggtcagattgctcattagcacttgtgtatcagaacagttgcctgagaaccacattgacagatggggcgcaccatagacacagttatgctaaaaatggacaggaactccaaattttctacttctacttttgttctgaacacttgcgaagttttcacgattgcgatcctcttctcggttagctctaacaaacaagctaaagaaactcaagt

SEQ ID NO: 4129 - DNA, 1501 bp, Oryza sativa
aggcctgaggctgacggcggctgcagatatttctcactttccttccatttcctgtgagtttgttatcctgtggctaaaatctctgacgttgtccgtggtcaaggttttctcgcagtggttgcgggtcatcgtcactgtttatggatgagttctgaatcctttttgtgctatatgattggagccctgagagagttatagttatatggtggatgagtcctgaatcatccttgtgctatataattagagctccgagggagtcatacttatatcgctattgtgtccttgtaaatctctccgattttgagaattacctgtagggtatgataagaaatagctaaaagaaaaattgcatcaatgtaatacgctgtcaattgatatccgatggcaaaattaatccaacataaaaaccttcaatcttaaaaatgagggaaagctacaaaagcatcattgtaaagacgtgagggcaagttatttaatgtatatacaatggtaacttttaacaacatagttttacgatagtactagacaagttaaacttttaagaaaaaaaatcagaagtgcacatccaatagacaaaatagtgtgtatggatcgatttaggatgccacatttatttttaacttcacaccatttaacacaaatctaaagatagtttatatccatatttatagttaaaaattagtctttcttaaaaatggagtgagtacatatcaggtgtactgtccaaaagacatatgcaaaaagaatttacactcgaatatgcaattatgcatgatttttttattgtgcaaggtcgtttgcagtagggctaaccattgtacaattttaggcatgagggataaaaggaataggctgaaaaaaactgagttaagctcaaattgcatttagaagagcttttaataatgatagttttgatctgacatgtcaacaatctatatgtagacttggggtagcaagtatcaacaagttgtctcgaatgagatcggacatagctaacactaatatgaaatatttattagtttttacatgtaaaagtaccggatgttggtccattgcccccccccccaaccccccaaacacacacaacacacacacctttatacttgtccttcattgccccgtcacaagtagaacgtgacttggctgacatggctcttaatagctagtaccaatgatattctctttctaatgatggtaataagtgatttagtagcaatatattatgataggagtttctagcatgatttatctagcatttatggttttagtcctatttcattggttcgccatgcttgaattaagtaggtgtgacttgagtgatgccatactttgacgaaaaccctcaacttgcagatagctagatataacattgatgacgcttgtagaagtgttcctcttcatgtaggtatcattattaggccatgaatttatctaccaactttttcaacttacatttgaaacttagcataggacatgtgtaataaaattttaaatatatcaa

SEQ ID NO: 4130 - DNA, 1501 bp, Oryza sativa
tacatgaatttgaggagagacaaaaactcaaaggaatttttccatgaagttctacctcatgttaaactttctcaaaaacttatatgagaagaaacattccataggaatttcattggatctcatggggtattcaaagagcgaaatcctctaaaatttctataaattccctttgaatcaaatggagccatcccattccaaaacaagggatggacctaagtacctaacatatcccacctcatgccaaatcaaatacatgagtgttgttttgaacacaatctaagatgagaatttgttttcgccgctcattgaaatcatatctattgcgccatcgacaattttgagatcctcccgtttgtcattacttagttggcgctctactgctcatccctatttatcttctgtcattcctctctatcaatagtgcttggtcaacaaatttgccccgaaagacgattaaataaattttatagtgggagaaaacacatgttttttttaaaaaaaaacttcaaaaaaaaatcagcattacaattgtcataagaatgggaaaacctgcaacgtcccaaacaaggccttgcaaaggatcataaggtcttcccagcgctgatgactgatgagtgatgagaacgatgggcgatccaacgagaaatcaagggcagcagcatattccaagggttcgacttaccgccggtaaccgcgtgtttaccgtgattaccggctttatcgcgggggtacggtaatataaataccgcggtaacctccttaaattcaaataaatttaaaaaataatttgaatttttgataaattttgcaccatttcgtacggttttttgcggtaaccgtgcttactgccggggcacggtaaccccgcccccggcggtttgggaaacctgggggcggtttgggaaacctgattccaactcgcaggaactcaagtatactcaacgcagcagtacagcgcgagaaaaccatgttaacagtaaatctatttatacatcgctgtccagtcttctcctatgaagtgtacagactgcgccatctccacaacacgccaagccgtgagatattctgcaatatccctctgttcccttttcatctgaactaaaaacctgaagggaaaaaaaaaaggcccactgtttcacggttgaagaactcgtcgatttaattttgtcaaatctaatctttaaattttaactattcgtgtaggagtaccctccatctctgtcgaattaaaccgtgtttttaacgtaagacgaccaatttaaaaagagtcgaagtggtctgaagtctgaactctgaattttgttgggggaagaaccgaagaggcagtgccgtaaaggcaaaagaaacaagaaacacggcccgagtctagtcgaccacgccccgcgtccgtcttcccccccaaaacttcagcaaaagcaaacgaagtcttctcagattaattctcgcgtcgtgtcagaccacgctgccgcgggggatctgccgggtggcgaggctgcggaga

SEQ ID NO: 4131 - DNA, 1501 bp, Oryza sativa
atcacttattaccatcattagaaagagaatatcattggtactagctattaagagccatgtcagccaagtcacgttctacttgtgacggggcaatgaaggacaagtataaaggtgtgtgtgttgtgtgtgtttggggggttgggggggggggcaatggaccaacatccggtacttttacatgtaaaaactaataaatatttcatattagtgttagctatgtccgatctcattcgagacaacttgttgatacttgctaccccaagtctacatatagattgttgacatgtcagatcaaaactatcattattaaaagctcttctaaatgcaatttgagcttaactcagtttttttcagcctattccttttatccctcatgcctaaaattgtacaatggttagccctactgcaaacgaccttgcacaataaaaaaatcatgcataattgcatattcgagtgtaaattctttttgcatatgtcttttggacagtacacctgatatgtactcactccatttttaagaaagactaatttttaactataaatatggatataaactatctttagatttgtgttaaatggtgtgaagttaaaaataaatgtggcatcctaaatcgatccatacacactattttgtctattggatgtgcacttctgattttttttcttaaaagtttaacttgtctagtactatcgtaaaactatgttgttaaaagttaccattgtatatacattaaataacttgccctcacgtctttacaatgatgcttttgtagctttccctcatttttaagattgaaggtttttatgttggattaattttgccatcggatatcaattgacagcgtattacattgatgcaatttttcttttagctatttcttatcataccctacaggtaattctcaaaatcggagagatttacaaggacacaatagcgatataagtatgactccctcggagctctaattatatagcacaaggatgattcaggactcatccaccatataactataactctctcagggctccaatcatatagcacaaaaaggattcagaactcatccataaacagtgacgatgacccgcaaccactgcgagaaaaccttgaccacggacaacgtcagagattttagccacaggataacaaactcacaggaaatggaaggaaagtgagaaatatctgcagccgccgtcagcctcaggcctcagccgctggcaaacgcaccgcatcagcagcagcagcagcagcagccatcccaagcgagagagctttgctttcgcgagtcgcgcgactccgccaggacaggaaaaaaccggaaaaaaaaaaccccgcaataaaatttccccaacttccgctttttccttgcctctccccaccacaccacaccaccccatctcccatctcaccatccccctttcccaccctcccgtgcgaacacacccgcggcgcggagcccagatcgggatcgcgacggatcggcggcggcggcggcgatgggag

SEQ ID NO: 4132 - DNA, 1501 bp, Oryza sativa
tgctaaaacgtgtcataccaattgttttggtagtttgagcagtaaatacgatggtttggtttgatgccaaatgatgggtaatgcacatgctcagtttgaaacaattctagaactttctttgctattatataaattttggcttccaattaatatcaattcgaacaaattcatttataatactctagagttattttggtgggctactaaaccaaacaaactttatatatatagggaataattaactatttgccgctcttacaagtgataattaaggatttgccactaggcacacatgtcatagattgcgagtggtaaatctttaattgccacatttcaaagtggcaaaaagttaaataccccgatatatagcgttgtgttgatttttaagactctactgaggatcaatgaggcttcccttgaagcatatgattttttggaaaaacttaggaggagctaaaatatttcctgtcaaaatcttataagattcatgcgttccaaggagccctaaatttggccatggaaacacatgaattatcaaacaaaaaaaggtaacagtatttgctcaagagaaagatataacacatattggcgtgaagtgagtataacttaattggttagtttcttcgtggtgcaatctatccacccgggtttttatagggataggtgacttcgtgaatctcaagatatacttatacaatcttcaaaggtgctcaaagggatagagtgattgcgtgcacatttatatgagcatctgttgttttaaaaaaaatgcaacaccacctagtcaaccctttgctaaggtgtggccaagatctattgttcacaccttaggcaaggtaaggggaaaaattaaatatggcgagtggagtctgtggctaggtaagaagaaaaaatataaggtggtgtttggatacagggacttaattttagtctctatatttagacactaatttaaagtattaaatatagactacttacaaaactaattacataaatgaaagctaatttgcaagacaaattttttaagcctaattaatccataattagagaatgtttactgtagcatcacataggctaatcatggattaattaggctcaatagatttatctcgcgaattagtctaagattatgtatgagtttttattaatagtctacgtttaatatttataattagtgtctaaacatccgatgtgatagggacttaaaagttttagtcccatctaaacagggtcaaatgtgatgagcgtagtctgtgactaaaaaccaattgactatgtttgggtaaaatgtggcattttttggttttcttttaggtgtttaatgtagctttggggaatgattttgaggtgtttttagtgtttgtaatattatggtgtttaaagtgagaactttttcttgggtcatgtgtatctcttgcctttgtttagaaaaaaatgtggcacttaattaagaaaacaaccctgtaaacagatggcctggcacgttaaagcgctgagctgt

SEQ ID NO: 4133 - DNA, 1501 bp, Oryza sativa
ttacagacttaagttcggcacctgaggttggcaactaatcactgttgcatggaaaacagagcggtccatcagtgcatgattagttaaatattagttttttttttaaagttgatcgatatgaattgtttaaacaacttttgtatagaaaaattttataaaaacgcactatttagcagttttaaaaggtgtgcgcgtgaaaaaaagagggaagtgagctgggaactttggctaccgaactcagccttacaggtcatataaactctgttaaaagactttgctatatgcgtttcgataaagaaatgggagacgaaccctctctttcttaaaaaaaggtaccctgcttaaaaacacattatatattattaattgtaaaatgcatgatgtaatgtatatgcacatgaaacccccattagtcgtttcatagtagttcaaacattacaataattattgatcaaaggctacattatttaagaacatatggagtaaccgcatataacaagagagaaacctgtttagtgcctttcaaacttccaactcttccatcacatcaaatatttggatatatgcataaagcattaaatatggacgataaaaaaaccaattgcacagtttacatgtaaattgtgaaacaaatcttttgaacctaattacaccatgatttgataatgtggtgctacaatagacacttgctaatgatggattaattatgtttaatggattcgttttgcaatttacaggtgaaaactgtaatttattttgttattagtctacgtttaatacttaaaatgtgtgtccgtatacgttaattttttttaccaaaacaactaaacacggtccttgtcgtgaaaaaattatatatttaaacatagcagtaataggtagatggaggcaaaccgaacatgtaaataagcatacatgtttatattatgttttgcaaaaagaaaaaaaaagaaatagacagagggagcatgctatgtcgatcataataagtatttatatataggatctgttcagattgtagccaaaacaaatattatcaaattttagcaatcgacaatttggcaatatcatcgttttggcatgatttcttatgtatttcctagagtttggtaaaaaactaaatgatgcatatatttgataacttttttaaaaaggtatggtttgaaataaaattaatctgaataacgccatactagttaatttgaatttgaaagctgagtggaggaatttgaatatttgatcggcgtgaaggtcgtctttccttcgcaattcacaaaatcggtccgggtcgaaccaatcaaccaaagcccagacagtacaccaaatccaaattggcggttggatcgagccagcgccgcggccacggcacttcagtgctccatttgccccaacctgacaaaaccaacccgacccgcaaaaatccctcgacacagcagcacacaagaaaagcctctttgctcgccggagagagatctcactcccgcggcggccatggcctccg

SEQ ID NO: 4134 - DNA, 1501 bp, Oryza sativa
ccgtaattttgttttatagtacttgactacttgtacagttgtactaaagtcggtactcggtagcaacacaaacaatgcatcgatactccctatgtctcgtaatataggattttgctccttccaattatcccacaatataaaagattttggtgtaatacttgtcacatcaatcaactcaaattcaaatttctatctattttaaccttcaactatccactcatccataaacaagggaaagtgatttcatccctcgaggggatatcctctcgtttcgtgcatatcacctaaatagctataaaaaatataaaaaaattggcaatatagattaatatgaaatatatcactccacaaacattgcaagtttaaattgaacttctacaagttacaacaaaaataacaaatatagttgcgaatgtgcgataactattctcagcttaatttgttatttttattgcaacttgtagaagttgaatttggtctttcatatttgtggactggtatatttcatattaatctatgttgttgttgacgtaaaacacgaggcctgggagatctgcttaactccagtgcaggtccaaagctcgccttcgggtgtgttagcgtgccagttgatttgattctacaatcaacaagaaatagaaacaaagagatcgcggttaaatctataaatgatagctgatcggctaagtgccgatgacatatcatttatctttgagccgatgtcatatgtaaatcgatcggcgactataaatagataataaagaactaaacctactcgatcggctgtagatattaccaatatatagttcttatatcgatatatatttaaatcaagtgattgagatagatcggtcgccatgccaagacagtataaatcacttggatcaaactatatattaataacaggactatatatgtttatagcatagccgatcatataaatttagcatgtatcggttaatactccgatactactctatatcaggatattaaaacaagtataatatatcaaacaaaagcttgatatacttaaatgcaataagatcttgacataaagggcggatttaacatgtcactgaagcatatagagcgaatatggttaaatcagataagatcggctgaaactccgatactaccctaatcggcaaccagaaggcgggctagagattgatattctaagcacgacttaatagatcaaactcaactgatgcagcattaagtatgaaaagaagaacaatatctagacaatcaagccgctggaagtttcatagagtggtagatatcttatataatctaaatcaacatcaaaatctaacctaatcggctgcgctctactaacagatgttagccgattgtaggttagatagcgatattgcaagagattatgtacgatatatgataactcgatgaattacgtaaacaatattagagtatcataaagatggaagcactaatcccgagaatacaagccgtcataacaagttttacctcttgttgaaga

SEQ ID NO: 4135 - DNA, 1501 bp, Oryza sativa
aatcgaccacctggaaaccacttgataaaattaattaagctcatactctctctgttctacgagataaaatattttactcttctattttatcctaaaatataagatattttattcctcaatttctaacttttctactatttattccctatctactaacttttgtagttatattcctataactatcacttttgtatcacgactttgctacttccttaattttggaaaaagaaaaggtttaatcccttgtgtggttatgggatggatgaagtaaattcaattgtttgataaattttgatcaaatttgattggcagccagttagttatggaggttatggatgaaactgctaggcaacaatgggtcattttggatcaatgctaaaacgtgtcataccaattgttttggtagtttgagcagtaaatacgatggtttggtttgatgccaaatgatgggtaatgcacatgctcagtttgaaacaattctagaactttctttgctattatataaattttggcttccaattaatatcaattcgaacaaattcatttataatactctagagttattttggtgggctactaaaccaaacaaactttatatatatagggaataattaactatttgccgctcttacaagtgataattaaggatttgccactaggcacacatgtcatagattgcgagtggtaaatctttaattgccacatttcaaagtggcaaaaagttaaataccccgatatatagcgttgtgttgatttttaagactctactgaggatcaatgaggcttcccttgaagcatatgattttttggaaaaacttaggaggagctaaaatatttcctgtcaaaatcttataagattcatgcgttccaaggagccctaaatttggccatggaaacacatgaattatcaaacaaaaaaaggtaacagtatttgctcaagagaaagatataacacatattggcgtgaagtgagtataacttaattggttagtttcttcgtggtgcaatctatccacccgggtttttatagggataggtgacttcgtgaatctcaagatatacttatacaatcttcaaaggtgctcaaagggatagagtgattgcgtgcacatttatatgagcatctgttgttttaaaaaaaatgcaacaccacctagtcaaccctttgctaaggtgtggccaagatctattgttcacaccttaggcaaggtaaggggaaaaattaaatatggcgagtggagtctgtggctaggtaagaagaaaaaatataaggtggtgtttggatacagggacttaattttagtctctatatttagacactaatttaaagtattaaatatagactacttacaaaactaattacataaatgaaagctaatttgcaagacaaattttttaagcctaattaatccataattagagaatgtttactgtagcatcacataggctaatcatggattaattaggctcaatagatttatctcgcgaattagtctaagat

SEQ ID NO: 4136 - DNA, 1501 bp, Oryza sativa
tagtgagagagtagtagagtggtggttaggagaggggggatcctgatctgaagttgaagaagaagaatcagattgtgataggcataggcatacttggatgtagatgaaggctgcagcggcggcgacgaggaggatgcggaggtcgcaggggctccgcgccatctcttggatctcccccaacactagtctagtagcctttgatttgggatgggatgttggggagaaaggggaggaggaggaggctactacttggtagtgggcagggcagagcaggtgagctcgcaattggatctgcacctgcaccgtacctgcacttcttcttcttcttattcttgtgcggtccggaggaagtggaggtggatcaggtggaggaagacgccgcctgcgccaccgccgccgcctgcgcgaaggaagagttgagcgggcggtgcggcgcgaatagatggatggcggcggaggaggggagtgggtcggcgccggagccgacgcggagagacgggcgacgtcgcctccctcctcaacaggggaagtgcgcgatttgggcgtgggagaaaggagagaattaggcagggttattttggtctagagaaaaaaataaaatagaagtaataggcctaatccagacccagcaacaagaaatgcagttcggtcatgagctcttcctcctcgtcctatgcatatagcgtataggttgtatttagaatttagagacgactacttgggcgatgcgaggcgcattgcaacacaatcgcagaggcggcgacttgacgactccctctcgctctagggtttcctcccctccctatcgtgaaccgccaccccaccccctcctccagcgggcttcgccatgtacggtcacctcctcctcctcttccttctctcttatccctgcaattccatcccgccgattcatccattgctttctttttttttctacaatactacgaatccacgcttacttgcttgcttatgcgatctcatcaatttctcgattcttttagggacaatttcttagtccccatctaaaagtaggtcactttgctttgctatcataatatgatatgatatgatatcatatgcctagtatttaggatacatgtacgtccccccctccctacaaaaccaaacccctcccccaaaaaataaataaatcagaggcagtaatagctgacttacatccaaattgataactgcaccaatgtggtttgtaagattattttctaatgatatgtgttatctagtagtttgagcatttcataagctgtcaacatttaattagtttttgtttatgaccactaatgcgttcgcatttcgactccattcaccttttttagccttaagtcctgtttagattactggtatttcttatctgcgcggttttctttatgtttgggttattttatatgaaatggggattgagagatggggggatcttctcctctctttttttttcttttctctttttgggactctggattatctgaagggcaatgatgggcaa

SEQ ID NO: 4137 - DNA, 1501 bp, Oryza sativa
atggctccaaaaatagagaggggttggttccatcatcctggccctctttgatacatccaagggactgcctgcggtcactgcgaagtatggattggattccatcattcgtagcctctttgatccctcctacccatccaaacccccctccccccctcccatcattgcccatcattgcccttcagataatccagagtcccaaaaagagaaaagaaaaaaaaagagaggagaagatccccccatctctcaatccccatttcatataaaataacccaaacataaagaaaaccgcgcagataagaaataccagtaatctaaacaggacttaaggctaaaaaaggtgaatggagtcgaaatgcgaacgcattagtggtcataaacaaaaactaattaaatgttgacagcttatgaaatgctcaaactactagataacacatatcattagaaaataatcttacaaaccacattggtgcagttatcaatttggatgtaagtcagctattactgcctctgatttatttattttttgggggaggggtttggttttgtagggagggggggacgtacatgtatcctaaatactaggcatatgatatcatatcatatcatattatgatagcaaagcaaagtgacctacttttagatggggactaagaaattgtccctaaaagaatcgagaaattgatgagatcgcataagcaagcaagtaagcgtggattcgtagtattgtagaaaaaaaaagaaagcaatggatgaatcggcgggatggaattgcagggataagagagaaggaagaggaggaggaggtgaccgtacatggcgaagcccgctggaggagggggtggggtggcggttcacgatagggaggggaggaaaccctagagcgagagggagtcgtcaagtcgccgcctctgcgattgtgttgcaatgcgcctcgcatcgcccaagtagtcgtctctaaattctaaatacaacctatacgctatatgcataggacgaggaggaagagctcatgaccgaactgcatttcttgttgctgggtctggattaggcctattacttctattttatttttttctctagaccaaaataaccctgcctaattctctcctttctcccacgcccaaatcgcgcacttcccctgttgaggagggaggcgacgtcgcccgtctctccgcgtcggctccggcgccgacccactcccctcctccgccgccatccatctattcgcgccgcaccgcccgctcaactcttccttcgcgcaggcggcggcggtggcgcaggcggcgtcttcctccacctgatccacctccacttcctccggaccgcacaagaataagaagaagaagaagtgcaggtacggtgcaggtgcagatccaattgcgagctcacctgctctgccctgcccactaccaagtagtagcctcctcctcctcccctttctccccaacatcccatcccaaatcaaaggctactagactagtgttgggggagatccaagaga

SEQ ID NO: 4138 - DNA, 1501 bp, Oryza sativa
tttagggggtcttgtatttatacctataggtgtccccttgtccaagtagaactagggaaaccaatatggatacaatccgagtagtcctggtcgtttccatgtagaactctggttgtctttctttatccggaactctctccatatccgcaggttgttttcgtataggacatggtatgtggtgggccctgccgagatgtagtcgactactattaggtatgtggtattcataaccctgacatagccctcaacagcacaaccgtataagcttgccaattaacacttgtgagcaataataatctgaaacccaacaacaccttttcctgtcgggcggaaatggcaaaccaaacaagcaaaacccctgctggcttggccaggcaagcatcaattgaagtcaaatttgacaaaaatgaagctaaatatgccaaacttgtcttaagtctttcaaagttatgccaaatttgttataaatatgtcaaaagtttccaaataaacaaatctttcatataacagggtgatatgactaagagcaaaaatggcaatttacctttagttaacgatgttatcttgcctttatggaatatggtcagtcttaagcaaactcaaaatagtaaggttagattggtagctaaaactagttgataccacacgctttgctacggaatatgtgatgaattaattcatgttactccctccgttctagaatataagaagttttagagttggacgtgattattaagaaagtagataaaaataaatggtgaagggttgtgattggataagtagtggaggtaggtgggaaaagtaaatggtggagggttgtgattggttgagaagagaatgttgatggagaagttgttatattttaggacaaatcctgagagcaaaaagtttatattttgggacagatgaagtatatattatagaaatggtagatgtatatatttaaataatgtgaaaatgatgtggagataatgatttgatatttgtttgcatattgagttctaaaaatacaataaaaatataaatggtatgttttgtttgcatgatatttaaaatattctagataataatttctagtaagtgatgatgtgatacacttgcatgtgatttaaaatattctaaataatactacatctgtcccataatataaatatttttagaggtggacacggttattaagaaagtactactaggtagaagtgaatgatgcagtgttgtgatttgttgagtagtggaggtaggtagaaaaagtaaatggtagagagttgtgattggttgggaagagaatgttgatagagaagttatattttgggacaaatcttgagggctaaagttgttatattttgagacgggggagtaattgctaatgggtgatgatgtgacacatttgtatgttgatgagacgggggagtatttgtatgttgatgagttttaaaaattagtgtacgtcaattttaagatagaatttagaaaagggtcgaataagaaattacccctgatt

SEQ ID NO: 4139 - DNA, 1501 bp, Oryza sativa
catttttttctccctttttttgttttttttaccgcgtcacgtataatcggattcgattttttttcgctcaatttctttttcacgctttttttcacggacggacgacggaaacacatttagttttttaagaagcagagaagagatagagtcagagatagagaaacggaaaaccttttttcccaactttctttttttgaatcggacagaaaaaatggtcacgcttgttttttttggggggatggacgacgggattttttttaatcggacataaatctttttttgcactattatttttctttttttacggtagacggaaacccttttatagcacttttttttatcggacataacaaaattttcgcacttttttcgcgcttgatttttttccataaagaaatctcttttcttttttttacggaatttccaagggagtcggaagttttttttaatgggagtcggacttctttttttggtttttttctcatcgtttctttttgttttcacggacgacgaaaacaggttttactttttaagtatatataagtatatataatatatagtagatagtagacttagaaaagtacccgtgattgcaacaattaaagacgacagggaaattaagtattatgtttctctaatcctattttaatgaaaaagttgaaggaatccctttaataacatttcatgaaacgaacaacgtaaaggtaacgaaagttttcaatgaaaaaaaatttcctatccttcccatgagttagagggtttcataggtaaaattcattaggacccttgatatcttatttctgcatagtcgattacaactgtgtatcttaacttgagcaccagtaaacctacagtcacgtacacaattatgttggctatagtgaatcctagattgggttgacgaaagggatggaagctaggaatgcaatttaaggggattaagcaaaacggtatatttacaaataaaaagtaatttatcaataaaacttttagatacgtgttattagcgttctaaaagtaaagactgaaaaataaaattcaaaaaaaccccctcaaatttagcttcaaatttaaagttgataattcaaattttaactgataaatataaggcaggctatatataggatagcccgctataggtaggtaggtaggtagcgtgctgatcgatcggtccggcgggccggcgacgagcatggcaggtgacggtgccaagtgctccgacgaggtgaacgacggcacctacttcatggccggcgtgatggccgtgaccggcctcatggcgaccgtcctggcgctctccggcatcttccattgcgcgcttcgacgcgttgggcagccaagcataatctcgcacatcctggtatatatatatatatatgcatgcggattggattggattgataattaaatttccagcagagagagagagagagatcgagatggaagctatatatatatatatatatatatatatatgagattgcgagcatggcagtgcagg

SEQ ID NO: 4140 - DNA, 1501 bp, Oryza sativa
tatgctgcatcggttaggctcgacctatgaggttgttgttgtaagttatatttatttaagtcagtaggcatcaatcattgtttcatcggggtttcagccgatgagttatttggacattgtttaagtgttctatcggcttatagagattatatacaagttggttttagctgattgcaacaaaagtttcattgattacttaatcatttggatttaatgacatcgggttttcagccgatatatactttaaccatcggattagtatttattcaatcatactattattggtccattggtttttattgaattatattgttgtattattataagttcactgcttgtccaattatctttgtatcatttattcaagtatcagaatctatatcggacatatagctgattgttcaaaactctatcgatatcggctattaccgctacatcggcttattggccaatcgactctttgatcatcgatttatctattttatcatttgcagaatcaaactggctagcacgctcgcatctcatcaataatttaggacctgcactaaaactaagcagatctacatacattaatgttttcagcatcaacaatatcatcggcagtaactaatgtcgaatgaaagcggaagatgacatagaagagtaacttagctataaacagtcatccacccagatttgacataaaacccagtaaaccaatctgataaaaacgcagccaccaagagtatcgcaccaacataaaacctccgatgccattactattccgcccatctgaaactaagttttcaccaggaggatctatcagcatcacctccaagaaggcgtgtggtgcccacggacatcaccgatgtcgatgctcatagcaacgacgacttcagttgcagatttacggtgatttgtgctcgacctcctcctaggctttgagtgacagcagcgacggtgacgggaggtggcttgcaacgggaaggaaggtggcgagttgcgcgcgccggcggcaccttggcccaccatcttcaccagttcgatcggagaggtttacagcagcaatggggtagggcgaatgtgctgattcgaagctcccgtagcccgatggcaactacttgagcaacggtgttgagagcacgccccctagctaggatcgccagaagctggatccggccataaccaggtcgtcgaaaaatacagatagctaagctaattgctatgataagatctttagataggttaccgaacaatatacaaattaatcttgatgcacgcatgtatatatatattgctgttggacacttggtttaattttgaggagcattatattgctggttatagatgctatatatcgtccttgcttagcaatatatcgtgagtaataattgagatgggaaactattaactagtgtttgttggattggttctcgatcgatctgcagagaagcggaggtctattttgatcgatccgagactgagactctgccatgggccatggatattggaaaattaaaat

SEQ ID NO: 4141 - DNA, 1501 bp, Oryza sativa
cataatgtgtgtatgacaggtgggaccatgtattaatagtgtagtaagcaaatattgtatgaattgactattacattggctatagataatttggagctagtagtggactatactattaaacttgctcttagtaccactgtaatgtgcatggttgattggctggagcagttgaagcagccaaaattaatcttcgtaatggtcgaaatggcacccaaaacaacggcccgtttccttctttggaagatgagatggacttcttgtgttctttggggtaaatataactgacagtttgaaatggtcattattgtgccctttctttgtacctacaactcatgtgagaatattgcattgttttctattcgttgaaactggtggggacagtttgatatgccattttttgaagtttgagtatggacctattgattgttttgtggatttttttttgtctaggtacgaaatgaagccattttagacttttcaaagtcaacaaaagactacttaattattttgtataattcaaaaggaaatgcatgactgtaaaatttattgttataagtttttcatatgtaaaaaatttatgtctcaaacaataaatatgatcgatgttatctggtaataataaataattactacctccgtcccataaaaattgcatttctagctaatttaggacaaaatagtaggattggaaaatgacaacaataatctaatttaatgaacccactgcatgcacacattccatatatataaatgattaaaaggaagtttgagagaattaacccatataattagcatacttaataaaattgcaagcattagcagcccaaattatgtgggatgaaaggaaacttatacatatgaatcaattggttgggtcccacatggctagaaatacaatttttgtgggacaaagccttagagctagaaatgcaatttttatgggacggagggagtatatggacaaacaatttctaacatcagtacccaacactttcccctgttttatcaaggaacacttcaattacaaatgtcagcgtctgattggatgacctcaaaggtcaagcctcccaaacagtggctacacaaagccctctcctcgtccgaacagccgcctttggttttggtcaaattaaggaaacgcatgggctcaaaaactcctaattgtgatgcaataatgactaattaaatccatgacactgcttggaaattcagccagcactagctcaaatttttagttactactattaatttgacaatgtgcaattactccattattgtactacgattgtaactgacattaaacaaaaaaggcatttcacatgttatgcctaacattttggagtcaataatgtcaagatagatgcatgtggatactcttcttttatcttgagaggagactcattgtggtcaccctatcatgctgcttttgaacgttcgccagcgtttgctgctaatgcatgacaattgttcaatccatttcccttttgatatgatcagatca

SEQ ID NO: 4142 - DNA, 1501 bp, Oryza sativa
accggtccttaaccgccatgggtgcgaccagcaaaaccatgcacccacagcccaccattcagtgtattttaattaactcacaccattgcggtggcaccaatctaaagctatgccaatagacaaagtctatgtaaaaaggtgatccccatttgtgtgctagttgaactaagcatggctaagcatttcctaaaccaacatctaatcattttgatacccaggttatcaatggcatatggtaaacaataaatggctgagtaataggacccatcccacatgatattgtaaaagaatgcaacatttaatagaaatgcgggatatttgtaaattgggtacaatatgatcaaacgtattgcatgacttgccttgctctcgaactgatgagacctcagcaacgtcttcgagaaactgcggatcgacgaaacggccgaaacctacgcgacaaacaaagcacacaagcaaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcagtaagtcccagggctgacgtcagcgaggggagggggtggcgccgacaggcgggccccactggtcagcggcactaagggagggagagggggcggctggcaagcgggccccactggcagcggcacaaggggagagggagggggcgtcggcatgtgggccccactggtggcggctaaaagggaggggtggtccaccggctggtgggccccaccgggcagcggcacagggcgggagaggggcgtggctgttggcttggcacggctcaagccggccggccatggcgaggcgacgacggcgcacgaccgccggcggtgaccggcggcgcggggagacggcggcggccggcgctgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggggtcgggttgcgcttgccccggccccgagggccgaggcaccccgaccctttaaggaagtctgcgccacatatatgggataagtgagcacagctgtgctcacctaacagcattaattgcagtctggtcaagcgtgtcacgctgcatgcaacgcagtacagtgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaagg

SEQ ID NO: 4143 - DNA, 1501 bp, Oryza sativa
ggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatctcttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacacgttgcacggggagtacgccggccgttacgccggcgctcgatgttgaggcgggcatccggctccccatgctgatcctcccgagtcgaaggcgtcgacgagggagtggcagccgaatgacgtgcagccgccgccgctcgccgcgccctccgtcttgatgacacggaaccggtggtggcggcgccggaggtcttggtggtggcggaccgtccaccagcacccaggcgctgctgggccgtcatgaccaagttggccacgtcgtccagccatcgctgagctggagactcagggtcatggacgacgggcgggtgacgtaggagcgcgccagcagcctgaagcgcgccctgaggcgtgctgccgtcgccgtagacgaggaggcgacgctccccatctcgccgttctcctgtatcacccgcgaccggtgatgctgcggatttatcaaccctctcgagcgcctccccctgcttaggactttggtgtggaggagg

SEQ ID NO: 4144 - DNA, 1501 bp, Oryza sativa
atagctttagattggtgccaccgcaatggtgtgagttaattaaaatacactgaatggtgggctgtgggtgcatggttttgctggtcgcacccatggcggttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggtgtagcgttggacagtgattggttaatattgattaattactacaactgttttactgctttcaactactgtttttaaatgctagctttatgcaaaagaacctctagcctcctttggttatatcctgcatcatacctcctcttccggtatgatttgctgagtacagtgggtagtactcagtcttgctctctttttcccccacaccagagctggagatcttcctagttggagctgttttgtcaaagttggtttcgtcgctgccgtcaaggattgcctgtggagtggagtcgcccgctgctgaagtcaagcttcccggtttagctcgcttttatttttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacacctgctgactcgggtagctagctagtcgtagtatgcagtacttataagggcatctgtagttgagttcggcgagaaccatccacggaaacaaagttaattttggttcgggtgctacttcctccgttcaaaaaaaagtcaacctagtactaggctgtgacatatcctggtacaataaatttagacacagagtatgttcaaattcattatactagtatgtgtcatgtcgtagtacgaggttaagttttttagaacggagggagtacaacgctagcatcgatttatcgggcccatctagaatcagccgtaatctttcctccctcgcacaaactagcgaagaaacatttttctaaacggcaaaatcgactatgcgttaggttcgagatgtttttacctcacgcgacttttttttttgttgaga

SEQ ID NO: 4145 - DNA, 1501 bp, Oryza sativa
cggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatctcttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacacgttgcacggggagtacgccggccgttacgccggcgctcgatgttgaggcgggcatccggctccccatgctgatcctcccgagtcgaaggcgtcgacgagggagtggcagccgaatgacgtgcagccgccgccgctcgccgcgccctccgtcttgatgacacggaaccggtggtggcggcgccggaggtcttggtggtggcggaccgtccaccagcacccaggcgctgctgggccgtcatgaccaagttggccacgtcgtccagccatcgctgagctggagactcagggtcatggacgacgggcgggtgacgtaggagcgcgccagcagcctgaagcgcgccctgaggcgtgctgccgtcgccgtagacgaggaggcgacgctccccatctcgccgttctcctgtatcacccgcgaccggtgatgctgcggatttatcaaccctctcgagcgcctccccctgcttaggactttggtgtggaggaggtgggggagtacgagctcgacggcgtgggtttggctccccgtcgtcgccgctcacactcggagagaggtcgtgcacctttgcttgctcggccattaggctgatcaagaaaaacttggcgcacacggaagagtatgagagctcagaaaacacacgctgagccccctacctgg

SEQ ID NO: 4146 - DNA, 1501 bp, Oryza sativa
tgttttttttacacatagaggtgcatatatgtgaaattaatattgatctgtcgataaaagtgcatccgaagtcataccaaatatttagaatgtcaattatacttcaaagtacataaacaattgacaagtggagcctcttgcacatttagagctcatttcatctcatctacagtagtataaatatagaatagctcatagtatagtacataaaactgtttgtagagcagaaaaaactggattgtaactgtcgagtaccgaccgtaggaaatggacctttaggggaaggaagtactaataattgagattgttttaggacagatgggttaaattagctgtttgattggtccatagggcaactggacaagagagctatgttgaagtcaaaccagatataatgctcctgttttgaaaagcatatcatgattcctaatttataaatccccagttcggtgattaatctactatttacatcatgatgcactaaactagcttcttccccctttttttttgaaaaccagattgtcactctccaaaaaaaaagtttatactgcatacctttctatcaaaacccggaccattataagaatgatggatataataggaggagctctcatatcgaaatttattaagagaagctatgctcgaacctagaccagcaagccccaccttgtggtgctaattagaaaatccccataccttcgtccagccggatcattatgcagatataattatcttactttaaaaaaaactatctaaaaaacatgttgttaatgtaactatactttccattgtacctttttttaacgtctcctaccttctttaataaaaaagaaagaatggagataatctataataattgtagaggtaataagacatttttaacgtgaagtactacacgtgagactgtgatgtatacatcttttgaaatgatacttttacagcacaatataatcatgttgtacatatttcaaaatatgtaaacttaatataatcatctattaaacttatggttgtatgtcttatgacaaaagccggagatgtaatccatttctattatctaaaaatgttgtatatatttcagaacttattcttttaagatacaatatatttcatgactggacatgaatattttttttagataatggaatccattcatcaatcatgcagaacgaacactagtacgtacactactgtaaacacacagttttctgaagtctgaaccttcattgcattactagctcaaacacacgcatggtgttctacagcagcagcatccaaatgagtagtagcatctctactttcaaaagaaatgagtagcatcagagatcagactatcattgtggagtgacttttgttcgaatatatatcgtgggctaagctgttgcttattcctctgaaactgtatgcacttttttcccagctcgagactaaggactacgtagctgtaactgttgcttgtgcagactgccaaacccttgaacaaattctgtcatcctcacgc

SEQ ID NO: 4147 - DNA, 1501 bp, Oryza sativa
catgtcacttgagctttacaacaaaggtaggtgaattatgtaacccccgctagcgacaaaaggcacaattcagcaatcgaccaatcaaaatagcaaggggactcacgttgctaggaagagcaacacgatagtttccttcctgagcttctcctcgtactcctcatcctcagctgcatagtcatcctacatatgtcccacacatatctcagattcctaacaccaaagctcagacaggcgatctagcatacacatacacacaaacacatgcagatcaagatcatcacaattaccagatccacaactttgaacaccgccttctcgtaccgcgccctcgcctcctctgccatcgcctgcagcaaagcaatacaaaccgaatcgaatcgaatcgagtaagtacacgaagattaaaaaggcaaaatcgcgcaaaaaaaagaacaaaggaggggaacttttggatcggaggcggatcggatcgaacagcgaccttagcgaagccctcggcggtgccggtctgcgtgccgaagaagacggtgacgcgcttccggccgtcgtcggcgtcggcgtcggcctcgatcttgaccggcggcgggcgcggcggcggcgcggcggccttgggcggcgcccctccaccggatcggaaccacacggcgaggatgaccaccccggcgacgagcgccgcggccgtggcggcgagggcggcgagcgggtcgccccccgccgcggcggcgagctccggcggcagcacggacgccgcccacgacctcgccgcctccagcgccagcgccatcgccgcgccgcgcgcgagggaagcgagggtttggttggggaggaggcgcacctacccccaacaacaactgctgctgctgccgctgccgctcgctggcctacgctgctggagaggggaggaagacgagttgttgcgggggctaaaagtctcgcctttttctgctgttttttataaagtcgctgtcttttgcaacggaggaggcgagcggcgtgatcttgacgtgctttgcgcttgttgttgcctttctcgcctgattaaaaactttttttttttgccccagcagaagaggagaaagctgcctttgtctgaaccctgcactgggatctcttttcagcatctgctgccgtcctggatgatccatcttgtgatgcaaaaattgctagatgaaaagactttttcgtttttttaaaataattataagcctactaaagaaagttgaaaacatgccattaatatttttgctattgctttcaatttcgtaccaacttaaacaaatatttttttcctgcgatgtgacagctacaagagctttagtacagcgtctatttttttctccgttccgaatataagaggtttttatggaagtaagaaagtatgtagagctgtgatgctctatttgataaatggaagtaagaaagtatctggcgatgcttgacagttgttcgggctatctagcagatctcgataataagaagatgttcattttttttttca

SEQ ID NO: 4148 - DNA, 1501 bp, Oryza sativa
ttgtgcgtgtcacatcgaatatacggacacatatttaaagtattaaacgtagtctaataataaaacaaattacatattctgcatgtaaactgcgagacaaattttttaagtctaattaattcgtcattagcaaatatttactgcagcaccacattattaaatcatggcgcaattagacttaaaagatttgtctcgtaatttacacataatctatataattatttttttttctatatttaatactccgaactaaacacggccttagcttatagggatgttcggtagcaatggttgtctgacagctgcggctgtacaactagtagcacggtagaatatagctcttatggtaattatttaagatacaaataaatgaattaatcaactagtattataaagtttgaaaaggttggtttagaaaagtgtttaaaaaatattgataatgcaagttacaccacaatcgtattgtttagaagcttaaaaggcgtgctcacgatgctctatagtttgttagatcaaaagaattccctaaattattctataaatatgtaagtcaaaatatattactacctccgtttcatattataagactttctagcattgtccatatttatatatatgttaatgaatctagacatatatatatatatatatgtgtgtgtgttttaattaattaacatttatataaatatgaataatgttagaaagtcttacaatatgaaacggaaggagtacgcaggtttgcaagcgtggtacgtgtttacctaaactcttgaaggtttttatattcttcactggtatacgtgtacgacggtgtgtgcgtatgtgtgctccgtgtaaccagggaaaaaaaattaaacttaattttaaaatcataattcagaaatgtggtgaaattctttattgggcaacatgcgtatgatgcagggggtgcacatgcagtcatgcgtcccacgcgctccacaagaaacgaatcgtccttctagatgcaacccaacccaaaaatccagcaacagaaaaggaaaaaaaaaggaattccaaaaagaaaaagaaaagaaagaaaaggaaataaaagaaaagaaaagaaaagaaaagaaaagaaaaagaaaaccgggggcccacccacagtctcacaccaccaacctccccgtaaaaaatccccatcacatcacctccatctcgagcactcgaagttggaactcgagctcatccatggccatcgcgacgacgaccttaccactcgcgccactcgccctcgcgccgccatcctccccgatctcccagtgctcgctcctcctgctgcgcccccgcgccccggccgccctctcgctccgcccctccgcgcgcctcctcgtcgccgtcgcggccagggagcccgagctcggcggatcgggaggcggaggcgcaggcgacggctctgggagcggcggcggcggggacagcgagaagccgcggggtggtgggggcgacgaggagggggaaggggaggaggagaagatggggc

SEQ ID NO: 4149 - DNA, 1501 bp, Oryza sativa
ctaccgtgctactagttgtacagccgcagctgtcagacaaccattgctaccgaacatccctataagctaaggccgtgtttagttcggagtattaaatatagaaaaaaaaataattatatagattatgtgtaaattacgagacaaatcttttaagtctaattgcgccatgatttaataatgtggtgctgcagtaaatatttgctaatgacgaattaattagacttaaaaaatttgtctcgcagtttacatgcagaatatgtaatttgttttattattagactacgtttaatactttaaatatgtgtccgtatattcgatgtgacacgcacaaactttaaatagggcctaagtttcatttacaatactatccccttggaccaaacctttgtaatattcattataacaaacctttggtaatgttcattattggattatgatgcttcacacggctaaacaaaaaagctttcaactttatacatacctagtccaagattgtgactctgaccagtaacaccggcacacttgcaatctttacaaaccggagaaaacgacttgcaatctttacaaaccggagaaaacgaccgtgtttctcacccaacctcaatatcaaaatctctctttttttagtttacttccagtatatacaaaaagcttcaaaatttatagcaacccaaaactgacgaactcgatcgcttcactttccaccaagacttcacctgaccttgccttgccggccagcgtggactcagaaaacagtagccaagtctcggcaaagaggaggaaattgcccaaccaaaacacccacaaagaagaagaggaggagtcgccaagacgtcgtaggcaacacctcccttcccccctacccttgaaccgaggccgagtcgtggtcgccgcgagtggaaggcaacaactctccaaggcaggcacaggcagcagcagcaggaggagaggaggcaggcgcgggcggcgtgagcagcagcggcagcgccgcattacagccttgggagtaggaggaggaggaggcagcggatgatgatccctagggaaggggcggtgccggagcccgcggcggcgtcctgatccccgaccgacgatcgcggctgctgctgttgctattttttcaggttggttttggtgctattcgattcggtttggttattcacgagttcttggatttggggtagtttggatttaggattagtgggtgtagtgcttgctttggttaggtgcggcgtggatctgggaggtcgatttagtatgctctagtttggtatatgtgaattattcagcgcgatttgagaatattgaagctgatttatgaacttgagcatatcatagagaaaggaagggagcgaatttgtggagaaagttgcttctttttcacacttagaatagttttatatacttttaatcaactgattagacttcctgtggtggtggttatagaggatggagaatcctcagattgagatgggggccttcaaggcgaacggtccgcaat

SEQ ID NO: 4150 - DNA, 1501 bp, Oryza sativa
ataacgatgttataacatcagcactctacaccacacaaatgttatggttattttctttattttgatgggttgtcagtacttatatgggatattctggcaatttaggttgaaaatggtacttccctctatccaagaaaatcttatatggaacatttcatagtaaaagaaatcttgacaaagagcatattttagattcatagtatgttgctagtaaatgattaggaaaatctaaacgatctatacaaatagaaattatatcatcttcattataaaatgttataatctaggatgacgagatctattctaaaacaactaatctcaacatagatatgtgcggtcagaaaattacgtactccctgtctcgctccgtttcaaaatataaacatttttaaaatagtgccaagtcaaaatttttaactttaactattaaaaaaataaaaatgataaaacatgtaaaaatgatattgctaagtcaaagtagcatcataatatatataacttttttatttaaaacatcttacttctatagatattgctagtcaaaatggtatctcgaaaactgtgtcgaatttcaaaaatactaataatttttaacggagggagtatagccaactactacctccaaatcatatataatcaatttaatagccaattcatatattagttacctataaatatatactacctattaatatccggtcccacaacttgtgttgcagctggctataaatttatagaccgttgttcatctctcttctttcatattctcgatatatgtttatagctggcttatagtctgctactgtacatactcttaccttaaataaagctataaatgtgtagcctactgtttatctctatctttttttcatcttctctctatatatatttatagctggtttaaagtatgctattgtacgtactcttaccaagtaaacatcaactcggcgtgattgttctagggtgacctatcttcatgagcggccgggcatgcagaaccaagcctatccatccatccagatttgaagcgagcattgcccctgcctgcaatgcaactttgcttccaaggcggtcaaggataccgccggcgccgaccgcaccctgccctccacctgtaaaacgccacctcttcaccgctgccaccacacctctcctctcctctcctctcctactagcggccaagctttcaaagccatggaatagtagtactagtaaaaagcatctctctctctctctctacatacatggcgcctcctcgaaaccctcatataaatataccgcgcctcgttgcctgtgcggcgcccctctctctctctctctacagactacagtgcgtcgtcgtgtcttctctttcctctattttatcaccatccaccgccccattcctgctctcttcatcttcaccttcacctagctgctgctgctgcttcttcttcttctatctgctactagtagctcgcagaaaaatactcgcctcgatcgacaagctctcgttgttacc

SEQ ID NO: 4151 - DNA, 1501 bp, Oryza sativa
cgccaccgcggcctgcggcggcaaggccagctgcttcgtctcgtcggtctgctctagagcagccgccggcaacagcgcgggcaccggcggcgccgccccagccgcgccgctcagctggaagccggcggcgagaaacttgagctccgactcgtacagctcggcggccgtcggcgccgtcgtctggaccggcgggcaagcgccaccgcttgatcccccgttgcagccgccgccgaggaagtcctccagtttcggcggcggagccgccccggctatcgcggccagctcggccgccgcgcccctctcctcctcctccatttcacctgcacaaacacacacacataccaacgcataagcacggcacttactccaaaaaatgaccaagaacacacacacatgtgatcgatgaacagacaacgaagtagaatgagtactaacagtggtgggcgagggagaagttgagccatggatagtggtgcgaggtgtccatgtccatggtaaggtaacaacgagagcttgtcgatcgaggcgagtatttttctgcgagctactagtagcagatagaagaagaagaagcagcagcagcagctaggtgaaggtgaagatgaagagagcaggaatggggcggtggatggtgataaaatagaggaaagagaagacacgacgacgcactgtagtctgtagagagagagagagaggggcgccgcacaggcaacgaggcgcggtatatttatatgagggtttcgaggaggcgccatgtatgtagagagagagagagagatgctttttactagtactactattccatggctttgaaagcttggccgctagtaggagaggagaggagaggagaggtgtggtggcagcggtgaagaggtggcgttttacaggtggagggcagggtgcggtcggcgccggcggtatccttgaccgccttggaagcaaagttgcattgcaggcaggggcaatgctcgcttcaaatctggatggatggataggcttggttctgcatgcccggccgctcatgaagataggtcaccctagaacaatcacgccgagttgatgtttacttggtaagagtacgtacaatagcatactttaaaccagctataaatatatatagagagaagatgaaaaaaagatagagataaacagtaggctacacatttatagctttatttaaggtaagagtatgtacagtagcagactataagccagctataaacatatatcgagaatatgaaagaagagagatgaacaacggtctataaatttatagccagctgcaacacaagttgtgggaccggatattaataggtagtatatatttataggtaactaatatatgaattggctattaaattgattatatatgatttggaggtagtagttggctatactccctccgttaaaaattattagtatttttgaaattcgacacagttttcgagataccattttgactagcaatatctatagaagtaagatgttttaaataaaaaag

SEQ ID NO: 4152 - DNA, 1501 bp, Oryza sativa
cgaccccgccgccgccgtcacacatcgaccccgccgctgttgtcgcgcatccagccgcccaccgccgccgtcgctcatccaggcgccaccgccgtccccctcgagcctgccgtcacgctgctgctctcctgaggagtttttttctctcgtgaaacaaacaaaaggacagaaataccctcccgcccatggtaccgcttcaatggggaggtgcagtaccatgaggtacggatgatttctgaccgttgaatgatgccagatcaacagttagaatttggtactgcacaacctaaagaacagtaaaaaaacctcgcagtataagctcaaaaacgggtcaatgccgggcatttacaatgactgaaaacgattgcaaaattgactcgagtagttttgtatgaaacgattcgaataattctgattcagattggtgacactaactacttttgaagtggttgccaagcgtagaaagattggcgccgtgctcgtacttgaattattatatgcttttggaactttgttgctttgattatgtgatgtagcgaatgcccgaaaaggataacgctacctagatgcttcgctgctatgagtcatatatagcacccatatatgtttgaaggttcagtattcagaagtcctatatactacaaacgttcaggattattcagagatgttctatactacaaaagggggaaatttgatggaaacagtgaaataaaatactagctgatcagaattataactgaattcaattttgaaaaatataaattcatggcatggattgattggagccgagaatgagaaaggatgacacgttcgttcacctgaactctgaaatctgaagcctgatcaaaacctgaagtagtctcttctcaatattcagaaaaaaaagagctgcatttttttttatggctgatgtagcgatcggccgcatcaaaatctgaggctaaaagccaccgggatatgctgcgtccacggagacgacagatgcatcctccgcatacacttcagatttgctatgatcactgacactgacacgaacgaacactcgttcttgcgtgctgcaccactcggtcgcagatgcttctcgcgcgccgcgagctgaatttttcttttgttggctagctcacctgcagccaacgccactcgctcgccgcgatcgatctatccacgtactgatcaccagcggttaaaacccccaaacacatcagcagcagcctccgtcatctccacgcagagattgatcaaactcgtcagttaatcaccagttggaacaagatcgcatcagagtttccggaaaactgttggtataatttgatgggggcgctggcggcgtcgatcgcgtcgcacctgccgtcgggggtgtcggcggcggtggcggcgctggcggcgagcccgggggaggtggtgaggagggcggcggggctggaggacgagctccgggagcttctccggctgaacggcggcgggcgcgggcggggcggcgcggcggcggagcaggggcagg

SEQ ID NO: 4153 - DNA, 1501 bp, Oryza sativa
gatgttggtagaagcaaaacactccgacagaacctcaagaggtatatacctttagtttctggcaccttgaaatatacaaatagttagctagtgcacaaacagtagcaaagatcccaaaaacacccgcaagaccaatcgcattcatcaacacaggaaaagtgtatgtgacgatggtatcacaaatccaaaatgctaggctacatattaccaagcatcatggtcggatccatgaacagaatttttttttttgggggggggggggggctcaattatacagtttcttcaacctccaactatttagggacctttagtttatcattcatggtgaaaaaaattgaagagggtgctccgggggtatccatggatcttgtgaatgaggagggactatacggaaaatttcagcacacaaaatatttggaatagggccaaatcccataacaaaaacacattgataaacgattacgcataatgctgaggtgatagcatgtaaatcagtgctcatattcataatattagcaacaagcataatagctagggataatagcagaatgggtatcgtgccaaggagaatatgcctgcatgcatgaagcgagggagaaaaattaccattttgtactttctttaactttttaattaaataatgacaataagtagtactctctccgtttcacaatgtaagtcattttagcatttcccacattcatattgatgttaatgaatgtctagatgggaaatgctagaataacttacattgtgaaacggagaaagtaattataaatattagaatactaaatttcttcctttcgtatctacgaacggcacagcaacaccaatacaaggaatcatcactaaggttgcgatggcacttaaaagtatagatgtagaagaactaattaagatcaaacttcgagaaaaaacctccaacaccaacttgctcaagtatttcaggagtatagtagaggatgccatttatgcctgcaaactgcataaaaaatgatgaggtaagatcatttcataacgggtttgtctttggatattatgcatgatcaacttatttgatgtaacaaaaatgaaaaaaaaagagttatcaatgatggctctcttagagagttgttacaaataattatatctgtgacgggtgcttaaatctaccgtaagagatatattaggatcaagagccatcacagtctcacagatgattgtctatctatgacagctcttcatttgaaacgatttcccacggctcttgcggtgtggacgtgattgccatccacgtgcggcaacctttgttttgtccaacgacagtatttgtttccagaaaaaaagttcattttacatgcctcatatatagacacattttaattcgtattcttcaaccgcaaaatcaaatatagagaattcctcaattgttaaaaccggattcaatctgttcaatattatgccgcgtaatattttcacgtctgcatttataaacatgtatattttcataattccccccaca

SEQ ID NO: 4154 - DNA, 1501 bp, Oryza sativa
ctcgcttcatggtcttgaggctccggcgagaaacgtgagcacacgctcccccatcgacagtggcaatggtggccccatgctcttggaaacctaggtcatcatcgccgtcatcgatgtccttggcgggggccttctgcttggcctcacttcgccgattgccggaaggaaccgccggggacttgccctctcggcgctcctgcctcatctcctcctcccacttcctcgtccgctcagccaaacttttgactgcgcggcagtccgcgaggtcgtgaagggaggtgttatggacggtacaccacttgccagttgggcgctccctgctgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcctccttacgagccactcggtccgcgagctgaaaaagctccgcggtagtctggggctccttggaggcgatcttttcgagcatgcggttgtgccgcacacccccctgaacgcgtagatcaccgcgtgtgcagggatgcatggtatggtgttgcggacttgacagaaccgctgaatgtacgagcgaagtgactcatcatcccttcgctgtactgcgtgtaagtccgcttcttcacctgggcgcggatatgtgccttgaaagttcatggtgaactgttggcacaaatcctcccaggagtggaccgacgcgggtggcaagttcattagccaaccccgcgcctgtcccttcagggccatgggaaagaaattcgccatgaccctgtcatcacccccggcggcctcgatcccggtcgtgtagaccaggagaaactcggcggggttgacgctcccgtcatatttttcggcgatggtgtgtcacgtcctgataaattcatcccgaattaaaaatcatttgctaaaaggaataatagaattaattaaaattcgaaaagaaattggcaaacactaaaatacgtacaagaaaaattcaaatgtggcccggagaatttttgttaaattttccttggtctaaaaggagccctcaaattttagtggaattttcagagcacaaataataattattaagaaaaaaacaaagttaaaatgattttataaaaagaaaaaccctaaaaagtctttttccccccctccccctcttgggccggctcggcccatctccttccctctctctcctcctccccgcggcccactcggcctctccccgcacgcgcgccgctgacgggcgggcccgcccgccaccctcgctgacgggtggggcccacctgtcatccctatcctcccgccgctcccgccgccccgcccgcgccctagcgcggccgccgccgcgaatcccgccgcctcccgcagtccccgc

SEQ ID NO: 4155 - DNA, 880 bp, Oryza sativa
ccccccccccccccggccgcgctgtggaatgaaagcatactgctcgactacctggtgaaatagctcttcaaatctacaagcaaaattacagacatgtgaatcaatgacaaattgtgcattatacttttacaaattgcaatgttttcacttatcatttgtcaaatactcaagaaatgttacacttttatgatgccaaagccttttctttcccctatctatccatttgtgctgaatcgtttcacttcaaaaaaatttgtgttgaatcgggctagttactttgctgccttgcccttgctaactcgttggtgttgctgcctgctcggcttagagctgggctgttgcgcgcaggcgcgcaaccgtgtaggccaggtggcactgcggcactaggagcatgcgagcaccgccgcgccggtctgcagtctgcagaggctcgccgcctagcctggacgccgcgcccacaccgtccacggctacactcaattcgacgcgattggggttttggaatggggaactttcgaccaatggccggcgttgtgggcggcgctgccggggtcgccgggggcggggagcagcggtggtggtgggcacgagtgcggcttcaagaacctgttcatcggggactccggcgtcggcaagagccgccgaccccgctccatcggccggagagagattagggagagagaggatagagagtatccacatgggcccaccattttttacttatttgtgtgtgaaactaacatgtgggtcccacgtattttatttttttccgatctaattgctacataagcaccacgtcaacgatacgttggacaaagacctggtcaaaaggagctatgtaggcgccatctcagccaaaaacgggtacaataccaccgag

SEQ ID NO: 4156 - DNA, 1501 bp, Oryza sativa
tacaattagaggtaacttcctaaaactaacttgcataaaatccctctttggtatttaatttcttttgtggttttcatttaaaaatatattttgttaaattgaggtatttcttgattgaattctatttttgaatattaaactttctttcgactaaaaatcttttattcaaattatttgaaaaccttttataaattatggtccaagaaaacctccaatattgcccttgaacctaaaccaccataattccaatttcattggaattaatccttgaccaaaacctttgatctagacctatctctaattctcctctatccaaatattttataaatccttctatatctattccaatggtcaaatttctatctagtctccaatttaatttctatggctttactccaaccttggcacaagaataatattcttagaataattgctcttgtgctaagaaaatagattttatccttctcatccaaaatccaaatttcctattatcctcaaataattctctaaaatccatgccatatattttggggctaaaatcctatttattttcctcccacattcccaataatatattcaattttaggaatcatactattcatgctaatatatatccctctctcccattttgagtgcatcaaataaattccattatattccacctccaaaaatattgcagtcaaataaattagaagatcttttgaaattcatctccatacataaatctctccaaattcaaatcctctccaaaacctagccatccaaatctcctccaaaattcaaaaacagtttctattcactttgggccgaaatcctttttcttctcccctcagcccatctccctctctaaccgcccaagtcggcctagccagcccagccgagccgccaccctctccactcctctgtgggcgcgcatggcgcatgcgagcgcgtcaccgccaccacatgccatgggcgccgccactgccgcggtttcaccgagctgccgtcgctgtgctgtgctcctcctcctccgccgcccaaccatactgcagccgccacgtacgcgcgccgctattgtcatccaatgggagaacgaagccggtgctgaccccatctcctccacgccaccgtcgtcgtgtaccccttgctctcctcctccgcaaccgacttgatccaccgcttctcaccgcctataaatagccgacgagccctccccttttctccacacaagccgagcctctcgagctctctctctctccccccatgaccgtgttagagtatatggtagttaaagttatattaggatatgattgaattatgtggacttctttcatatctgcaatcctttcttacctcctcctcatatactcctatatatattggtccccgaggctcaatacaacatgtttaaaattcgtagtatctctctccctgcactattcaatatggtatcagagcagacgatctagctccgctcaaaagcttccgccgccgctaccccgggagtagcgatctcccg

SEQ ID NO: 4157 - DNA, 1501 bp, Oryza sativa
agttacctctaattgtatttcctaggttttggaggttattaaaaacataagaatcggcatgacgcaggattagaaaatagttaattttcagatgttacacacgcgcacacgtctctcctactaaattacattacatgtgttgtctctcctactaaattacattacatgtgttttatatgtatgttcattagattatacttaatcaacttacatacataattttcggacttacattgtaaatacatatgtaatttacggacttacactgtattaaatacatgttgactattttttcacgaaaaatatgacggcatatatatgggtggtctctgttttgtttacgggtagtacatatatatgtacattcttctcgatccatatgcattgaatccatttatcagagattagaatgaaggattttaatagatttaatctaatggtcaaaaataacggatccaccaattaagtgaaaatttgttttgcttttttttctcaaaacttgtaggagattttaatagatttaatataatggtccaaaataaagggttcaccaatttaagtgaaaatcaatggttatatgtttgctttttttcttaaaatttgtagaatttgttttaatttattagaatgtcatgtgatggtttgatagcatttgtataaagtttgacggaattttagtatatataatagatatagatagatgtaataatagcccgtgcaaacatgtggtttggcactagtagtattaattcacgtttattgcatatagttccatgcatatagtttctttttcacaagtactcatatatacatgacagcactttctcctgatgtgcacgaatctcggcgcatatcgatccaatggccatgcacataagagtacatgaccttaaggactgattttacttttccaactctatttcactactagaaaacttattttcgacgtcgtaagggttaaattttcgcaggcgggtgtagacccccgtttttataacaggaatcaatcgtgtaaacggtaccatttccctggatcaagtagtttggtacacacgaattcatagctggaatatatagtgcacatacacgagtgtttaatacgaattattacatcataggcccgcccgcaggcatagtcttaaatcatcggaccgagaggtccggaatacatccaaaaacagaaatagataaggcagcggaattcaggcagcggcatgccattgccacaggcaacgactgtactaagacctactggacgccatcgtcttcatctccctcctgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccag

SEQ ID NO: 4158 - DNA, 1501 bp, Oryza sativa
cacataaatggtttctcaaattaatatctgcacttggcctctttgcataccaaactttatatttctctataagtactccagtagtctacaaacttttgttatcttggattaacttattttgtttcgatatgcaagtcatataattaatcttcttgtagcagtgaaatggtccaaccccttcctcttttgatatgggttttcagctgctacttttcttctttttgcaggaattttatttgcaaattaagcactcaattcacttccctcaaattgattcacaaacttacacccgcgcttttaaatctgtgcagttcattcatctatgcaaacataaattatttaatgttataatttactactgttattctctgtcccatgttaaaccaaaaaccatgtctaccattgaagcaattactgtaacaagttcattttgccagctgaatctacccagccacttttgctgtagctccaaccaaaataaggtggctttatggtctctgtgtgccatacaacttttatatattaatttaaatttagttttacatggtctgaacttggccttgcattgcttaagaacttggttgacaacagtctgaaattggcgttgcattatatgccaacctgtgtagtgtaatgtattgtttctattcagaacataaacatgcatattttccctgtgaaccattgattatgtactgagttaattcctgacagccttttgaaacgtggagtgttttttttaggttttgttgttgtttgattgccaaatgtttataatttcagtacaaatttcctgggagcaaaaaattgccaatcacatctcatgttatgtgctcaaaagaaacaaaacaatagatgtctgaacgtgcctctcattttctttatttggagtcttattttctgccgtgctgatgacaaattctttatatatacctctcattttctgtatttggagtcttatcttgtccttgcaatatgtgtgaaaaatagatgtctgaacatctgccagattagtgtttgaacatttcttatattattttctgagcatttgacatattagtttatgacttgttcttatgatgtacgagtatctgaatttagaatctgaacttgggcaagcatctaaatgttgttcaatgttttagtttgctgtgagctaattaatgttatgaatttcttatagctcaagtattggaagtttacaaattcaccggtcgatgtaaggtttttctgggtttagtgtaaacaatatactcatattaccattcaaggttatctgaacgtgaatatgtaatgtatctgaattcagtgtgcggacatactcttgccatgtttcttaagtcagtgtatgaatatgctcttgcaagcactatttttccctgtatttttattgttaaaatatatattataaaaacgtgctatgcacgtgcactattactagttagagaagacgaccacaatccgtggcgacgacgttgtcgccgccggcgccgatgcggca

SEQ ID NO: 4159 - DNA, 1501 bp, Oryza sativa
atccatattacttcagagatcaccatctgactctgattcctgatcatgtggttcatcttcctcttcatcttcgtgttggtgttcgtcatcagaaacagcttcatcatcgcggtccccaaactccccgtctttgttctcccggagcatctgagcgaactctctcccgcaattctcccagacgagagctcggttctcctcctgccgatcgaagtagccgtcgtccacctcgacgaacccgttggcctcgaactcggcgcgcacccgcgccgccatctcgcagaacctggcccagctcgccttcctcctctcgacgaacccccgctgcagcgccagcaggtcgtcgaaccacccgctccgcaccagctcgtggtcgtcggtgtagagctccctgcgcgccgcggccttgtcggcctcgtcgaacgacggctccctccggtgaaggatccagctgatgtgctcctgcggcatccggagctgcttcgacctcgccgccgccgctgccatggtttcgaattcgattcaccaagttgggagaagcgtcggcgatttatagcgggccgtgtatgtgtcctagtaagagtaggaatcggagaggcagaaattggctccaaattcgttcacggtttggccgaattccagcaccggattcggaatctgtggtggaaaaacacgagcaaaggcacatttctcaaacacatacgtaccaaccaacaacaaaagcggcggcgctggggggtcgcgccggcgagctccgccgacgggaaggcaggggaaagaggggcgaaacggagagagcggcacggggaacccatttcctccactcgatttgggagatgtgcaatggcgccgacggatttcgcgattttgaaacgcgcggggggacgaaaccctagaaatttgataggtgttcaccgagggacgcgaccgtctactcgatcggtgagtaataacacccttttccacctttgcattgctgaattcttaactggtgatgacgtttactgggatgtaaagaaacacagtgcttaataaaatgttgagatagccatttctcattatttaatcttgcaattaatgcaactaaatgtattgacaacagcctaatagcatcgggcattcaacgtcaaaattatacacaattacatccagacagacattagtgatgtgatattggcatgactccacccataactataagagttcaaatcctgatgcccagaaatattacccatatacatatatgctttcaatagaattttaataagaccatggatacatcgtttgtttccgtttattaaagtgtgtgcgagtgtagtgttaagtgtatagtagtgtatgcgcgtgtctacggtgaatctcacactacatgggggaatgaagagcatgcagttcaataaaaaaaaagacggggggggggggggtttcaagggttcgattcctggcctcctaccatcaaataattgcttttatggtgttcctctcccttagcctttgcttacgt

SEQ ID NO: 4160 - DNA, 1501 bp, Oryza sativa
actgtcgtacgccatgctagtgtgctttcttcctgtacgccggtgtggccgtggctgcgtgggcgtgggtgctcctcgtgtgcatgtgtacgcccgtctgcgggagacgagggtttctgaaccaggagacgcacgacgcggaggtgctccggcgaggccttgatgaggcggtgaaaggggttcggcgaataaaactcctaacgcccttggatctacgcgaccagtgatgagctgagcacaaaatgcgaggggaaaccggctcatgttgaaccgtcgcagggcgaggccacgatggagacggtggcacgggcagaggcatggctgtggtgttcttactgagtaaaacgtacgggcagaggcattgacgccatcgttctcgtttgtgtgggtcgagaagagcgttgttctggacgccagtaccgcggcgtgcgtcgtcgtcgtcggcgcgtggcggttcgtcgtagcgttccttgtcagggtgtgcgatcttgcacgttgcgcggctgcgtgctcatgggatcatggcgcgagcctgcctgagcatggtcgcgaatccggctgtcatgggcgtgcgcggcttgacgtggcgtggcgagaatcaggttcacatcactcgctgacaggatcaccatgacggcagcagccagcagggttggtgcttcttcctgtatgccggcgcgtgtcggtggccgcgcgcgtgggtggctcctcgcgtaccagcgcccgccggagatgagggttccgatcgaagcagggaacgcacgatgcgtctctcggaacccactgcgtccattgatctgccacggcccagatgagcacagtgtgcgattgcagaaaccggctcatacttatattgtatgagtgctatcaatttttttttagaatttttcatagtaattgtttggatggctttaaacaaacgagcgacattctctcgagggatcaaaattgtttcctccatttgcagcttcttcttttaatcatgtatattccctaaatagaggaacggccaatatactaatcggcagtgagaaggatgaaatgagcagaggcaaatcttgggtcgcatatagtcatccatgtgaatgttgttactaccagttagctgcaattcttgattggttgctactatgcttactgtggcgttcgtccgtcgtcgcggcgtgcgttcctcgtcgatctggccgtctggtttatttgggcggttgggctgtgccacggcgagctgcaccacggcgatcatgccgctgcgacgtactgcgtgcgcgctcagggcgcgaaccgggctgtcgcgcgcgcgcgcgcgtggcgccgcggcgtgtatcgctcgctgacgggattgccatgctagagtgcctctttcggtacgccggcttgggtttcctgctcgatcctcgtgttaaatcattgtcataattaatatttatgatgaacaattggctgtgcaaatgattttatcaaagaattggtttgagagatgtgtggatgttggtgtgagtgc

SEQ ID NO: 4161 - DNA, 1501 bp, Oryza sativa
tttttttttatgcgctatgatcaatcagatgagaaatcttccacaaaatcggaaagctaaatgacggatggaaaaaaaccggaaaccatacttattatatttttataatggtagagattattttctcccatattagaaaaaaataaccttttggcaccattttaaatttgtgaaatggctcttctattattgtgatattgtgaaatggctttttctagttgtttgttggattattttaacatagtaccgttggatgtgattttgtacaatttgataaactgaaaaagctttcactttgtctgcctatgcggtgaagtatgtttgatttaattcatatgcacgtacacgattattagtagaaaattaagcatgcggttatatttttgaaaaataagtacgaggtatacctcttgggaatattttctctactaatatttattatacctcttgcaaaatttctctgcttatttattttattatgcagtgtaattaaagggcttctctttctatatatgtgttttcacacatctgttgtttactatttctatttctacatttttcaaatcacgcgttttaaagcttgccccttagaattgtgagaaattgcgtgagtaacgtggcactcgtaaatattaaaaaaataatctagatcttaattaaaaaacatccaggtaatttcattagataaaatcaaagaaagattaagatttggtgtttccgaaaactgttttagattagattaagatacattgacggtccttcaacttgagcgaagatgccacttaggtcaataaacttaaaaattaataaaattatatattaaggtccatgatcttattttaataaaatatagccggtccaagcgcatttgaccggagctgaccgctaacatggtgctctacttaggcagcattttgcatccgcccccttcacatcttgacatatatggtggtaattttatacttaaccccatgttgctacagtagtcgctgaaatcccccgcccctcccctccccccccccaaaaaaaaaatcccttcatccctttgcattccaaacaacagctagggttgcgatgacaacggcggtatccggaggcggcgaggtaatggcggttggggcgccgattcatcttctccactgaaggcgaggaaggcgcattatgcatcgcctatcaagcgctgctagtcgcgcatccaaattgacacctcaatcaattcgcaccaccgatgatcgtcggcatcgtcctcgccctactcaggcctctccctcgaaagcgtctgggggatgcaaagggacgcaggggtttgggatattttgatggatttcgatgactactgtagcaacaagggataagtaaaaactattgcctacatggagtaccacatagccgttcagctctagtcaaacgtcatttggactagctatggttcattaaaacaagattatgaattttaacgtgaaaatttcaagtttacggacctatataacacctccgctta

SEQ ID NO: 4162 - DNA, 1501 bp, Oryza sativa
cggggtaccccgtcgcacccctcggtcccgacgggttgcgccacctcgagacccccgctcagctgccactcggcggctaagtgggtggaggagggggcgccgctggcgtatttatgaacggcgtcccaaccacgcacgcgcatcggcgtggctggtcgtgcgacgccgcccaagtgattgacgtgcgtcaatcacttggaccggtctgtgaccggtggcagatggataggacgggtggcagcgcacccacgccccgccctatgtcaggcggcgtgagggcaggtttgccccgtcccatcagccattagggctcagcacgtacggccggtgcattcccagtagcatgtgcctacaaaagtcttcaaggtttaatgagggaatgacaggggatgtcccccgtgtcagatgggagacggtgctgggacccacctcggagcaagcagccatattgcttccggtctaaggcataagcgggagtagaacccgaggaagagggaccccctccaggaaagatgagacgaatagaggcggtgcatgtggtatccccttgaactataaaaggaagaccttacccaccaagcaaggggacaacttttgatagcctgaactctaagggaagtacagttaggttttcccaggagcccaagatctcttgtaagaacttaagcatagttccacacacagaagtagggtattacgcttccgagcggcccgaacctgtataatctctggtctcactcccggtcactctcgaccaccttggtcaaatcttcggctaaggttggctcttaatcactcgcgccctatcgcctggtcgaactcacaaaggggggtggtctcatgtcctcccgctagagagggttactcctcgacagctggcgcgccaggtagggggaaacccgcgcgtttgtgaaggagccgcttttcttccgccccaagtttccctccatcctcaacgaccatggttgaggtagtggaggaagaggtggtggcgtatactccctcaccttccggaagtgaggacggtagcgggagtcgcgaccctcgccaccaccgctggaactctccgacccctcctcgtcgatgtcccggacggcaggaggaccccaccggttcggaggattagccctttccccgctggcggacaggggcaggttacgccgcgccggggtgcgacgccgcctcaactacaatgatggcggcacaccccacggcacactctaggctgtgggggctctcctgcggcacccttcggtcgttctagagccggaaaccctagtccggcggtggctggatgacgtgacccacttggtcaccaccgccccgcgacagctggccgccgacgccggcgaccggcccgcgaccactggtacttcgcgtaccacctacaaccctctcctcatcggccaggaggagggcccgtcgttccgccatgatctcacggtggttgacggtcccgacgtcatcgaggcccacggagagccacgggcgtcacgacagt

SEQ ID NO: 4163 - DNA, 1501 bp, Oryza sativa
cttcatacgcgaatccaccaaaaacacaggagtagggtattacgcttctcagcggcccgaacctgtatacatcgccggcgtctagtgtgcttccggtctggcgaatcttccacagattgggagcttagagtctcacccagggtccccggccgaaccggcaaaggggggccagcgcggtctcccggtgaggagccccacgctccgtcaaaatacatctcatagtaaaaccagataaccaaagcaagtcataaatcaaaagttcaaaattaaaaaaaagaaatattggtagctagccacgcaatctacgtaggccaccatgctagttaacttaataaagtaacagaaaaaggagtctccacatttgctctcatggtctagaaattctcacattaatcaaaagaaaataagagaaatagaaaaatcgaaggagattaggattaggtagaaacgaaaaaaagaaataaaacatctcacgacacgggaaacagacaatgtctttgaaataagtgtgaactggaatactcctataaaccaaatgtaatcaataagtactcgtcatgccaataaatacatctcatagcaaaacacgagataaccaaagcaagtcataaatcaaaagttcaaaattaaaaaaaatatattggtagctagccgtgcaatctgcgcaggccaccatactagttaacaacataatagatatatataccatgccaataatagattcggacaagtacaagttgcatagaaaccgtcaagcagcttcctcctcccagatatcaaatatacatacaaatgtcatgtcaatgcagtgaatctggttcctgtgtttctgactttcaggtgcaactactgcttgacgtttgtggccacccatcagcttacatgttctagctaagatgatcgagacatcaacgaaacagaagtcggcgaaacgtgagaactcatgagctgaacgaatcttctcttgaatgatcaatcagcagtcaaatgctaaataagtaggagtatcaaggaaactgcatccagatcagtggagtagtttggatggaatcctcttcttcgagatgaattaatgcattgaatcttttgtttgctgatgtcatcaactgaatctgaaagctctgccagccagtcgatcacctttgaattaatctttcttcacacaattgacctgaaacttcagtcaataaaaactgtatttcctcgtaggaaattaagcatcactgttgtgtgatggaggtcagcagttctgaatattcggtgcagtgcaacgaagctgatcaaccacacatgccatgaatatatagtcaagctttcaacgagctagctacgacctggcttgctctcagatcgatcgacaaacttgaatttgtaaggttttgggtggcgttccgcggatcggaaccaccaacctattttggaatccaaccgtctctacttgcgtaaattcaaagaggatctcgttgattttggttggacgtatgtgtacattcaatttacc

SEQ ID NO: 4164 - DNA, 710 bp, Oryza sativa
aatatttgtagaagttgagaactctgtttttagagggaaacaaatataaaaagagtacgcccagtatttgtgggccaaaactaggtgatagccggcccagcccatcctggcccattaatttattgccttgtccagttctcctcccttctccagttgttcttgttcccttctccttttgctcggaaaatttccttctcattttctcttcatgtccgatttttttcgcggcctctcgattgccacaactccggcgagcgagccggccgcctggcgcgacctccttggctgtgtcaccggaggggcaatgtgtcgctctggaggaggaggggcggtcggggcagcagcaccttgtccatgggggtggcatccccggacatggcgaaccgcgtgcgctgaaccggcgtacggcggcggcgcgacgcatttggggccacgcccgaggtccttctgttctttcttagccagatctttctactgctgtaattctacatttctattttgggggtttgatttaattttcatgttggaaaactatgaaaaactggcataaataaataatctagtttagtttagttttcgataatgaaacattctgtacaatttgtgagttacttcgtatgctcgctaatatgaatattgataaaatttgtttcgcaattttattttgtaccaaattcaatattttgatactaaaaggttatcttattagg

SEQ ID NO: 4165 - DNA, 1501 bp, Oryza sativa
cttcttgcacccaacagcccaggaattatccaatctaaaaaccattatggaacactttggcatagcaactagtctcaagaacaatgcgcacaaaactcaaattctctcaattgcttgtgaaaacattgatgtgcaacagttgttgctggatttcctaggagctgttcaaggcttcccaaccagttacttagcctacctcttcaccttagaaaactatggaaggtagatttctgtcacgcccagaaattcactagtaatttccgaactaagttgtgcatagaatcctcgtccaggaatcagccgaggtacacaaactgacaatttaatatacaaatccatcataataataacgttacatacttacaaaccaaaagaaaaacagcagccgaataacggtctagcgattgcttcagctccactcccataggcagctcaattggggtataagccaaacgtcttctccttctggatcctttttcttcaactgaggttgattgattattgcaaggtgagcatatgacatactccgcaagccacacagcaaatatgcaagtgcacaaggataccaaagaatggcgtaatataggctcatttgcaaaagcagcatttaacaagcatttgagaattgaaaaacagtagagtaattaatcaatgttattcaacactgaacaacacacccatgctgctcaggcccaaccatcctgaacaaccatacccggctgtacagatctaactccaaaccaggagttaagtaaattattaccagttatagcatcaataattattgtgagaggtgtgagactaatcacgaaaaacattgctcaacttgtccatgaccgcgggcacggctattcgaatagttttactctggcctgaggtgtaccactgtacccacaagacacagctccacgacatgtcaccatgcgcctcaataccaccacgatacctcggaaaggaactgtgacaatacccctcgcacaacacaactcaccacagtgcaccattcctgcatcataatcaccccctctataaatataaccagaggcatggactccccagcgacccccatgaacttctcgccgcttctcagtctagcaccccgtaatgaaccatgctatacaaaaggtaaagccgttgcccacgctggcttgtggttggtacggttaatgtctcacaacagtagctcgcgaaccggtccttaattgtcatgagcacgacctacaaaaccatgtgctcacaacccaccattgacaagttttaattatcaattaattatcataacacgattaactatcgtgagataccattaaatataatcataaataataatgtagtatgattcatcccattaatgagctaatgtttctaagcatggctaagcaattatatatatatatatatatatatatatatatatatatatatatagcatttagctgaaccaaactaatatataaggttcaagctaatcaatttattacccgaggtatcaaggaataga

SEQ ID NO: 4166 - DNA, 1501 bp, Oryza sativa
ggtaaaacaaatattatccacaagttacgtttttttcccacaacctatcctaacatttttcatgccaattgggattgtattggtgcaataaatggaacccatcttctatgtcagcagcgtttaggggtagaaagtgtgttactacccataatgtaatggctgcggtggattttgatcttaaatttacatatgtacttgttggctgggaagggtctgcacatgatgccctcatacttgcatatgccttagagagatgatggccttagtgtcaataatttagagtgtcaataatttagatcttcaggattttttttttgtcatctggtaatgattgagcacattttatcacatgttaggcctcactactgggaacccatttttactactggttcggcaaccccttttagtctcggttgtacaaccaggacgcacaatccggaactaaagatggtaattttaggcccggttatttcagtcaggattaaaaatcgatctataccaaccgatactaaagatggtagcgactagtggctagtgctaccatttttagtactggttggatctatttgcttttttttaatgttttttttgttgcttgctgcttttttatacatatgcatatatggtgcttgctgcccatatggtgcttgccttcaggcttagccaatggctctgtttacaaacgtggcccttctgctcacatggcaattagcaaggcacaactaatttgcttggatagagtagaaaactcttagggcatgtataacggtctttattagtggtctctctctattgatgcaagtaaatttaatgacatggaagaaagagaaaggagtatggttgttatgcatgacaacggctcagagtcgactcttagaatttattagagcaaatttcgttgtatggtggtgaaagaaaggaaagaagagcaagaaaaagtattttaatacattaatgattagagaccatattgtctctaactgttataggatgctagtctctaaataacgtagagctcgtaactaactctacctttgtgcatgaccttatgtcacaactgtttcatgtattatgtgttcccttgtgtaccttctgtttaccattatttatggtacttccgagcgcagatttttcgatatcctgtgacagtttaaatgctgcctgtaagtgaatatgatatgtcatcgtccttagccgcgaaagtaagaatctgtagttcttgtttgagaagtttggtagcctaagttttagtccctggcagtttaaggagtcccccgcgtcgccccccgcgtcgggcgactcgggcggcgcaacccttgccgccgccgccgcccttccccgccccttcctctgccttgccgccgcctgagcgagcggccagcaaagccggcggctcccaaggacggcggcggcggggctcacggcggccatctcccgagctcctggcgcgggcggacgcagaggcggtggccgaccggagcggcgccggcgtcgaggtgca

SEQ ID NO: 4167 - DNA, 1501 bp, Oryza sativa
gcggcgccggcgtcgaggtgcatggtggcagatccagcgtcgccaccactagatctggcgcacccgcagctagatccggtcgcggaggcgccggcacggcgtcggcgaggcgtgggcgcaggcggccacgacaggcggtggcaggcgtgccggcggcgcaaaaggcgcgggcggtcgggcggcagcgtcaggcgcggacagccgcgttagtcggcggcaggcgcgacggcggcgcaggcgcgggcggccgcagcaggctcggaggcgcggctgctttggccggcggctcgatgcctggcggcgacggcagtggtgcccccagatccgtgcctctcggccggatctggagggtgggagcagtcggcgacgatagcgacggtgtggcgacggcggcggcggcagttggcgacggcggtctcggccggatctggacgccggcggtagttggcgatgacggcggcggtgtggtgatgacggtggcggcggcagtgggccggtgacagttggcgacggtggtggcggtcgcggctgtggtggctgccgtgtcatctggcgatggcggcggaagacatggcgtcgggctgctagctgctcggtggtggagggtgacagcacagcggcgatttgcggaggcggtggttggcgtcggtggcagcggcgacggcggctgtgactctggaggcggtggcgacgtcggcggtggggaaggagtcaggggcgaggtggctgggtgttcggcaaccaaggctgtggtggtggtgaccgtgtatacggtcaccggaggcatggcggtctcggttgactagccaagggcgtgggagacggctgcagctggccggcgcggcatcgttcggtggaggggtcggaaaccggcttggcacaaagaagcgcagccgatggcagcagaggccggctcggcgcgagatgcgcgagcggcggaaatggaggccggcttggcgcgagaggcgcggccgatggagggaggctggattgacacgagaggcgcggccggtggagaaggccggcttggcgcagagaggcggggccggcggtggaggaggcgacctaggtgtgaggaggagctgccggtgggtgtggcgcggtctttggcgcaagaaggctggccggcgggggacgccggtgaaggggtcccacatgtcagcaaagcttgtggagtggtggagcatcggtgcgccagccgtgcctttgttggtctagtggcggtcggccacgcttagcggcggccgatccggtactagccttctcctgggcttgtgtattggcgatatcgtcgtgtgggtggtggtattttttttcttttcctggttacgattctccagggttgtaatcttttattttttttcctgctctgttaatagaacttcgtaccgtctcgtgcgagtcgttcaaaaaaaaaagtccctggcagtttgatgtctggtccagagatgttcatccattgcagcttcgtgcactgcacgaaacatgaaattgatcgatg

SEQ ID NO: 4168 - DNA, 924 bp, Oryza sativa
atttaacagtttgattcccatactatcagcaaattgaacaaactcatcgggcacgaaaattgaaccctgatcagttgtaatggtttgaggaataccaaatcggtagattatatgctcttgaacaaaccgtatcgcatccccagaatcaaccttattcaaatgaatcgcctctacccatttggtgaaataatcagtcgccaccaatataaacttatgtcctttactcgatggtggattaatcatgtcgatcatatcaattccccaacctctgaatggccatggtttaatgaaaggattcatagccgacgctggtgctcgctgaattgctccaaatttctgagaatcttgacatcctttgtaatacctgaaacaatcttccagcattgtcggccaaaaataccctgcacgccgaagcaaccacttcattttatgagccgattgatgagtaccacaaatcccttcatgaacttcgccgatcgcaactttagcctgatcggcactcaaacacttaagcaacattccatcaatcgtccgataatagagctcatcatccaataaagtatacttcaacgctttatatctcaatttccgagaagccgactgagatgtattttgtaaatattgatgtacatcatacctccaatcatcggctgttaatgcagcaaccttaaccctgatatctttgatcatcggcttataccccgatgccccttgggccaaatcattagcttcaatattttgttctcgagatacatgcctcagagttactagccgaaactccttcatcaactctcagtacttctcattataaaccattaatgtatcattcttgcactcatattctcgtgtcaattgactgatcactagcaaagaatcccccataatttcaatagcatcggcttcaacttccttgaataactgcaa

SEQ ID NO: 4169 - DNA, 1501 bp, Oryza sativa
gcgaccggcttcttcgtcgccttcgcctttaccaactccccggccggtacggaaccctccaggcgctccgcccccagcgcgtcccctcctcggccggggagctcgtcggctggagcggatgaggagggaatcgcagaggcggtccggcggcgggtcgtagccatcgcggcgagggtttcgtcgccaaaagcaaagtggggtggtgaccagtctttgactaaagtcacccttcgtttccggaggagaagcacagcagttgaattattaaattaaacgccctttgggcttccggcttcccccatctagcgagggccgtcacgtcagatacttatttttataagtaaattaaatggacagaatacaatttattacgttggtgtaatttagtgtggtaatagagactataatctagctataaacatgtttcgatgaaataaaagagaagagagaagagcaactggctacagctacaacacaaactctaagatgtatttgtgtatgtcagatgggataagatattaattgtgtagtatatatttataggtaattattgtatgaattgattattaaattgactatagataatttggagccaacggttagctatactattaaacttgctctgaaacgctagttttagtgcatgaatttatctaaagcgtcccaaccacgaaaataaaaatactacatggggctaatcttattaatttaagtgttgactacgatacaattattagatcttatactcattaacttatccttagcacatacatgatcacctaaacttatgcgggaattgactgaccggttgagcttgaagccatcttagtcgcggtaggagtcgtcggtgatgtcgaggtcgtggtagcaagttgccggaggtgaagcagatggcgtcgcccttcaggccgccacctgcactggccgggaacggcgttggagaacgcctttcggtctccttccagcacttcttaggatcggcgttagggtttatcgggagggtttagtgtacttagatcgtcacctaagcacagacggcctctcccttttaatatagcgctagaggagatcgggggagaatccgttatggagaacgatgcgcatccgatcggcgcacgtagtggatgagatgcgagcgtatcgctcgctcctcgccgttagccgcgtgtgggcgtgggtgtgggtgggcctagaccacgacgtgtctctctggtctcgttaccaggagatcaaccaacattctcccacttgatcttctcccacttgatcttaatgctaacgagtccagtctaagtagaatagcgaaccaaagcaatgtgtcatagtaatcaataaaatgtcactatgacaacagtacctatagccactataataccttgataggaatcaacttaatcttattgggtgttgattgattcttatgcctctattctagaatcttgcttataggtcacctactaatcccatgccggcaatatgctcgttaaataagttgggtggt

SEQ ID NO: 4170 - DNA, 1501 bp, Oryza sativa
tatgttttaatctagactgttatattatgaatatgatcggagtacatcccatctcaacattgtaaataatgtttattttctcccactgttatgataatttcaagctcttgattgttcgcacagtaacttaatcaattatataagacaaggacatatagcaacacaattacagctaaaaatgggcggagcttagatgttaacaccaacctgtctacccggattgaagtcccatatttagtggtaggcgatattgatatcaacagtgagctgtctgcggtgactttatcaatctcaggatatgtaggatgtacgtgcgtatatattcataggagtgagtgtgtacgtgtgtatatgagcgtttgtgtatagtatgttttagaaaaatgggccaacggccggttttccaggtagtgatatttaacgtttcaatgcaaaatcatgtaaaacataggtttgcaaaagaaaaccgaggataattaaatagtacagaatagtttgcaaaagaaaatcatggcattaattaaataatagagaatagccaattttacatccatcaacctttcataaagtctaaaatcctctcttactatatagatataacccactgactctaaaagcataacatgcaaagatgtcacattatcatccactaaaaagatgttatatcatcatccactaacaatcattaaatttaaacatcatgtaaacatgctataatatctataattttataatttattaaattttagagcttttagaatgcaagcatgttaaatcatcatcccacatgatccatataatattttaatatatatcttcgttatttttacatgatatactgtgtacctctatagttcatcctcacttagttaatgatatttttctcttctctaattaagccatatcacatcaattatttttagtacttaaatgattaatctatggtcccaattatctctctacttttcttctcccattaatttatattacctcaattatttttagcctttagatgattaatctaggtccaaactatctcaatacttttctactttcataaagtcatatcaccttaattagttttacatttgaatcatcattctatatactagttaaatttaaattatcaccgcgccaccgccgctccaccactatgagccgacgccgcctggccgcggcgccacgcaggatggccgcgcgccgccgctattaacgaccaaaattggtaaatcatagattggatccaaagtaagaactgaaacggatttgaagaagatctgtagccttagaaacagaacccgcatcggctaagagttgtatcagctaccgtctgcatcggctattacccgatcggacggggaggagccgatacagccgatcccggcaaagcagtcatgggatcgttaccgaggatggttcaaactctacgcaagtattgcaaagcatggattgaatccagaaagggcaattgtatctattcattaggggcaattgtatctat

SEQ ID NO: 4171 - DNA, 1501 bp, Oryza sativa
ggtaaagtaaggtgctatctataaaacatgtacatctcagcaatagattagattaatagtaaaccacttcaatggtatgtctacatgggtatctatagttctctaatctattgccacgtttttctctatagactatctccaggttagtagatagttttgctctctctttttatttaatctattctaagtaggaaaatattctgacatggatcttttgtaaaaagcctataaataaccattatggctgctctaagtgatatctcgatcgggggtagctgggtaccaactccaatccaagttaaaggccaaagctgatggcctacgtacgacccagcagctatattgccaatcgcttctatatgtcctgacatgcacatatacctacagaagcttctgaatcacgcgtgcatgtagaatataataattttcagtaattcactatatccagtcttcaggtgccttgtcgcactattaaaaagtgaattttttttcaaacttccaggctcatttctataggctggtcataagaaaatctgctggtaataatgatgaggatgtcctataatttaaattaaaaccgcttgtgaaaaatctgatcatgcatatattcgtagaatagttcttaccagctagctagtgatgagtactaccactgctctcaaatatttatcatatatatatttagggcatgttcactttgatgccaagcagaatttcttatatagttaccaaaatttggcaacaaactaaatatagccacttttttggcaactttatcaaaatttggtaaggttgaaaatggcatcaaagtgaacaggtccttaaactttgatcgatcacactccggcctacaattttagtaatgaatttgtaaatatttaaaaatatacagtgttatataaatatgtcgcacgttaaaatatgcatatccgtacagctttggtttatagacgatatctgataatttaaagttttaatatgatcaagattttaatagtagcgcaatcaatataaatgttgatgataaatattttctttcgagaaaatgataataaggagtgtactatttgggaatggataggaacaaaatcaattacgagcgcacaaggaaaataaaagaagttttctcaccaactggggtgtgtgatggcccttccatcaaatgggccctaccatattttttttttccttttccaaccgtcttgaaccactctcgctctcggtctgtgtctctcttgccatattcgtgttgttttcctctataaatacagccacggtgcgtgcctcgtctccttgcatccgctgcacccaccactcaaaaacctgcagcttgctccctagcttagctagcagacgacgacacaggtgtacctagcaaactagctagcaactgtacacgcgtagctgtcgtcgtccctgcagggggcgtgataacatatatcacagggaaattaaattaactagctcgaagaaattcagggaggagatcgactgatcgaga

SEQ ID NO: 4172 - DNA, 1501 bp, Oryza sativa
aacgcgattcaatttccataactacatgattacgcgcattgatcggtagcgctaaatccttccataatttggattgccctcgatctcccttagcgctatactaataggagaggccggtgtcgtggttaggtgacgatctctccacgaccttcttctccccgaaaatcccaaaaccctatccgatcaactaagcgctggagggagaacgtgtggtggttccgggacagtgtaggtggcgaccggaaggccgtcgctaccccgcaagtgatcgccggcaacccctttgggatcaagccggcgtacctactgctaccactacttcgtctacaccgacaaggacaaggaccgcatcaatggcttcaaacaacggtcagtaatctaagaattccgcattagggtgatcatgttaggcttatcactcatgtcagtagatcgcataatctacatttggtatcagagccactgctatagcctaatgatcccatcattccgtttagaagccataaaatgcatctaagccctcgttctcatgtcggttttgatgcaatcacattctggttcatgttgattaatcatgttttattcggattaagtttcgattaagcgctgctcaaggctcgccgccatggccccggctgcgcgcggaggagaaccggggacggtgggcaccggcacggcatcagaccgtgcggcatcagcctgccacacggggcgccgccggccgcagccctctccgctgcgcgttgtcaccgcgccgctccgccacctatcgcctgcgccgcccccttgtgcgcaccgccgcatcacgcgccgttgcggcgccgcctcgcgcgcgcgccgccgccgcaaaatcgccgccgccgccgccgcatattgacgagaaagaaggggatcggggaaatgaagtaaagtagggttagggttagaaccggcatgttttatgttttttttttctcaccgattcgagttaaatctaagctgtccattagatcggacagatcggatcgttcctgcatcgggctggcaccgttagcaggccgccaagccccttgggccgccgcaatggaccgcgccacactacacgtgcattatgggccgcacatgttctttaagcaggccgacttattaatgggctgcgctattagattttagcctttttcacttatttatttttagaaattgcattagtaccatttatatcgcttaaaattgctgaaaaattatgaaaaattttatggaggcttattaatttaattctagctaaatggaaccaacgagaaatttggctagatatttgtttttcatgatgtgaatttattttctgaccaacgttgattataaattcacataaatttattcataattatgtttcccaaaattatttctgcccaacggtgatgtaattaggggaatttatttctgtttaattatgtaactaattgagccaacacaaattaattgcatatatgtacttatgtatatttttttcttcatgattttt

SEQ ID NO: 4173 - DNA, 1501 bp, Oryza sativa
aaggtaacaggtcaaaagcaagcaaattggtgtcacccagttttgttgccggacatttgatggtgtacgcatcaacgagcaaatgtgaaaaaattatagaaaaattagacatgtatcccaacaatattatacatatatgcaaatttgaagataagattttacacataagtgtaatattattggaagtatgtgtccatgcttttatggaattttctgtgatatttgctagatgatgtacacggagtatgcatgaaaattttgtgcgcataggatatattcccgtactttcatagcatcttttttattttatttttgttcttttctcttttgttgctgggctgctgtgacattgtgcagatactgtttgcagaggacagatttgtaaataattactcattatccaaaagaacatgatatttcattaatagtgcttgaattggagtcttggaccaactatatatctaaccttgtcaaaatctttgttcacagtcctcaaaaaatgatctgatggattcctcattggagggcaagggtagccatttgaagcaaagaactgcaaattaaaccaactattgcaagctgaaaacagcgataacatttaactaattaaacgactatatacacagaatgattctacactagatcgactaacctcggcagccattgaagctgggccaaagaagatggtgttcccagcggcgagcaggcaaaggacatggaagagctcgaacacctcgctgcatggctggtgcacgacagcgacgactgtcatgccctccctggcagcgaggcctatgatgcgactcatgacatggaaggaggcggcgctgtcgaggccgctggtgggttcgtcgaggaacagcagccggggacgtgtaaggatgtcaaggcagatgctcaaccgcttttgttgcccaccgctgatgcccttgcttgaccgcccgccgatccgagtgtccagcgtgccggtgagtcccatctccctcaccgtttcatcggcgcgccgcaacttctctgccatagtcatggtgtctggcagctggatctgtgccgagtagtagatggcctcgcgcactgttagtgtcgccattagcacgttctcttgtgtcacgtacgcctgattgattcatgcattcacaatacattcatgtttttagatcagacaccagtttttctcgttctctctcgctggctctatccttaatatttgagctacgttaatgtttgcagttaatgtttgcagtgtcatgattgtaaatccccctaagtctaaagaagttcggtagcatattggattgattatactattacactagctaaatatatatccctgttattaatagtgtaattttttaccatgtgaaatttcacaacatttttattgtagacaaaattgcaatcatcatctatacacggctaaaagatttggctagaatcatatgttaatttatttttatcgtagtgaacatgttcgcttcttctcgactatggggggattaga

SEQ ID NO: 4174 - DNA, 1501 bp, Oryza sativa
tctattgcacacatatcaccaatttactgtgctaatttaacatcaaatatttgatcaatacccttaatattatatagaaactgggtctcaattcaagatctagtttcatcgtttcattcatttaatctgatgccacattatcttttacaataggtggcatgctatttaacactatagacatcagtgttgttgggaacttattgcatgccattggtggcatgctaacattatggacatcaccattgttggagcttaatgcatgcctcgtaatataaagttgatgatacgagatagataaacaatataattgggggatcaaaatagctatatatagaggatagaggaatttctaatttgcttccatacataaatggagagccaaatcacaaataaaataaagtaagaggagagaggaatttcttttttttttcagttttcacacataaaaaagatacattaggaagtcatgataagcacggaaactctaatgggcgatcaatcgccctagctattggctagcgatcgccccattcccccctccctcgctctacctggttttcttttttggcaccgcattactttcctattttagtaaatttatgcacctaaagtttatacacctagggtttatacatctaaagtttagagagcaaaagtttataagtcaaaagtttatatatccgattcaaatttgaatttgaattcaaaaactttttatatatagtatttctatacatctaaaatttatagacctaaagtttatagacccgtttcaaatttgaatttgaattatatctgattcaaatttgaatttgaattcaaatattttctatatatagtatttctatggatctaaagtttatacacctaaagtttatagatccaaagtttataagtcaaaagtttacatacccgattcaaatttgaatttgaatttgaattcaaatttgaatttgaatttaaattcaatttttttatatatagcatttctatccataattttttctaacttttgtttttttaaaaaaattttgtggtgtactgtagtaggaagataagatggggaggagaaaggggagaagagggaggaatcggcataggcggaggggagtgtgggtgatcgctcactcccagcgatcatccgcgcattagcaggaccctgataaacatggtataagtacaatatcaagatctataaagcaaaattaaaagcaaccacaagccaatcttagttgcttgtactaacggataaggtgtccctattttagagggaataccttatatgccatttaaaagatattgagtttctatgtataaaagaaaatatattttccttttatgccaccaaatgaatttttgttactcgtagacgccactattggttgatttttcggatgagcacacaatccgaaccaaataagaagataagagataaggttgttttgtgatcggttaaaagaatttttgattcctaaattcaagataagctcccggcctcacc

SEQ ID NO: 4175 - DNA, 1501 bp, Oryza sativa
cctgcgggtcagtgactcaaggagagagaggggcggctggcaagcgggccccaccgagcggcggctcaagagagagagggaggggcgccggcacgtgggccccactggcagtggcacaaggcgggaggggcgcggctggtggctcggctcggcttcaaagccggcaggccaagcatggcgaatgacggcggcacgcgcggtcgccggcgacggcaaccggcggcgcggacggcgacggcagacggcgcgaaaagcggcggcggcggccgaagacgacgatgcgcgcgcggaggacggcgacgcacacggaagagagggaaagagggaggagggggaatttttcaccgaggttggccggcgcgagtggagacgacggcgaacgacgacgacgagcgacgggaggacgacggcgacgggcgaacgatctccgggacctcctagggaacaaaatgggaaggattagagggagaggggtggtctacggcgggcggaaaccatggccgaaggcggcggcaatggtggtactcaccggcgcgcggggagaagcgggccccgacggcgggattggatggggatgcggcggccggggtagctttggcggcggcgaagctaatggcggcgcagattgactcggcggcggcgagcggcgaccggaggagtggaaaaggcggcggcggcgggtgtagcggtgcgggagtgatggagggcacgggagagagcggcggaaagaggaaaaaggtggaggggagtgcggggaagctttattggggctcgagagagacggacgaggccgggaggcggccggatttctcgccgacgtggggaatggagagagagagagagagagtttcgaatttgaatccctccgttgcggggtgcacgcgcgagtgggaggagtggggatggtgggcggcgacgtgggcgcagggcgcggagtggggcgcggaaggcggggaaggcgggcggcgatgggtggtggtttcggcggcggttggcgcaggcgtgggcggccggaggttagggaaagggctgacaggtgggccccacctgtcagcgcccgagagggagagggaggccgggagaacttcgggagtgggagggaggagcgggccggcgcgggaagaaatgggccgagccgacggcccaagaagagaggaaaaaggaggaaagaaaaagaaaaagaagaaaggattttttttccagggatttaatattgcactttgcttattttaattggttaaaattatttccaatgctctgaaaattccactaaaaatcctgttagcgtattttgacatgtagaacccaagaaaaattccacatgccgattccgattattatttgcatttattaatttagggtttctttcttgcctttaaacaaataatttcttccaaccatttattaattgaatttttgctagggaaaagaacttctgggcgcgacagttttagagttcattttggacacaaagaatgttttattcaatttaatgatgaga

SEQ ID NO: 4176 - DNA, 1501 bp, Oryza sativa
  unsure (1)..(1501): unsure at all n locations
aaataagaaatattggtagctagccgcgtaatctgcgcgggtcaccatgctagttaacaacataatagatatataccaggtcaataatagattcgaacaagaaaaaaggagtctccacgttcactctcatggtctagaaattctaacattaatcaaaagaaaataagagaaatagaaaaatcgaaagagattaggattaggtagaaacgaaaaaaagaaaaaaaaacatctcatgacacgggaaacggacacggtctttgaaataagggtgagctgggatacttctataaaccaaatgtaatcaattagtacttttcatgccaataaatatgtcggtgacatgggatcaggagtatcatgactagaggtttgaggcagacacaatcgcccacgtggcctggcaccatcgggggacgtcgggcccgagggtgatgtgttcgccctcctcttagtccccccgagggggtcgggccggacccgcctcggccccgagggccgaggcgccccgacccctcgtgggttntcgctccgcgtgtatggggtagggancncacnngggctcacctaaccacatttattgcgatttggctgagcgtgtcaagccgcatgtaacgcagtgtagtgcactcatttatccggtctgtgaccagtcacagaccggtcagatcgcgggttaggtggcgacaggcgatttgacgcacgcctcgccccatcctgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtggtggacaagaatgaccgacgtgactggtctgactccggtcatgtcgtcagcagacagtcacgattccacgtcgcatctgctcccggcgaaagtggaggtagttgtgagccgtcccatcagaaggtgactcggacggcaactatacaaatctccgtccatttatgaaaaggtaggggaagtccccacaaaaaaggggaaaatggtgcatgtggtatccccttaagatataaaggaggaccttgcccacttagagaggggggactggacttttccagattaggaacccagaacaagggagaggctgactcatactttgtagcttcttcatacgcgaatccaccaaaaacacaggagtagggtattacgcttctcagcggcccgaacctgtatacatcgccggcgtctagtgtgcttccggtctggcgaatcttccacagattgggagcttagagtctcacccagggtccccggccgaaccggcaaaggggggccagcgcggtctcccggtgaggagccccacgctccgtcatctggcgcgccaggtagggggctctgcgagtgatcttctgagctctcgcactccttcgtgtgcgccaagcttttcctgttcagcccaa

SEQ ID NO: 4177 - DNA, 945 bp, Oryza sativa
agtagcttgttgttggagaatccatctttttaacccatctcttcaaaaactttaaagtcaccaaaattcccctactctggcgtgccactgtcgacgtctgagatcacgactacggtattttgcatagtatggggatttttgatactagggtatatgcgagattgaggtaaaagagatggagatagagatttttatacaagttcgggccccttatctaacaggtaatagccctacatcctgttggccgaagccggtgttgctctttattcatcaggatcacacaagtacaatatttgggataacctatctagctgtcgtcgacttggcggctaaataatcaactcgtagtcgacgacagggtagtcttcctccttgaatccgtactcaacgagatcagagatggcactaaatccctcttgccggcctccgtaggtactggatggggtatgtctatgctaatctctgatgtcgatttttggcggtgtattagtttgtattggcttgtggctttgtggctttgtggctcgtcccctctcctcctaggggggcttgtatttatagctataggtgcccccttgtccaagtagaactagggagataaatatggatacgatctgactagtccttgtcgtttccatgtataactctattagtccttccttatccggaactccttctatatacgaggtttgtttccgtataagacatggtatgtggtgggccctgacgagcttagtcgattactattgggtatgtggtatctataaccctgatattggtgtctgggtaattaatttccggtgattgctcaggaggtttaaggtgggtgtaaaggtggtgacagccctcaattacactgaagtcttccttgtccgggtacgcattagaaggacatctgggagagcgggctgactagtgcctgaagtatcgcgttagggttaaact

SEQ ID NO: 4178 - DNA, 1501 bp, Oryza sativa
tgtcagcaccttggatgacaaatccaatgacttcctgtaaagatcattcgcaggttcctacaagaaacaggactgtacattagtttccagataaaaaaaggcacttattttacagcaaaagaacatcaggaggctcctgtgacggttttaggccacacaacttcaggactgcaggtcagcctccaccatggaacaaggaaatgtgtttgcggaagcatactagcaaactacacataccacatcaacagccttctggaaacactgggttgccttttcaaagaattcattggccttgacagtgtctgaagtgaagaatccatgagaggtctgtgcatttcccaagcaccaaagcgcatccgccttcatgggatcaattttcagtgcttcctccagcttggattccgcatctataaataaaattaactggatcagtatacttcaatttgaacaaattgagtaacttctactgacatcaaaatacacaaattaatgtgcaacaaaactcataacacatgtgcatgttaagccaccaacaaagtactgttacttcaattgaacagcccagacggcacaagaacaatcaattgctttccattccaatacttgattatgcacccaccatattatcctacttcctagctaaaatgtgatcatactcttaactttaacaaagaatcaacaaaatacatcaagcaaacgaacagctcccagcatttacatataacttgataaaattatgtcagtaggcccaggaaaaactattcagtctgaacaattgggtgaagaatagcattcttctcattaatcatctgatgtgtagtgcactgctggattattgaatgattttgatgaatcccgtcatcatcttctttttttcatcccaaataataccttaaaaaggaaaacatcaaacatgcaaagttgtctaaactcatgaatggatagacaagcaccatcagaaaacagtagcggttcctaaactgcatataatgaaattgaatgcaccacctacgagtgccctaaatgtttgaggtactgaaatgaaaaaccacataaccgtgggtagaacagttatccagtcactaaactaggcagaacaagttgtgattaccttcccatgtcataccagcaggattttatccttttcttattgttaataaaacagcatgacaaattttcctttaagaacattgtaccttttactttaagcaaacaatatattaggtttgagcttttcaattatcatgagaacaaaagtcaatctaattgctaaggattagcttgacttgtagaacacgatttgcaaagatttggcccttccagaccaaccgaatccattaatgctgaataacacacacagaaatctcaatcccattggttacaatagcccctaggaagcatcaactccaacatctctacaagtaaacagtccaaatcaccgaataatccgcacaaccaagtttcgagatctcacggtataccttctaggcacttgaggctc

SEQ ID NO: 4179 - DNA, 1501 bp, Oryza sativa
taccaaaggctgaaagtacaaacatctcaaaggcaatgaacaaatcaaagagattttagataaggcaatacacccacacctttgaagaaacacaaatggacatcagcacaagtcaccataaaagcaactatgagaaaatatcgccacccctaaatctgaagatggaatataacccaaaagggttatcccccaatccaacctggtagtgttagaatgtacccaattgcactaaacctatagagcctaaccggcatcacatacatcataaaaccgaacaaattactaatgatccatccaaacctggtagaactactcgaatccctagcaagctgccattacacaacaacattagtacattaccagtagactcacgagcagtacaatactaattattcatccaaatcaccacaaactattcgaaaccctagcaagcagtcataacacaacattaccagtgaactctcgagcagtagaatacgctaagagcacaagcgaaggttccaaactagtacctctatcagttaatcaaccatcagaacgcctaaatcaacatcgatagaagatagagaatgcgaggggggaggggaacctggatctcgcggcggatttcgcggaagtcatagaagcggcggccggggaggtggaggaactcgccccactcatccgcctcggcgtcggcggggcggcggggctggtgcacgagctgcagcacgaggggtcgccgcgtgcatatgtcggagccccggggcaggaagtcgcggccgacgagcgcctcgaggacgctggacttgccgctgctctggctccccacgacggcgacctgcggcaggtcgatcgtggagctgctccccagctgcgagaagatgtcctgcagcttgttcacgatcgggatcaccgacgaccccaccgccgccgccgccgcggccgccgtcgccgtcgacggcggcgcggaggacgagtagatgccgtcctccatgggagcgaaggggtggaggagggggctccgccgctagacctagggttttgtgcggcggaggcggcgactctgcggcaacacgagggatccctagatcgagagctctcgcgtgaatttttttttttttttgggtatcgatttgaatcgggaggtgtcgaggggaaggagaggaggattcagaggtgggagagagaggaggaattgacctttataacccccccccccccccccccaaccttcttggcctagggaacaagaagaacgtgctgcttgatgcttctttctttctttcttttcgggcatgaaaacaacagaatcgatgcccgattgtgcctctactgttttataccagagtgtttctttctttctttcttgatcgacaagaagtcactgtaaattcatcatcagtagtaaaagttcattggtttattccgttaggactaggcccaattctttttcttgactctaaattttaaatttcttattttcatcaaaccgttaaatggtgtgatagatgttgtttaa

SEQ ID NO: 4180 - DNA, 1501 bp, Oryza sativa
ttgtgactaatttgcgagacgaatctttcaagcttaattgctcagtgatttgacaatatggtgctaccgtaaatatttgctaataacagattaatcaggcttaataaattcgtctcgcgatttactgatggattctgtacttagtttttttattagtacccaaataccaatacaatactctatataatatccgatgtggcttgccaaaaacgccgctggaattaaaagccccaaaatgctgcaaaagccaaaaaccgtctctagttacacccgtggggcccgtccacatcccacaacggcccaaaatgagagcatgacagcccgggcccacgcgctactcccagtaaagaaacacactctcccactctctcctctcctctgtccctcttcttcctcttctcccaagaactctctcctctctctctctactcttctcttctctctccttttgttgcttccatttctcgttcttgcacggggaagaggagagaaagatgtgtgtcgctgtggtttgaaaaaggttgggtgtgagaggagagagaaagtggagtggaggggagagagagagagagagatgggttcttgcgcttcggttcacaaggacctcgggttccccaagaagctgtttcttgcgtcgtcgcctaccaaggagaagaaggccgcgaacgggaagggtggcggtggcggtgtgtctgttgatctcaagcgaaaggagcagcagcaggcggcggcggcaggggttggcgtcaggagccccggttctggtaggattcgttgatcttggctctcttgggtctttttctgaagtgagtttcagtttcagatggttgtttgattgatcagtttggttgcttagctaggtaagtctattcttgaaaggttaaagagggagatgagtagatgacttggctgatctttctgtggaaaaaaaagaagaagaaaagaggccttttgggtttgtttattgattgatttattgtttgggtctggatttaagaatttgaaagggaagttttatggtgttaaaagtagtttatgaagaataaaaagattgcttattggtattaacaatagcttccgaagatcaaacagactgattgtttcagtaggaattgatgatattaactgaaacggacctctgttcaagtgttcatacaagctggttttcgattcaggttcatccaaatcaggaacttgcttcatggccatttgattagcctgggggggggggggggttgcagtgtgtttgtatctagtattactttgtccaaaatcaactgcttgctctttgtgttaccaatcatcgacgagatgtgcaagttgactgttttgtgtattctaatgttcttgtttgtcaattgggcacttcgttgaatttgtgtgttcattaattaagcctgatcgaatttataccatggttacacatgcttgtctgacctgaatatgcagtttttaatggatagaggaacttaaagaacttaatttgcaggtagcaaggatg

SEQ ID NO: 4181 - DNA, 1501 bp, Oryza sativa
ttatctgtaattagagactaggtccggactaaagctaagccgaattgttctttgcttatgaagcagcgtgtctaaatcgcctttttattttagtagatcacagggatcttttcgtgtttttgtaaaagactaaaaggtgattttgttcgaatcgtgtgtcatgtgaaggattatttgtgtgagcccccgatctttcccgagccaaccccacgccacgccacaccgcgtactacgtgcgtgccacccggccgctacgtcctcctcctctagctgctcgatcggcgtacgtggcgccaagattgcgtgcgttttcctcgtcccacctcgcgcgcgcgcgacgtcggcagcggagcgcgcgcggtgcaccgcaccgagcaagcggcagtgcacgacgaattcgaagcggcgccgccacgcggtgtgcatatgctttccgagagatgcgatgcgaggcgcggtcgatgataccgaggccggcggcagcggagatgctcctggagtgacggacggaggcatcagaaacaaggccgagaccgagttttttttttttaaaaaaaatggtcaagtgactatggtcctccctggcgcgattctgcgagaatgattcgattgttggcgtcagaattcagcccagcgtgccaggtgcaggtgcagtgcatgtaggacacgctgctccggcagcctagtgtacgtactcctacgcgtgggttgtttgtctcttgtcggttcggtctctctctctctctctctacacgcgtgtcaatgcgcggggtggcgtgccatatgccaccgcggcaccgctctgcccggacgcgaaccatcggcaaattttggattcgcaggtggatgagggaggcccgcctccgcgagtagctttcacgtgtactcggcccaacatgaacgcagggtggtcggaggcccaatggattccaccaaattcactcagcgccgcccaccacggcatcgccttgtcgagctctcgccatggcccaccacggctgtttacaccgatctcggccctcgccatggcccatggctggatcgagttcgtgggcttggcaatatgacaccatcatcaattgcttgttatattaaaattattttttcaaacttgtttaagagtattttatcgtagtttatttttatcattaaattttagaccataacaacacataaattattttatgttgctttgtttattgttcgacggcgcgatagggctttctgaaattggcaacttcagaacaaactagttagtggtaagacgtcagacttgagactaattaggtttctgatgatgaaagctatactatgcctatcaacaagttatacccttcagaacgaaaagaacaggttgacaagaaatggcagctgctgggttaattaccccatctctgatcccattgggccattggtaagggagcacagagaaacgatacattatacatatacgaatgagtagactatcattccaccgtaccaaagcacaagcctgagtctg

SEQ ID NO: 4182 - DNA, 1501 bp, Oryza sativa
tccacaggtatgtcttaaaaaaggaagtaaattacaaggacgcctctaaaagatcgctacaagatatgagtcatgcccgtggtcatcacaaaaatgtctgaaaagatatatcattcgttatttggactcatgaattgaggctagctcacttgattgggtatggatatacacctaaaacacccaaatttaagccctcatcaagaagggtttttatggccttttcttttcctaatatatacaaagccaccgagtctcataagttttcatatgttatatgaatgattgagctaaagtggcgatgtaactttttaaggttgatcttaaattctctagcttgcgctaaggggccacaaccattctttcgtgtgacatgaaccctaagttgaattatggagttctaaaagatgagagagaataattagaggtagaaaatagaggcaacagtatgaaataaaaaaatagctgttaaaaaggaaaaaggctatatataccaaacggttacagtgcaagctcataaagagtcttcaataagaaacttctaaaaataagaattttcgcacttcaatacttaccttttcttttctggcgggccatttaatacatactatatttgttgctttgttcagtagcggacaaaatgtgcacagctatctactccttcaccaaaagtcttatgcatatttggttttctggtctttctaaatgagatgggtatattggtagcctctatgcacccaagacttcttatctgtggtgctagattgaatcgttgatcagaacttgagcatccatcttaatacttactggttacatacatgtgtatagttccttaatttttgttgtacgcgggatgagttgattgcttcttttttttggtgataaaagaaaatacgtccgagacatttggatggaaggagaaatgctggcttttcccgacaaacagtttcaatctctcaacatggattttaattatgggtacccgaaaaaacaattggaatatatatctcagctcagttatacacctggccaggcaaacaattgataatgcaacaccgaactaatttaagaacacgtatagaccccccgcccctcctcttttccatccgtcttcctcacagcacgcgtggcagtgaatatacacgtacaatctttttacgtgttcgtgaaaaacacccatctacactaacaagctaaccgccttttgtttttttcttcagtgaatgcagatgccggggaccttccagcgcacgggcccctggcggcgctgctcgtcgggcatccgccggtacgcgcgccactcctcgagaaggttgcggaggtcgtgcagcttggcgccgaggccgacgcagcagttggcgtgcatggtgtagagcgtggcgaagtcgcgcgtgttgctgcagaacccggcgacgtgcgccgtgtccaggaactggatccgcacgccgcgccgctccaccagctcccgcttgatctcgttcagcacctgctgctcgtgcctccc

SEQ ID NO: 4183 - DNA, 1501 bp, Oryza sativa
acacataaaatattaatcatgttttatcatctaacaacaatgaaaatgcgaattataaaaaaatttcatataagacgcacagtcaaaattggacacggaaacccagggtttgcctttttttaaggatggagggagtactatggataagtgtaagtataaacaaaataattggtctataattagggatgtaaataggcagccccgctacccaaataaaaacccacttgctagttcatttcccacatggtagtacaaaatttagaagaaaaaataaactagaagtgacataagcgggctaaaaacatcccgcttgcccgtcatgtttgcatccctacatataacttacttggaagaatatctccctttagaatgtgtaataactcaacaaagattgttcaattgtttctttatgaagattgtgaatgtatgttttgggtgaatatattccatgaaaattatttatattttcttaaagacatatttttttgtttgaatattggaataaatgaatgtcttgtgataattattcgaaagtaccaacgaaacaaacgaattaactgctataaaattttttaaaaaaacttaaaacaatatttaaaattccacatatatattttgtctattaatccatttacccatatttctcattattccagtgatagatgcgcaagatacttgtggtaactttccgattttatgatgcgctagttatttatagagttagggtgtgtatgttgtacttataaggccataggccttgtttagttctaaactttttcttcaaacttccaacttttccatcacatcaaaacttttctacacacataaactttaaatttttccgtcacatcattttaatttcaaccagacttttaattttgacgtgaactgagcacatgccattgtactgtgttaaaaaatactattgaagtaaatgtgacgagcttttatattaatataaatgtgatgagcttttattgagaagaatagagaaaaataataataataataaaaaggaaaataagggtcagggtcactccaataacgcaccagcaccaccttgcccgaatcacaaagcgaggcccacttccaccttttcctatttctcctctccgttctctccgggttcttcgtcgcctccatccacatcgtcgtcgccaccacccacgccaacctcgcatctctctctcacctctgctccaatcgctcgctgatccccccccccccctccccccctccgaccagacacagccgagctcaggcgacgacgcccccgcctttaatgggctttcctcccaccgacatgccggcgatccccacacccgcgccgcccccggtgacctctcctcctcctccttctccttctccccctccccttccgccgccgcggttgcgcttggagttgggggtggcctcggcctcggcccctctaggctcctcctccacctcctcctcctccactccctcttatagcccaccgccaccggccgccgcgcgccca

SEQ ID NO: 4184 - DNA, 1501 bp, Oryza sativa
ctaggatttaaatttgtcccaaaataattatcacaatatagtattaatggtctcattaatcacttctcattcaaatttatctctattttaccctcaactacccctccacttttatctatatatagaacatttaataaggagcatcgattatagttttttttctcaatccttaatatatgcaaccatctagaattataatttatatgggacggaggtagtaccatttaaaaatatgcttgttgttttgaacaagggacacaatcttaagaagcaactttatcactattttctattacaatatttaaataaatatcatgaatgtatgattttattaaagtatatttcaatattaatatatacatatagtttccatgcttctaaaataaatattttaaattttgttcatagttaaagctgtacaaagtttgatttcagttttagcaaaacgataagtgttatgatactagcaaaaaaaacttccctattggagataccgcacttaagctttggctcacgtcgatctggtcaaatggaccacgcaaacgcagtacatgcatggccaaccagctttgtgcctatcatacatacagcagcagctagcagtcaaaatcatacccgtgatatgctatatatcatgcatattcccctctgctcactttttttgatcgatatggcgttagcgcaacaataataatttatgaaaaatataatcttaaaataataattacacttataaaataagtcacatatattgtggtaagtagcattagtttatggtgcacattatacttaaggtctatcacaaacaaaattaaaatatttttatctctctcattcacctcataaacaagagctgaagtatttttttttctatctcatgtggccctatcttatggttacttaaatcctagccatagcaatagcattgtgcgaattgctttaacattatcccactattcatgggctcactcctaagattacatcacaccacataaacattgagcttgtctttgtgtagcacatccctatatctatcagctgcctctatttggtccatttgatatgaatactattctctccgtcccttaatataagggattttgatattttgcttacactgtttgaccatttgtcctattcaaaaaaattttggaattattatttaatttatttgtgacttattttattatccaaagtactttaagcacaacttttcgctttttatatttgcacaaattttttaaataagacgtagtcaaacagtgtaactaaaatgtcaaaatctcttatattaagggacgaagagagtagtattcatatgaatgcaaggcacacaccacatgatcaagcgtacctaatagtattccctctatcttacaataaaccaattaaatatgagatgcgatacatcataatattatgaatttaaacattttatatttggttaatttgttttggaaagaagtaataaatttctccaacactgaccaaccgtataata

SEQ ID NO: 4185 - DNA, 1467 bp, Oryza sativa
caccattatgcaacatcccagcaaacacaacatcagaccatacaagattattcacttctaccactaacattgctatcaaactactcttgtacagcataatcatcccccccccccaaatcccatcactctctggagtctggggagggagacgctttacgagaccaatcagtttccgaaatttctaacccccaacgctttagatgaacatctgcttgtctaatttgctgcgaataggagggctccgacgaggaattaccttgcggctcgatgccgcgggcagcgcatcaacgcgggggcggagcagtcagaagcggcgccgtgcgaccatggatgggggcagatcccgacgagccccgccgcggacaccgcctgatcttgctcccggcggcgaaggggatcagtctggccgcaagtccggcgaacggctgaagagggagggtcgccgccggtcgcgtcggcggtcggacgcggtggtggaacgctcttctgcaaaggagtaggattagacttatgtgcggcccatgctactcattgggccggaacggattctgatctcgatttcgtgtggcccaaacacggggagagtcacagtcgagagggagacggtgtgcgttcttcgagttcgaggaagaacaaaaaaaaagagtaattattatattgagcatcgtgatttgagcttgttaattatgctttttaattaattaattaccacactttcttctggtatcaattcgtcaccatttatttacccctgttccagcaaaggtgagaaaacgaggccaactgaacaacatgttcagagttcagacttcaggcagttgagctttcaggagaatagcatatgcctctccagcatcatctgacagctcgaggtttttcatctatctgattcatgtaagttcttcgcacaaaatggtgcaaatcgctatcacaatccaccattagagcacaaaattcagcacgcatgaaaaatctgcatcattgcagatttgcagtagggggtccaaccttccaaattaataaaagacagcattaccaggtgaattaacaagcagattatcgtggagtgatttgacaaagatagagtagaatacgcaattccgcggtaataatagctggtttgggcgataaaaaaaatttcaccgttgagcggatgatggaaggtgaagtagactagcacgctaaacgacgaaatgaattgtattttatgattttatctaatctaaacaatgtcttgttcgaacaatcttttactctacctcccaaattaacccttactttactattgtttgttagtatcattttgcaccacaaaaatcaagacaagtggtgctcattgtcggtcaaggtgtcattagagcaccattaatcaagacaagaattctaaactaatctcataggattaagacatgcattgatccaggtgttaaacccttgggcagatttaggatgtcgatgtgccgttct

SEQ ID NO: 4186 - DNA, 1501 bp, Oryza sativa
tctcttgctcttcttttgtctgtaagtgttgggtgttctatttgtttttatacggaattaattgcacgcaaaaaaccgagtgctcacttctgcaacgttctaatggttgcgaccttgggtcgttctcccggtggactcgtaccacaaaatccgcaactgccgctgcacattaatcacttcctccttgatttttcaattttaaaattgaggcccccccacccccgcaaacgccaatcagatggatcggaattccttaattattgccgaattattatggaatcctatgggttgtttgtcgtacaaagccctttggaaacttcattttgctcagcggaggacatgtgctggttagttacatatggaattataagcaggaaatcagctgcattttgcattctcgttagtaagattttctttttatataaaaaagaacccatattaggaccgttatctcgttctcaccccacagattgcgtatcttctgcttcttcttcttcttttttttgctaaactgtgaaatcatcgagaaaatcccaaatttttaatatcatttttacagtttaagcttcaaaacctccaataacatgaatataaatgtttatccataagatttttttgttagttcatttgtttttttgtcgccttatcaatgatagttcaaatgattagagcttagcaatccttttttcaatttatactctcattttccacgtgtttcccgaattgctaaacggtgtaattttcttttaaaaatgttccacaggaatgctactttaaaattatattattttttattttagttaataattacttaatcatgcgcaaataagatacatcgttttttttcgggagaaatgggctagcagcaatgttgcaagctactacatccgttttagattataagctattttgactttgatcaaaattaatctactctaagtttaatcaagtttatacataaatatactaatatctacaacactaaattagtttcattaagcttataattgaatatattattatagtatatttgtattgcgttgaatatgtgactacttttctaaatttaatcaaatttgaaacaattttactttaatcaaagtcaaaatgacatataatctaaaatagagtgagtatctctgtagggtgtgtttggataataggaaatagggagtgagattgggattgaaaattgaatgaagagttaggattaaatgaaagagagagaataaatggttaggatttaaatatgtttttagtaggtgggaaatcatttccatatcctattagccaaacactggcctaagctaataccaacattcttcaggagctggatgcaaatttggcagaccaagtccaaaacacgacagccagcagcagcagcaggacaccaacgcgacgccaccacagtataactcgacgcccccactcgctctctcccccaacccaatgacagcatcagtattccagtagcagcggagagagagagggagcggccaac

SEQ ID NO: 4187 - DNA, 734 bp, Oryza sativa
gcctagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacggaggttgccgcgtacggttttcccgcgcgcgtccttgcgcatgcaagctgcctgcacctcctgagcccatgcgccatgggccgccgtcttgggccattgctgcttggacgatgcaggcctgccgagccgagccattcaccatcttgggccacgtggaacggctggattggcttggcctccctgccaaccaatcacagcgcacatgcacagctagctagcttgacttttccaccgagccatgctagtagcaaccagtacaatgcaagctcctccttgcacaagtacagtacgtgtacatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccctgagtctagtcccgatccgccgttgaccaagatcgaccccgatcacctgcacacacatga

SEQ ID NO: 4188 - DNA, 1501 bp, Oryza sativa
cttttatgactatcaaccttcaaaactcaggctaatggtgagccttagatcgagatcaaaagtcatcaagcctagactttggctcatgcttattttttttacttgagctataagaataacaagttaaatcttgcccacatatgacataaaataatatcgacacaacatccaaactcaaaaagataacatgccaaatctcaccaacatatataatccaaaacataatagtactacataataccataaaatcaagaaatggttatgcccaaagttctataataacatatataataattgaaagacaggacgagcaaccaccgagagaccgtagtgtgtggatattacatgtgtgagatgcttaaggttaatgggagttacacaacaaacccggacaatataaatacaaagatttgttctttgaaaaatactatcccatagtaatgcagtttattaatgcggacatcaaaatttctaacttttattttcatatttcttttatatattcttgaaattcctcccgtagcataacaattcgacaaggaaacactactttatgaatgtctgcaccgatatgtgccactttatccaacgcgagtgttgcaatgcacttggtttgttgtttgacgattagagcacgccatcgtaagaaaacaaatacaaaacccttcaagagtagaaaaaggaacatatgtaatgaaactttattgttatgcgatccgagaatgatcatttgtgatgaagttaacaaaacaatgtttatatatgtcttcatttgaacatatttaatatttatatattgataagtacacacttctagagcatatagtactagctactataaaactaagttttcaactggaaaaatattttgatttataataggcggggaaatagctatctcaagcaaaatcacgagaatattcatggatatatcaaatggttttctcaagatgatcatgatgatgttatcacatatctcctatactacatactttgttataattacaattttgttttttcccattgtaacatgctagtattgtactaatatgacttaattaaacattatcgacacaacatccaaactctttttttttaaaaaagataataagccaaatctcaccgacatgtatcacccaaaatatagcactagtacatattaacaaaatctaaagaaatggttatgtccaaagttcccaacacagcaatgacttttatacaacacatgccaatccattttcccagaggagccctcgcgtcggcaaaaccgacgtgacgtggacaccctcccgctgcgtccttcctcctctttcctctcctcccgtcgagattgcaaaaggaaaagaaaagaaaaaataatcctccatcacccaccgcatctccgctcctcgaccgcgagagaggagaggagagagagagagagagagagagagagagagaggcgttgcgagattcatcaggcaggcgcaggagaggagaggagaggagaggagattcatta

SEQ ID NO: 4189 - DNA, 589 bp, Oryza sativa
caaaattacatctattagattcatattataaaatattggctggtgattaaactttttaatcacattaaaaataaataatattcaatagaacaattgttggttaaactctttatcttaaaaagtatatcttatattttgaatcagagagactgaaaaaggacggggcgatggatgatggatccatatgagtttgacaattatgcataaataaatgcgttaaatattagaatactgagaagtctagaaaatactgatgaatgatttttttaaaaaaaaatcataccgcttagaaccttgaatttttttttgttttctgaaaggaccataattaaaaaaaaatccagtgctaaacggttggctcacgaggcccttcacaagataataaataaagggtgtagctatatttatggcgccatatttttcaccaaaaaatagtcggcatgtatttacattgtaacttcctaaattacatatgtaattttaatgtatttataatgtataaatctcgaaattacatatgtaaattccaaaattacatatgtaaatattaaaattacatatataaatagagtgtaattttacatgtaga

SEQ ID NO: 4190 - DNA, 1501 bp, Oryza sativa
ttcaaatgaagacatatataaacattgttttgttaacttcatcacaaatgatcattctcggatcgcataacaataaagtttcattacatatgttcctttttctactcttgaagggttttgtatttgttttcttacgatggcgtgctctaatcgtcaaacaacaaaccaagtgcattgcaacactcgcgttggataaagtggcacatatcggtgcagacattcataaagtagtgtttccttgtcgaattgttatgctacgggaggaatttcaagaatatataaaagaaatatgaaaataaaagttagaaattttgatgtccgcattaataaactgcattactatgggatagtatttttcaaagaacaaatctttgtatttatattgtccgggtttgttgtgtaactcccattaaccttaagcatctcacacatgtaatatccacacactacggtctctcggtggttgctcgtcctgtctttcaattattatatatgttattatagaactttgggcataaccatttcttgattttatggtattatgtagtactattatgttttggattatatatgttggtgagatttggcatgttatctttttgagtttggatgttgtgtcgatattattttatgtcatatgtgggcaagatttaacttgttattcttatagctcaagtaaaaaaaataagcatgagccaaagtctaggcttgatgacttttgatctcgatctaaggctcaccattagcctgagttttgaaggttgatagtcataaaagagggtatttggatttattagatgcttctgttgtctatagtaatggcatctgatagtaaactctaatcatttgagctgtggttgataagtcataggaaaatatacgatacaaaataatttattagtaagacttttgtacatatattatttgtggtttaaaattcattgttggcaatgaaaacaaatcaattctaaagttaagtttcacaatttaaattttggttacaactaataagctaacacatacacgataaaaagcccaaatatctataccaatcgtgggtccaatagaaaatgaagtaactctaaataaggaatcaatttattttattaaatccatgaaactacgtaaaggaaattcctaaaatttggaaagtaattatctcccaatataggtcaatggaataagccaccctttcaggaaatatgaaaactaaatccaagttcaaatcatccacacacaaactcaaataaaatggtaactctaaatatattcgctctttgggcccaatcctcattccccatcttttcttcccttttgtagtccaacccatctgagcatcatcccccctcccccctcccccaacctcctgttggaccggaccatcaaggcagcccggtccagctcgacacggaatggatcatcgggctaccaaatgtcaaaagacttggatccccttcaaggatgatataaaagcatgtacaatcttgcatttagagagggt

SEQ ID NO: 4191 - DNA, 1501 bp, Oryza sativa
atttttctcagatctggaattttcggaagttccgataattgtttcggaagttccgaaaatcccttttattgcactctaacgggcagatttgtgctgtgggtataaatacccacctcccctcacttgtgagggttgctggttccattccaattatttgtgcccttggcttgctctctctctctctagttcatttgagccttgcttcctcgattcatctctccacccgtgtttgatttggatttggtgtgtgtgtgagagtgtggattcgagcttgtgtgggtgcttcttgtggtctttgtgaagatttgtgagcaattgcatcatctccgggagttctttgcatcatcttttactcttggaggttgaggactcctagacggctagatgtcactcccgagccaccgatctacttgtggttggccaggagaagtttgtgaaggccggatctcgcctccgcaagggaagagatacctcttagtgaaaggaggagtgcttagtgcaacctcttgagaaaagggttagctaagacccggctcttagtgagttcctcaacagagagtagaatccccttaaggatttgaactccagggaacaactttgggagctacatcttggtgatatttcttcatccctctcctctagctttgcttgcttgtgccgctattggtctagttgctgattgtgccttgtattccctgttatagtcttatagatctagagttttcattttgtgtgcgctgctctgtgcattttcggaagttccgaaaattcccagcctagctccaaaaattactgcttccgtatttcttaagttttaaattagcctattcaccccccctctaggcctaattgaccctttcagtttctccaccagtgtactatagctcccacgcgtgcactatgagtgcctcctgttttgcaaatacgaaggcacattttactacttgggaaatgtagacatgtgagaccaagcatgtggcccaagatgtcaaataattgatgctaattttgtggaatggcaaagtaccgaaattcctaatttgtgtgccatcaacacaaactaaatcattgcaataaatggcttaagtgagagtatacatgtggggttgtgagataatttggcaaatataagggactatttcaccaatatgctgttattttaatctctggttcatgtggtatatgccaatattttatttatttattggagttttaagaaaagtatgttaccattggcaaatcataagactaattagaggtcccataacatataatgggccttcaaaatgtaacaaaggtaaataaaagtccttgatgagaagtaaccgtcaagtctatgtaaactacatgtgcaacttttatagatgagttcattgacacatatgaatttgtaagctttattcatagcaaattaatagttccattttggtgacaacaggtataaagcacaaacatcacaattagtactgatcattccaatcctagtacaatctagatataa

SEQ ID NO: 4192 - DNA, 1501 bp, Oryza sativa
tcatggaccaaccactatagttaataaaaaatccttaatttttcatgtacaatctatgttactacttcgtatttcactactgttctgcacttctatacaaaattcttaattcatgcaattagcacaggtaggagtacttcacaattgttggctgttagctcatttgccaaccgttagttcagacagccctcacctgtgtcctcacctaggctacctacctagagcagagtaccctatgcaaaattgggaaatatataagcctatttctcgatgggaataaattgttcaatcgaaaggagatgagtctggtgccacgcgttctcctccgtctccccttctgctagtgctttctaccaggggtgaaaatagtcggaatcggcaggatctcttcaaaaacgacgatggatcggccgataattgaccatatttatcatttaagctactcagtgtcgacattaatacgacgcataaagaaattaaaaaaacaaaatttataaatagctataaacagtacggtaggaaatggtaccccttatacagaaacgatgctcggttgcatcgagagtttccgtgaccgttttcagtaccatctggctggcaccctagccttcgcctcatccagcaacacctccacatcgcaggcgcccgccacctgtgccacaaccgtgctaggccctcctcctgcgcctcggccatgcaagacactgccatcaccacatcatggtgaccgaggcctcctctcagcctcggccttggcctccatgccctcctccttgtcaccgttctcgtagtagtcatcatcattagagtcctattatgacagtgggtccttgtggttgtcccaccagtgggtccttgtggttgtccttctttggtggggacccattgtatcagcggttttgaagtcactgtgtccactttatcagtaggtgatttgcttacaatgatttgggagttcagtgatgcggggtggatgcgctcgatgtatcggctctattcaatccagtgcatcgagcctttttttggatcgcgtacgtctcaaaggtgccgattttaaaacctacaaaccggcatctattacacacatatagatacagggttttgaaaccggcaccgatgaccgaagtcatccgtgccgcctccatggtgccggttgggaaaaccggcacccaaggggattcccaactggtaccgatgtgcttttctggagttgtggtgatgtaaaaaatcaacaaacgtcatatataaaaatggagagtgtatataaaaaacgaatgtactaactgcgtactaagacatacttccttcgttttacgatgtaagactttttagcattactcaaattcatatagatgttaatgaaactagacatatataaaaaaacatatacattgatcaatagataaatctatgttagtccaaaaggtatatatatatgaaacggagggagttacatattgtagccacgtaaccacacacacacacacacacacacacacac

SEQ ID NO: 4193 - DNA, 1501 bp, Oryza sativa
tatggtgatttcttatgaaattcaaagttaatacttatggatcttacattgtactttaaaacttataatggaattttgaaattacactgtgaacttatcaaattcacagtgtaatatcttgtaagttatagtgtaatttataaaactagtaatttgtctgtgctaacactaccgtaatatttgataatgcatataaataaactaaagagatcatatattatcgcaatcaagcatataattagataaatttaaaatgcatgtaaaaaaatcgttcccatgggcggcaaatcctgaatattgacgaagtcaccacaggtgcctcgctgttgacgggtacatcgcctatcactgaaagcacaataccgttaaaacctaaaaaaatcgtttccatgggaagtcaaacccaagaactaaggtgctactgagactcttgtaaccattacttattttttattttgttattaaatacatagccacacgatatcatcacaacttctatatgttcggatccatctaattcttgggctaaaaaatttttataactacatgaacataatttgtccatgatgcacagcataactaatctttggaaaccagcatccaatcagcaccttagaagcttgtcggattgcctgggtcatcatcctcgtggagttggggtggtgatcttgtgatggctggtagtgggaaggtggctgctgccccttgccaaagtagttctggtaccccggaagaggctggctcgactggacacggctgtgagtaatcttcattccacagcaacaacccaaaatatatcagggaataatatctgtacccagttgctgtggaatcataatttcttttacaccagttgtaacatctaagcaaaatgttggtgtatttgccgctcactgccagggcagggatatcaagtggagctagcagagcatataatggctgtgccaggagacactcacgctgctcaaaatccaatcggggaggacactgcatacagggatacctgagtcaataaatgatgcatatttgacatgaatttaacttcaaacttgataatccaactattatcaagcatcacgttgaaagtatcatgcataagcatgcaaaattatacctaaatctgaccaatttgtcatatagcttgcagagttgttacatgaagcgtggtaccttgctatcaaagaaggatctagatgtatattaaaggtggacctcacatagtttggtcaactttaattgtctgagttcaataaagttttcattaactaaaaaagtcaggtcaacttgataatatggctatgacagagcatattgatacttaaatctatactattatgacaagcagtttgatgatcttaatgccgatgacggtctgaaaacctcaaggctagcatataaatgaagcatatccagggccggccctggccctatgcagccgaggcgacggccggggacccataatggtgaggggccaacacctaatactagtaatctagtacgt

SEQ ID NO: 4194 - DNA, 1501 bp, Oryza sativa
tgggaatccccttgggtgccggttttcccaaccggcaccatggaggcggcacggatgacttcggtcatcggtgccggtttcaaaaccctgtatctatatgtgtgtaatagatgccggtttgtaggttttaaaatcggcacctttgagacgtacgcgatccaaaaaaaggctcgatgcactggattgaatagagccgatacatcgagcgcatccaccccgcatcactgaactcccaaatcattgtaagcaaatcacctactgataaagtggacacagtgacttcaaaaccgctgatacaatgggtccccaccaaagaaggacaaccacaaggacccactggtgggacaaccacaaggacccactgtcataataggactctaatgatgatgactactacgagaacggtgacaaggaggagggcatggaggccaaggccgaggctgagaggaggcctcggtcaccatgatgtggtgatggcagtgtcttgcatggccgaggcgcaggaggagggcctagcacggttgtggcacaggtggcgggcgcctgcgatgtggaggtgttgctggatgaggcgaaggctagggtgccagccagatggtactgaaaacggtcacggaaactctcgatgcaaccgagcatcgtttctgtataaggggtaccatttcctaccgtactgtttatagctatttataaattttgtttttttaatttctttatgcgtcgtattaatgtcgacactgagtagcttaaatgataaatatggtcaattatcggccgatccatcgtcgtttttgaagagatcctgccgattccgactattttcacccctggtagaaagcactagcagaaggggagacggaggagaacgcgtggcaccagactcatctcctttcgattgaacaatttattcccatcgagaaataggcttatatatttcccaattttgcatagggtactctgctctaggtaggtagcctaggtgaggacacaggtgagggctgtctgaactaacggttggcaaatgagctaacagccaacaattgtgaagtactcctacctgtgctaattgcatgaattaagaattttgtatagaagtgcagaacagtagtgaaatacgaagtagtaacatagattgtacatgaaaaattaaggattttttattaactatagtggttggtccatgattatatataatgaaactgtgtgaaaaaccaaccaaaagttacaccccaccatcaccagcttagactcattcaagctctactatccaacatcactcgaggttcttttggagagattacgaaagaagaaaaagaccatgatgctctcattaaatagggtgtgagtagtggtagatgggtgatcgacggtaagatggtaaaaaatattaaatactaattaattaatggaataaatatactataggatttcttatattttgagataaagtttgaattttggatcatatattatatattataagacagaggactccatccgt

SEQ ID NO: 4195 - DNA, 1501 bp, Oryza sativa
ggccttattccctcgggacttgaacacggggcgatgattttgggaagcaagtctccgtgagcctgctaaagatggctagtccccagggccgctgctcgcgaggtggcggcggtggcggtggagaatgggcgaagcccgatcaaatctattacttgataaatagctatgcaaggacaaagagagagaggagaagcatgacgtgtggcgcctcggaggagaaccccccaccgtcaccgaagtcatcgaggatagtggcaatataatacggctcgtcggagagcttcgaggaacaccatgggggaaaagatcctacaaggtttgggtggtctagggtttttttggaagagtgagaagaaaaatgagctaaagtgggggcagcctgcgcccctatcctggcaatcgccaccaccaccaccgccgtatctactagcctgcgcggtcacctcgctctagctgttcctctccgctcctcctacccctcggacggatgccttggggctcgggcttagggctgtcaacgagccgagctcgagcgagctcgtctgcccaagctcgagctcggctaccgagctcggtcataagtagtataatatatattttaatgataattttttgataagtataattattttctagttaatcacactaataaaagagtagaaaatgattaaaataaatatattatgctaacacatgctaatttattgtgtaaatagatactaatatatatatatatttacctattagtttattatatcaataaggtgaacatgcaatatgaactataaatagtcaagctcggccaggctcggcaaaagctcgagctcggctcggtaaagctcgcgagcttttgctcaggctcgggttcggctcgtttgaagctcgagccgagctcgaatcgagcctaggacgagccaagctcgagctgctcgcgagcctcgagcttttttgacagccctcccgggctctcctcgagcgggggtcgctaccagcaccgttgttgagaggggagaaggacgaggaagagagggaagaggtggatgctgatacgtggggctcacaggggtcccacgttgacttagcatagctaattggagtcaaagcgccaagtaggacgaaatcaagaactatattgccttgggacgaaagttgatacggatttgcgagttcgggacggtctatacatgctactgtggtttaagacgaattttagtctgggcgacaaattaggggaccaaaagtgaacttatttctctttagccgtcagaattgactacggcccaatagacccaatagcccaacaggaaacacattctgaacagcccgttaacccctaacccttccacgctgtcttctccactcccaccgccggcctcccaacccgccgccggcgacgattccggcgagatacctggtcggcggacaccggctcccgcgggtacgagccttctctagacgggctgcgtctctgtccatctcttcttcttctccaacatgaggc

SEQ ID NO: 4196 - DNA, 1501 bp, Oryza sativa
catgattgggtttacttgaacgcttgtagtattcttaattttgttataaaaggttcttttgggcatcaatccaaacaaaagcctttactggttatctttagtctagtcgtggagtatgcatcatataaagatctggacacatattccaacaggagcatctacaacaagtagctaactaattcagcaccaaaagggattctctaagctggtcattaacaggggatacctagatgggtccccaaagcagacccacaaaactatccctcgcaagatgccaaatgtgacctgtccttcctggtcgcataacatctgctagttaccctttgtagaaagctgcaagtaaaacaatttggcagcagaacctctagggtgtgagagttcagagaggccaccacgtgagactgctaatctaaacgctacttgcagtataaactcttttagcactcaagacacagaggataactagttaagatacttttaatcttttatacttgtctggagctaagtactttataagagtctatttggtagagcttcaactcctaaatttactctaggagttgagtctggaatagaattgtggagcagcctaaaccccggttcacattatgagagcgctccacctagctctactcagggttccccttaccctttttggcgcggttactgcacccccacagtaaccctctttttggcgtggttgctgcacccccacggtaaccgcgcggttaccgcgtggtaaccgcgagacataccgtggtttcaaaaactaaaaaggttaccgtgcatggtaaccgcgataaccgcatggtaaccgtgcggttttgtaaaccctagctctgcttccattttagacgaagctgaaactatttggatagactcagctccatctctagagttgtaccaaacagaccataataagtactttctccatcccaaaatgtaaggatttttagaatagcgacaaatcaaacatttttaactttgactattaatatcatataaaaataaaaaacatcaatcatgcaactttgatgttactagtagatttatcattcaacaaactatcaacatatgccactcattttatttaaaatatattacttttatagatattattgttcaaagtagtatcaagaaaactgcgttgaggtcaaaaaaaatttatattttggaactgagggagtattacgaagcaaagaccaaattttatccgctatatatatattaaaaaaagactcttgcaaaagattattactagttagttggagccatggaggccttggattaattagttagcaactcattattacctcctaaagtgcaggagaagggaggaatactattggctccaagtggaattcattagtagtagtacaataggttggtgttgtagtgatggtagtagtaaaatcttagggcccctttgaatcgtaggaatgaaaaaacagaggaataggaaaaacacaggattctgacaggaatacaattgtaaaacaga

SEQ ID NO: 4197 - DNA, 1501 bp, Oryza sativa
taaggttttctttttctccttttaagcattgggcgttatgttgctaagattaccagtagaagtacagctatgcctatttttcaatttataagccaggaaaaaagtacctaccaagcatgtcgctttaaaaagtatgatcggttttcttaaaaaaaaaactagcataaatggtttaaatgaccattgtgcgttatatataaaaaacatatacaccttccattttttgattggttgtcatatttgctttgtgcccggtaccaatacaaccccccatgacacttaatcagtattgatcaacgtgtgttgacgtttcgtatccatgcacgccatcatgatctgcatggcgcattggcctcgcccgcgcgtcgcgccaatttattgtgatcgcataaaatccatgcatacgaactactcccaaattgatttccgcaacacaccatacaaaagcatcattagcgtcttccacttgatttctgccagctcccaacgtcttgcgacgatcaaacatggatcttttttttattgtttttagcaatatgatgaccaatcgcggatgaagggactacatacgactcagacgacaaataatcaattgaactatttcaaataaaattaaataattaataaccttatttttatagacgagtatagatggtactccctccatctccatctacttttgatagtcatatttcatcttggcacacagaccaagaataagtaattctacttatcatccatttaaacatgctactagtcattctttgtaaataaacgattcattaatatttacatttctcaatgcccatgtagccaatcatgtgtgaaagaatggagagtcatgcattaaatccgagaaagtcattaagatgatagattgttgaattgaaatatgcctatcaaaaataaaatttccagatttgaaaatatgactatcaaaagtagatggagagagtattaagctatctactaggctgtttgaaggtactcttttttctctctcgctcttccctctacataaaagttcgcaaaccccctaacatcatgccattattgatgccctaagccaaacacttagtaataatattttacaatccttactacaaaatactccatattattttgtctaaaatgtaccctctaaacaacaaaacttccctttacgtaaaagttcttacttgtgtcacctactcgtataccctaacatcatgccattgttgacaccctaagccaaacacttagtgtaacaatatttttacaatccttactacaaaatactccatattattttgtctaaaacgtacctctaaaaacaacaaaactactttagtggagggtgtagttagtaaaaaagccggctttgtctcctcgtatatacactctctcggccttgctcggttcctcctgtcctgtctcccctctccactccaccgccgccgccgcctccgcgaaatggcgaatctgccgccgtcgctctccatcggcgccgcctccttcgccg

SEQ ID NO: 4198 - DNA, 1501 bp, Oryza sativa
taagttatgctttgggccatattttattacctaagtttcactttggaccacacttaaacatatcttttcactttggatcggataaatttaccattgttacgatttggaccaccacgaacgattttttttctcatgcaatcaacgatcttaaacacatcagctctaatatacggccgatctcctctatatatggttcatatgtttgccgaaagggaagttaaacatgacgagaaaagttgttcatggtagtccaaaccgcaacaatagtaaatttacccagtctaaattgaaaatataggtttaagggtggtccaaattgaaacttgggtaataaaaggtggaccaaagtgtaatttactaaaaaaaaatcaaccaattatctccagcaatggatcggagtgacgtccacccagaggcgaagccaggatttgagattaggaggatgtcggtgagggtaagccataagagttgagaatgaataaccaatattaatattgatagtaaaaaaagggtcaaatagttactctcaataacaaccaatgtttaaactaatcctttaaaaaactggaattttagccctttaataatatcatccaaagtttgaaactagtctttaatttattgctaaattcttttaatgtaaactattgaataatctcacaaataagtataatctattttactttgaaaaagatgagaaatcacaaactaattttgtagatcatgtttcttgctaatgtttttagacttactaactaactaagctgataataatttcaagctacacaaataaactagataaatacttattttagttaatcttaatatagagtaaaaacagttgggtgtggtggtggtgttcagatggggggtgttggcaccctctagcaatcccctagctgcgcgactgcgtgtctgcgtccaccatccacgggcatcacgtaggcgcaccatatgtataacttgttgcatatatatgcatgcaatatgcacattctcgacgtttcgaaacgttgggttaaattttataactttgactattaattattttttaaaaaataataaagcaacatatattgatttatcttacaaaggactataacaaagtaaaattaattatttactatatacactataataaaaatatattttaaagattatgttatattggaaacatcaataattatgaaccggatgaagtaaattccgtgaacctcctcagcttctcttgacgccgcatcctcacattctcacctccctctcgagtctggaccatgccccagctttaatttgctggcggctcacctctttttggtgtagatccatgcatgaccaccaaatcattctgttcttgatacctcctcccttccgaatgtgtccatcgtatccgtgacaaattcatccccccaatccaaaatcctaccaaacgtcgaagctgtcatggcttcctgaatgatttttggtcaccatactagtagcacacgaccatgcattatcagct

SEQ ID NO: 4199 - DNA, 1501 bp, Oryza sativa
gtaccacattgtcaaatcatggagtaattaggcttaaaagattcgtctcgtaaattagtcgcaaagtatttaatacttcatgcatgtgttcaaatgttcaatgtgacagggtgaaaaattttagggagggatctaaacagggcctcagtagattttcagcaaatttaatttaaaattatttatcgattttacaagaacaatagcactaaaaaattatgtaaaccatccaaattaattatcgctcttgttttgatattccaccacataacctattttgttgcaaaagcccactcactcagcactgccaagtccatccccttcacaaacatttgattcaacccatttcttctgacatggattcgcagcggaccatatcagtgtggatagttatatggctagctatgaggttagtttgactcaagctcgtccttaggttagttgactctaacccgatttcacctcacaaccacattttatgagacgatatggctgataagtaccactataaatccacgtatgaagaaaaagccgaatagatattcatgtatgtagagaggcagagataattttgacgtggcaatgttggttggataggcttttacaataaaataggtattttgggatgggggagtaatttgctatggcaaaattgtttcaagcattgaaacgatgtttagctgtctcccaagtcccaacttgtacactacaaagaaaactcacgatagggcagcagcatatcagaaaccatttgattgtttaagcagcattatatatagaaaccattttattgtttactcatatcgcccgtcatcttgttgcagattcatagccgcatatatcaaaaaccatatgattgtttaagcatattttagaaaccattttattgtttactcatatcgcctgtcatcttgttgcagattcattcaaggctgtcaacgacgatcgagggcgtgccgatgtaccagcggccattcatgaaggggaagctagctagctctacatccacttctccttggaaatccctgactcgttgaaacaaaatctctttctgctcttcctcctgtgtggtggtgctgcgttcttgactgctgtgtgagacattgttgcttccttgagatgacgagccgtatgccgtagcagatggcaccacgaatggactgtcaatgcgcaattgactcggccgtgtaagcatcgcgtcttggccccccggtgtcgcgatcagaatagcaaaagcgttaaattagacttggcaagtgaacttattcctgttctatatatactccaatcggagcagctagtcggccgggacgggtggggagaactagggttttactgttcctcttcgatcgatcatcactcgcctcgcccatgtcaacggcggcgctggtggcgcggctcgcccgcgacgtatcggccgcgcgagacgccgcccgcttggccgcggccgccgcatcccgcgccgcgcgctcctcggcggtcgcgtcgtccagtccttgcgcac

SEQ ID NO: 4200 - DNA, 1501 bp, Oryza sativa
ttctctctcagtcccataaaaaatcaatataatactggatttgacatattctaatactacgaatttggacgtacctttgttcagatacgttgcattacaatgtcatatcattcattttttttggacggaagaagtacacaatatcacacatgtatcacttgaatacttttcttaacacacgcttaaatgaaagaaaaacaacaatgatatattaatgatctcacaattctcactattttttattaatttaaaatacaattatagacgtgggccactttgtgtacatgaacggatcgaaccggaaaagtaaaacttatcgcaaagttttccaaccactctgctcatcaacccctgtttgatcttgaacgccaattcttggtcagacgtttggacgacaccgtactttctttgagacgagacgatcagccattggaggcccatagagcaggtacaatagtaggctataagccagctgtaaacatattttaaggagataaataaggagagagaagagcagcgggctacagatttgtagccagctgtagcatagactctaagacacaatatgtttatgacatgtgggaccaaatattaatagtgtagtatgtaaatattgtatgaataagctattagattgactatagataaattggagctagtaattgactatattattgaacttgctcttacacacgcatttatcgcacccttgaccgaaatgcgggtctaaaaataatatctcggaacccgaggcgaggggaggggccccgaaatgcacgtctcactcgcaggtgggcccccgaaatcgcgagtggggcccacgccgcagtgggacgtttcgtgcgcacccactccccctccccctacgcgcgccggtcgattttagcaacgcgccaatgcccccacacccccgcaatagcctcactagataagggggacccaccgctctccggccccacccgtcattggcgtgaggggaagggagagagcgggaggggggatttttatttaggattttcttttatctgtatttttttttattaagagaaagccttcccgactccgtctcctcctcccctcgtcgtcgtcgtcgtcgtcgtctcgccttcgccgccgaggcggaacaattccgcggggagttcgctgattaatccggccgaatcctgaaattccccttgagcaatcgggataaggtagcctcgcaatccatccgcctttcctttctggatagttttttttggtgtttttcttttgatttatccgtatcgttttggttggattggggacatgggggcggggcgatttcgtggtgtgtttatggtcatttcggtggatttcgtatcgtggatggggggattattgagcaagagactcctgtttcgatcgttgattggcttggtttggcttaatccgtggaattttttgctcatagaattcgttttttctttggtcatcaggcgtaggaatcttgcgcgggaagggctaatcgaatcggttgggc

SEQ ID NO: 4201 - DNA, 1501 bp, Oryza sativa
ggagaagccatgcacatgggcctcgcgggtcacatatacgttttcggttgtttttgaaattgtatttaaaatttattctcgaatttatatgtgcaaagtttatgcatacagggtttatacatgtacagttcatacgcacatgctatctatgactctatgtatttcaaagtttagggtctcgtttggtttgcaatatttttaaaacatagtaatagggaaaacatagaaatagaatgggaatacatgtgtaaacttaaggattaataaccatatgaaacttttctacagttgcgtactaaacgatcaaaggattaaaaacattagattggagtggagggatatgaaattttcctttgatttctttgaaacgaatgacaattaaaaaaacgtagatattagggaagtacctaatatcaaatatagaagtgaggctttgaatttagaccggctagtccaccatcttgtgaagctagccggaagacaacgggacgtttctctgaaaagaatgacaatttagtgtccattcctaaaagctgtatatgcctatacttttcctttacaattcctctaaaacgaacgaaccctatacgtataaagttttcaaatacaaatctcctgagctaaaaaacgagttgacccaaactcaaacaagcctaatgcaggcctataaatacggtactgatgcacctatgggctgagtgatgagaggaatatcacatgggtcaatataaacttgttttggatcgaggaacgtagactgcaactctgggtaggctaagagcaagtttaatagtagagcccactactatctccaattcatctatacccgatataatagctaatttatacaatagttgcttactatattattaatatatgatctcacctgttatacacacattgcgtctttaagtccgtgctgcagctggctataaatttgtagtccactgtttttctctctcatcttttatctcattaaaatatgtttatagctggctaatagtctgctattgtacccgctctaaatccacacgttatagccacacgtgggctttggctaatagtctgctattgtacctgctctgaatccacacgttataggcacacgtgggctttctcattgttttccacccgctaggctcacccggcatgaatcgtgtgtttccttatcggaattgtctatccatttgtcaggtgatttttaacaacacaaatcactaagatttttttctattattatatttgcattcaacggactaaaaaaaataacaaatacatatttacttacatattattttttatcaaaattacagtgcacttacatgccatatcaattaaatttacaaatgtaatattagttatattgaactgtaattttatattttaaagaaaataacaaatacatatttacttgcacattatttttatcaaaattacagtgcacttacatgttatataactgaatttataaatgtaattttaattatatatgactgcaatt

SEQ ID NO: 4202 - DNA, 1501 bp, Oryza sativa
cgaggaacaccatgggggaaaagatcctacaaggtttgggtggtctagggtttttttggaagagtgagaagaaaaatgagctaaagtgggggcagcctgcgcccctatcctggcaatcgccaccaccaccaccgccgtatctactagcctgcgcggtcacctcgctctagctgttcctctccgctcctcctacccctcggacggatgccttggggctcgggcttagggctgtcaacgagccgagctcgagcgagctcgtctgcccaagctcgagctcgaacgagctcgagccgagcttgtctaaaagctcaaaggtagaataggctcagctcgagctcggctcgagctcggctcgagctcgtgtacctgctggaactggtcgccgtggacctggagctgtgccttcagtgagtctatctcactgcataaaccctaaaccctacaacttttagacctattctacctttgagctcgttctacctattctaccataacctagagctcggctcgagccgagcctattctacctttgagcttttagacaagctcggctcgagctcggctaccgagctcggtcataagtagtataatatatattttaatgataattttttgataagtataattattttctagttaatcacactaataaaagagtagaaaatgattaaaataaatatattatgctaacacatgctaatttattgtgtaaatagatactaatatatatatatatttacctattagtttattatatcaataaggtgaacatgcaatatgaactataaatagtcaagctcggccaggctcggcaaaagctcgagctcggctcggtaaagctcgcgagcttttgctcaggctcgggttcggctcgtttgaagctcgagccgagctcgaatcgagcctaggacgagccaagctcgagctgctcgcgagcctcgagcttttttgacagccctcccgggctctcctcgagcgggggtcgctaccagcaccgttgttgagaggggagaaggacgaggaagagagggaagaggtggatgctgatacgtggggctcacaggggtcccacgttgacttagcatagctaattggagtcaaagcgccaagtaggacgaaatcaagaactatattgccttgggacgaaagttgatacggatttgcgagttcgggacggtctatacatgctactgtggtttaagacgaattttagtctgggcgacaaattaggggaccaaaagtgaacttatttctctttagccgtcagaattgactacggcccaatagacccaatagcccaacaggaaacacattctgaacagcccgttaacccctaacccttccacgctgtcttctccactcccaccgccggcctcccaacccgccgccggcgacgattccggcgagatacctggtcggcggacaccggctcccgcgggtacgagccttctctagacgggctgcgtctctgtccatctcttcttcttctccaacatgaggc

SEQ ID NO: 4203 - DNA, 1501 bp, Oryza sativa
attgctgaatttgattttgtccatactttttacatataaaattcaccaagtatgctgcaacttgttgctgatttgaattttaattgtcaatggctcctgtatttatgtccatgcttatgcctcatggttggtattgcacttttacagttgtcgtaactcagtatctccctttttatggcatggagataactggatgcactacatttccttaggctgaggtcttcacttcttggctggcaaatgttttatggtgtttgtttggttaatgtggtagagttacaaaacagataacatgatttccattgctggaaactttttgtgtaacattatgcgtgcaattgtcagtttccagaatgagaatcaagctttcgtttgcatgcaccagtggattatttaacttaaatttctctgttgaagtacttgtcctgttttaacatctacacaatcggatgaacattagttgtttatattgcgccttaactaatttagataatcctagcttttttgtttgtttgtttttgttttttttccttggcagggagatcatagtttgttttggtgctgtctgtcttggtagtaagcagtatgacaatcgatcaattgcgagaaattagatagttgtgattggcagatgccatagtcagggcattagctctttgtgctattctgtttgttgtgattgctgaattagatcaagaccacattcagttatgtcaaccagggaagagtgttcgttgttgtcaatgtttctgtaacttgattttcttgtataaattttctccaactactgattagcactctctccactcgcttgcaaaaggtacagtgtgagattttctgatatcacatcttctccttcacattttctaaatttaaagctaacaataatttcttcatttcttgcttttgcagagattagtatatcactattcccaaactggtgtctactctttaccgtctttcctggagaataattgctgcaagctttggaatgtgtagtttttttttcatcgagtaattcatccacattttcaaaagcgcggtgcttctcttctttgaactggattatcgagttagcttgtgaacttgtcagaatcttgtatacgttccaatcatgggacacagatctatgtgaaatcgtaaattctgaatgtacacatttccaagctatctcgacattttcactttgaaatcttaaaccaaatcatttgaccaacttcacaaaattctacagaaaagataggagaatttgcacgccttcatagatgggccgatagcccatctgtattgcagcccactacaccggaaaaaagaaagaaaagaaaaaaaaaagaatggaaaggcaacaccgcctatccctccatttcccaaggcggcaacgcgcgtcgcacgccacgcggcaccatttcgcttcgccttccccggcaaaatctccccaaaaaaattcgaaaccgcgccgacgcctccgcttcacgaaaccccaaccggcgacgcggcgcgc

SEQ ID NO: 4204 - DNA, 1501 bp, Oryza sativa
cccaactaggaaacggaaaaaaaaaagaaaaaaaaagaagaagaaaaggcccacgcgtgtagcgccacctgcaataatagcaagcggcttcgtctcctctcctcctccggcgacgcgatcgagaagcggcgccggattttgccgccggcgacgcgcggctgagggggcggcgggaagggggtgggggtggggaggagggattccgcaaccccgcgcccatggcaggttcgtcgcttgcttctgcgactcttcgcgctgtttctcccctctggaaccggttgggtgggtggttaggctgactcgatccgggggagaagggaaggaaggagggagggatcgatcgattcatgaggggttacgtctgctcggttcgtttctggagggggattttggttcctcgagttcctgatttatgttggggattttgtgactgtggttagggtaggaggctaggagctaatcagctaaacgatcatgaaacgtagaattgtcctttagggactaatcaattgtgaaccgtagaattggctattggatgtgtttgtgagcaatatgcgttcaatttctaaattattccaagatttcatgcagatgtgagcatatgctgaggtagtgccaacgaaactgcttcctttctcacaatgactacatgctagatcacctcagtaattttggggatcctaatgacagcatttgcatgattggttgggcactcaattgggtgcaggggagggtataaggtaatgaataggtatttgtaggacggggaacaaatccaattgggcccatgatccaggtgttaactgattccagtcggatttatttatgaactaattttttaaaaatggagtaatttgtgagaaacctaactatcgtggctcagttgtaaggaatgcaaatgcagtgttatcagaaattcggacggtgcggaatgaaggcttattatgtttatgctcatacggaaatatgcagtctatgtttaaatttgttcagttgacctataatcggatttgttgatcttaatcattcagagctcacaaattctgcatttgtgatattcttgtgtgtactagttatggacttagtaattgcaatgtacgcttccatgattacgaattatatcctactagaagtatttgttgcaaagtttttatcgggattgaattatttcctgcctgcctgctggtcccaattgcttacaatcaacattgtaatagcatccgtgactccaggttcttgcagtagatttatctttgcaagataactttatgagtttctcccctagtcttgcaagttatccactatcatttctctgttaatgcttccgagacgttgttttgtctgagtgcacacttcttgtagggaaacttatggtatattttacgtcaagttgaaatatcagtgttttagtatagataagtgtccatctgttttgccttttgagatttacaagaagagtaattgttctcctggtaggccttgggccaattccttaattcac

SEQ ID NO: 4205 - DNA, 1501 bp, Oryza sativa; identical to SEQ ID NO: 4197

SEQ ID NO: 4206 - DNA, 1501 bp, Oryza sativa
ttgcaagatgcgcctggttctttaccctaccaatttattggtagtgctctttaccctaccaattcattggtagtgccataacctagataaatttcgacgctaccaatttttttgatagagcaaaattaatgtttggtttgataccaatatgaagccaaatctattatattattaaaacaactttgaaaggaggtacacgttcgctgtgggggctagaaattcccacattaatcggagaaaaagaaaaaagaaaaggagagtccaagtataagtacaatctaaaaatagctaaaattcagaattaaaaataagcaatatggaaagaggagtccatataggaagccaatacgacattaatcaaaattcaaaataaaaataaaataaaatccaaaattagaaaaggaaaggagagtccaaaagcaatatggaaagaggagtctatataggaacccaataaatccaaaattaaaaaggaaaggagagttcaagtagaaatacaattttaaaatagctgaaattaagaattaaaaataaggaatattaaaaaaaagagtccatataagaacccaatatgagattaattaaaattcagaataaaaataaataaatccaaaattagaaaaataaagtaaaagaagagttcaagtaggaatacaatttaaaattagttaaaattaggaattaaaaataagcaatactgaaagaagaatccatataataacccaatatgagattaattaaaatttagaattaaaaaaataaaataatatccaaaattagaaaaattaaaagagagttcaagtaggaatataattttgaaacaactgaaattgaaaattaaaaaaaataaaaaataaataaaagaacacaatactgtattaactattttttaaaaaaaatctgaaattagaaaaagaaaaataagatttcagttagaaatacaatttataaataactaaaatttgtgataaaaataaatattattgaaagaaaagaccatctaaaacaaatgacgagataaattaagtaacatgcctataaaggagtagagtggtggtggttgatacgacatataaaaattattaatgaaacaccaaatagaatcctaatgacaattaaaaggaaagacgtcaggcaggttgtgaagcaaacgagtaaggcggttgccgggacttctattcgatttttaaaatctcaatgacaataaaaaggataagcagtgggcggggtgtataagagtatagttgcagagccaccgacggttgacgggacttctagaatacaaaaaatgaatttcaacgatagttatgttcgatttttagaatcacaatgacaatagagagtaagcggcggacgggctgtagaggggcatagtggcatcgtttgatatgacttctaaaagttataaaaaatgaaattacaagtccaatatttaaagtttcggaacttctaaaaagtaaaaaaacaccaataataatcatgttcaattttaaaatttcaa

SEQ ID NO: 4207 - DNA, 1501 bp, Oryza sativa
gattttgcaacgtgactggttttgtaatccagattcaaatattttatacatttcacagaagattcaaatacttgatgaagactagatttcatttccagcacagttgtattgatcctcgttatattggtagttttgcattgcgtccttgtttcaaataggatggatggcttttatactgattgctccctggacaattttttttttatccaatggaatggatgagattctacatcgattgatctttttctctttagttagatctctgttttcttctatccaggttctattcttctcaatcttgttatttgtttctcaggagcaacaaatggagaaaatgattttgaatcaggacttccagaatttgatcctgttaagcatcacaacagttactgcccatgggtaaatggaactgtggcagcagcttgctgtagcaacactgaatcaagctcaagtagttcaccactttctggctggcaattaacagttgatgcacttgacacattccaatctcttggtcaagctcaaaatcatgctatgcgatctgattccgcagcctcgttatatatggtaaaattcgatcgtgctcatccctcttttaaattcaccatgaaaatttggaagtttgtggcaacagatagtcatactggcttatgagttgtgacgcaaaataataatttagagtttatattgatgcatgtctatgccatatttggttggccctgaaatttactgacgaaactcatcatctgtgtaccgcaggatgatcatgtaactcctaaccacaagctcgccagaagggcatcagtgagcagaagccatgggaaatgctgatttgaggcccttccacgcatgctagcctttactaatcacccaagtttgcagcaatactataccagtaatttcacagcttatccgaatcaaaaagaaaaaaaaataaagacacagcttctcaatcataagtaacattcgccagagatccaatttggcacatcgaggagcgtatttacatgtaattctttctgaattatgttgggttggacatcatccccagtatgttgcgctgcccatgatcagacaggataaaccggctaattaataatccatgttagttacaccgtgtgacctatatagttgttgctcagaaaccggcaatttgatgtggtgtccaaacgataatatcatagtactgtatttattctgaaagagtcgattcaatgaagttgtccccagattgacatgaacatgtcgcatgtgcaagttaagcttaccaatccattaaagtttattacgattgattttatttcttactattttttttgcttgtatgtaaaatttgaacgcatgaacatgtttgaattcctacaggattattactgcaaacaggctcggttcctggcttgtgggcctgagggcctctgcttccatgcattgtgtgatcttttcctcttgcccgaatccgaccatccaatgagcgccgcccagagtgccacgtcagcaccaa

SEQ ID NO: 4208 - DNA, 1501 bp, Oryza sativa
actggtacgttgttcaaaggtcagttgtccgtgctattcatacagtgcttgctttgagccgtacgactgtccctctgaagaatctactcctacgtactactcctacaactagggtacagtactctgttatgtcacggactcgcaggacgtgcaggatgtagggggtgtttaaaggtgggatgtcttttagttcacgctaaaattaaaaatttggttgaaattgaaataatgtgacggaaaaattgaaagtttgtgtgtgtatgaaacttttgatgtgatggaaaagttggaagtttgaagaaaaattttgcaactaaacacggcctttgtaaagttttggtgtgtcacatccaatattatatagggtatcgtatagagtgttcggacactaaaaaactaattacagaatctgtcagtaaaccgtgagacaaatttattaagcctaattaatccatcattagcaaatgtttactgtagcaccacattgtcaaatcatggagcaattaggcttaaaagattcatctcgcaaattagtcgcaatatgtgcaattagttattattttaatctatattaaatactttatatatgtgttcaaacattcgatgtgatatggtgtaaaattttgaggtaggatctaaacaaggtgtaattatggttttttgacatactcctaccgcagatcatatagttttcttcctttgtttttttgatggcaataggccggatcgggcacaggtagagcgaaaccatgtgaacaatgtgatggatgcgcaagcgcagcgcggagccaactccacataagttgtgtggccaccagagctccatcgcaacatcttttctacataattaccatccatgtatggaataattagtactaataaggagtatttatttcctatgaagatcaattttaaccatccccgctttctaacaggagaagggaaacgatatgcgtactaaactatttttataaactttttacacatatgaggtgtcacattgtgattgaatctttaaccttttattataacttctagttaactcaatcaaatgaattagatttctattagtaaaaagtttgtaagaaattttagtacatgtagcactaaaaaaagaagaagaattacacataaagtattgctactactagttattgctccctccgtcctagaatgtaagaagttttagaattagacacggttattaagaaagtatgtagaaatgagtggtggagggttgtaattggataagttttaaaagtgaatgtatgtgggagaagtgaatggtgaaaagctgtgattggttgtgaagagaatgtagatggaaaatttgttatattttatgataaattttacttcatccgtttcacaatgtaagactttatagcattgcccacattcatctagatgttaatgaatctagacatgcatatttgtttagattcattaacatatatatatatatatatatatatatatatatatatatatatatatatat

SEQ ID NO: 4209 - DNA, 1501 bp, Oryza sativa
gttaaaatttagcaagtatggagaaaaaataccctccaacaacctccaaattgcacctctcactaactttggagagtcaagagtcactctgcctggctattcgtgggccccaccactctccctcccaccccatctctctctccccgtcgcacccgcaagaaggcagcgacgggaaccgcacgacgacgacggcacggaggagcgaggcgccggagccaaccgcaccggccgccgccggccgcgcccgccgccgtcgtccgcgacggctaggaaccgcacgacggcgacggcatggaggagcgaggcgccggagccaaccgcgccggccgccgccgtcgcctgcgtcgtccccagccgcgcccgccgccgccgtctgcgcctaccgccgcccgcgctgtccccagccgcgcccactgccgccgtccccgccgccgctgtccgccgccgccgccgtctgcgcctaccgccgcgcgcccgcgctgtccccagccgcgcccgccgccgccatccctagccgcgactgccgccgctgtctgcgccgaccgccgccactgtccccagccgtctcgggagtgtatagagggagagagagaggaagaggaagagggggagaaagatgaggaagaatgggtatagaggctgatgcatgggtactgctgtcatagactcaaaatagagaggatggatgaagaagctgttggagtaaataacaaatttgacttgataaatgagatggagagttggccaaatagatatttggagagtcgaatttagagagagtgttggagatgctctaacaaattacaacatcaattacaaaagggttttctctatctaataattgaaatattctagtagcaaaaatatactaccaccgcttcatctagtataattttttttaggaagaacaacttcaatttatattatccagaatcttgaaagtgtttgattcagctctaactctatggaacaagaatcttgaagtaagagtctgtttggcatggctccagctgtacctcttctggagctagaatccagtcaaatagtttcaactctacctaaaataggagtggagttggttggagcgctatcacaaaatgaactagagatgtgaagctaggtttagactgctccataactttacagatctatcttctaaaattaaatttaagagttagagctttaccaaacgggtcatacaagctttaccaagcccttaaaaataattctttttttccccaaagtagtactaatactaataattagttttatctccgatcagatagaagtacacaaggcccatgaggactacggggcctaagaagcagcgagcccaacaagcaagcaaccgcctttttagcctttattccttgcctccccacgacgcgtttcttcgtgagctgtagtaactagcaacagcaaagccaaagcccctctcgtcaacgacctcgtcgcgcccgaggcacccaattcgcgccggccatggcggtggcgacgctgt

SEQ ID NO: 4210 - DNA, 1501 bp, Oryza sativa
ccgcccccgatgccgcctctccccctccccctttccccaccggcgccgcttccctcccctcccctccagcggcgccgctccctctcctctccccccgtctcaccggcacggcgcggcgatggcaggatgcggcggagacggcagaccgctccctctccccctctccctcccgtctcacggcgtggcgcggcgacggcggagacggcggagatggccgtccctccccctcttcctcttcctctccctgtcggcctcgacggccatccctccctccctacctctcggtgacggtgccctcccaacggcggcatccgcgctccctcggcgacggccgtccctaaggcaagcgtcgacggcgacgatggcgtctgcagcgtccgcgggtggatccgttagcagtggcggcgaccgcgggcggatccggcagcggcggcttcctccggcggcggcatctgcggccaccatttttttcttttgcaatttttttccatcgttattgctaaccaaatcggattgcatacagatgaaaacacggacgaaaattagatgtgacgaaaggaaaaatacgaatatttatattagttattagttatagatatagattaaatgataaaatatgaataatactttatgcgtaacttattttttaaaattttttcatatatattttaaataaaacggattgtcaaagattgtacacggaaacccatgaatcaacttattttgggacagcatgtgtgtgtatttttttttaagaaaaaattgaagctcctactttaataagaagggaaaatatcgtgagttcgtgacttgttgcctggtggccctggtcacagtcacagagctagccttatctctatcttcttctcttttttttttggtgagaacagccttatctctatcgctttactctctctgtccctggctttcttcgtctctcttcatgtcgccggcacatatccaccaccggctccaaccctccccaaccgtggcggagccccctccctctaccccggcgcccgtccctccgggctccggcatcctcctgcctatgccgctcggcccgtgcttcgtcgcaccgctgccagggctctcctcctcctgctcagaggcagttcggtgacgagcgggttggagcagcctcgcccctcctcgtctggatccagccgcaggcatggccacatcgccggctcctctactgctcctctcctccatctccctgcgctcaccgttcctgatgagggcacggcgactcgaggcgacggctgcggcgactcggtcttccagactcgtcccgccaccggctacggcctcaacgggcgatgacgggcgacctagccgacggatccatcggcgtggaggtctggggccgtcagatttagccgcatccgacctccatggtgacgggctgacggcgacagcgggttgcaggtgcgacaaatgcccctcctctcctctactttccctcggtggcttggccggtggatccatcggtgtggag

SEQ ID NO: 4211 - DNA, 1501 bp, Oryza sativa
aactatttgactggattctagctccagaagaggtacagctggagccatgccaaacagactcttacttcaagattcttgttccatagagttagagctgaatcaaacactttcaagattctggataatataaattgaagttgttcttcctaaaaaaaattatactagatgaagcggtggtagtatatttttgctactagaatatttcaattattagatagagaaaacccttttgtaattgatgttgtaatttgttagagcatctccaacactctctctaaattcgactctccaaatatctatttggccaactctccatctcatttatcaagtcaaatttgttatttactccaacagcttcttcatccatcctctctattttgagtctatgacagcagtacccatgcatcagcctctatacccattcttcctcatctttctccccctcttcctcttcctctctctctccctctatacactcccgagacggctggggacagtggcggcggtcggcgcagacagcggcggcagtcgcggctagggatggcggcggcgggcgcggctggggacagcgcgggcgcgcggcggtaggcgcagacggcggcggcggcggacagcggcggcggggacggcggcagtgggcgcggctggggacagcgcgggcggcggtaggcgcagacggcggcggcgggcgcggctggggacgacgcaggcgacggcggcggccggcgcggttggctccggcgcctcgctcctccatgccgtcgccgtcgtgcggttcctagccgtcgcggacgacggcggcgggcgcggccggcggcggccggtgcggttggctccggcgcctcgctcctccgtgccgtcgtcgtcgtgcggttcccgtcgctgccttcttgcgggtgcgacggggagagagagatggggtgggagggagagtggtggggcccacgaatagccaggcagagtgactcttgactctccaaagttagtgagaggtgcaatttggaggttgttggagggtattttttctccatacttgctaaattttaacttggccagccatttggccattctatgagttgctcttagaacggataacttttcaatggcaaaacaatagaatttctcaaagggagtacctatacatctttcgaaagatttttataatcgtatcacacagatttttaatttttgtattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttaccgtgtaagtttcataaattacactgtaacttacaagaaaatgcactgtaaatttgagtgagaaaatcgagtgagagataagaaaaaatctttcgagtgagatatagcaaaatcgtttctcaaataaaaactgtaccagtagcatggcatg

SEQ ID NO: 4212 - DNA, 1501 bp, Oryza sativa
ttgtgacaggtgggaagacggagggatggatggccagctgacacctacaacatagacgggtcaaaacttcagaaatggacccggagcaaacaacagctacctaattctatttcaaagcactttctttatgctgtcaatttgaagaaaaaaaaaaccctctactactccctccgtcccaaagaaaccaacctatagtactaatattgacacattttagtatgtccattggttttatatgagatggaggaaggatataacaacggaagggagcgtaaatatacttttataatgagagtgttatatccttggtctctttacaccgtgaatgtacacaattatatattcatgtaagtgcaaatacgtggtgtggttaaagtgataatgagcttgctatactatttggtgaaagaaaatataccgcctcctatcattaatatttgacgtcatataatatcgacataagtttgtgtgtagcgtcaaatataatgttagggggggggcatatttttgtaatgaaaaggttttatatctttattctctctacatcgtagatgcacatagtcatacatgcatgtaagcgtaaatatgttgtgtggtgaaagtgataatgaacttgctagactttttttgacacctagttatgctccctttttatgcactgccgcaccatctcttttctcctcttctctgttatcatcgtatatactacatattttacattgaacctattgttggctacgccattatggcatccaccactgctgtcaaactgtgtaaaagatgacataccactattaagagtgttaactataaaccaataccctcaggctatataaaaaatgatttcaacaatattgatgctgagcaataatgcagacacatcgaaattcttgagttaggtgtccaaaggcatttaatcaatatttcactggtatttgacatggacttttatagaagaaaaatacatcactgtagtagtagtatctttttccaagccctgttagcaacagtattgatgtggttgtcctcctactctacctgtatttgtcctcttccacctcataccaaataaaaccccccctctccattgttctcgcagcgtataatctcacccaaaatacacgcaatctcacgccatttgcacctacaaatctcatcatctcatcaatatccatttctacaaaaaaaaaatccatttcagtatttcattgctgtagcatcaaatttattggcattatttgctgatattgcatgctgcattgagaagaaaattaaagaaactgacttggatagcactgcactctagctaccattttcttggcttgtttgcgaaagctgctccatctcctgtgtcctaggctctttccctttttaaccccgtgccacagctagccagccaagcactgcacaaacctttcccttgaagaggccaagaagttatgggagaggaggcagccatggccaccatggagagcgcctaccatgatgagcttgctccggc

SEQ ID NO: 4213 - DNA, 1501 bp, Oryza sativa
gaaaaaaaagaagaaggaagaagccgatcctagggactgtttagaactcagtagacagtagaggtgatggcgtattggcatcgagccaaccgtcacggatgaagaacagggacgaaataagacttgagctatagttgaaggaaacaaaatagacattttctagacaatacgtgcacgataatacgagagcccgctccagtagaaactacttttttgggtattcaaagcccggcccagtagaaaccacttatctgggtcattaaatatcggcccacgtaagagcacgcgagttggaacgccatgggatcccggcccatcaaggctcaccggattcgagcccaatacggactctgctctgtctgcgtgcagtgcacggacggtccggatcggaagcgaggctgcgttggacttgatctgggccgtacattgctctcagggcacgggcggtgcagacgaagcgtctcgtgatcctcgtctcctcctggcggccgcagcgcgtgggttcccaaatcgcgaaattttcttttcccccaaaaaaccgaataaagagaaatctctccgagcgaattcgacgagatcggaggctcggatcgaggtaaattttctcctcgtatttttctttccctgatcgattgtgttgattactggatctggtaatgctctctgttcaagcatgcttgggtaggggacgtagatttgcgcgacgaatcaagtatgttatgcgcgttttttcgcgggatttttcggggttttccatgcgcgttgcgggcgacgcccagcgctgcgttggatttgacttcgaattaagggcggcacggtggtagattcctcgctcgtttagtttttgaagagttagatctcgttccctacgtttcgaatttggtcgcaggttgctaagatttcccggtttgatctgcttattaggtttactttttgtatgtatatgatcatgcaatctcagatttggtgatttgattattgtgcggtgcgaaggttctaggttgacgtgttgtggaggtttctttgatcttattggagccacccttagcttattcggcttgttttgatccgaatttactattaattttggtgcgaattcagagttcaataatccctcttccgtagcatcgactttctcatctctatgaaaaaagtttgtgggagttaatttagaatcactggtttgtttattataaatcgtccccttttctgataggcaagtttgctactgatttatatgaccatgttagtaacaagtaccaacccacctctttgtttgagttggctgtcagattctagaggaattagatctgtgattggaagttactcttataagccttgtgccatttggctgttccaattatgttaaccataaaaattggactttgtcaagtttaagctgaagattttgattttttttttcaggtattctccttctgatttgattggattcgggatctgctggcggggatccatctttaggtaggatttcataatttta

SEQ ID NO: 4214 - DNA, 1501 bp, Oryza sativa
ataggtgaaggggaaaatttttgagaactaaactggccctaactcactatcgtcgagccttctttggaggcaggcacttcattaatatcttcgtttgagaaagaaatattttatttgaaccttttgttacacttttatactgctaaaatagagaggtggtttagtttttaccactattgtcaaaattggttgcctacatgtattaatggaaattcttatattctacttcctccgttttatattataagactttctagcattgcacacattcatatatatggtaatgaatctagatatatacatgtatgcctagattcattaatatctatatgaatataaacaatgctaaaaagttttataacctgaacgaatgggtaataatatcctaatcgactagagctttaacggtggcttcttttgtactaacttttatgccatcttctcttttaaaagatgaacggaggaatgactctataataaaaatagaggatggccggatttatatgtcaatgtggccgaataagtacacattattcattttaactcacatttacttagacagtctactaaatttaaaagcataataaacaacaaaacaaaacatatattatcgttcttaatgatagtacaattctaattcccgaatacctagtgctacatagcattccaattaaattagcaccatctagtttctacataactttataacaatatctttttgagatggtctataattttatttttgtctacatggacacacatgctccactgatctaataaccatcctttcgattgaccaaaagaagagcccacgaaccgcagatccacatccaacactgttgcttgctgcactgcagtactccactgcacctctcttgctcctcaccccagccgcccatcgccgcctgcgcccgcgcgcggccacgccgccactgcctgctgctaccgcgtccgcctctccaagccgccgccgccgccagccagcaactcgcgccgatctgctgcttcttgagacggcggccgcgggcggctgctcctccgctctgtttggccggcgcgcggctccgcctcctgtgcagctgtgcttcccctccggtgttctccctcccgcggcgtgtgacggtagcggaggggcgggactgatctcccgcaatggcgggcgcggtcttcttcctcggcgttcgctggtaatgcgaatctccccctctctctctcgtcggttggtcgagatgctcgattgctgtttggaatggttcgtggtcgtgctatgtgttctaggcatagactgaatcgttgagcagaaacagttcattctgtttgtttgattcggtgtttatatataatatggatctagccacaaaagatctcggtactttttggtagcactagcggttgaatcctgatttccgtttgtttgatttctagggtgcagatgcttgctctagtctaaatgagacctgcaagagctaaaatctggcagtggagtggtgattgttacaga

SEQ ID NO: 4215 - DNA, 1501 bp, Oryza sativa
aaagttacgatagacaccttgctatcgacgggtatatataacacgtaccactcaaacaatagttaaccgtaaatacaagcacccacaccaagtttagaagtcaaaattaaaaagttagtttcgactacaaggaacctaactaactaagctacgctcagttgtataatctaaaatactttaaccacgctacgtgtaaaaaaagtattataaagagacaaaatatatacgttctaaagaaaatgaatacgtttcttctagatgatggaaaaagtaaatggatacattgacatacatctaactcaaaagattccatatcgattctcgaatatggttgaagatgaattggtctatatatatcttgctacgtcaacgtgtgaagccaaaaatccgtcttactaacatgtcatccaccgtgtgttagccgtgacctagaccgattacgttgaatgcgccaaatgagctcaccgacttaaaataatacacaatacaaaaagtacacgacaccgcctagcctcatggcagtccacgttcttagtatcatacaccatcaattcgtccgatatgcgtcagaaagaaattgataaattaaatcgaatccaacttagcactattaaataacacacatgtaaaatttatatatgtgattagtttaacttgataggttttttaaacacgaacaattatatttttagctaattatttttcaaatgtatagaaagatataaagatatgagcgtagtttaaccggttattcgcgcatataataattacatacgagtgtagttttaacatggttagattatttagacttgatacgaatagtttaaatttttggctaattatttttccagagtaaatatatatacagataatatagcaccattacacctacgaaactgacctaaaaataagtccttagaagaaacctgcgatgtggaaaaacaatttttgactaattattttttcagagtaaacaaatatacagataacatagcaccacttaacctgcggaactgacccgaataaaaagtgatacggcaaaaaccatgaggttttacgtagaccggcgcccatccccggaagcaaatacggcaacgcgaccatgttctctcccgccacggggccgcgcgcccggtggctgcagcgtacatccgccgaaagaaaaccccaccaaatacaaccaatccatcgcctcgtctccatataaaaccggcaaacccaagagagaagaagaagaagaaaaagaaagccaaagacaaagcgatcgatcggagaacgaacgaacgaagcgcgtcgcgtcccactcctcccctcctcctcctccgccgcgagcgcgcgcacgcgcgtgcagcctccgcctcctccctcacgccaccaccaccaccacctcgcgcgcgcgcgcactactgcaccaaaccccccgcactaagtggttgtgttcttgttggcgaggaggagagaggggtggggtttgtggtgtcgtcgtccatggcggcggtga

SEQ ID NO: 4216 - DNA, 1501 bp, Oryza sativa
ttgcttctgtgataggcattgtgtcaggttcaccatatgttgcacaagtacttgagtatatcagagtttttacattatatgctgccattgcctcaagcactgtcaatgtatttgatgttatgttgtggtagtacctgttattgcagtattagcacagatcatgtaatagtaacagcattaacaacagattatttctgaaggatacaaaaaaggaaaacaaattatcaactaaaatcacatacatttacattaggcagtctttcacactaatcttcacagttcaaattgctcgtgccaaaagtatgttatcggcaaaaaatgccaacattgaaaaagatggaatgcctatattttccattttcactatatagtatgttttcaatatagattgtcatgtttagcagttttgtttaataatagagataaccaagagcagtttgcattgctctgaacacatcaaaggattgcacatgaacatgcaatatataaataaccaccatctatgtaacatgaatacaagaacattagcacatcaatgccttacctcagtggctccaacgtgctctcaccaacgtaagcaacggcagcaaagtgcataacagcatcgaatgcattttctgaaaatattttgttaacctggctattggttaagtgcaaaacagatcacaccaacacatgaatgtatggaaaaatggctataataaggtattaaagttcacattgtagagaaaaaggatacagctttcgcatcgcctaaatcagcataaataaactgaagcctcccaggctctggaaacaaacgttgaaggactctgacagctcccatgttccctctagaaaggttatcctgtaaagatcacatggaagaaattgctgtaacataaaagctctttgagttaggaataaaaacatgaagctggaataagaaatttaccacaatggtaactcggtagttgtccctaagtagacgaagagtagcatgtgacccaatgtatccagctcctccagtcaccaacacatgagtcacaccaatttcatggcgagagaactatagagcatgtgaatgtatcatgaaaactagatcagatgacaatctgaaatgcttcacaaaaacagctttgcttccaatggaattatgaatgtgctttattggaaactacgatggtgcatagaaaataaccactactagcacagaacacagataaatgaacagtgaattcatcaaatggaatggacgatcaatgtgtttctttcaatcatgttaaaggaacctctttctgtcagacaatatgcgattgttccaaatgaaacttacgtgtcacaattaaatcaagtttgaacaatacaacaacgagaagtgaggactcaacagcaatcaacaattcgacagtgaagtgggctagttgtggagagattcggcacttaccacacttgtactggtaaaaccaggcgactgtttcaacacaatgatgcacatgaccgtgagtgcaacagctacggt

SEQ ID NO: 4217 - DNA, 1501 bp, Oryza sativa
gcgaattcggcccatatcgcgcggatctattcggccctaaccaactaaccaacgccgccgccgcgggcaccgcccacctgcggcggcggcggcggcggcgatggcgatggcgacgagtcgcgcacgcagcgaatcgggcgttgtcacgcgtgcgcgcggtggctgccggaatctgtctgttgtcagcgtggtcaccgaacctgaacctggcagtacgcatgctcggctgctcgctcgcacgcgcgtgcagtcaccggcgcaatctaccattgcagaggagtaggaggagggctagggctaggagttggcctctactagctgctgcattcgggctacgaaagcaaccaaaataatggaggtgactgcctcctttgttcccttcctgcgtcttccacctcatccccccctcgcaacagcggcatgggcgattcttggactctaccctttccgctgacgatgctagctcacccttaattacctcacctcaccacatcatcgtcagaatttcttcacctgaatgtatatatgtaatgatgaaagttatctcttggttttgcagggaatcatcaagatcgatgtcgatcgaattaattaaggagaattgtatgtgtgtaggggttaggggtgaggagaagattgtgttctttgtttctttgctgcttcaatttgcttcaccataccatgcattcttctggttccgagggttttgtgttcagaaataacgcatgggctgcttgctagctagctgctcatcatgttaggtactagcactactagcagcagccagcatcctcactgcacatgtctactcgatgctttttaattgtgatcgtcagtagtcacatctgttcataaaggatgcacatgagcagccaatcagatgctaattaatcttggatcttcaaattttccagaaccagactatcatttttattactagcaattttcttgtcactagttttattcttctatcattatctaaaaataaagtttagcggttttatgagcaaacagtgttggtggttagcagctcaagaatcatgtctaaatttttcagataatacccaagtattaacaaatcctcaatcataattgaaattattgctgaacaatccaaagatgtggatagagtggtgtccggtcatggttgttaggtttgggttttgggcgatctcggttgtagtttctttgttggtctagcgcggtctgtccagtgctagccttctcctgggttgtgtgaaggtgttgtcggcgcgtgggggtggttatttcttcattctttcctggctattgcatcccagggttctagtcttgcaattttttttcctactttattcaatgaatcttcgcaatgtctggtgtaggtcgttcaaaaaaaatattgctgaacaacatatgcatgtaaggattacagattacagtaggacaaacatcatactagtttcacattcatcagtcatgatttctctcaacatttactaatctactgtatatgtcttta

SEQ ID NO: 4218 - DNA, 1501 bp, Oryza sativa
agaacatcacgacctcgcggttttagctataagatgaagtacaaactcatttttgaaggaaaaaaaaaactctctaaccgttgttattttctagcactcattaaaataatgtatttatgctgacgaggtaacaaggggcctgatattttacacgttgtgacgccgccactattctccccaccatcctcgaccaacctcatcgccgggatgcaaggctgaacttcgctgtgtggttcgtgtggatctgagtaacctaagggtccacacagtattcacctcttggctgttgtggaagaagcagttttcgccaccgtcggactacacacccaaaattgcctcgtcggcgtgctggagactagtttggttcgcgtctgttcaagccaaaccagctcaatatgatctggacccgcacgcaggggcagtttggtcactccgcgtaaaatatcgggccccctattgtctcgtcagcatgaatacattattttaatgagcatgatgtttattgtaaataaccatgtaaaaagagtgttttccctcaaaactgagtttgtgtggtgtcttacagttaaaacttcgaatacgtgatattctgtagtaaaatttgccaatttctttcatgttctgccattgttttttatcgaactcaactaacttatgtctaaatattttaaaaaagtttagcagtatgatacttagtttgaatgtgaggtgaggattggttagttagtgacatggaaaacaaagcgcgcgattagagcatattaactattataaatttaaaatattattttattaaaaatcttctctatatatattttttgtgaagcacaccgtttagccattcggaaaatatgctcacgatgaatcaggaagtagctgaacaaataatctacttagaattccctaaatctagtcgcacaattagttctatgaattcttgagttaataatctgatatgacaagcaatgaatacttagaaaaataacaacaccataatccttaagataagataagtagtgactacaataaaagcaataagagttggcaccgccgatgaccgcggcggcggcggtattggcgacatgttcatctaccacacctcattattgtatcattagtcttagaatgtttcatttcgtagctctctacatacactatttgctccattattaaaaaaacacatacattatttgcacaagttttccatgggaaaatcagattggtcttagccgctgtggtgcaaacctgaaactatgcaaggcaggtccacgcctccactagagccatttcagctgcgctgctgattgctgaagcagtgaagctgacctatgcacaccggtttgcctcgtattctctcttatcggatccggttcacccccgcccgttaacccgaaatcacccgaatatatagcgaactttccgtgacacagtggagttaaccaccactccgctaaccaacctcacgagctgagcttaattgatgcgccatcgccgccggcaa

SEQ ID NO: 4219 - DNA, 1501 bp, Oryza sativa
aatttcttgtttggatcgatcgtcagcctctaccatgtatctgagtctctgatgggactttgtttacgatttttggagaggcgcccataaggtcaatcatttcacctaccttgctataggtgatggctctaacttgacttgcaaagaaagagttcgtcaaggtacagtactatgcatagattgtttcttcagagttcagagtagtgagggctttctgcataaagacatatacagtagattagtaaatgttgagagaaatcatgactgatgaatgtgaaactagtatgatgtttgtcctactgtaatctgtaatccttacatgcatatgttgttcagcaatattttttttgaacgacctacaccagacattgcgaagattcattgaataaagtaggaaaaaaaattgcaagactagaaccctgggatgcaatagccaggaaagaatgaagaaataaccacccccacgcgccgacaacaccttcacacaacccaggagaaggctagcactggacagaccgcgctagaccaacaaagaaactacaaccgagatcgcccaaaacccaaacctaacaaccatgaccggacaccactctatccacatctttggattgttcagcaataatttcaattatgattgaggatttgttaatacttgggtattatctgaaaaatttagacatgattcttgagctgctaaccaccaacactgtttgctcataaaaccgctaaactttatttttagataatgatagaagaataaaactagtgacaagaaaattgctagtaataaaaatgatagtctggttctggaaaatttgaagatccaagattaattagcatctgattggctgctcatgtgcatcctttatgaacagatgtgactactgacgatcacaattaaaaagcatcgagtagacatgtgcagtgaggatgctggctgctgctagtagtgctagtacctaacatgatgagcagctagctagcaagcagcccatgcgttatttctgaacacaaaaccctcggaaccagaagaatgcatggtatggtgaagcaaattgaagcagcaaagaaacaaagaacacaatcttctcctcacccctaacccctacacacatacaattctccttaattaattcgatcgacatcgatcttgatgattccctgcaaaaccaagagataactttcatcattacatatatacattcaggtgaagaaattctgacgatgatgtggtgaggtgaggtaattaagggtgagctagcatcgtcagcggaaagggtagagtccaagaatcgcccatgccgctgttgcgagggggggatgaggtggaagacgcaggaagggaacaaaggaggcagtcacctccattattttggttgctttcgtagcccgaatgcagcagctagtagaggccaactcctagccctagccctcctcctactcctctgcaatggtagattgcgccggtgactgcacgcgcgtgcgagcgagcagccgagca

SEQ ID NO: 4220 - DNA, 1501 bp, Oryza sativa
ggtacctagatactatgaggtaccaaattttacactaaacttttgatatctcatggtacctcctcaagtaccgtagaattgctctatttgttatggcaaccggatatcatgcactatagaaaaaggagatctgaattctgttgattatcactgaatatgttcggtccattctagggatgtgcctgtgccaacccgtggacacgtttataggcaaaatttagcgggtaactcgtgatttggctcgcggattacctactaagttaacctataaatatgtttataggttgatccacttataatagatgtgccaagctagatcctgacgtgaaaatccatggatgattacttatttgacttataagtgagttcatgagtcagcccgcttgcatcctgagtccatgggttgttgataagtaaatgaagtcatcaatgccgttttgaccgtttgtaacgcaaaaatggaattacttaaaaaaagggaacgtcagtattttctcctcaaaactttcaaattcatgatattggaattaatagatgggctaaggcccattcgaagattaattctttggaaaatcacaaaagcccacctcatgggatggcatgcatatggggtttagtactaccttgcttattctaggagaggggatctccttaaaagggaggatgccctcctagccacttgaagcatgtgtggtggagagaagaggggaaacacacgcgcgagctcgctcgcctggcctggcaggcggcgcgcgtgcacgacgtacgcgtcgaatggtccgcaaaattggctcctcacccttacgcagatgcagcctccttttgcagttttgttttgctgcgggaaattcgaatttgttttgttttggaaacactccaaaaaatccggtgcgtgaaaacggcatggagtccggataggttacgcgcgacttatccggttcggtttacgcgggcgccctgatcaggcgatctatctctatataaaccgagccgccaccttcacgcaacacacgcgaaatcaatctagggtttgcctcctactctgtgctgcgccatcgctcgtagactactccatcccgctcaccggcgtgcaccggcgatcggtagagcaagtctccggaacctctgccttcgacgtcctgcaccgggagaaggcggcaataaggtttttgggaagcgctttgcgcgactgctccctgttcgtccgcgacggctcgccttcctctccgctcgcgtgcttcgcgccttcgtcgacgctcgcaaccgcgagtagttcctgccgagcaaccggtctttccgccaccttggtacgtgttcgacatgttgcgcatatttgatctgttcatgttttactgcttagtttatatgtgtagatctaatgatgtgttcaatctagtttacatctgcaatgtcatgatttatttatggaataaattaaatcattatgtgcttataatttcaacaatccaaaaaccttattataggcgctgtgattttacta

SEQ ID NO: 4221 - DNA, 1283 bp, Oryza sativa
gccctcacctgcgaccacgcctcgggcagccccgccgccccgccgccgttcacctccattcctcctcgccgccgctcgtcggtctccctccctctccgcgccggcgccgacgacgacgagacgaggcggaggagcgagcggaggaggcgcaattaatgggattggagagtggagtggtgggagagcgtgggagagagcgggggttttataaaatgatcccacgcacatgtactagtagggttttgtgtcactctctctctctctatctctctctctgtgcactcaccaagattaaaaaaaaatcccctccaaaatctactctactcttttttccaataaaaaatatttatctttttaggtcgatggaaaacggaatggtttatgtgaagtttccctcggtactaaatatgccgacatacgatggtcgaaacgacttaagttacacaaatagaaatagattgattatttatgtatggtttctcggttctaaatatgtcctgtgacagtcgaaacgactaaatttacacagagagtacaaatcggtaagaagtagaaatagactgatttctgtgaaaatttattggttttgagtaggtcatagaatcatccaatggtctaaatttaccactttgtttcaattttggcaaaaccatgaacctatccagcaagaaataattatgcatgtgaaagttgggctccaggagacgctccacagtgcaagggaaaaaggagaaaaaaaaatcacatgatacatgattgggtggtaatgtggtaataacattgcaaagtgtgttgaaggggggaggccatggctgtcgagtggggcccacagtgagggtgtcggtggtgaggagggtgtgcattaaacaaaaccaactggaggtcagtcagtttaatcaaggggtgtgtgtgaggtttcttgtgtggaggggttgagtggttactagtgatgatcaatcaatcttggggttgggttgcttatggctgctgcatgccacatttttagggttcctttggctttagccaaaagggcatatcatgcagcaaattggggagctttctgttactctaacagtgtggaaagagctgtaaatagatgagtgtactacaagggtcgaattcggcattgttcttttgtgcgggaactcgcacgggtgtatgtcatccaggtctccaaacttctgagtatcggaatggttacgttcgagctcttcttttagcaaatccaatgcttagcgttacacattttactacgagttgagacaacacagctgacgtagaca

SEQ ID NO: 4222 - DNA, 1501 bp, Oryza sativa
ccaatccaaccaatccacctcagaaccaatcctgaattcatgaaactcacatattccagccacactttgaggtagcggagatcgttcttgtagcggtcgtcgtgccagaaggcacgcacgcactgctcgtagatcaccaccaacccggagcaatccccgcctgtcggaaacgactcctgaacccatttgatgcagctgcgtgtggattaagcagacaaaggcatgccatgagcagcaagcttgcggaaaccgcagagaaatcgccgacatggcaaatctttcggctcaacctactactactagtatacgaatcaatgaaacaaaggggaaattgcttactctatccatggttggagcggatcctcgccgctgtattcgtcgattgcctcgatcattttcctgaatcagtagatcaatcaaacgtaggacgaaaaaaaaaagattaccagagacccgcccccaaatcaagaaatccagagcaaaccaaacccaagaaccgagagacgcgggtgacgggagcggcggcggtacctccgggcggcgaggagggcggcgcgctgggcggggtcggcgtgcgccttgagggcgcggttgaggaggcccacgttgcggccgcgcttcagcggccgcacgttctccttgaacgtctcccactccgcgcacggcgcagccggcggggcgtcgccgcaccccatcagcatcagagtctccttgtcgagcgccaccaccgcctcttccgccgccgccgccgccgtcgtcgccatcgccgccgccatgtgttcgtccgggcgccgctccggagccgaccgtttgggaggagagatattcaaattggaagagatttttgaccgttgagctgaggcggatgctgctgctgctcgggtttatataaggtgaaaaagaattgggcttttcatgagttgggcttggaaagtttatgtgggcctaaaattgttggatcttgattgcgtcagcactcacacggcagagtcactatgaagaaattcagtctcagccctgttcagcttgtcagctaattagccgataaattcatagattaattcaatatactgtagattatgaagttaattaattatttggttagaaaaggttatcgaaacaatgctattgtagaaagatttttgagaaatcatactgttaaaattgtggcccgtcaattcgccgtgatgaatgagttttgttttttttatgttaatgctggagtatatgtgtttgtgcaaacattacgcagaagtttgtgatgatcagttgatcttcacatgaacagatttagtttcttaaatcacatgaaacacaaattgttcagcttttttccccaagaccagttgcgtagttcttaaaagcataactcaaacttgaggcaaaggcgcaaagcttcatgcttgctgaactttctgttttgccacgattaaatttcagttaaactgatagcactctttcatattgcacaaaaagaactccaaacaagtgctctaaatgt

SEQ ID NO: 4223 - DNA, 1501 bp, Oryza sativa
tttctatacagaaggcaatgaattgcaagtgaataattgggttccatttctattttaatttggtgcccttgtatgcaggcttttttgttcaatgatttgctcagatccaaagcttgattcccatcgctttaaagatataattgatgaggcaattgctgaaggtaaatgattatatgctgttgccatataattttatcatataatattgaatacctttttctattccttttctacaatgaagcgctggcaaagtgtttagcttatcatgctaactcaatctattccctgaaacttctctaatggttaaactcctttccatttccttcccttttgtaggtgagctgaagtcaacaaaagcatatgataaatgggccaagaagatctccgagattgaacctcccacaaacccattagagagaagagtgaagtaagctctcattctcttatctcccaagtaatccgccttccgagatgttgtctaccatcagttgctcactactgcatttgcctcaaacctcgtcacaggaagaacaagaagaagagcgaggagaacgatctgatcctcgcgatctcacagcgcagggcgcagcggaaggaccggttcgactcggtgctctcatccatcatgtccaaatgtgacccaaaggggagcagcagctcggagcccacggaagaggagtttgagcaagctcgtcagaggctcgagaaaaagcgttccaagaaccgcaaatgattcgccttgcagcctcccttgtggcttgtgcaattctgtttcatcgagtttgttaaccaggcctatctttgacagatcagattgtctgatattctgatccctagtatctatgtgagattggctgcttctgttgtggtgcaagttcaggctggaatctgaacttcctgctcttttgctgaaactggggccgatctttagcatcactgcatatgtgtataatcaaaatcttaaatgtttcctggatgtgaacttgtgatctagtttctgtataagttaatccagtagctgtcttgagtttttacgcctgtaaacgatataaacaagaatgcatcatcaacagggacgagaggcgggtttgcaatctcgttttggggttgaattgtgaggcacagcactattttcactaaattctgatgaaatttcaaacggaactattcataaaactgaatggtttgggaagctcgaataaaattcgcatgaacaatcttgataaaaactggttggtttttgcgaaattttctgtgatttcgagataggctagaaatcatatttttgagaagggggggggggggggttcgaatggtatttgaaaattttagggtttaaacagcaaaattcgattgaaatttggcaaacgccattagattagaacttcatcgagcaatcacctccactaatcaccaccacccctatcttggcaaacccactaatcaccacccccatttttggcgaagctccaccccgagcttcgctcatggccgctcgccc

SEQ ID NO: 4224 - DNA, 1383 bp, Oryza sativa
cttgcctgcatcagctgttggcacaacagttggctctggaataaacttgacaaccaaaccaaagaaaagaactccagcaaaaaactgcaaaatattattattagttaacaatggttgctgcttattgtatgagatagatcggcattacattggcatggatactataagtataggcaaagcatgactgacccaaaggttgcccttcaagaaaccaatagaattcaatgcattgtgtgccaaatctagaaaggaaatgctcaacataagtccagcggcaaaaccctgtattcagtaacagcaagagatcaatctaccaagaaccaatagcaaaaccagaacttgcttaaaagatagtgaagttgctccattactatagagaacaaagcttatcacctgtagaagcccaagcatcttaagattaggcgtcggattcaaaatcacaaacagcgcacctgaaaaacagaaaattggagcttctaaagtgggaaaatggcacaaagaagccttgctggaaaccctccacatagtattagggacagttttaaaagagagtactcatcgctcaatgtcctgagatcattcacggtcgcaaattgttaaccaaacataaggaagtacaatgttgaaccctaggggttaaaagtttttgaccatgcaacgacatttattacttatcctgttatacatagtacacataagagaaaaccacaccctgccactaaacctgtccagttatgccacttatttacaaattacaacaccccattgctgaccttaaaacaaaaaaatctgatgaatcattgtgatcaattaattttcatattcagaggcctaaatagcaaaacattcatcactcacaagccaaaatggtacaaaagggagatactcactggattctgaactctctttcttaacaaaaatcctaaacactaattttcgatttgctaataaaggatgcatctgaattcgcatggaagtcacctatacgagcggtagcaagacagaattcgctatcgacacctgaaactcaccagaaacacagaaattcccaggaacgcgagattgcgagatgctcagccacttggcgattccttcaagcagcgagcccgcaagctacacaaaacggccttaaatccacccgcggaaccctaggaaaccgcgcccgaccgcaggcagagcagcatccaaacccccgaaacgaaactgttgagaggggaagaggcgcgagggggcggggccataccgatggacgtgctgaggccgccgacgagcgagagggcgagcgccaccagcacctgcgactccattggcggcgagagagagctagggcttgcagggtatcgaggcggggggaggcggggaggagaggagaggagagggaga

SEQ ID NO: 4225 - DNA, 1501 bp, Oryza sativa
aagcagcgagcccgcaagctacacaaaacggccttaaatccacccgcggaaccctaggaaaccgcgcccgaccgcaggcagagcagcatccaaacccccgaaacgaaactgttgagaggggaagaggcgcgagggggcggggccataccgatggacgtgctgaggccgccgacgagcgagagggcgagcgccaccagcacctgcgactccattggcggcgagagagagctagggcttgcagggtatcgaggcggggggaggcggggaggagaggagaggagagggagatgggggaagggaagcttttgctgcggcggcgtctcacggcgtgcgtacgtcagcagtttgatgagagagagagtacggcgtcttttgctaatcacatgcttatgtgctttgggtttgggttagtcaatagataggggaattttgtcttggtaattttttttttcttctgttcttttttttgttgtctttgtcagggcatattggcaacttgtgttcttggaattttgtattttttaaaaaaatatatatatcgcgaatttgatatcgtggatcgtgcagattcgacggtcgagatctaactggatgagcagatatagcaggtcgaatttagatttggttgagatgaagttaagccaccaaaaacaaaagaaaaagtcattaccatgtgattgattagttgagttttaatattctaaatcaacttctatatgttacgtccgtcccataatataagcgattctggaggaatatattttctagtattacgaatctgaaccgtctcttagtctagattcgtagtattatgaagtgtcacatctctttatgattttagtaatgtgacgcggataacatgatgtagattttttaaggagaaacaatgtactatactccattcgaactggtaatacttatcattttgaagcagagtaaagtcaaaccttcaaatctttgactataaataatttataaaatatttatcttagaaatatgaaaactatatgtatatattagttttaaaaatgtacttcaataaaattatatatttgtgatatttctatatatattataatagaaaatagtggtcaaatatgtttcttagactatatttttaaaacgacaaatattatcaactcggagggagtagtaatatcaatattatttatcagtttcataaaagctaactgaaacaatgtagttgggctaatacaatagccagccacatgaatcatgccatccacccacctactcctgcgtccattctataagcttgagcggcagatggttctccatgccacaaaacgacttgtgttaaagatgtttaccgttttcgataaatctataacgatctgaatgtattttaaacaaaaaaaacaattaaaaaggaacaaatcaattcatatgctatatttaaattgccataaaataacggttacaagcttacaagtgtggatttgagcaggtacaacgtcagaaaacaaattaagcaacatga

SEQ ID NO: 4226 - DNA, 1501 bp, Oryza sativa
tatgatcccctaaaaatcatgagtgattcgagatgaatcgtacttcagtgtcaagtatatgcaaacggagagaggatttcctttgagctaaggaattcattcatctttgggtctgtttagttcacgtcaaaattagaagtttggttgaaattgaaacgatgtgatggaaaagttaaaaatttatgtgtgtagtaaagttttaatgtgatagaaaaattgaaagtttaaagaaaaagtttggaactaaacaaggcctagtttacttcaaaattcgtcctgtttcttcctctcttttttttttgtttgtgagtacaaccaaacttgaggatgatatactggttcattctactttgcgcaaaacaagaaacggattcctactactacttcctactgcctcactactatgcctcctcttctactaagctcaacgccctcttcagcggagacctcgccgccgccgccgccgccggcgcggcgcctctcgccggactcaggaacacggcgaacacgccgagcgtctgctcgttcagcttctcgttgaacacgccgtcgacgtcgccgtcgccgtcgtctctgctttgcgcttgcgccggcatgacgtgcaccttcttcttctgcttcttgccgccgccttgccggtgtcgccgccgccgctgtggcctctcgccgacgagcgccaggctcgcgcggacggcgagcctgcccatgtcggcgctggacagcggccggccgagcatcgccctgggcagcacgaagtagagctcccccggccggagcggctcgccgggggacagcgccggcgggcggtcgtcgaagtagagcgcgtcggagttgcacacgaagaaggacgccgcgtcgtcgccgccgccgagcacgtcggagaccaccgcgacgcagggagaggccggcagctccctcagcgagccgtcggccgcgatcaccctcgccggcggcggcggcggcgccggagcttccgactcgacgacgatgtcactctccggccggtagatgcacgaaagcttcgatcccattgaaattttcgtgtgcttttgtgtgtgtttttgatgagattaaggagagttgagtctgaattttttattttgcaggtggattaaggatgaagaagatgtatttatagagtggcaaaagcaaagggttggaccgggtgtctttccattattcaaaacaaaatagatgatgcataattaattaattaaggatttgccgggactgatagggcactgatgaattttcattgaggatatttttttctttattaattgacacatctggattaaaaaaccttattgtagctaaatcactttttctagtaagaattggtgtggctaaacctctatatgtctataggcgtatagacatggtaaatgtgcgttaccaatttttttataactttaatactaaatgtgctagttttggttgaggtcaaccaattcgtagtgcccatattttatttggttcattctagaagtttattcaccac

SEQ ID NO: 4227 - DNA, 1501 bp, Oryza sativa
cgatgtgtcgtcgggcccatacgtcagtgataaaggcacggtgcagtcgactgcaaaggatctcaatgccctgtggtagtgtatagtactatatagtttgtttctattctttaccggcgttatcttttgatgatgaaagtatatactccctcagtacctaaatatttgacgttgttgatttttttaaacatatttgaccatttgttttattcaaaaacttttatgaaatatgtaaaattatatgtatacataaaaatatatttaacaatgaatcaaatgatagaaaaagaattaataattacttttttttaataagacaaatgatcaaacatgtttaaaacagtcaacagcgtcaaacatttagggacggagggagtataactatagtatactccttccatcgcaggataacatttttactcttgtgtgttttaaacaagataaaattttaaaaagaatcaaagtgcttatcattaataagaaagtagtactggtaaagcaagtatataaggtgcccggccgtaaagtatattgaaggtaatctgatttgtggatcgataataagtagaagataaatgtgaatttattttgggagaaaaagtagagttaaaataaagttattttagagagtatggactagtaatccatcactaatcactatatcattgggctagtttaggttgatgctaattttttctgctactaaaatttttggtaacttcaatagtgtcaaatgcatgtttggttttgataccaaattttatctataatagttcaaattcagtagttctatctatttagggtaaaaattgtttcaatccaaacaagctcatcttgttccgtgagcgggtctatctattagagcatccgacaaatatagcagatatcttaatttaatttatactggtttccaagttgtaattaagaattattcatatcaacactcatgatagtagcatactcccttcgtctcataatataaagaattttgagtttttgcttgcattgtttgatcactcgtcttattcaaaaaattttggaattattatttatttttttgtgacttactttattatccaaagtaatttaagcacaacttttcgttttttatatttgcacaagttttttgaataagacgaggggtcaaacaatgcaaacaaaaactcaaaatcccttatattatgggacggagggagtaacttattatattcagttatctcataaccttacttacatctgcatcattcagtctactaaccacaatacttgaccaaaaaggcaaaaagtaagaaattatgttttttttaaaaaaagtaagaaacttattttgttcatataatttcccaagaggaaaggggcttaaacgaaacaaactcatcacttcccccatttcgcactctatatatacaccatccattttcagtctacgcatccaacctccaaaccagcaatagaaaattccaacattttcgccaagatttcatgggattgaagctttcct

SEQ ID NO: 4228 - DNA, 1501 bp, Oryza sativa
tgtgacttactttattatccaaagtaatttaagcacaacttttcgttttttatatttgcacaagttttttgaataagacgaggggtcaaacaatgcaaacaaaaactcaaaatcccttatattatgggacggagggagtaacttattatattcagttatctcataaccttacttacatctgcatcattcagtctactaaccacaatacttgaccaaaaaggcaaaaagtaagaaattatgttttttttaaaaaaagtaagaaacttattttgttcatataatttcccaagaggaaaggggcttaaacgaaacaaactcatcacttcccccatttcgcactctatatatacaccatccattttcagtctacgcatccaacctccaaaccagcaatagaaaattccaacattttcgccaagatttcatgggattgaagctttcctgcatcagctgccggcgacgctcgtcgtcgcaccagccggcgccggcgccggccagggtcatcaccgccgacggctcactcaaggagctggccgtctcttccgccgtcgccgacgtgctccgcggcgagggcgagggccggtccttcttcgtgtgcaactccgacgcgctctacttcaacgagcagccgccggcgctggcgccgggggaggcgctccggccggggcagatttacttcgttctcccggcggcgatgctcgggcagccgctatccaccgccgacatggccgcgctggcggtgcgcgcgagcgccgcgctcgcggccgcggccgccaaggcgccgcgacgccgaggggttcgccgcggcggcggcgacaggaagaggaagacggtgcgcgtcacgccgctgcgggacgagcggctcgacggcggcgacgtcctgctccacgagaagctcaacgagcggacgctgggtgagttcccggcgtcgtggagcccgccgaagagcggcggcgagaagctcgccgcggcggcgcgttcgcggctgaagcgcgtgctgagcatcatccaagaggacgccgagtgaagatagatgaagattcagctttttgtcccccttctttttaggggaaacaattttttcgtattttttttcagaagcttagagcttaacacaagtttaaagctttaattaatttgttcaatactagactagatttagaagggaaaaaaatacccggggagaagagatccatgcatgatcaccccttgtaaatactacttcaatctgtagatacaatcatacaaacctacaagaatatataaaagttgattttgtatttttatgtacatttcccagctgctatagattgcagttaatggaaactttcaatctcctgacgcactgcaataatcgtgcaatcagtaaaacactgacgatcgaaatgctgctactaacttttcagtctacccaataagaaactcaaacttcaattccactgcaaaaaggggattaaacagggtaattaacacctactgacatgcttagcatattaatcct

SEQ ID NO: 4229 - DNA, 1501 bp, Oryza sativa
ttaagatgagagatactctaaaatcaagtgttctcaggtacaaagagtaggaccatcagactgaccaaaacttgtgaagacatgcctgcatcaattagcaaaagttctttaaaaatttcagttaggactgatgctgtctgaaaatctgtatacacacgaaagattagaagattaatctgtatgcacacatcatggatacgtacgcgtgatccgtcgacttacctgtcgaagcaaacgtgatagtcttgcttcttgaattgaaaagcatgattttacacaaagttgattatacaagttgatcagatacaagttgattagataagccatgggagtagtagttaagcactgttggtatggaaatggaattagcatgctctaagtcactttgcccaagttgcccaacaaccaacggggtgtgaaatgagaagtgacccattgttgaaatgaatccaaatgttagacaatgcaaaaggtgttataagatacaggattttcttcttgtttttttccctttgatttcagggaagacgaatgcacatgcacacacattataacgtaaataggccacacgcctatggacataagtatgatttctaaactatgtttaaagagacagaggctgctgtaaatccttcattttattaaatttatactaaaaatgtaccaacacgtataatatgaaaccataacggacgaagtcatacagacatgaattcacaatcaaatttattttctcaagataaaatgattttctaattgcatgggttgtcattaatgagtccaaattaataaatgcctaggtatggggtatggctatttcctctgcattaagtcatctcctttcctttttttttctttcaaaggcgtaaaattaaaactatcagcatattagttctctgccctacgaaattattagtactgccaaaatcagggtaaactatggcactactaaagaattggtaaggtaaagttatctaatgtatgtttggattgtgaccaatataaagccaaatttaatattgtggtgaataaacttctagaatgaaccaaataaaatatgggcactacgaattggttgacctcaaccaaaactagcacatttagtattaaagttataaaaaaattggtaacgcacatttaccatgtctatacgcctatagacatatagaggtttagccacaccaattcttactagaaaaagtgatttagctacaataaggttttttaatccagatgtgtcaattaataaagaaaaaaatatcctcaatgaaaattcatcagtgccctatcagtcccggcaaatccttaattaattaattatgcatcatctattttgttttgaataatggaaagacacccggtccaaccctttgcttttgccactctataaatacatcttcttcatccttaatccacctgcaaaataaaaaattcagactcaactctccttaatctcatcaaaaacacacacaaaagcacacgaaaatttcaatgggatcga

SEQ ID NO: 4230 - DNA, 1501 bp, Oryza sativa
tctcttaaattatttagagataatatctttacaatataatagttgagacgacgaaaactcaaattttgtttattgttgttctttcttgttttttctcaccctcatgtaatcatgttttctttctgtaagtgctaagaatcaatattgtgctgttgttaactatatcaacgatattttgtttattttttttcacaaatatttctaattagcaaggttaatagcttatgatttaatacgggttgtacacttgtacatggccttacatgtgccatattttggccaacaaccaacgttggattgctagagctatcaactcttcttgccatgtctgaaactacaaaacccatttatcctatcttactataaagttatcccccactaactccttaagcttaacatgcaaagatgccacatcatcatctactaatccactaattaacaagatgtcacatcatcatccactaacaatcatcacatttaaacatcatgcaaacatgctatatatttatagtttttataatttaagagcttttcaaatacaaacatgttaaattatcattcaacacaattcacataatgtttcaatgtatatttttattatgttttatgatatcctatatacttatatagttcatcctcacttagttagtgcttaaatgattaatctatggtccaaattatctttctccttttttcctctaattaagtcatatcacatcaattatttttagcctttagatgattaatttacggtccaaactatctccctacttttcttctttcataaagtcataccaccttactttttacgtttgaataaccattctacatactatttaaatttaaattatcataaaccacattaatttacttaatctgatgttatctagttattttacacgttattttttttgttatcatattaaattcccgcagcaatgcgcggggtttcacctagttattactatgggcatatttggtgcagctccagatatagcaacatctctcttggatcttaagcctaaccaaacaatttcagtttcatctaaattggagtggagctggctagagcgctctcacaaaatgaactaggctaaataatctgcaaataaaacttttatatacgtgttcttaacgatctaaaaagcaaggttgaaaaataaacttcgatgagaaaacctcaaaatcaactccaaatttaacgttgaaaattcaaaatttggctaataagcataagcataagtgaaaagatgaaactgctaaaagggtggagctagatttatactgccccacaactttatactagacccaattcatgaagttaaatttagaatttaaagctctaacaaacgagtcgtttggttctataccaaacaaaattcccactataatggaaaacaattttaatataatctaataaataaaagaaaagaaaagaaaaatcacccgctcccctgcgatcccttctcgccatttccgcggcgccaccgcactccgccac

SEQ ID NO: 4231 - DNA, 1501 bp, Oryza sativa
agtgcctaaacaattaatattgtcatcactgtacaaatatttaaagctagcacatttatctagtactgcatttgtgtgtgcaggcacaaacaagcatgcacttgtccaaacctaaaataccagacacgctttacctggatgcaacatcatgatcagcaaggtagtaatatgctcggccacgaagcaacaaggcatccaggttatcttcatcttccttcagaataaatcctgtttctgagataacagttgagtagtctttaagtgctagcaatgctttagccttgagaagcttcgcctgaaaaatccatttttagtactgcagcttactgagacaaaattagatgaaatatttatctgtccatggttcctactatcctctgaaatatacctttaagcagtctggagaaaaaacaagcacaattttgttgatgtaatccaggacttttgagaagtcatgagactcaaactggccataagcagactctaatgcattttgagcctgaagcagttgagataattccttttccactgaagaactcccaggttttagctccaggtatttgctatagtcaccctccgcttccttgtacctagacttcagaaaaaacacattgaaacgagtaagggatacggaaaggtgacacatacgtgtaaaactgacaatgttataagtaggcacatatgcttaacggttctttaatggagtctttcagatatggatgtttttttaataataaagtttagacatttttaggacaagagaaaatgggagtttagctatctggcggtggcaagtaattatttttctggtcagtaactttgaactgaggaacagatgtgaatcaaacatgaatggattataatctaaagtaacggatacaacttttttttacctgcacttgtgacgaagcacagatgcacgctgcctgtaagcttctgagtgatttggttcaacctccagcacagcatttagcagaccaagtgatccatcatatttccttaggttcatcatttctaaggctcgtttgaacaaagtagagggatcattatcttggccttctgaaaaaatgaggggaaaaaggatacttagtctaccaggaagcataaaggaaacatccattttgtgtagacgtagtgctgattggaatgaaaagaaacttaggacattgctgatccatgaaattaatatgctgaatagaaaatttaggatggagtggttccgttaaatttcatgagatgaacccatgatggagcagttaataggatccaaggctggctctagatccaaatatcttgtgttagaaacgatccaatggtatcgcagatggatgcagagcactgaggtggtcgaatgagatgacgagtctcgcgttcatcttatctgtatgatggatgattcacttccaatatttgccatttgggggtggtggggcgaagaggaagcgccgccccacaagagagagaagacgggggtcgcagtaccttgagcgaagacgaagaa

SEQ ID NO: 4232 - DNA, 1501 bp, Oryza sativa
gggggtgactatgagcttgggggataggagcttggacagcgtgatgaggtagaagcctcatcactcacgcgtgcaggtgaagacgacattgcagttgtggttgggacccgcgccgcaccccccctgcgtgcgcaagtccatgatgtgagcgctcccggccgtcgagcttttcctcgccgaccgacacccttctccccacccattggcggatgcccaggaggtttgggttgagatgggaggaggggagtgaagtggaagaagattgccggttaacttgtggggtccacgtgggactcagccaccacatcaacaaaaccgaaaagcaatactaccttgggatcaaaagtgatccgatccggttttacaggattagaggtttcatggccttttaaactcaacaagaagttagggaaccttagatgaacttttttgggagatgaaaaattccagcctcatgggcctgtgcatatgacccataggcaggcgacgacctccgcctccccaatccgtcccggccgtctcctcgcccgccggccgccgccgatctccatcctgccagctgaggtggcgccggcgtcctcctgctcccgccgcattcgctcaccggtgagcatcctaatccatcccatccggcctcggcctcggcctcggatttcgcctcctcgcccgccgcttccgccgcgagcagaggtggcgcccggcgtcctcctgcttccaccgcatcgtcgctcgccggtgagcatccttccctacccacacctcatcagctattctgcgttaagcgttatccctggttcaaccgaaacagggttagatctgcctctgctcagttccacctactttcaacttgttaattttgatttttgtttttagcggatgtaatttggttactgaatatcatccacaaacccttagaatagttgcattagaaagaaaaatgtaagctcatataatttgtacttatccaaactcagtaactcacataaaaatttcttaagaagagtagtcacacacaatatctttttatcaaggtatattcttataagaagttttcaacaagatttgcttgaaaatttgagtctaatttagcaggcagaactaagagagcatggtggcgatggcgcggtggccgtggagggtgctgctgccgctgcttctccttcactcctcccccgtcttcttcgtcttcgctcaaggtactgcgacccccgtcttctctctcttgtggggcggcgcttcctcttcgccccaccacccccaaatggcaaatattggaagtgaatcatccatcatacagataagatgaacgcgagactcgtcatctcattcgaccacctcagtgctctgcatccatctgcgataccattggatcgtttctaacacaagatatttggatctagagccagccttggatcctattaactgctccatcatgggttcatctcatgaaatttaacggaaccactccatcctaaattttctattcagcatattaatttca

SEQ ID NO: 4233 - DNA, 1501 bp, Oryza sativa
ataattttcatgaacacaagagtgtcaagcaggcaaaaattgttttatatctaggacaacctatatgtttcatttataaggcaatatgattttatagggaatggttatgaacatgttgttcttttcatctacaaaagttagcaacaatttatacgattatcatatgaacacgttatctttttattttataccggttcatattatttcacagtattactgcaatagaaaaaaactaaattccagcactataataagaaaggatttaataattaaacacaagtatcacaccaacaataaagagaaggaaaagggacacgctctccctctcctccatcttcttccccagcaagaaagaaaaagcccctactttttataaccccacatctcccagggacccaaccgcaaaaccccacaccctccctccgattcccatccgtccaaccacgatccaacggcccacaaccccaccacgtggcgtaaatacacgtcgaggcgaggggcaaaccggtaatttccccgtcgccatcgggggctttcttttttatcagtgtctctctctccccccacccccaccttcccctgaagagagagagtgagagagagagagagagagagagaggagacgccaccacgcgcaccgagctcgcgattccaatccccgcacgcctcctccgccaccgccgcctcggcctccgccgccgccgcgaccagggttagggtttgccctcttgctccccctgcctgattccaccccccccccttgagtttgtgggtgacccgtttgatctgtgggcttctttttcttttttttgtttttttcttggggtcgattcgattcgatcgatcgatccgcgtggtgctggtgttggggaggggggatcggttttgggttggtgcggggatctgatgtggggggtcgttgtttgatttggtatttgatgtggttggttattggttattgggctcgaggggaaagcgtttatgtttgattttttttttcggttgtgtattaggctatgtgatctttcaggttgaaatgattagattcgcgtgagtttcctgatctttttttggggttgatttgttgtagaaccgtgggcgattaatcattactcggggtaaatgtgagtgggtaaaacgtgttacagcagatttacggtgtttgaatttgatttcgtcgaaatggataggcgcgtttggttgataagatgaggaatccacttttgtgatggcgatttcgttgcgcctcatagaaattaggatcttgtttcataaagtgtaagctcgccgcagtgggttataggttattttaaaagtcacaattatatggaaatttcgataggaaaattgtagcaactaggtgcttcttggattatcttaccgcccgatttaattggacactagttgatttatccgtatgttaaattttaaatttgtttcttatacgcatttcggtattgagttttgcattgtttgtttgatgaacagatcacagttgcga

SEQ ID NO: 4234 - DNA, 1501 bp, Oryza sativa
tctctcaagttgactccctatccatcatcggcaatactctcctgagatctcaagacacacttacatatgaataaataagaaaccatattcaagcattagttcttttccaacttgactcaatattatcacacaacagtatatataacatacgtatagaaatcatctggaagccataagcaagaagcaatcattgttaatcaaaaaatcaactccaaaccaactccaaacaggagctagtcaatcaaaccgtctggttggccggtttgaccgccaccatgcctacagtttgaccggtgcctactgtctggtcccatacagagacaaaatcacttcgccaataaatcaccatatatcaaaaccaatacaaataaaatctcatgtcaattgttcatcacaataacaatcaaaacattgattttaccgttttggatgtgtaaggcacactagaacttttaaaattttgaatgtcaatatcttttttaatatttagatcgggtgtatgaaaaacaaacatatcaaatacatatttttctcacagtatcaaatttttgtcgggttttacggatatactaaaaatactccaaatcgttaggcctgtccaaagcaacatattttcttgactagagcatatgcatcttataagaactagacgagaaatgttattgttatatatagttttgttaggtctcagttgcttgaaattttcttattttccaataatcttaattcgcatagcatatataagtttgctggaactttaagctagcttgctttatgttatactacattgttatgggttaatctagatgtgtttctttaatatatattcttctctgtttttttccttttttgatttcaagttaaaagagcatctaataaacatgtgaattgttggatattgatgttgtggttgatatatatcatgatagataaaaagtggtcattcgacgagtggtgagttaaagcaaaaaaaaaaaaacctaggatttaactctaacctgtgcatctggttatccctgggcaatctaaccctggttaacaaaaaaaaaagttagtacagttggttttaaattcttacacgacatgatacatgggttgcacagtaatgtggttgctgttgatgcagttgtgtgattgttcgtgtcggcggttcaacaggtctgagaaaattgctgctgatcaagggaaatctttttgtgtggccctagagtgaaaaatgacatttattatcttcgtaatcaataagatgccgccgaattttgtaaatttatttttagaaaagtatggaaatgtaacagcatggagaaatacttatattagtttaatactttcaaactactccctctatcccaaaatatagctacttctgatagtacatattttagactagtcaaaagttaaaactaaaacaatcaggattatgatatattaccatcaaggtttctggaactatataattcactcatgtctggccaaaggttcaaaccaaagacagttcttg

SEQ ID NO: 4235 - DNA, 1501 bp, Oryza sativa
ttttctatacagaaggcaatgaattgcaagtgaataattgggttccatttctattttaatttggtgcccttgtatgcaggcttttttgttcaatgatttgctcagatccaaagcttgattcccatcgctttaaagatataattgatgaggcaattgctgaaggtaaatgattatatgctgttgccatataattttatcatataatattgaatacctttttctattccttttctacaatgaagcgctggcaaagtgtttagcttatcatgctaactcaatctattccctgaaacttctctaatggttaaactcctttccatttccttcccttttgtaggtgagctgaagtcaacaaaagcatatgataaatgggccaagaagatctccgagattgaacctcccacaaacccattagagagaagagtgaagtaagctctcattctcttatctcccaagtaatccgccttccgagatgttgtctaccatcagttgctcactactgcatttgcctcaaacctcgtcacaggaagaacaagaagaagagcgaggagaacgatctgatcctcgcgatctcacagcgcagggcgcagcggaaggaccggttcgactcggtgctctcatccatcatgtccaaatgtgacccaaaggggagcagcagctcggagcccacggaagaggagtttgagcaagctcgtcagaggctcgagaaaaagcgttccaagaaccgcaaatgattcgccttgcagcctcccttgtggcttgtgcaattctgtttcatcgagtttgttaaccaggcctatctttgacagatcagattgtctgatattctgatccctagtatctatgtgagattggctgcttctgttgtggtgcaagttcaggctggaatctgaacttcctgctcttttgctgaaactggggccgatctttagcatcactgcatatgtgtataatcaaaatcttaaatgtttcctggatgtgaacttgtgatctagtttctgtataagttaatccagtagctgtcttgagtttttacgcctgtaaacgatataaacaagaatgcatcatcaacagggacgagaggcgggtttgcaatctcgttttggggttgaattgtgaggcacagcactattttcactaaattctgatgaaatttcaaacggaactattcataaaactgaatggtttgggaagctcgaataaaattcgcatgaacaatcttgataaaaactggttggtttttgcgaaattttctgtgatttcgagataggctagaaatcatatttttgagaagggggggggggggggtcgaatggtatttgaaaattttagggtttaaacagcaaaattcgattgaaatttggcaaacgccattagattagaacttcatcgagcaatcacctccactaatcaccaccacccctatcttggcaaacccactaatcaccacccccatttttggcgaagctccaccccgagcttcgctcatggccgctcgccc

SEQ ID NO: 4236 - DNA, 1501 bp, Oryza sativa
acgacgtaagcaagagcatgcacattcactaagacacattataatgactaatgataaacttcatcgattgttgggagtttcataagatagctgatcataactcataaatatgctcaattgctagaaatttattggtatatctttttatgaccatatagatcaaatggggatcggagtaggaatttaaaacacacttgtcatatactccattatttaagtatatatgtgttttttgcacgtataaatacctggaggttgttgtatctgttgaaggtcttgcggcagacggggcaggagaactgggtggcgccggcgaggatctgcgccgccgtcgggatccagtactgcccgccgccgccaccgccgccgctcctccgcacgctctccacctccacacccacgccggccatggcgccgccgccgccatcatctccagcaactcctgtactagaagcactagccccatggttcgccatcgccggcgacggcgacgccgacgccgacgagacggccggtaggcctatgcgcaaggcaaccgtgacctcctcctcctcttcctcctgctgtttgttgcagctgcagcaaccgtaccggagcagctgatgacgatcatggccgccatggccatcatcatcttgctgctgctgctgctgctgaccactgctgctgatgcaagaagaggtagatgaaatgaggctgaggaaagggaattccttcatgagctcgggttgatgatgatggccatggcctctcgagatcaggttggtttgggcgtagtcctccatggatggatggatggatggatcaatgcgagctaaggtagtagctagggtgcatgaagaattttgcagatgatgtgatgctgcaggggatatagctagctggggacgacgatgacgaaggggtattgtggatatcgtttgatttttataagatgtgggttggattaatttcacgtacggcctccagaaaatggagcttgacattatttgtaggacgaatcgaacgatgtcacttttaataatctaaatggtgagaatatatatactttcgttcgttctaaaatataaagacgcaactgataccaagaaataattattatcacctttttatttggatcaccctaataaataaattatgtacacacctaataaagttagagataagggtggaggatttaaacaaaccaatttaaacgagggaagctagttaactatatgtatatgcatatatgcacgtcttgtattataaaacatagaaaaaaaatagttgtgtcctaatattttgaaatggattatagagtaatatttttcagatgtatgtaaacagctagtacgactattatatatcttcttcatttccttgtacgtcctgcatgcatggttgcgtatatatgtagtgacgacaatatgtacggttagcataaagttaaaatataaagaattacatttaatgtaaagatagtagacatgattctttgaaggtattacatatgctacca

SEQ ID NO: 4237 - DNA, 1501 bp, Oryza sativa
tttggatggcccaggcaaaaattggaatgcaggcttgctccgcaagaagaacagaacacggatcacgccacgcttaaaaatgcaaacatgaaactacttataaaataaaataaagataagtaaaatccagagtgatttgggctatgaaaagcccatttctgcgcggcccaccaagagacgcgggcccaaccaaacaacgcagcaggagagagggaggagctgatacggtttcgttctcaatgttagtaccacctcgcggattctgagcgaggcggggcggaggagcgtgtataagaggaggcccagagcaggagagcaactcatacctttctcggccttttggctaagatcaagtgtagtatctgttcttatcagtttaatatctgatatgtgggccatgtgcccacttcgatgttaaatttattttttgtgagggagggcccaccacagtggctagccactggggccctcgcgcgtcgcccagtcgttgcactgctgcccgggcctggtgcaccccaaccaaagcatcaattaaatttttaaagggccgtttgttacgcttggcccatcagacttttcgacaggccgattgttatctttcattagacttaaaccctagattttcgatttacgaggttaattgaccatacgtgggatattattttgttgcaaaataaaaaggtgtttaacgtggagtattttttaagttatttgacattttgttgcaaaattattatgcagtatagggcaataagtggaacgttgtcaagaaaaaaacccagaaattgattttcgattgcactgggaagttatcaggctcagttcacttctattgatgattaatactctgtcctaaaaaaaaataattctaacaataaatctgattactgctgtcctacaaagaattcaattctagcaatgaacctggatacataggatacggagggggtaatattctgttccggttttgttagcaatttttttaaactgtaaaaaggtgtgttttataaaaaaaatcttttatataaaaattattttaaaatatcaaataaatttatattgcaatattaaaataactaaaacttaactaatcacatattaatatatgtttttattatttgtgccctaacttcttattattcactcaaataatttcattggaaacgaatgggaccttaaatccgagaaaatgatttttatttcaatttgcaagattggggtgcagttcatttatattctttttccaagaacagtgagttggcgatgctttgatccagccacgaaggcacaaagcccaccacaccactccactccacatcgcgcggcccaacacatcacaccactctcttccaaactccacatctctcacctcctctcgcccacccaatcccttccgccttctacccgccgccgccgccgcgacgagccggaaaccctagccgagctccgaggcggcgtgcgcgagcgcgagcgcgggcgcgggtgtgggggagccgagaga

SEQ ID NO: 4238 - DNA, 1501 bp, Oryza sativa
cagatctggtttaagcagaccaaccaatctgaaaaagaaaaacacatgccaactcggcgaatcttggaagaaaaactacaaaaacattagctcgcctttacgaaacgagagtcacatccgctcttagtctctctctctctctctctctttccaaacctacaaaccctagcagaataagcagcaaaagggcacgaatcggggaggctcctcgatctaactacgcagcgaggaaaccaaatctcgccgcggcgggagagagggggatgcgattcgggaagacgagagcaaaggtcgggcacgggaaaggggaggagagggttgcgactcacctcgcgcgcgcttcccgccggcgccgttcgcaccgtcgggcttgcccctcttgcggccgccgacttccatctctcggctcccccacacccgcgcccgcgctcgcgctcgcgcacgccgcctcggagctcggctagggtttccggctcgtcgcggcggcggcggcgggtagaaggcggaagggattgggtgggcgagaggaggtgagagatgtggagtttggaagagagtggtgtgatgtgttgggccgcgcgatgtggagtggagtggtgtggtgggctttgtgccttcgtggctggatcaaagcatcgccaactcactgttcttggaaaaagaatataaatgaactgcaccccaatcttgcaaattgaaataaaaatcattttctcggatttaaggtcccattcgtttccaatgaaattatttgagtgaataataagaagttagggcacaaataataaaaacatatattaatatgtgattagttaagttttagttattttaatattgcaatataaatttatttgatattttaaaataatttttatataaaagattttttttataaaacacacctttttacagtttaaaaaaattgctaacaaaaccggaacagaatattaccccctccgtatcctatgtatccaggttcattgctagaattgaattctttgtaggacagcagtaatcagatttattgttagaattatttttttttaggacagagtattaatcatcaatagaagtgaactgagcctgataacttcccagtgcaatcgaaaatcaatttctgggtttttttcttgacaacgttccacttattgccctatactgcataataattttgcaacaaaatgtcaaataacttaaaaaatactccacgttaaacacctttttattttgcaacaaaataatatcccacgtatggtcaattaacctcgtaaatcgaaaatctagggtttaagtctaatgaaagataacaatcggcctgtcgaaaagtctgatgggccaagcgtaacaaacggccctttaaaaatttaattgatgctttggttggggtgcaccaggcccgggcagcagtgcaacgactgggcgacgcgcgagggccccagtggctagccactgtggtgggccctccctcacaaaaaataaatttaacatcgaagtgggcaca

SEQ ID NO: 4239 - DNA, 1501 bp, Oryza sativa
tgctcaccattttcaagtaatacatggttagttccattacaaaccattggttttcccctcaaattccaaacaaattaacctattctaaacaaattatatccaagtggttcacagaaaatcaaattgagtaatcacatggcagtaccaaagtccctaaaagataaagtagtgaaaccctcagaatatgatatgatccccacagctctcaatgaagataatatcactaaattcaacttctgtttcactgcatgacaaaaacaagcctattccaacatgaatgctgaaaccatgctaattttgggggaaatcaaccacatagatggaaccccatgaatgctgcaggaaatttgcataccaaaatgctaaacatgaaatgtgaggtggtttgttttgtagctaggaggttttgctttgtgcttgagcacaatctgaacctttgataaaccacaaaaaggaaaaaaaaactaaaaacagttgagatgatgtgacttcacaagataagagagaattaacaataacttagtggcttctaagtgtataagatattgagatttggactaaactccacttggtggatgcaatttcagtctcaggaaagtccaaacctactatgcaattaaggtactaaggttaatgttgaggctagaggtgactgaagttgacctgcaaacaggctccgcaatagcgatcaagaaatcgtaggcttgtttgtataggggcgaaaacgtctccaggaagatgcggccatcggcgcaggcccagagcggcctgttcgcgtgatccggcttcagctctagcttggtgaagtccctcttcttcacctccctatcggctgcaccgaatcaaagttccaacccccacaaaacaaaaatccccaatcagttcaatgttccgtgcaaaccctcatacattgggggaggggcggtgagtttagggcggattcgagcgcgcggtgttaccatcgcggacgtcgtcatcgacgtcatcggtgtagtccagttcggcggtctcgtcaatcgacctcgacggcgccgaggacttgtgccgcttcggcgcgcgggcgcgatcgcctgcagaggggagaggggggaacggtgtaagggagatgcggtatataggacagaacgggggggcgccggtgccggggatggtgccgcttagggtttgcttcctcaccgtcgccgccggccatggccggaagccctggagcgaggagcgaggagcgcggcggcgcggtggcggcggtagccggagaggggagatgttggcggcgcacggggcagtttcgtcttctcgtcgccgcgacccgctcgggctgggaaatgctttatcgatcgatctgggaattctggagtcctctatctgtctcttaaatctgacgagtgggcccaggggcaaaatcgtccgatgggaagaccgatcaaacggttcagccggccagaggcgtaaagggaaccggacaaattcctccgtcgtctggtagcttcttctcgcggctgcg

SEQ ID NO: 4240 - DNA, 1501 bp, Oryza sativa
tgccgaggtccttgaaggagcccgtgtgcgagatgccgcagtgcttaacccagaggtcggtcatcccgccgaggtgctcgcggccgaggcgctccgcccagaagaggttggagttgccctcgaagagggagacgatgtggtcggagtcgatctccgggagcacgaactccttcttggaccacaccccggagccgtagggccacgcggtgcgccccacgcgggagtcgaagaggtcgcgccagtaggagcccgggaagcgcgcgagcgcctccatgtcgtggcacacgtcgaggagccccccggagctggagcggtagaccacctcgtccagcgagtagcgctcgtcggggtcgtcctcgggcgtcggggggaacggcacgtaccacgccgagaagtcgttcccggggccgcggagccgcgcggcctcctcccggatgttctcctccgcggggcggcggtgcctcgtggccgtcgtggcggcgtcggaggcgcatcgcgcgcggtggggcgcggcgcgcagcgggcggcggaggtgaggcccgccggcgaagggcctggggttggacgagtgtgggtgggcgaagaggagagagagggacgacgcggtggcggtcgccatggcggaggaggcgaggtgcttggcggcggaggaggaggggatggggggagtaattagggaggaggatgggtgacgtggatggggaggttttaggctttaggggagggatgattcgattgatctggacgttaattgggcgcgcagccgttaggaggccgacaggtggggcagattctttgtgatggtatatttgcgtttagtttttttactctctccgtgagcttaaatccaaatacagtaacagtagtcaagctagttttggcttgctactaatgtagataccatgtcatctataaataatgctaataccatggacaacaatcgcaattttgcaacattcatattctatatactcccccatcccaagataaatgtaattttaaatttaacttttatcctaaaataaatacaatcccacatattacttgctcacattaattaatcgcattacatctcaaaattttctccatcataccttcaattaccctctcagtccctaccagctcttatttaatagggatacttaggtaatctctctattattttcctcacacactttttaaaaatatacttacagtggaacagagagagtaagcaacttcatgcaaaattggtcgtgaagcatcggaagatcattatttcaatcttatagcactaagaaaaaaaaaatcccgattcactttttatgaaatgatccggttccctttaatggatattgcaaggctcaattatcggttttcttccatttagatcgataaacgtgtactcattctaaaattgcttatatttatggatgtaggtagcagcttactgttcgcattccattcatattgcattgaaattttagcaccttaggtgctggggtcgactccccatgggagc

SEQ ID NO: 4241 - DNA, 1501 bp, Oryza sativa
tatacttttagtggaggcaaatgattgggatggtacaataatagctaaatagcctttggatccaaacagcaagagggctattttgttagggggctattttggtgggataatctttagcccaaaaaatatccctgggatagttctccaaacaggcccataggaactttttcagtggaagtctcgcccagaaaaggaaaagaaaaataaaaatcaaaggcagctttatggctttataagagcaagggcagataaactttagctagcctactcgatatactgctatatttgcatggtatcatgtttgaagggtataaagtgtaacaactttgctacaagcccaatagcatggtcaaagcccacaatatgtcatatccagagagaacaagtctacattgactccctcaacttatgcccctggttgaatcgcatccctcaacctcagggtttacgattccgacgaaatccggtcggatttcgcgaaatttcgacgttccaacgaggctcgaaagtagaaaccgtttgagattccgaggagtttcatctaaatttaaatttaaattgataaaaaagaaaaaataaaataaaatcttataaatactatggtattcatataacttattgggatataaatttatgaaaaaaaagatgtattatgtgtatttactaaaacttacataatgaaaaaaaaattcagaaaattacctctattacaaattaatgatcgaaatttcgatgatttcgatcagaatttcgccaaaaccgaccgattttcgagaacttgtcggcaacttagggaatttatattcaaattttggtttataaaatttgttcggaatttaccgattttccaccggatttcgcgaaattccgaattccgccgatgcccggaacggaagggcctgtcggaatcgtaaaccttgctctaccgcaaaaccgatacaacccatcctccaactcataagaccgttgcaaatcgactcctcgaacggtttgggaggtggtttcgtccaatgtggcatctttgaccccgttaactagctgagttagcacatggaccccatatgtcagtgtcttgtagacagtggcagtgcctggtggtggtgcgcggcggtggccatgcgtgacggcaaacgaaggtgcgacagcggaaattgagggcacaagcgagaagaggggaacacgacgatccttactgatgcaattacgacggcaagcggcaacaagcttgaaaaggcggtggcctcgggttgatgtcgacggcggcgctccggtgatgtccaagtgaagcgaaggtgcagttgagattctctttcgtcttacgaaccaaacagtgatgacgacggacgtggtggcacggttggctcggctggagcggtggccttcggcgaagagtgcgcaaggaggcggctagggcatgggacgagctcggactagggttagaatcggaagaggggaccttaggcaagctatatataggtggaggagaaagagaccgggctag

SEQ ID NO: 4242 - DNA, 1501 bp, Oryza sativa
acgtatataaaaaatatatttataaattatttttcgtttgtaaatataccgtaacgatgtggccattcatttctgatggcatgaagatagggtggaaatatatgtttaatctaaggagttgaaacaaggtaaatatttgctattcatgtgagaattgtttcttttttccgtgtaatcatgtagctcaaagagagtggctattgtagtaagtaccggttctatcctaaaatatagcaagctaggatgtttagagagcattagtaactagcggttacaactacaagcttagcgcaaaaaaaaagttatggcaatcttttttttaacgtaagttatggcaatctctttgacatggaaaagtgaaggttcaccgccacaacacctgcagttttcggctgtggcctccgacacgggttatgcaggacgcaagaattgaccttctaagagcagttaaaataacactcatagcgccggcgatactgactccacgtaggtttgaggagtaagctggagggtgaatggaaaagagagagaagctcggtgactaatttacagcccggttgtacactgctcccaatattgctgctgctctcagccaattgcaacattcaagtgaagattttaaaaaaaaaaatcaaacctagccatgggaagtgcgtagagatgtatatataggttctgtttggggagagtttctagttgctacagcttctcccagaactagaagtttccccaaacagtctagattttggtctagattttaagaagctatagttatagaatccagaaaataaactaacagtcagactcttagctattttcagattcttataagctggttaacaatcagctgcttctcatgattttaacctccccaaataaacccgcactctattattgtattgattagcttgtgtcattcgctagaatagaatgatgtggttatttttggaggtaacaagtagctgtactattagcctagctgtaacgatagcggcctagtcgccgacgatggcggctggctcctccggcctacgggctcgcttcggccgaacgctacgccagtgaccgtcgctttgcgcccttgcgcccaccgcgtagcgagagagagagaacagagaagggactcgagcccgtgccgcacggggcatttccaccgtcggattctgaagcctcgcggccgagatcgagggctcggaggcaaccgtcggattccgatcctgggttactcatagccgtccgatcagagtagacgatggaaaagcgctcctggttccgagccggccgccaattcgtggttcctcctcctcacgggcggcggcgacggcggcgactacggcgatgcggctgctctccggcgcctctgcttcccgaatcccctgccccctcctctcactcgcccgcgcgagggcaagatgcttgccggtccccgcctctgccaccgcgtgccgagcggcctcctcgtcagccgcggcggccgcgggcgacggcggcgcgctgaagc

SEQ ID NO: 4243 - DNA, 452 bp, Oryza sativa
agggtatgtggagcctccagtgtctggtcatgcataaaagtatcttcattaccttgatttatttgattcgggcaccatgttgtcatgctaaaacttaatattttggcaatactagtaccctgaacatatgaggaagaatattttatgtaacaaattctgagtgaatgcaaatgttagcagccacatcaatgaccacgatggcagaacatttctcgggggtgggggtggggactggggagtaatatggactccttcatacttaattaagaaacaggaaacttgatgttctaaaaaatatttcaaattaatcttaagcccgttgcaaaccacacttcttacatattgttttttttgtcagagaagtgaagttgcacttataactcaggcagcactgatagaagttaattcagtggatgtgattattttacgtgtcatttgagtcctgcctgaga

SEQ ID NO: 4244 - DNA, 1501 bp, Oryza sativa
ggtagtttgagggtttggagaattggcttagcgtacatgagtcgtcgctcgtgcacggggttaaggttccctttttatgcgtattgaggggatcaggggtgattccttctcgaggaaaatgacgcttccgatcataaagctaaagagagaaacgtgtgagagaatgcgtgagactcgttcctcaatgttagggatcgcgtgggctttggtgggctaagcccaacgctctcctttctggctcggtggccagacatcaaccaacattgcgtactcgttttgcacatgtactatcttggtgttatgcatctatttatatatgccctctgcgttccagacttccgggcgtccccaacctgcaatggaataagttcactttgagtccctcaaatactgctccaatctgattcatacccctcaaccacaataccatatatcttgattcttgacccttaaactatattggaaccagtgttttcgctgacgtggctcgttgacttggtcaacccctacgataatgtggcagcccagtcacaaattagaagtgggcccatatgtaagtgactagagagagaaaaaactatgacccatttgtcatactcgttgacactgtaccccttatatctcccttccctctcctgctctccctgatcgacaatgccgattggcgaacgagggagcggtggcatgggcctggggtggcaggtggcggcgatagccaccagcaagtgccggagaggcggagagggggctagggaactggcgtgccgccagcactaggggttgggggttggggcattgccgtggcagcggaggaggtgcactgaggagaggaggggtgggtaaggagcagatgaaagcggagtaatggtcgcggcgaaggaggagctcgagctccatgacgtagtagagagagaatgttagtgggcccacatttatgtttttttaatttttatatgccacataagcatcacgtcaatgtcacgtaggacgaaaactggtcaacaccaccatgtagacgcacgacagcgaaactgctcttcaaaaccaccgaggaagacaaattgcatcagttttaatagttggagggtcaagatacccggttagtcaaggcagtcaaagtgaacttattcaacctgcaatccctctgtctccgaacgcaggcccgttggcccagctgcgcaatgcctgctgccgtgctccgtctcgaactctcgatcccctgtaacctgtttctcgtcttcctactcctttggactactagcccgacgcgaccaaagctgaatcaacctatggatgcagtggcccaatgcccactggccagctggtccactccgtcgatctcgtcttcttcctttccacggcacacggcagcgctgacggaatcactcactggccactcaacttgctactcatacccgatgatcaactgagccaatatatacactcgttctcttcagacttcagtgcaagatcacgattcacgagtccgcgatggcaggac

SEQ ID NO: 4245 - DNA, 1501 bp, Oryza sativa
gcctccaaccgcgccttcgccttgaggagcttggtgttcagctgttgcacctgcgcgtccgctttcttttccttcgccttgagcaggcggatctcctcggcgacgcgcatgatctcggtgcgcgtgcagtccatggacgtcatgaactggaagctcccggccttgatcgtctccagctccttcttcgccgcgtccagctcggcctccgcggtcttcagcagcgccttgtcctgcgcctcctccttcttcctcctcgctgcgtcctccgccgcctcgtcgctcttggcgtggctcttctccatggcgcgcaccagctccatctcggcctgaagcacctccacgtcggagttcgtcacggcgagcttcgcctccatctccctcgcgcggctcgcctccttctgcagcgccctgaccctggccctcgcggcctcgatgtccgcggcgaaccgctcggcctcggcgccgcgctgggcctcgatctcgcggcgctcccgctcggcctcgatgcgcgccagctccaccagcacgtgctcctcgttcgcctcgtccacccgccgcttcatctcgtcgatggcgcggaggctggactggatcgtgcacgccgacgccacgatgtcgcgctcggccttcgccttggcctccgccgcggaccgcacctcgagccgcagccggagcagctccttcttggcttggtccagctcctgcaccacctccgcgtaccgcgcgtcgcgctccgcgcccggtgcgtcggtgcccttcctcctcgtcctcgctgcccacattgcttggagctccgacctctgggacgtggctttggccgttgtctgctcgatttggcgctcaagctccttcgccatggctcgcgctctcgacagctcggactcggcgccggctctctctttatccacgtacgccttgcgttcattcagcttgtccagaccggattgtgctagctgcttcatttcagaagacagattctgcacatatatataccgaaatggatataaagatacagatacagtgcgtttttacagaaatcgtataaaaatacaatgaaattgagaactgttgaacttgaggtttgttcacaagaatcagaaaagcgtgtgaattcagacactacctcttgggctggaacagttcctctgttcttgtctgccttcctcccgttgatgctttcgccaaagatgctcatcgcagctcgaaatgacccacttcgtcccaagttctcatccatggtgatggcggcctccattttatcgcaccaaagaaaaggtgaattgcaccaaggctgaatctttcgaacgaaaaattcttggaagtacttatttgtttggagaacagttaagacaagggagagcttgtgtgttggtaaatgaggacaagtgtagcagctcgcgggtctatcctgcttgcatgactagaggagctcactaccacacaagtacacaacatgtcgatcccgttatattatccaccttgttcttgtctgaacttcgca

SEQ ID NO: 4246 - DNA, 1501 bp, Oryza sativa
ctggaagatgtgtacaattttaccaatgtatctatgcaattttttttcttgcacaaactcgtgttctgaattgtgtgatatgtccgcgagattcttactcaagaaattctgcccagctgtattgtagctttaatgctatcttttatgcaccaaaaccccagtttctgttctcatgaaatttcatagctgtcaaaaatggagtatttttttccaccaaattacataagagatgcacttaaactttttaaattttcgttattccctagttctgctgatctgctttgtgccatgcttgaatcagcatttggagccttattgcatcctaaacattgcaaagtaaggaagcattgtcacactagttggtccagaaagttctgtttactgcagcgatttgttttccaacttatttttgttcagtgtatttacagcatggagtaaattctctgttgttccaaaacatagttacttctccacattaagtgtacagaactataaaattgtaacaacaatgatcagctctttccgaattttaatccctaattcccaagataattgctaatttatactcagattaaatcattcatcctatctggaactaagcggtaagcgatttgtagcgattaactaaacctcatattttttttgtcaaaaaagaatagaaaagtactcattgccgatcgattatgcacacaactccacaagttaggatcatatagatatactaaccccaggagacaggtcaaatccaatcgcattggtggccactcccgagagcagcatcagcgggtgattcctcttgggcgcctgcacaaaccaagctagaaccaaatcaacaaccataaccactaaccagccgccaccctctccgctgggaggggaataagcacgcgcacctcaggcggcgggcggtaccgccagagcgcgagccgccactctgtgccgggcacgggcacgtagtgcagctcatccgccgtgcagatcgcgggcttcgccccctgctcgcacgcggcggccgcggaggcgagggcgcgggatggcgacggcgaggatggttggggcggcggcgggggaggcggcgaggcgcggtaggaggcgaaggcccggacgcgcggcggcggcgggggagccggagggggaggggcggacggggaggaggcgcgcgcggtggcggcgggggaggagaggtgcgcgaaggcggcgccggcgaggaggacgcggaggttggccgcgtggaggagcggcatggcggttggagttggagtccctcgcgctctggccgcctctgctgcgttctccggctttggttgcgccgcttcaacatcgaaggccggtggtgacactgaccgatgggccagtctatgtggagaaaattgacatttaaccatgttcgggatggggtttcgctggaatgctagtcccgaatatggttttgttataatgtcattgtcaaatgaagccaacttgctagaatgccatttcaaccattttaactgatttccaa

SEQ ID NO: 4247 - DNA, 1501 bp, Oryza sativa
ctccaatcgcttgcatgatgagattcccacgggagatatatatcaatatatgcatggctaattggctgcagcgaaatgatcgagcccgttttaatggatgcgccgtctcgcaacgtccaacgtctcgtgttctttcggttggtcatccatcgaaagggagagatgcgagatggaaagctcaacccgagctaccaatctctctgtctgctgctaataatcctcagctcctccttatccaaggagctagctttggatgagcctgaatgcctgatggctccgggtttgtgctttaaatttctttgtataattccattaagataacggctgcatattttctacagtcggttttatatccatccttgtgatcatctatgatccatgacctctcaaccatcagtagtgttttggatttttggatgcaccgagtaacctactgtcctaccgatgtgtcatgcatgtgtgagtactgaaagctgcccttaaatggtactagtagtatttgcttacatacatcaccctattggacagattagccaaaagatatataggagtatatatatagctggccagttcttgtgtaatcgtgtggtctattccttgtgtaactaaaaatctgaaacagcttcccctgttatgggaaacaataccttttgtctttgacaattcatattgaaagcacggccagaatacggaaaacatcagcctcgacaaagaagggtgaaagctcaatttagtccattttacagcgcagtctgaagaaagaaagccgatgctgctcagcgtcactagtcactactgcctatagcttcctgctggtcaccatccactggacactgctgcctttttctttctaatcttcctccatgaattgaaccatacagcgtgctacctttgtttaggcaaaggacacacagcaaaccaaagtataattagaagtagggagtcaattacaccacgcatctgaagacaaggaagtgaagaataaagatgaggtgagctgaagcccaagtgcaggaatgatacttaaccctccatccctgccctccgtcgcttgcttgcttgcttgaggtcgcgaccagtgaccacaggcccacagtgagtgatagctgagataggaggcatctcctctttctttctactgcctcgtcgcttctctttggctgccaaaagcggctgcgaactgtattcccatcgtttaggttttagatgcgcgcccactagataaaaaagcaaagaatatttctcccatggagaagagcgctccgttggagtcaagctcgtcgtcaatagtggacttttgattgagcgatgctggtacagctgaatactttaacgtgacgacctgctgacttctctctgctgcttaaacctgcatgggcaaaaccaaaaaacgacacccatccgtaagaccgtacaagtatatcagtcccacggtcccactccaataagagaggaaatgtagggtaaattactgtgtactgtaatctctttaggttagcac

SEQ ID NO: 4248 - DNA, 1501 bp, Oryza sativa
aaaagcctcagaaagatgtcgagcaactaatttacgataataatctactggagtagttaaaaataacatggggcccagttacccctttgaacgctagattttttttccatgtgaataaaggcattactaagatgcgaaaaaggatatagcccctagtgattacaagagtctcagtagcccctgtttccatttgaggtttcataacgagcctgaaaggacgtaaatacggttgtgtttagatttaggggtgtaaagttttggtgtgtcacatcggatatgccggtacacatttaaagtattaaatatagactaataaaagaactaattacataatccgttagtaaaccacgagatgaatttattaaacctaattaatccgtcattagcaaatatttactgtagcaccacattgtcaaatcatgtactaattaggcttaaaagattcgtctcgcaaattagtcgcaatctgtgcacttaattattttttagcctatatttaatacttcatactccctccgtcccataatataagggattttgagtttttatttgtactgtttgaccgctagtcatattcaaaaaaatttgaaattattatttatattttttgtgacttactttattatccagagtactttaagtacaacttttcgggttttatatttgcacaaaatttttgaataagacgagtgatcaaacagtgcaagtaaaaactcaaaatcccttatattatgggatggagggagtacatgtgtacaaacattatacgtgactgcgtgctgctcttgaagcgagagcgggtctgcgtgctgctcctgaggctcgcacggctctgattcgcaggggggctaataaggtggctcatgagcttgctcagctagctattcggaatagggaggcagtggttttgcgcctgcaggcgccggtgtgtgttgctaagcaacttgctaagaattgtaatccttattctgaagtttaataaaacctctatcttaaaaaaaacattagacgtgatagagtgtaaagttttacaggatctaaacagtgcctacatcctaatcgaatcaaaatctcaaaataaaaagacaaaagagtcaggttctgcatcaatcagagccgcacgtccaccctaaacgccgtcccgtctcccgtgtggtcgcgaggccgtgtgtgaggcagcgagccagccagccagccaagccaaggcactcgagatttcttcctgctccagcgcccaaagcccggcgcaaatcacaaccttagtattatttcctcctctctcttcccctccctcccttccctcttcgtccctcctcccctcccccccgccgcgatcgagacggcggcgaaaccaacaccggaatccgaggggggatccgccgcggcttcgctaccctagcccccgccccttctcgaatccgcgccctaaaatcccctttgcctccccaccccacccccgggcgcgccgccatccccccccgcccccgcgagcccctcccga

SEQ ID NO: 4249 - DNA, 1501 bp, Oryza sativa
aaagtagttcactgaacagcgtgtcaacatttccctccttttatgaaacaaaaaagaaaactgttattcatcacgcgtgtcaacgtactcctcaaagtacagatccccgaagcagaaagtattttctacacctagaaaatccacgaagacgaaagcaggcaacgccgttgtgttcaggttcagctcgaaccagcgcctgcagtccatttggccaggaaccccttgtactgcttcagaacatcgccggcgtcgggcatcacctgcctgacagcgtcgacggccaagaaccgctccgcccacgccgccaagcccgggaacttggcctcgtcgagcaggttggcgccggccacctcgtccaccaccttgatccacaccagatggctcccgagcgcgacgtcgacgagccccgcgtcgtccccgccgaagaaggccttccccttggagcactccccgaacgctcgctccagcgcctccacgcgagggacgacgttcttgaacgcctcagctctctgctccgccgccgtcgacctgaacagcactttccacgacgggaaaaactgcagaaaaaattgcaaaggaaatcaaccaatcaaacagaattcctatctgccgttctgatgtccagtcattataccgtgtcgttgacgtagttggtccagaaacgcgcggtggcgcggtcgtagggatcggcagggaggagctgcggcgtcccggtggctccccaggtctcgtcgatgtactccaggacgacgagcgactcgcacaccggccggccgccgtggatgaggacggggaccttctcgtgcaccgggttggacctgagcaggtggtcgctcttgctggagaggtcctcctcggtgtactcgtagctcagccccttcatccccagcgccactctcacccggatcacccacgggctcgaccacgtccccagcagccgcagctctcctcctccaccacgtcctgccatcgcggactcgtgaatcgtgatcttgcactgaagtctgaagagaacgagtgtatatattggctcagttgatcatcgggtatgagtagcaagttgagtggccagtgagtgattccgtcagcgctgccgtgtgccgtggaaaggaagaagacgagatcgacggagtggaccagctggccagtgggcattgggccactgcatccataggttgattcagctttggtcgcgtcgggctagtagtccaaaggagtaggaagacgagaaacaggttacaggggatcgagagttcgagacggagcacggcagcaggcattgcgcagctgggccaacgggcctgcgttcggagacagagggattgcaggttgaataagttcactttgactgccttgactaaccgggtatcttgaccctccaactattaaaactgatgcaatttgtcttcctcggtggttttgaagagcagtttcgctgtcgtgcgtctacatggtggtgttgaccagttttcgtcctacgtgacattgacgtgatgcttat

SEQ ID NO: 4250 - DNA, 1501 bp, Oryza sativa
ttagtaaggactctagcgctagcccgggcgtgcttctttccggaccatgcgtgcagcacgacaggtcgacgacagctgcaaattaggcaaattttgttggcttatttccgcattccttcccgttttaatgacctcacacaaactgttcacacaaagatgctcctcgcgaacacagatttccggcccgatctgtacagctacttcatacgtgttgcttgttaaggcggtgaacgtgtcacgaaattcctttcccgttagatggcgactgccacatagacgagaaaattgacatttagctattgtcaaaacagggtttcgctggaatgctaccctcaaacagggggcaacatgttgcaatgctattccatccatttcttctcagtttaatgttttttattgctgagatgaccaaaatatccttgatcctatctcatctctcctctctgtcttcctcctctccgttcggctcggcgacgcagccagaaacggggatggtggtggcgcggccagggacggggacggcggcggcgcgcccggggacggggaacgcggcggtgtggatggggacggtagcgacgcaactggggatgagaaggcggcgttgcggatggggacggggacggggacggcggcgacgcggctagggacggggacggcggtagcgccgacatggttggggcaggtgggatgttctcctacgccgatgcagatggcgccgctgagccgagcagccttccccaacccacgccggtgccgtccctgtccccagccgcgccggcacctcatcgccgacccccatctccatcctcctcgacgacctcctccttgagtgcctcgccggcatcccctatgcctccctcccatagctccccaccactccaccacgcccatcgcctaagtcgcgcccacggcgagctccgcccctccctcctcgccctctccgtcgcgtccacggcgagccgacggatgttggcgtggtggtggtgacgaggatgaggagctggcggccaccgactcgtagctacgccccgtcgtcgctgccgctgctacactccaccgccggcgaccggatggggatcgatcccttttctcctttcccctgcaaagtcaacaaaatgactaggggcaaatatgtcagagcacgataaaaaacatttggaaatcagttaaaatggttgaaatggcattctagcaagttggcttcatttgacaatgacattataacaaaaccatattcgggactagcattccagcgaaaccccatcccgaacatggttaaatgtcaattttctccacatagactggcccatcggtcagtgtcaccaccggccttcgatgttgaagcggcgcaaccaaagccggagaacgcagcagaggcggccagagcgcgagggactccaactccaaccgccatgccgctcctccacgcggccaacctccgcgtcctcctcgccggcgccgccttcgcgcacctctcctcccccgccgccaccgcgcgcgc

SEQ ID NO: 4251 - DNA, 1501 bp, Oryza sativa
atcatgagttggtcaatctaccaggtgttttgttctccttctattcatttacacaaaaagttattatttgagttttcttctttgttttattaaactgacacaatgcaggaagtcgacttcttaggccacaagattctcgctactataagtatcaactggcagcaggatgaaatggcatataactagttgcttttaagagtaaaaagtcacagacctaaagctcatttaatggtagtatacacataatcacatatgagcaaagtaaatatacagcagcatagcacatgccttccgaaatcaaacttttggatagtgactaatggcaattgaaaagcatgaggcattctttcaggttgaaccaaattgccttgcacaacatttcatcaatctttggtggaagcacatcaatgttcaaacatgttataaaggatgcaaagctagagctggccagcaaaaataagtaattgtttccggtgattcatatcaataagttgctaactacggaatcatgggagctttcccctggcaaatgtcttacatcaaaggatgcaatctcacaactaacagataaaatcccacgaaggagtattgaccttcctagcatacatcagaattgctgtaatcacacgataatttcacattatagttttttttcctgagagaatttcagcacacagttatagtagatatagaaccctaatgcaaatatacaaatagctcaaccagctagtcagtcagtcctaccaaatcatccgtgctcatcaaccctaacccggtaactccattcacccatagcatcaaaatcgaaaacacatcgaaaagttagtgtgcagtacttgccttctcgagttcatggcttccttcttcggccgccgactcaaatcaacttccctgcaagagagacaacgccgcgctgatcagaacaaagacgccacccagccataaaaaaacaaaacaaaaaaaaataatggactaaaaatggaggggaagaaaacgacaaatcgagagatgatctggagtcgagtccttaccctttacctctcgatcgattcgcgctggatccgcggcgcctctagaaaacgttagggcgcggggctccccgacgaaccaggcggcggcgattggcggatgccggaggaggaggaggaggcggcgctgcgtaggctggtggcagcaccggagctccgggaggcgacgcggcgacggcgccggaggaggaggagatcggcggcggtggagaggagaggagaggagagcgatttggggaagcgatcgaatgatcgagaagtgcacgcagtgtggggcgttggaggttttgctgcatggcaggcgcgtaatttcagtccaactccaagagtattttcataaatagttctcccctatgggctatgggccatctcaatttggatagcagaccaactaggcccattagtttgaggcccattaatttaggacatctcgagcagacagaagcaggaggagaccaagacaccggccatgg

SEQ ID NO: 4252 - DNA, 1501 bp, Oryza sativa
ataactgtgtgctgaaattctctcaggaaaaaaaactataatgtgaaattatcgtgtgattacagcaattctgatgtatgctaggaaggtcaatactccttcgtgggattttatctgttagttgtgagattgcatcctttgatgtaagacatttgccaggggaaagctcccatgattccgtagttagcaacttattgatatgaatcaccggaaacaattacttatttttgctggccagctctagctttgcatcctttataacatgtttgaacattgatgtgcttccaccaaagattgatgaaatgttgtgcaaggcaatttggttcaacctgaaagaatgcctcatgcttttcaattgccattagtcactatccaaaagtttgatttcggaaggcatgtgctatgctgctgtatatttactttgctcatatgtgattatgtgtatactaccattaaatgagctttaggtctgtgactttttactcttaaaagcaactagttatatgccatttcatcctgctgccagttgatacttatagtagcgagaatcttgtggcctaagaagtcgacttcctgcattgtgtcagtttaataaaacaaagaagaaaactcaaataataactttttgtgtaaatgaatagaaggagaacaaaacacctggtagattgaccaactcatgatcattggatcacatttctatttttatcactcctgctctgtcccaagctctctatcttagttttgtaaacagtggaagtgtataaggaatcaaagaaaagggaaggccctaacaaggatctgtacagtgggatagcttgttctaaacttctactacttgatattgacattttgacatttggttgcagatggagtttatgtccagctgcaagcctttgtctgctctaaaagcttgttactcactatgcacagtttccagtttaggaatggcctgtgatcatctacctgctaacactaagaacttactaactcacacatgctgtttatccaagtcaaaagtacacagtattagctttgtcagtcaaatatatttgataacaagtattaaccttttcatgatattcataactataaattcgagttgaacattattaagatgaatagaacttgttagtattgtggaaggtatctatagaaatcagtagtatgtacctgtttatttatggcttgagattgttttggctcatagtttttcttcagttaatttgttgaatgcatattctctttctgtttttaattctttgatacatgtgtcaaaagctattgtttttgtgaacttgggagattttagtaatgtcgtcccttcatacttgacatatataaatgcattcatgaattatgattgctcagtgtatatccatgtagactaccacggtaaatgtttctatgtaacagattgaatatttatttatatggtttgcttagtttgcatgtgtctttgcattttatttccatcatatgctttgcgcacgctgattatttc

SEQ ID NO: 4253 - DNA, 1289 bp, Oryza sativa
atcggactcacttctgccttaaaaaaccccagttttttttccttgtttttcacgtactagctaaatacccatactttactcaaaaaaagaaaatataatgtaataatattacctaaaataaatagcaatatacttttgttcataaaatgcgttatgtatatttttaatttaggggatattcatctaaatatgattttatatatgactatttatttagatttgattgttttctattatgaagttcatagagtaaatagggtattagattcactgtcaccaacataacctcctaataaggagtacagatgtctatatatgaaatgacatgtatatatagaaaagaaatgacgtatataaaatactgcaagtggaggtatggaacgggaatgttgaactaactaaacatacttccaaatttgtcaatggacaagtatattgaggcagagacgtcaaaacatttataatttgtgatgtgggcagtacactactgcatcgttaaaagaagaagggaaaaaaaagaagaaaaggagaggagatattgggacacatgaacaaccgaccgaaccgagcaaccaaaaaaatcgttgtatggattggaacggaacggagtacggcttaattaaatcttgcagattcgatccagtgaatgacatgatggcgtttccccaattaaattcgtgcttaattgtgacccatttgtttcggccggccggccggcctgcgtagcctatcgaaaatgaccttgttggtttgttccttctttttgtttctttactgtcacttgctcaaacgaatgtaaatatcccctctatgttaccccctaaataaatactctatctgttttttttaattttttaatatataacgctgttgattttttcaagatatatttgagcatttatcttattaaaaaatatataattatcatttaattatcatgatttaattcatcatcaaatattcttttagtgtgacttaaaatttatttatgtataaaaaattaaataatatgaatgatcaaatatttattaaaatgtcaataacatcatatacttaaaaaaagtaaagtagtatatgatgttgttaattttttaaaacaaattataaacgcagatgctcgtataaaacacgcgcacactctctaccatataaaagaataatcagttgtaaagttgtaaatgtaaacacacgtttgaagtatatttgaaaacagaggtatagtacgtacagtagatcttaaggttattgcttctgttgtgcaagttgcggttgtatatttacatgcaaga

SEQ ID NO: 4254 - DNA, 1501 bp, Oryza sativa
tcattgtttctttcctttgcgtttatgggtattctgaataaaatattttgactgtgctagcaatttgccttatgcctgttttattctctcgttagttgtaaaaccttcagtatcgaagttgatgcgtgccttattggtggccaatagtcatgtttttgtccatattcatttccttggcatgatcttgtttattttcttgactacatcagctgtggtaggaatttataggtttcctggtatagcgttctctcctattgttattatgttttatgcctctttgatagtgctagttaggaccagattgttatgtttttgctttgtaaggagtaatgaatactgtggagataaaagtttacggttcatatttctgtactgaataaacatacttgcagtagtttctataaggttgctgctcgagttaagagataatttgtatcccataaaattacctttatggaatcttccttggcatgtccctgtgttaaaaatcgtgaaggttctcacagaattcagttttgaaaccgtttgcaattttaatcttctactaccctgcaggctaggatcttagccctcaacgcatcctacttcctgaagaatggtgggcattttgtcatttcaatcaaggtacttttggtctttttttctcgctcctgaaacctgaagttaatcacgtttattgagattgcggagacagaagatgatagcagcattggactgacaaactgtttgaacaggcgaactgtatcgactccaccatgccagctgaggctgtgttcgctagcgaggttgagaagctgaaggcggatcagttcaagccgtcggagcaggtgaccctggagcccttcgagcgtgaccatgcctgcgtcgttggtggctacaggatgcccaagaagcaaaagggcacatcttaatttaaggatacggccatctgcggtcaaagctcaaatgtactagtagaactttttataagcgttagcgtttttgcttaagctattttaattagttcatgctgctgctggttttacagcaatccatgtgtaccgcgaacagagaagttgaaattggttgaatcgacgctaccgattaactatcctctcggccaacttaatttcatatggcacaatgtcatcacgaatcatcatggatgtgctactagcaaaagctttgtatgtgctggtaggtttcacgcaatggcaactcctaccacggtatttgatttaattttccgttgggcaaccataaatggattaaagtagcagcaaaacctgctgctgtaagtggtttaagggagagtgataaaaagaggaatcatcaaggaataatccaggagtatattttgagtaatatataggaaaatggtgcacgtggaactctgttgggccgaaaagaaagagagaggctaggcggcccattggaccaaagggaaaaccgctcgcggacgcagtggagaggagagagaaagaggcggtttcagaagcgcagagagagagagagagagtag

SEQ ID NO: 4255 - DNA, 1501 bp, Oryza sativa
aattagtgctggtacaagatgtttgcaaaaaaatcgtcggggtctactgaccctgataagtgactctagcgtcgtccctgtttgataatatatctagtggaagaaagagctttttatctatggaatttgacggagcgttcgtcgccggcggcaatcagattcagacggaacgcttcgtcttgttgaggcggcgccggagttggaggagacgatcgagggaattaaatttgaaaatatattgttcatttaatttttttaaagaatattcaggatgtaatttttttatagaaatataccgtcgatctcgtacaaccgatgagcgaaaatgacgtaaaggtaacgtcgaggatggtatcgcacagcgaatgcacgagaccgtgtgccgtgtggtctctcgcaccgaccgcgcgctgtcgcgggaaggacgagcaaactccatttgcttagtgactaatgacgtaattatctatttaactaataataattagtcattaatcataataattaatcactaattcaccattttgaaatacggtatcgctgattggttcagcgagattgcacggtctcgctctttcatttcgcgcgaccgcacggtctcacgcttcccccgcgcgataccgcccgcgacgtcacgccacttcactttcgcgtaatggttgtgcgagatcaacggtatatttttgcaaaaagctttgaatcctgaatatttctaaaaataaaatgaatggaacagtatattttcgaatttaattcggtgatgaggcggctggtcagttggtcttgtgttttgggctttttcggcccgtctagtagcccatgggctatggcggattatttgctcggcccaataaagcccattaaaagcggagctaacctagggtttgtgagcaaggacgaacaggtataaaagcgagcctccgcgccgccgtcgcaccgttccgcaggccgcagccaccaccacgccaccggagcacagcgacgcgccgccgcggcttcatcgtctccggtgagttcgacacccctcgcgcttgtattctctgccgaaatcttaaaatctgctgtttccactgtaagacctattgcttggtagatttgatcgctgcctcttgcggttaaattctcggtgaccggtcgattttgtcgtgaaattctcagtgatactattatgcttttcggtcagttgtttggctgcaataactgtaaacttagttttagtttgagtaattcggtgcacgcgggttgtttagcttgttagatcgcctcgctatgctccaatctgcgcatcatccgtgttctctagatctgatagctgatagggctagccatttcgatcaatatgatgttggatgagagattttagggcagatgccatttgtgatcgacaccattgctgccagcgttgtgtaatgtttttgcgtgttaatggtcacttagtggtctgatggtcatttgctatggtgtaatggtcgatctgtttggtgatgtagctacagcgaaa

SEQ ID NO: 4256 - DNA, 1501 bp, Oryza sativa
cgtacagggacatggtggtggccgccgccggcgacgagacgccgctctcgtccatctccgaccgggccagctcgtcgtccgccggcaccggcggcgaccggagcggcgagctctggaggaattaatcaacgttttgctgtaaatatgcaaaagcgaaagtattcgttaaaattctgctcatgtgttgatgttgtttgtgaattgtgatcgagctaatcgctgacacgatacggttggaatgtgattttgccttcgttacttgtccatctggttttgttcatcacgttctggatttactattagattaaaaaaattttgggggccatttgttattaccgatgttttgttttgaaccaccttttaaccaatgttttcacttttaatcgggtaaatcttacatttgttgcactttgaaccacctcaactctcttctcatgcatagaatgaccttaagtacaagtgtatggcggctcatacttgtcaataaactccatcaaccattagattgcttctttgacatatgacaaactgaatgtagaacgataaaagatttgaggggtggcccaaagtgtcacagaggtaaaattacctggtctaaagtgaaagcattggttaaagggtgattcaaaacgaaacatcagtaataaaaggtgtcttaaagtaaaatttaaggcatgtttagattgtagccaaaataaaccttaccaaattttggcattgccaaaaatttggcaggatttcttttgtatttagcaaatttggcaataaattaaacgtagtcattttttagcaactttactagaaaatggtatggttgaaaatggtatcaaagtgaacatgcccttactcttgtcattattttggatgggccaaaaaccacatgtatgggccagtctattcgcgtgccacgagcttctgggataggccttgatgggccgtagcggcacgcaaggaagtgagaattcatggcctcataccgcttcatgcaacactagtggttaaaaactgaatctatcttctcttcttctgctttttttctttttgggtaaactacatgatgacatgacttgttatcaataaaaaagaaaatgatgatgtggaataatgatatatatagtcaataatataggatagtactatgtataagaaaaggttgaacatgtcatatagcgtaacacaatatattactcctataaagactcaacaacaaacgcttccaagcacaagcttacaaaagcacactgcaggtagctaagccaccaccctcgataaactagaggccaagaaccagtcaggtcgttgcaaatgaaggccggccatagctgaacaactcagattaattagttaattaatcaatcagctaattaatcaaatcaaatcaaaatcaaataacacggagacaaaaacaactgttgcggccggcagaatgagcaaaaaagaaacataaaacaaggctaacatccaaatcagcgagaggtaatctctaacacaatggtcatgg

SEQ ID NO: 4257 - DNA, 1501 bp, Oryza sativa
gttttacatatttcacaaaaatttttgaataagacgaacggtcaaacatgtgataaaaagtcaacggcgtcaaataaaacgaaacggagggagtaataatctagttgttgaagccggtgacacagttacctgctgcatgcttaagtgccagctggagacatggtttagctgacgctgtgacgcatgttgctttcgttgacaaatagagtgagctctcaggatacgcgtgactaaattagctgcaaaagggctataaaaactttacggacttgttgcgtgcgtgtgtgcccatggatttgaactttgaacataggttatggattataaaaaaaaaatgcgatttgaaagttgctgcgaacatacgtgatgacgcgactaaagcttatatacgctgaagagggagatgttaatgattcaattagtgtagttggccgatcaagatcagtaccttaacatttgctatcacactcttgtctgcagcaacaagccaagtctgaagaagaagaactagtcatcgcttgccaggtccacctcaaacgccgcgtctcactggcaagtgggccccaggacatcaccggccccacagacagtgacactgatgtttaactggtcgggtcccaccggctcgcgctcgccggcgttggacatggtcgcgccccttgacttggccgagcttagctatatgtccacgccgcgcgtacgcgccccctggtggccggcgcgttgggagctctgagcggaggcgggcggctgcgcggccatggagggacgcgagcgccgccgcagcatgtcgtcctcgtcgtccgggaggcgcacgccggagctggagagggagcgatgggcgccgtggagccccgcccccacgtggtcgcggccgctctccgtcgggggcggcggcagtagggcggcgtcgctcaagtcgctcttcaggacgatcgggttgtggttcagctcgctctccacctcctcctcctcctcgtcgtcggcggcggccacctccgcctccggcagcaacgctaagaggaggagcagaagagagcccaatgacttgatcaagaagccgccatgtaaattgtttctctcgatcatttcttctccatctatttcatccttgtccttaattacctcgatttgaattgctcaagcaaacaggatataatccgaattatttgcccaattgatgcaactgttcctgaactgttcaagaaatcagtcaattatcacagtccagttgccggctgcaactactctgaattggaaacagtcaattatcacagtccaattgccgcaactactctgaattctttactttctggagcagaattgctagtgcaaagcttacagaatcatatttataaaatctgaatcacagaagacttcaaacatttttttcaaaattcagagcagcaattaagcagttgggaattaattcttgatagatgaatctgtttgatgattccagtgccggggcctggcagtgatcaggggaaggcgtcgatgc

SEQ ID NO: 4258 - DNA, 1501 bp, Oryza sativa
  unsure (1)..(1501): unsure at all n locations
aaagtgtgcaaaacatagctccaaatgtaatatgacaaaaaaaacattgggaggatgaagttgctaaccttttaggcacctccggatttggtatatagatcaccaaaatacaatctcatctagnaaacttttgggcatggacnnctcccgctgcttttttggaatgcaaatctttggaaggcttggctcggggcagtctgggagggagggaagtaagtacattatattatacgcgggttggggactttttatgtcccgggttaggtggttatgaaccggggctatagatccccgggatctttagtctcagcgtaaccaaccgggactaaagatcccaggggggcctgacaagccctgacagcatttgaaccaggactaaagatgatcttaccaaccgggactaaagatcaaatatggccgttaccctttttaaccgggactaaagatcatctttagccctggtttttattgcaaccgggactattgtggaattcggccgaccgacgaaggatggtttctccaccagtgacatgtgtatgatagatgggactaggtattaattgtgtagtatatgtttatagctaaccattatatgacttgactattagaattaactatagatgatttagagcccatagctggccatactaaacttgctcttcacttataggcaccggatagatatgaaaaaatgtagaaagtactgttagcgcttaccgtggctctttaggtaatatggagatcaaccgaaagaggtcgtgtctcaattgtaaaaataatatataccaagggcataaggagaggcagatagcgacaaggaagaattttcaaatgcttctagtcgtccgtatacgtattagtgccggctagtatatgtctgtctgtgtgtctgtcgtgcataatcctactgtcaccactttatccctttaccaaagctgaaggagccaaagccacgataagaggagatcgctacctgcaaagaagagaagagtcccctctttctctctcgcacccagtaaaagcggttgctagaaaatcccccaataacaacagcactcttccctccctcctcggtcccacaaaaaaaaaagcagagagacagatagagggtgagagagccagtgggataaaaagaataatagatgggggccggcccagcaggctcctcagaattgaccaagctgtgctcctaccatttcacatcacaagtagcaagccaagtagattgttggtttgcttccctttgcatgtttataaccccatgtcaccaccatttcactcatttgcattgcatggtaaacacaacacaactagctagtttagatcccctttgcatccatcgatgatcagttgttgcaggacagtgtagtgaggtgagaaagattgttgtagtagctgctgtgctgtatggtggtagccagtgagtagctactacactgcactgcagtttgcaccccggccatatgttggctactactactgcaggtgtcttaggtctaga

SEQ ID NO: 4259 - DNA, 1501 bp, Oryza sativa
  unsure (1)..(1501): unsure at all n locations
tcccactggctctctcaccctctatctgtctctctgcttttttttttgtgggaccgaggagggagggaagagtgctgttgttattgggggattttctagcaaccgcttttactgggtgcgagagagaaagaggggactcttctcttctttgcaggtagcgatctcctcttatcgtggctttggctccttcagctttggtaaagggataaagtggtgacagtaggattatgcacgacagacacacagacagacatatactagccggcactaatacgtatacggacgactagaagcatttgaaaattcttccttgtcgctatctgcctctccttatgcccttggtatatattatttttacaattgagacacgacctctttcggttgatctccatattacctaaagagccacggtaagcgctaacagtactttctacattttttcatatctatccggtgcctataagtgaagagcaagtttagtatggccagctatgggctctaaatcatctatagttaattctaatagtcaagtcatataatggttagctataaacatatactacacaattaatacctagtcccatctatcatacacatgtcactggtggagaaaccatccttcgtcggtcggccgaattccacaatagtcccggttgcaataaaaaccagggctaaagatgatctttagtcccggttaaaaagggtaacggccatatttgatctttagtcccggttggtaagatcatctttagtcctggttcaaatgctgtcagggcttgtcaggcccccctgggatctttagtcccggttggttacgctgagactaaagatcccggggatctatagccccggttcataaccacctaacccgggacataaaaagtccccaacccgcgtataatataatgtacttacttccctccctcccagactgccccgagccaagccttccaaagatttgcattccaaaaaagcagcgggagnngtccatgcccaaaagtttnctagatgagattgtattttggtgatctatataccaaatccggaggtgcctaaaaggttagcaacttcatcctcccaatgttttttttgtcatattacatttggagctatgttttgcacacttttttgtctccaaaatttagttgtaagttgatgagagagaaaatttgtgtgggggaagaaagaatatatagaaatttagtttatttgctaaagaaggtttttataaaatagttgagaaggaaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgtcattattgtatgactgttgaaagagtttgtaattattttaaaactgtcattattgtacgaataattatttgtgtacgattttttttcatctcatgtaga

SEQ ID NO: 4260 - DNA, 1501 bp, Oryza sativa
accaaaacataacatatactatagattgctcatccttccccaccatgtgtcattaagaggactcatcatcactgacatcagatgaacttgttggtcaagtctcccccagatgattatttatctccgatgttcgtggccctgataaccaattaagttttaacctacaggtatgttttcttaatgctggtgctactaattaaccatctttgagcatttaagggtgccattaatttgaaaaatacaactaggtaagctagcttggtggtgtattaagacatgttcatatgctattatactataaacatcattaatgggtatgtagacagctctgtttaagaaacattacggtagtgggctttattttgcagggtcaaggcatatccatctatgttcatgggatattcctagtatagaagcatccattttagtcaacggtgtgtataaatacggcatgtctcccgtacgtgattcatgttggcgacctcttctcgctcgcaactaattaatcaattatccgcggttttaaattaatttgcgtcctagtacttactactcagagattcagagtctagcttgttaataactgaacaacctagttgatgcgtttggtaactaactagctagcagggttaggaggaacatggcatgcaatgaatcgatcgagagccgcatcatcctcaccgaccaatccaatttaaggttgggttcgtataggcagcgaaaggcatatgcaggttgcagggctggaaatcagagcgaagtttcagaattcaagtgcacatgcaaagagggacattaattcagaaattagaattaaacaggaagatgtcttgaccatctactacgtgtactagctggagtagcattgaatccatggagaaggagagatcagagagaggttttggtgtagtatttggtcccatgcatgcatgaacgacaattgaagtacactgacagtttgtgaccgggagtcacacaaggcggctacacatgcacgtacagtagtgatcgtgattgatggaggaactcgacaactagctagtctgaaactgcaagtgtgcagctgggtgccacggcgagcacgtcgttgtggatggccacacgggatcccatgaaagaaaaggtacggggaatatccgactccatgggcccacctgtcagcctctcctatcccctcctgccatttgccacggcctcctcctcccttttgaagatcatccctccttccttttccactgccattggattggaggcaaagagattcagcttagtaatagtaccgcttaaatctgcatgcgtctgtatatcagcaggctctccatggccatggtcgattcctcctagcttccttcattcctcaacgctgctgctgctgctgcatgcgtgcgtcgccgtcttgtcctttttaattccagagtagttagttagcagctaatcttggctttagtactccgtattagttagcctagctttggatgagcagaagggcagcgtgatcctg

SEQ ID NO: 4261 - DNA, 1501 bp, Oryza sativa
tacgatgaatttagatagtatatatatattcagatacataataatagaatgtgtcacgttccgattggttttttatcggatggatggagtagctaagtagttgagaaagcattaaataatggttggttgcatacgtggtcgtgccatgcgtgggcgcggttatagacgatggcggcgccgaggctgcgggcggggttgatgccggtgccggtgatggggatggtggcgaggtggacgaggaagacggcgaagccgatggggagcggcgccaggatggggacgtgggagtccctggcgttgcgcttggcgtcggtggcggagaagacggtgtagacgaggacgaaggtgcccacgatctccgccccgagcccgtcccccttggtgtaccccgggttcacggcgttggcgccgccgccggagcccatgtacaacccccgctggaaccccttcaccacgccggcgccgcagatggcgcccaggcactgcatcgccatgtagaacaccgcccgcgtcagcgacagcttccgcgccaggaacagcccgaacgtcaccgccgggttgatgtgcccgccggagatgccggcggtgcagtagacgagcgcgaagatcatgccgccgaacgaccacgcgatgccctggatccccacggtggcgcacttggacgccgacttgttcacccccatcaccgtcaggatgctgatgtacaggaacaggaacgtcgccacgaactccgcgatccccgcccggtagaacgaccacgacgtcagctcctccacctcgaacaccggcgccgccggcggctcccggtagtccttctcctccgccccctgcgccgccgtcccgatcggctgcctctccgtgtacctgttcgcccccagcctcacatcctcctccttcccctccattactattaatttgcctcttcttctttctactactcactactagctctcttgccggagccggagacgacgacgacgacgacgacgatggcgagctgtggctgtgaggagagcgagtggcttcctgcttctttttatagctcctgctccactactacgtctgcaccaatggccttctctttctcttcctctttactaattaattaattaattaattattcattttgttttagcagtcggcaatttagtaattagtggacgacaacgatgatggtaggggtttttgttttaccttgattaatctgtggatgacaggaagcgctactgttactaagcttgaatttgatggttcatcggttattgtcagcgagagataaataattcacaagatgatatgatagattagtagtatgggttcgtttgctacggggcaggttctggaaattaaagccatttttgtttaggtgacacgggccctgtttggatccggagggctattaaatagccctccggaatttcgttatttaagagtattaaacgtaaattactgacaaaactcattccataaccactaggctattttgcgagacgaatctaac

SEQ ID NO: 4262 - DNA, 1501 bp, Oryza sativa
ggacattttcgtttagcccaattaagcaatcaagaaagtgatgaacactgcttactctgtttttaagtactttctctattttaggatataagatgttttaattttagttaaagtcaaactgtatctaatttgatcaagtttataaataaatatagtaatatttacattactaaattacttttatgtaattaataattaaatatattgttataataaatttatattgatcgataatattaatattttttctataaatttggttaaatttgaagcaatttaatattgactaaaattaaaaaatcttgaaaccttaaacggagtgagtagataatataattgaatttaacgtaacggttgatcattaagctgtaaattaagaaatgatggaactgacatgatgtggtcggatgtccagaggatggcgtagtggtggaagtcggcggtggggtcgaaccagaggtggaacttgatctcgcggccgagggaccggggcgggtcgccggagccgagggagaagacgttggtctgcagcgtgtagggcttcccgggggtggtgccgaggaactccatgtccacctcgtcgtgccaccccgggtgcgcctcgccgttggacaggtagaaggcggtgatcacccccgccgtgtacccgcgctgcagccgcacccacgccccgaagtacccgctccggtaagcccgccgcgacttgaacccgctccccgaccgccggtccagccacaccgtcacccccgtctccggcgccgccgcctcctgctgctggtgctccgccccccacaggctccggaagtcgcgcccgaactcccgcgctcggaacatcctgctcgggtacacccccggcgacggctgcgcttccgccgccgccgccaccaccaccgccatcaacgccaccaacgtcgccgccgccgccgcgacaccctgctgctgcctccgaccaatgatagccattgatcgatcttacaaaccggaggagttgctagcttaatttgttcagggcgaatataatgctagctcgtgcaagtttgtgggtggtagcatatctcctatatataaataagctaagtagctcggccggcttaattatgcaatgtgtgcttaattacctaaatcattaatcttttttcccttaaggatgatgaacagagaaatatattaaagcttgtgcaatatatgcacactgtgatctttgtgatatgtctcgctcatgatcatttgctagcttaattagctaggatcgatggtcggtgagcgagcatgactgatctaaccgcggacaacactacactgcatgcccatttattactcacagtgattttttttcttcttgtttggttcattgaacaacccaacattgtggaacagccgaaaccgacacaatttcttatctttatttttttttctttcccccatttgagatatcagaaaaccaactaaccgacgaaacggagctcagcagcccatacaacgggcccaactctaacaaaag

SEQ ID NO: 4263 - DNA, 1501 bp, Oryza sativa
gtgtcatcttaaatttttctccctggcaaatcaagttaggaaacaagtgcatttatcagctaaccacagattttttttttagtttattttgcattcccacggtccaggtaacagctggataaatgatgcccctatctcccacaacatcgccacttcaaaactaaccgatcgtagttgtcaaagttatccagttaggcatgagaaagattgaacccagccactaaattactgtaccaagttctgtagtttgcattggctgctacacagcgtgacaatttagaggtagatgacctaatacaaatgtagagaccgcgctatgatagcttcatatcatatcagggcaaaacaaaagctgagacctccttcacagctagaatcaccatctcatgatctacatcgaaacgattataaacactcacggagaacatgaagagcagctcccgtagatcgcccgccccctccagaggtgtcggcggcgacggagcgaggtgcaggaacaccaccctcttctccccgtcgcggtggtacctgactccgcccgcgagggtcctggcggagccaccaggggagaacacatgggcgtccaggatccggtcggcgaggcgggcagtgcccccgccgccgacgaagccgacggcgacgacgccgtcgtgggagggcggggtggcggcggggggcggcggggagggggaggaggaggcgggtggcgggggcgtgcgggagaggacgcggacggccggggaggggcccgcctgaggcggcggctccatcgccggcggcgaggtgggggtgggtggcgccgccgcagtagcagcaacctctgtctgtgtattgcgagacgccaactaattgttaaatgggcttctacctgggatttcacgagggcttagtgggctttctatctatatgggccggtaatgttaaataggcttttgttagagttgggcccgttgtatgggctgctgagctccgtttcgtcggttagttggttttctgatatctcaaatgggggaaagaaaaaaaaataaagataagaaattgtgtcggtttcggctgttccacaatgttgggttgttcaatgaaccaaacaagaagaaaaaaaatcactgtgagtaataaatgggcatgcagtgtagtgttgtccgcggttagatcagtcatgctcgctcaccgaccatcgatcctagctaattaagctagcaaatgatcatgagcgagacatatcacaaagatcacagtgtgcatatattgcacaagctttaatatatttctctgttcatcatccttaagggaaaaaagattaatgatttaggtaattaagcacacattgcataattaagccggccgagctacttagcttatttatatataggagatatgctaccacccacaaacttgcacgagctagcattatattcgccctgaacaaattaagctagcaactcctccggtttgtaagatcgatcaatggctatcattggtcggaggcagcagcagggtg

SEQ ID NO: 4264 - DNA, 1501 bp, Oryza sativa
tgtttaaatagttgataagtagaattacttatccttggtctgtgtgccaagataaaatatgactatcaaaaatagatggaaggagtatatatcataatgatgagaaatctcgatcggtacaaaacggggaacacatgcatggagatatatctagaccaacaagtacgtacagaaataaacttctgtcgaggatgtacttgaacatgaatgtttgcttgatattgttatttagctatattttagaatactttacaaatggagggatgaattgcaagtacaccctctaatttaaattagattaaattaaacacatggtgaaataggaatagttaggaagctaggcagccgtaaattaacctaaaatgtacatattgatagaagcaaggcatagtcatttatgcgtaaaggtaggcaccgacgactacagtagacgaaattttgggggtggacggagagttaattatttttccgttatatatttggtacatatataggtaattaattatgtggcggtttatataaataaataaataaataaagggagatgcatgcagtatgaaataggcaaagggaggcgaggagaaatacggcatgcatgttgaccggaaggcatacacatacatatgcagaaaaaggaaggacggaaaagaaaagatgcatggcggaaagggaaaggcccgacgaatgggaggaatcatatattccatcgattagagcaagtttaatagtaagttcaatatcaactatcgaatcaacatatataagtacagtagttgtaaggttatttttaatttttcttctcctctctttttctctcactaatgtatttatattagagcagctaataattaattgttgttgcatgagagccaacacgtacgttttcttttatatattttttcttttacataataagtttatagtgtgcttatactacctcattgtattatgtttgctcttaattaaggcattaattaaggtggacggagaatcggaatggattgatgcgatgcctccactgggggaacctccctcttctctggatgcttttgctgtgccggcgccgcgtggttcttcgtttcgtttgtctcgccatctcttaattccttacgttgaccattatttaagcctcaaaatcatctgtagcttagcttgttcaaggaggccgcgtcccgcgtgcgtgcgtctgtcgcggtcgcggtcgatgccatgctatgctagcatcacctgtcaagcacgcacgcatgcagttgatccagtcaaaccccacaatctcctcaggcctcagctctccatccatctatatatacattaacaccacaacaccccttcccgctcataccatccatccaaccatcgatcgatcacttccaacttattttctttaagagaaacaacaagcttaagctagctagttagtcatcttgttaattttggcctcaaataggtctagaattcatcaagaacacgagctagctagctgcactgtctcgctatatat

SEQ ID NO: 4265 - DNA, 1501 bp, Oryza sativa
cgagcacgacgtcgatggcgaacacggtggcgaccgtcgcggcgaggatccagacgcgcaccttcccccagaaggcggcgcggcgcaggcggagggtggcggcattggggcggagctcggcggcggcggcctcgacgagcgcggcaacgaggcgcttggagcgggggctgaggccgcggccgccgcgcagctcggcgagcgcgaggctgatctggtccgggaggggctcctcctcctcctcatcgaccatagccgtagcctcggcgggcgctgtgacctgcacgatataatcacagctgtcgaattgtaaaatccaaattcgtagacgcactcgaatcgagcaaattctggaacagaaacatcatttccagttggaaacgacaagtggattcagaatcgaagcaaactgaacataaagggaaacacaaatgaatctgaaatgattggggagcagagaaactgtaatcacactggaatcaaatcgaagttaaaaaaaaaacgcccgatgccataaacccaaaccaaaacccagagcgtgagcatttcaaaatccaccacctcggtgagagcggagtcggcggaagcggtgatggcgtcatccgggtccggggcggcggagatgagggcggcggtggtggtggtggaggaggaggagtcggcggggtcggggaggtcgagcagcggcgcgaggtcgtcggggaaggtgaagtcgccgtcgtggaaggccaggcacttggcgaccccctggtggttggttgatcgaaagggagaggacaaggtttagcggtgggcgatcgaggaggaggtgaagggcggggaggtttggttaccttggagttggcggcggcggggatcggcggcctgggggtggaggaggagccgacggatggccgggcggaggcggaggaggagcggatggaggcggggcgcggggtgtgcacggcggcgggagacggcttcgccatggctcctctcctctccgttgctgcgcttctctctctttgtggctccttccctcatgaagaggagagaggagagggaggaggaaggcaacttgaattgggccgcttccatcatttgggcctcgcgagcgaacccaattcccagcccagcccaccttagagagaggagacagagacggagacaaatcggtggatggggcccaaaaccgtctcttcctcctccttcgccttcttctcccttggtttttccctcgtgacatcacggacaccagcggcgatccatcggcgatccaccgcgcgcgcttcgatcggcgaccgcctcaggtgagctccgcgctcctccctagctccacccccatggtattcccctcccttggccatgcctcgagagtcgagacgatccaagcggattcatccacgcgagtctcagattcagatggcctaatcgatccaccatcgcatcgcatcgcaatttcttctctcatctaactcttcttcttcttcttctctcctttgccagttagttagttaagtttcca

SEQ ID NO: 4266 - DNA, 1501 bp, Oryza sativa
agaacataaatattacttatgagtgatttatttttagaaaattttatcataaaattttcaaataaaaaggattatcaaacattggatacagagacccacaactgtatttagagtactcctgtacttaaaatagaacggatagagtagtagggatgataatggttcagttcaaaaaatttacagtttccagatgtgtttttggaaacggaaagtgccgattagtttttttttggagaatttttgaaacaaatttagaattgttatataaataacggaaccgaatatggtaaggctaccatccattggaaaccggaatcggtcaaaaacgaattcggaaactcttcatatacaagtggtttcaatcttctccactctaaaatgttcagattgcttatgattattgaggtgtttagttagatgaagatgtttcttttaaggttttctttggtctaattatttttttattaggctgagccatactaattacattatgtgaatatagatctcgttctcgtgaaaagtaaagcatactattagttgtattattattgaaactggtaaaattataaatgtcgatttactattttaggtaatataacgagctacatctttccgttgatttgagaagttcagtttgagagatttttatattccgataactattcattttgtattggatccgatgcgttttattttcgtattcgataatatttgattccgtttgcatatccaagattttcgattctaaaaaaatatgaaaaagaatacaatagagatggtttccatccgttttcgagccgttttcatccctatttggtagaactctagcttcacctctcctgctcaaccgaatagtttcagcttcacgtataaaaaatgattggagtagactaaagtactgtcacaaaataaaacttggaagagatggagcatgacccaagctattccataactccactttaaacataaccctcagggttcaatttagaagcctactccctccgtttcaggttacaagacattctgactttggtcaaagttaaagtgcattaagtttgtaaaaaaaatattaacattttcaatccagaacaaatttattatgaaaatgcattcaattaattatttgataaaactaatttagtattataaatattactatatttatctataaatatagttagatatgaaataaattgattttaactaaaaatcaaaatatcttgtaacattaaacggagggagtactagacaagcatgtatatggcttttttcggttgatacagtcgcataaaaaaaaacaaacgaagacttgcgccttactcgctggaactatccatcttggcgtggacttcaggtgtcatcgtctctctcttctgtcccttatataagctagctccacaagctttcctgtttcgatcgaccactagtgcatttcttgcttctcctaggccagctaggctaggctactaggcttgcatgggtgaggagtcgtcgccggcgg

SEQ ID NO: 4267 - DNA, 1501 bp, Oryza sativa
gtaattcggacgaccgcgatagtttagggggtaattcgtactttttcctcaacaatatggtattatttctgagtctggttgctatgatgcacgacgcatacgtgcagtcgtgcagcatatcgatggaccgaaacctcctgggcctccatggcactccgcgcgatcgagcggcttgccgcggggcggggccagtgcggaacgatggggctgaggcctgcagcctcggacaccgcacggcccgcgcatgcagacaccccctcccgtcgcccgcttccgcggcccggtccacctcccagctaggccagcagccggcgaggcccaatgggaccctgactctatttgggccgttagctgcaccgacaatacacgcgtaacgagcaataagtcgtcctttttctgattttagttctgggaaaacgtcgtgctcgtctgcagaaaagggacagaagtgtataaaccgcgggacaagcacgttctttctccagtctaatctcttacacagaattcagggcgaattctcgaacggttagccccaacacgtggcacttccggattcctggatttggtttcccaccagccaatgcgcagatcgtacgagttgcctccgcgcgttcgtgcttgtgcccgcaaggcagctgggcgcctggtccctgggccatgctgcagctgcacattgactagggaggtgatggcccaagctgatgtccgaaaacgggtggaaaccttccaaagaaatacaaatacaagttaggcttgtcttcggcagcccctcttcccaacccatctccctctttttccactgttaaacggtgtgttttttgtaaaaagtttctatacgaaaattgcttagaaaatcaaattaatccattttttttaaaaaatagcaaatacttaattaatcacccgctaatcgctgctccgttttccatgcggtcactttgggttggaaaggggttccgaatacacctttcctaacatgtagtagtagataattgtatcagaagatggaaattagaccatcttaaaatgaaaatgtacagattagcaaaccaaggaaccatttctgaagaaaaaaagcaaaaacagatttaggcacctgtcggtgacatggggccgggggtatcgtgactagaggcttgggtagccgcggtcacccacgtggcccgaccccctcgggggggtcgggcccgagggtgacgtggccacccctccttctgtctccccgagggatcgggccgctcccgtttcggccccgagggctggggcgccccgaccccctgtggttttggcgccacgtgtgtgggttaggtgagcacagcgggctcacctaaccgcatttatagcaggttggatgagcgcgccacgccgcatttaatgcggcgcagcgcacgcttatccggtccgtgaccagtcgcggtgtgtgaccggtcacagaccggtcagatcgcgggttaggtggcaacaggcggcctgtcacacgcctcgccccgtcccgtcggaa

SEQ ID NO: 4268 - DNA, 535 bp, Oryza sativa
ggaaattgacttttccaacttcacggctgggggctaggatttgtcagcttcagcatggtttgttagagcatccccagcagctcatctatattggcctcgaaacgtccatatggagtatcatccaaaaaaagattcctcatccatatcccttccaactccaacagatcatccatatcccatcatcctatattttagtaatatctttcaactaaccttacatttatattttaagagatatattttgaactacttaattttaaagatgttatttatcgtgataatatttcaattaaattttaacagaaatctttttaattgatatatttaaaatgagtgaagcattttttttgtgcattgaatgactacatttgcaacggctacattgccaacagctagctagctaattgaaaatgtgcaacggctagcaaattgcaacggctagcacagacatgcatcatctctatatataccactacattgcttgctatctttttgcaccatgcaaattattgtgcatgattcttccatcactcaa

SEQ ID NO: 4269 - DNA, 1501 bp, Oryza sativa
tgcggggccaatctgaatctactccaatatgactttatttaatcttcagtttaattgctctggcaatcatgaccgcgactctaccgacatgctcagactgatcgcccaggctttgaaagctgaggaacttcaaaaatggagcgcgagaaaattgcattatgcatataaacagttctaaactctgaatactattgctctgctttccccagctgaagcacaatcacagaacaacagcgtagcattgctgtgcatctaaactactcattccgtctcaaaatacaataacttctctttgaatttgttctaaaatataacaacttcttcaccagcattctctttccaaccaatcacaaacctccatcattcactttttccatctacctccatcttaataactgtgcataactctaaaatttcttatattatgagatggatagagtagtaagcagaaagttaccacatttgtttctcattttgattgcttcaccgaacaccgaacgagagatcatgcagaaaatcgcaagatcaggagaaagctcgtgtgctaaaaagaattattaggagaggcttatcgtgtcaccgcgagaggataggaacgacacacacggacgtacatatccctgtatcaatgcgcctttcttgacgagaaatctgcaagagcaacagcgcagcagcacacggtagctgtacgtacgcaggccaagccgtcgtacacgtaacacgtccagtagccctcgatctcactctcccaggacattaatgccggtgagccgcccccatcgtcagcatctcagcggtatgcagatgccgtgccgatcgttcgacggccttctcccccccgcgaggaaaacgatatccttctaaacgcaattaagaatcagatacacggacacacggtacaccggtgcacaacagatttgctttgccatcaagccagaaaaaccggtcgccgtgaaaggcacagggaaacaaaacctgtttttcttttggttctctgtcacgtcaagtgcaacgaacggcacgtctcgcttgcgtttgcggttgcgcccgaccaaccagccgatcgcacgacgcgtaccgactcaagagtcaggtagacgcgccgcggcgtggcacggaggagacacggcgcgccacgcgttcgcggcctgagatgatacgccgaggcgagccgcgtcgcgccgtaccacgggcgccagcgcggccctggcacgcgccaccgaccccttctcgtcggctgccacgccggcgccctgcactgcaagccgcgcccacacggccacaccggcatgcgggttaaaacgaaagaaaattgtgaaacacaccaacgcactgtacaggtactggaccacgtcgcagccaggacggctgtggttttgaccagagttcaccgcgcttactactagtagggcacacaaggaggagtgctatataaaagccggaccacggcggaggcgcagtagttatcaccggttcatcgtacaaaagaggagagagaggg

SEQ ID NO: 4270 - DNA, 1501 bp, Oryza sativa
ctatcgacagcaagatgttcgtgttgacttcatcaatcttaagatatgtcggtccagtcttttgaaaatgctagaaaatcttataatataaaacggaggaagtagtagatatgaggtatcccatacactcatacttactttacggggaatgtagttatctactccctccgtcccaaaaaaaaaaggcaaacctgggttcccgtgccaacgtttgactgtctatcttatatgaattttttttataattagtattttcattgtagttagatgatacaatatgattaatattttatgcgtgacttatctttttaatttttttcataattttttcaaataagatgaacggtcaaacattagacacggaaaccagggtttgtctttttttttagacggagggagtaattgtacacaaaaagatatctatgaataggggtatactaggagtgaatacgcgtcacacaaggaaagattgcatagttcaagtcatagacgttatggcttcatggacaagatctagtgtcctacttgggatcaagatctacttgaaccagggtcgtattccggtataaagacacaccacgtcctaggagaatagggcgtcaaatctcaagccacagccttcatgccaaatccatttaggggaagcccagagctagccgccaattgcattgttgccgcatctttagagttgtaatagtatagcccactactagctctaaattatctatagccaatgtaataaccaattcatacaatagttgcttactatactattaatatctgatcctatatatcatacacacattatgttttggagtccgtgctgcaactggctacagatctgtagcccactgctattctctctatttctttatctttttaaaatatgtttatagttggcttatagcctgctattgtacctgctcttagtcaaggttagttgagtatgctagattagagatcccacctcagacatcatactcagtgtgatactttcggtcaatagatataaacatgaatagaactattactcacattgagggttcgaacttgtaaaaatctaattgcatttcttcttatgacatctacgtgcatatccttataccgatcttatacgctacatccacaaatactatagccaggatcttactcctcaataatgctatttaacaaattctaaaatatttgacaattgtataatcaatgaattatgtaaagagaaaggttatattacaaaccaatcaattttgtgttcttaaatatttgttaaatggcaaaatttgctacatgatatcagatattatggtatttattggtcgataccgttaaacatgggttggttttgtgatactacaaaattttggtggtccagtaattttggtggtctgtgcgagtgtgtaattgtgtacaactgtacatgcagtgtcgtttgtgcgtgcgtctgtgtctaattgcgaaaaagatttagccacaacacatatatttgtcctttaaagtttta

SEQ ID NO: 4271 - DNA, 1501 bp, Oryza sativa
aagaatattacaaaatattcccggccaataatttttaaaggaaattttaatttcctctataattcacttgattaagttgatttaacttttatttaatttctagaaaatgtattattaattgatttttattcccgaacgaaaatcagggcgttacactgaacaaggttggtttagtgatcaggttttggatgatctacaggggaaaacatagatgcaatcagattttccagaaaagagtaatcagagggagggaaagcagatagtcattgaggggggacagattggaaatgttgatctcaagtacagtggtgaaccaagcacagaggttcctaagggggggtctattgatgcctgacatgatggtggtggaagacaagataaagtgttcacaaatattaagagacaaagaattggcttttaagttacagtatgaagattcaactatgatacagctgaatgtttgtgaatcaaagaaatcctcaagtgaagaaggggaggtgcttggtcaggtggacaagatacagtcttctcaggaacagttatttggaggagggcagataaatgatcagatagacagcatatctagaaaagttgcagaggggatcctagaattggagatggatgaggaggataaggagaaagtttctttgaaagacagtgaagattatatggattctcaggaatcagaaggaagttttggccaagagattagatatagacttgactgaagatgtgacaggaagtcaagaataggagatgaggaggaacaaaagaccgaaggacaaggaggacaagaaaccttatgagatggccattgaaagaaaagaagcccaaaatgcttttatcaacaaaggtcagaaccagatcccttcctttatacatgattcaaatttgtctttagttgacatggctagtattctaggggtaaatcttggttgtgctgtggatgatgtagaatccaatgtgcatttgattaaagagttggacttggctagaattaacctctttatgaaagagggacaaaactctgattgccattttgatgatgtgtccaatagggagataaatcctgtgatacttgaacttaatgattctaaaaattccggagaggaggttgatgactttgaggaaattgagtttatgctcaagcaaatacaatcttcagctagaaaaatgaaacaaaaaaagggaaaccttgagattttcaaggtcactcctaaacttaagaaaaggaaaaagaaaccaaaagaattatgaaaaggcatattctggaatattagaggcatggggaacccgaaaaaatagatcatttgcaggacctaattagggattcaaatgtagactttgtgggaattcttgaaactataaagcatgatttctctgctggcttacttcatagcttaagtggacaaaaaaaaattaaaatgggaatggctactctcatgtggcaggtcaggggggattctagtgggtgtaaacatatacaagttatcatttgtaa

SEQ ID NO: 4272 - DNA, 1501 bp, Oryza sativa
agcatgtcggtagagtcgcggtcatgattgccagagcaattaaactgaagattaaataaagtcatattggagtagattcagattggccccgcaataagataatcatatatatcctttgatttcttttctcataatggtttctgaagccttggctcggccggccgtcatgggttgcctgaactagcatcagggtttcggggcccaaatcctcatatggtcatatataactgcatgacgttgcaatatgtatggcaaggatctattttacatgggtaaatttgtttattaccgctgtaaaaatcacgagctaaaaaatacatgctactccctttatcccataatataagacgcggtcaaaattgacacggtctccaaaactaatctttaacctataattttccatgtactataaggttcctagccacaaaactataaccatatgaaagtaaatttaaatatcaatctgatataatttttaacaaataaaatttattttatactccattcgtccctaaatatttgatgtcgttgacttttttaaacatgtttgactgttcgtcttattcaaaaacttttctgaaatatgtaaaactatatgtatacataaaagtatatttaacaatgaatcaaatgataggaaaagaattaataattacttaaaatttttaaataagacgaatgaccaaccatgtttaaaaaaaccaatgacgtcaaacatttagagatgaagggagtattatactaagtgttagtgaaatattttaaatgctaaatctttaaatacgtgtgcgtcttatattataggatggagggagtacgtcattagtatgtagatccagagatccagcctttatatgtcattatcatgttacgatgttatgttacaactcgagtatctttaagatggtactaagttatccgattttacattagtataatgttttgagttaccatgtttttaagagaaaagatagttttaccaaagatttggatgctactatggtattacttccttcatctcagaataagtttgttttccatctatttgtcttacagagacgccatctttttcagcgatcattgcattagagtattgggagacaaacgtattgagatttgctaaagtggagaataattatattggagtttgctaaagtaagaacattctttttttttcctttgtattggcatgggtagaaatgggctaaaaatgaagtcttagtgatggagatagtacacgggaactgtctaaagatttcagattgcagatttcaggcttcaggcttcttttgtttgagaccaaaattaaccaatcaaaaaataaatgttgatattgccaaattatttggcttagggcttgttcactttatagtcacttttaaccttaccaaaatttggttatactaaattttaacacatttttacattaccaaatttttagtgctagatatgttttgtttgaagccttatcaagttttgatggaatttttacgagtggaaa

SEQ ID NO: 4273 - DNA, 1501 bp, Oryza sativa
ggcgctcaccttcggccagatcgggttcaagggcaggaccgagggctacttcgacaagtgaatgaatccacagtggcttttggttagcttgactgtacggacggatgtgtgcgctgcatatccttccttttgtatagggctctgatttgatcctcttgcggatgtacgctgttgtaattctcctcaactccttaaaactttaaaggacaaatatatgtgttgtggctaaatctttttcgcaattagacacagacgcacgcacaaacgacactgcatgtacagttgtacacaattacacactcgcacagaccaccaaaattactggaccaccaaaattttgtagtatcacaaaaccaacccatgtttaacggtatcgaccaataaataccataatatctgatatcatgtagcaaattttgccatttaacaaatatttaagaacacaaaattgattggtttgtaatataacctttctctttacataattcattgattatacaattgtcaaatattttagaatttgttaaatagcattattgaggagtaagatcctggctatagtatttgtggatgtagcgtataagatcggtataaggatatgcacgtagatgtcataagaagaaatgcaattagatttttacaagttcgaaccctcaatgtgagtaatagttctattcatgtttatatctattgaccgaaagtatcacactgagtatgatgtctgaggtgggatctctaatctagcatactcaactaaccttgactaagagcaggtacaatagcaggctataagccaactataaacatattttaaaaagataaagaaatagagagaatagcagtgggctacagatctgtagccagttgcagcacggactccaaaacataatgtgtgtatgatatataggatcagatattaatagtatagtaagcaactattgtatgaattggttattacattggctatagataatttagagctagtagtgggctatactattacaactctaaagatgcggcaacaatgcaattggcggctagctctgggcttcccctaaatggatttggcatgaaggctgtggcttgagatttgacgccctattctcctaggacgtggtgtgtctttataccggaatacgaccctggttcaagtagatcttgatcccaagtaggacactagatcttgtccatgaagccataacgtctatgacttgaactatgcaatctttccttgtgtgacgcgtattcactcctagtatacccctattcatagatatctttttgtgtacaattactccctccgtctaaaaaaaaagacaaaccctggtttccgtgtctaatgtttgaccgttcatcttatttgaaaaaattatgaaaaaaattaaaaagataagtcacgcataaaatattaatcatattgtatcatctaactacaatgaaaatactaattataaaaaaaattcatataagatagacagtcaaacgttggcacgggaaccca

SEQ ID NO: 4274 - DNA, 1501 bp, Oryza sativa
tatcgtagcaaatattggtgcgttcgacaactttcacagcattttgcagcagcacgcataattaagataaacctttaatcgagtaagtaattattaaaaaattaaaaatgatattatttgatttttttttaaaaaaaacgttcatatattaaaattattgtacaaaatataccatttaacagtttgaaaacatattaagggaaaacgagaaagtagacatttaaagttgatgaaaaaaacttagctccagttttacactgattaaagtgccacgtaggcatgcacaggtaggcgtcacgttggcaacataatactcaccgtgccaagattgtgaggagcggaggaggaggatgcagcggttgggcagcacgacggcgagcgttgccgcggcctcccgccggccaccggcgtcgagggagtggagagaatggacgtcgagcggcggcggcatgaagggagccgtgccgtcgcgcgtccctcctcctcgccgcagctcatccaatgccgccgtcgcagcgtcgtccctgacgtggatcgatcggctccccaggcggaggcgtccggcaatcctggatctgacatttggtgggtggcgcccggcaacagaattattcccggccgttgctggcgtccgggtggccagccagacctcagttccagagcccgacgactgatgggctgattacttgaggtggtgttcggacgaaaacgctaatccgcgaccggtcgcgcatcgcgcgcggagaggagcggcggacggcgcgtgtacggtattcccttttttttgttttttttttcttccggcgcgtgtacggtttcttttttttttcgttttttctgttttcttccgtatttttggtttctttttcctttgttttcgtttttttgttttcttccctatttttggtttctttttcttttttttcttttttatcgttttcagttttttcggtttttataaagtttgtatacgtgtatataaagtttgtatacgtgtacataaagtttgtatacgtgtatttttttattttttttatttacgtatacaaagtttgtatacacatatataaagtttatatacatgtatacaaagtttatatacagtacataaagtttgtatacgtgtatacgaatatacgtgatgttttttttagttttttatattttttaatatgtacgtatacaaagtttgtacacgttgtatataaagtctgtatacatcatatataaagtttagacactactttagactagtcgcgcattagccccccccccggtgtttggatccagagacttaactttagaccctgtatttagacattaatttagagtattaaatatagactacttacaaaactaattatataaatgaaagctaattcgcgagacaaattttttaagcctaattaatccataattagagaatgtttatcgtagcatcacataggctaatcatggattaattatgcttaatagattcgtctcgcgaattaatccaaga

SEQ ID NO: 4275 - DNA, 1501 bp, Oryza sativa
taaaaatataaatattatttatttatgctgtgacgtttaaatcataaaaaataattttaacttatatttttacatatttatgttgattttttaaataagataaacgttatattattttttggagcggaggatggagtactcaacttggtccggttagtcaagcatcccctgaacgcccataatgaaatgaagcaactgcatgccattacctttgtctgtgagcgtacattacttaatacaagaagatgcgaaatttgataagccgaattctcacatgctaaatttgagccatctagataacaaaagtttcaacgttgacaacgatagcttaattaagttctattaaccacagccgcctaggcctagctaacgatgaacccaagataaccagggaataatttacacgtcagcaatagtcaaaccaaagagggtagtcacatcattaaacactgaaaattgtgttctttatgccgccgagaactaattcatgtgtttattcatcgaattctttgaatttgttgtttttgaagaaactaatacaagcgttctacgacaggaagaagaagcgatcgaactgcaaaatttggctcgatcttacaaggacagcgactatactaaaactacagtaaagcaccatgtccatggtggagctggccgtcgtagccggcggccggcatggaggccgggctgagcagcggcacggagaaccacgacgcgtagtcgaacatgtccgccgccgccgccgcgtcgctctgcccgtgcgccgggacacccgcgtaaggcggcgggggcgcaggcacagcctggctcgcgcccatggccaccgccggcgccgcggtgccggctccggtgagcctctgcacgagctcccggaagtccctgggcgccacgcggtacaccttgggcggcgccgcccccgcggcacccgccgatccccccgcgcctcctcctcctcctccgccgcgccacggcttcgccgccggcctctgcaccgccctcagcgccgcctcgtaggcgccggcgctcctcctctcgccgccgccatgatccatcggctctcgcgcgcgcgcttgaattggaagttggaacgctcaggttgggggggaagggaaacgatcgagctcgtgatgagacacggcggcgtacgtgcgggggagcagcatatttgtagcgggcgcgggcgcgcgcgtgcgcccgtgcgggcgggtttcgcagcggtcagctggtcagagtccgcgagagtggatggatgtgtgggggctcggcggcggctgggggctcgcacggacgcggcgccaagcgatttgtggaagaaacacgtggaaaacaaaggggaactgcgggtcaacgactcaacgcaacggtgggtggagacggaaccgatcagtaagagcagactctaaggagatgaaaagaagatttatagccataaatatattttaagaagataaaaagaaaagagaagagtcgtgtgctacaaatttatagtcagctgtagcac

SEQ ID NO: 4276 - DNA, 1501 bp, Oryza sativa
ataatttgatagaaaattaggttcaaatctggcaatttttggaccatacaattgtaatccaacggttgagatcttaccccttattcctatacataggggtgggcaaaaaaaaaagaccgaaccgaaaaaaccgagaccgagaccaagaaattcggtcatcaattcggtcctaggtagtgaaagactgaattttgttcggtcaattcggttagtctcctcgggtaaccgaatagaccgaattatcaaaaaatgtataaatacaacctacaatccactatgtttaataggattaaactctaattttcacattcctaccttttttaggcatgtaacataataagagtctttactcataagtgcttacgattttttttttgtgatttttgtgttgaaaatttctattatttctttgcatatatgaaaatgttgttgaatttcggtcaggaccgagaccgagaccgaatttgtcggtcctgacatttttttcactgaaatttggtctttacttttcaaagaccgaagattgagaccgaaattttcggttagaccgaatgcccacccctacctatacacccccatcctccgtatctccaccatggacggccggacattgacgcctcccttcgaccacacattcatgctttggtgaggtgcccctacctagccttcctcatccgtctcttatagttgatttgccccacccttctccacctttggtgagcggatctattagcacctcccttcgcctcctaacatctccattctactttgctcccgctgctgacctcacaactcgagcgataccgtcgttgcgccccatctccatggtccaaccttaggccgccgcatctcctagtatctctctaagatgagaaacttcccaactcttcccctcccccttccttcccttctcaatcaacttaccaagcattgttccttgcaagagtctcctttcaatcagcaccgatttgaaaatcgctcgcaccaccgcgttgttactacttcgtatgattggttgctctgaagcgatgttggacgatggacatattgtgcatcaggggtttgccgcaccctagccaatgtgttctttgcgctcaacatgatgcaagcatcgatcgcattctggatacatgtcctaagtcgagacagctttggtggctgatactcaggacaatcgatcacccaaaatgctctccaatgaataaaggatccttacatggttggttgtgcgacaacaggaaaaaaaattgccaaatccaaacaccaaggattcgacactatcgctgctcctacgtcttggtcaatttggaaagagcgaaataatcatgtatttaatcaataacagaaaaactggaggaggttgggaaggcaatggcaaaagagacggtgatatggcagctccaacgccgataacgtgaggacagtttggtcgcaaaatgttctgtgagagtaggcttcagtccttttctcatgtattctttctcctcctcattcttggttt

SEQ ID NO: 4277 - DNA, 1501 bp, Oryza sativa
ctccagccgaggaaggagaggacacacaggcgggtgggtcatcgtcgcttcgtcggagatcgagagagaggggagagagagaggtgagggaaaagaaaaataattaagattagaatggctgacatatatgattatttttttatttttctcaatgacatgtgggtccataagtgccacgtaggacgaaaccactatccaaacagccaagggagccaatattgcggttgagggagatgattcaaacaatggcaagagttgagggaggcaatatggacttattccatcaagaaaccaccaagaaaacctaccaacctgctcaaatgtaggtaatgacgttgtcgttggtgagcttgccaccgaggcggttggtgacatggaagacatccatgaaccacctcccatcctcggggagcagctcgtgcttcggctgctcccgaccgccgccgcctcgtccccaccgccaccgctgccgttcccgaccgctgccgccaccgccgttgccgctcttgactgccgccgccgccgctcccactgccacagccgccgcagctccccgccgtcatcgtccccaccgccaccaccgccgcttccgaccaccccgtcctcaccaccgccgccgccgctccccactgccgtccccgccgccgctctggccaagatgaagagaaaggcgggaggttgagagagagataagggagagagaggggaggaagaagggaattagtgggaggatgacatgtcggttcacaatgcttttttttttgtgtgtgaatgacatatgggtcgcacatattttttttatttttgtttttattctaatactacgtaagcgctacgtaggataaagacttggtcaagaccaccacgtaagcaccacgtaggacaaagacttagtcaagaccaccacgtaggcgctacgtcagccaaaaccgcctccaaaaccaccgagggacattgtttgcaccggttttgataattggaggagtcgatatacccggttttgtggttggaggatatgaatcatactcgggcgatagttgagggagtcaaagtataccaccgagggacattgtttgcaccggttttgataattggaggagtctatatacccggttttgtggttggaggatatgaatcatactctggcgatagttgagggagtcacagtatactttttccttgccagtttgaagttgaaaaagtccgtcctgtctatctatcttgctgggccttcccataatgggcctatctggacaaagcccgcttatagatagcccggcccagctcataccaaggtgcatctttctactacgttttgggagcaggagaggcagcgggagtgggaagacgatggtgagattgggaattccccgcgcaaccacaagccctagccgcccaatttcccgccaaaacaacccgcctcgcctcaccccggcgatcgccggagctccgaatccacgcgggatggcgaagaaagcagcacccaagtccgccgccgccg

SEQ ID NO: 4278 - DNA, 720 bp, Oryza sativa
cttcccattgatgaagcaacaaatgagtaagattggaaagcaatttatggttacaaatatgaaaatatccaatagttaatttattttgaaacaaatagagtaaattaaaaaaatgaatctaagatgattgatgcaacgcacgaatccatttgtgaacaagttctaaatgcctggaatacttatatttatagacaagtggagtccatatacacagttttatcatttgcttattgacttatcagccgaaaaaaaatagtttggaacttattttcaagataattttaagattttttatcgtagtttattcttcaatattaatttgtaaatagctaagagcatatattaattttctttttcttcgtggatgaaccggtataataaacgacgagaagcatcgtcacttgtcaattgtctgaatgcgcacgtccataactaacgaatatactcctgtatgttttctttgtggcaattttttttttcaggaaacctatcaactgtactcttacttgccaccgcagcagcataactatacccatacttgtctacagtatattccttttctcaaatcggtttgaaacaaaaatccttgtaaaagaattgatacgattgacaccgtttctcccctgctttgagtcctatataaagcgtctgaatgacaccattgtgtatgcaggttccatgacctattcgatactagtcctacacaaacataacacgcca

SEQ ID NO: 4279 - DNA, 1501 bp, Oryza sativa
gatcaggggcaggtgcgtcgcgccaacaggaggagtggcggtagggtcggtgcaggcgtcggtgctgtcgtggtcattggacggggagaggtcaaggttggagctacgatcaggtgatggttgggccgaggtagaggcagagccagtctccgaccccatcactccttccctttcctccactcttccgcaggaggggaatgacctctgctgctcttgccaatgacgaggaaccaaggaggaggatggaggggacgtcggccggcgcacatccaccactacctaggcatcttctctgttggcggcaacctctcctcaatgttgtcgttgcttgtagtaccaccgccctgcacagtgctatcgtccgtgcaatttgggagagtggaagaaggggatggctttcactgacttgtggtcctagtcaaggctatgtggcgccacgtcaaaggaaaccagtgtcaaaatcactcgggaggtagattgactggttttttttttttttgaggggcacgaatcaaactcaacctatagttgatggtggtaaattggacttaatccaaagagatcgatcccatacgaattgggcctttggaattgccacttgagctttcactgcggtatgtgggcccactgacaacaacgttgcttaaggccgttgataactttacaagaatacatcgaaggagagtggagaggaaaacaacgagctcatcagtgaccagagagccagaggtccagagcagaagataaagcgcacagctgacaacacacagatgccaaatccggcagcacgacgaagcttctacccgatcgactgaagtttagcgatagccggtaatccgccctccagattaaaataaaatcctgacgccttctagaaccccttgtcgcaagcaaaagccccatcctaatctttcccatctgcaaataagaaagaccacacatcgtcggtcggtcctactaatcattcacaccccccccccccccaccccccccgagatctctccacagacacgagaacattgagaagcacgcgcgacaggaaaaaagcactgtccgtgcgacgtcacctcgcccacgcaagacgctgtctcgccggtcgatcgtcatgtacccacgccacgcgagtactaccatcgaacagcacaaccatcgatcggcacagctcggttttacggtcgcgcgactccgaaccatccaagggaagacgccgacggcgacaaaaaagaaacccaggataccgccccgcccgcccgtcccgtccgacgtccgcgtcacgcacgcgcgcctgctcttgccgctcgatccattagagaagtttaattttatagccaactattacttttaaattatttatagtcaaatttttttataggatatttatagtcaaattaataatcaatttatacaatagttatctataaatataataaatatatgctacactattaatttctgatcccacctgtcatacacatattgtttcttaaagttcgtgctacag

SEQ ID NO: 4280 - DNA, 1501 bp, Oryza sativa
ttttttatacattaaaaatatatttatatatatacgtatgtacttactatatacacacgtgtgtatatatagtatatacatacgtatcagccgtccccacaagtggacggtgcagcatccctggcagggcgccgaggccatggccggcacagcagttcagcagtgacagcagcgactccaattcagtgtcgtggaagacggtatacggatatcggacggagagggtaccgctaaacgattaatcggaatgcggacgattaatcagaatttggcggaaatataacgttttgaaaatatatgtacatagttgataatagttttcccttctatatatccttaaatagaataaccatatatgatatttaaataagtttataatggatagctgttactgtatatctcaattctcatgtagtgatgggttttgttcataatgcatgaaatgaattatcaagagaatgtagtacatagcataaatgaccgtaatcaaggttccaaataacatatgtatcggcttcatcaaatacaaactccaataacgtgatcatcgtcaaaatcaaggaactcatgttcaaactttagaggaagtcagttccttgtcattttacatctttctgccttgtgagaatttcggaagagcaaacttctagtcaatagtagtaaagggcacagctaatgagttggattgtggaatcgacctttgtcaccacgctgattatacggctgattagacggagacggacgatttaatcggtaataattggatttatgcgtttgttaccgactaatgatgaccgcatcggcgtgacgtgacggactgatctccgtatccgtattatcggacgtattaatggccgttaacatcgttttccacaacactgctccaattaggaaaagagaggaaatgatcacaaagaggtaattgatgaccttatttaatttgaaaaccattactcattagcaactacaaattaccccattgacaagtagtgtagcagcattgcagcatcagtaagagaacaagccaagagctagaagcagaggagtaatgcttttcttctctcctgacccacctaaattttgggtgttctctaccactgggcacaggcaagcttaggatgatgaccagcgcacaaatctcacgcaaggaagggaagtcgttttgatcctgggtatgtcccctctagtttgttgaactatttattctaaaaaattaatataaaatcttaatcttgaactcaactcacaataagataaaaaaaaggattattcatagattgaatatgtctttttctgtatgtgtagttgaatttgaacttgttttggtagagtgatagatgtcggtgtactctacatcatcaattgttttgtataactgtttgtatttaatttagaagaaaagaaaaagatgcacgagggacatcactccagtgattagaatccggttccacaatgggaactagattctctgctgttttcccaatcacctgactagcaaaga

SEQ ID NO: 4281 - DNA, 1501 bp, Oryza sativa
ccgacagccgaggctgccggagcagcgcgaactccctcatcccctccacctcgccgccgccgccgcccgccgccttcttgatctccccgagcgccaccggccgccggaactcccccaccgcgcggacgtccaccgcgccgccgctcgctgcctccccctccccctcgtaccactccctggcgacctccacgacgccgacgacgcggcgggaggcggcgccggcgccggagtggtagaagaggcagcggtcgcccacccgcatggcgcggaggccgttgacggcctggcggttgcggacgccgtcccacggcgcgacgccgccgccgggggcgcgcgcctggtcggaccacgaccactcccccggctccgtcttgagcagccagtacttgcagttgccggcggcggcggcggcggacttgggtgctgctttcttcgccatcccgcgtggattcggagctccggcgatcgccggggtgaggcgaggcgggttgttttggcgggaaattgggcggctagggcttgtggttgcgcggggaattcccaatctcaccatcgtcttcccactcccgctgcctctcctgctcccaaaacgtagtagaaagatgcaccttggtatgagctgggccgggctatctataagcgggctttgtccagataggcccattatgggaaggcccagcaagatagatagacaggacggactttttcaacttcaaactggcaaggaaaaagtatactgtgactccctcaactatcgccagagtatgattcatatcctccaaccacaaaaccgggtatatagactcctccaattatcaaaaccggtgcaaacaatgtccctcggtggtatactttgactccctcaactatcgcccgagtatgattcatatcctccaaccacaaaaccgggtatatcgactcctccaattatcaaaaccggtgcaaacaatgtccctcggtggttttggaggcggttttggctgacgtagcgcctacgtggtggtcttgactaagtctttgtcctacgtggtgcttacgtggtggtcttgaccaagtctttatcctacgtagcgcttacgtagtattagaataaaaacaaaaataaaaaaaatatgtgcgacccatatgtcattcacacacaaaaaaaaaagcattgtgaaccgacatgtcatcctcccactaattcccttcttcctcccctctctctcccttatctctctctcaacctcccgcctttctcttcatcttggccagagcggcggcggggacggcagtggggagcggcggcggcggtggtgaggacggggtggtcggaagcggcggtggtggcggtggggacgatgacggcggggagctgcggcggctgtggcagtgggagcggcggcggcggcagtcaagagcggcaacggcggtggcggcagcggtcgggaacggcagcggtggcggtggggacgaggcggcggcggtcgggagcagccgaagcacgagctgctccccgagg

SEQ ID NO: 4282 - DNA, 1501 bp, Oryza sativa
ccacttcctttgccaaatgactagtaagacgagtccctgtaaaccatccatccaataaccggtatcggataggccggaaacgtacggcttctggcagggtaacaattagcgtggttaatgctattttgatggccgtgttatctgaggatggctggtagttggacaaagtctcgatggcatttaatgtggcatgcagtccgagatttattttgggtagattttggctggaaccatcacctagaagagaatggtagtcgtctccaaaagtcaggagtgttttgggttcgggaatttgatctgcaaactttggatatacatgccaatgaccggttctgttggcaaatccggttacatacaagttatctgctcggattgacaacattgcattgtcatcccctctcccaatcagatgtcccatcttccaatctactggcgcacgattgggagtttgttcgctaaggatatacctattatcaatctgtagctgacttgaggtagcaattacatcgtctcgaaacatgtaaaaattgacatagtaactgtttctgaagaagtcgtaatccaaaacatgatatggagcccacccaacactgaaaaggagaaaagaaatcagaaaaaaaaacaaatggagctaagacataagaattatattactcccttcatccacaaaagttacacctattacttttgccaccaagataaggagaaattaaactatcttggatgttacaaaatcaagaagtgaatgcaaggatgtaaccaatgagtatttagatgactccctgggttctaattaaacatttaatttatctcctcatttaagttttgaatgcataaagactataaatagaaacaacttatttagaaaatcttaaatgtaaaataggtgtaacttttatggatggagggagtagaatgcaaacaacataattcttatacattccgacgtacctcttgaagaactctactgattgcacggggaaaacaaggtataacagaaacaccgctgtaatgacagtagaggtagacatggtttgtgcaattaacactaataactagctcatcttatatagtctttacctggtgatttagctaattagttggtaataattagatattgttaattagttggtagtgagtagtttgaataattagttggtattgagtagtttgaatgtaaaaaaacaaattaatatagaggattttggtaattagttggtaatgagtaggttgaatgtaagaaacatatgaatatagaggattttggtaattagttggtaacatattgttataattatcggtggtaaaagttcttcatcaaaccccctactatatcaatacatactacacaaaacttttgccctctatttctttttttaaaaaaaagaactcttcatcaaacctatgagctaatgtatactactaataaatggtttttgcaggttgccaaaagcttaaaaccgatattcgtatgcgattatgtcacccgcctgtacgaaaa

SEQ ID NO: 4283 - DNA, 1501 bp, Oryza sativa
tgttcagtcatacaaaagaagaaataaatgtatccgcattaatccttgtagcttgtcagcagcatcacatggatcaaggtatcttctcctcaacaaaatgtaggaaaaaaattagtgatatcatttagggttgaacaatcgagtatatgaaataacaaatagtaggacacaccagaattcaaactggctaaatgttgggcaaacaatttctttctgcacagtgtataaatatccaaagtttagtagctgcctagctggttatatgaaatatgtgaaataagctactgaacagtaaagacagattttcctctcccctaattgtcatttcatataatgcactataaaaaataaaacaaaaaaaaaacaaatgacgatgtagtgagtatagttattagaaccggaccggaccggcagtccgacggtgtcatggttatggataccacatacctaatagtagttgattaagctcgatagggcctaccatataccgtgtcttatatggaatcatatctcgtgtatagaaggggttccggataagtaatgataagtagagttctatgtcatggcggcctcccggctcacgcactcactttgacttccattctatgccccgacgccgacgcctgcggccacggcatcgtcttcttcgtcgccagccagtacatcggcctcttcaacgacatcagcaacggcgacgccacgaaccacctcgtcggcgttgagctcgacattgactagaacaacaagttccgcgacatcgatggcaaccatgtcggcgtcgacatcaccagcgccggctactacgacgatagcggcaactccggcgaccatggcttccataacctgacactggcgagccacggcaaggctatgcaagtatgggtcgattacaacggcacggccaagcagatcactgtcgccatggctcccctcaagatggccaagccttccatgccatattgccattgctatcttctacctacgacctctcccgggagggagaaacgggacatgccgtcgatacggcgtcgtcatcctcgatggctcgatctccccttcctctgccgcctctcccggaccgcctcgacggcagccatcggtgacgccaccgccgccgcatcggccctcggccctcggcacattgctgttcatgatgtagtgggagagtgttggtatttcttaacgacattactataaataaaattcccagcaagggtgcaaaaatactcctgatatattatggttacagagttcatccacaagcgcacggatatatcattgtagcatttcacccgagagtattccaagggtatcgtatttatttaatcccgtgagaagatcatagtagagagaaccggactaataatttatatgttacttgtaataatcatagtctaagcagggattaagataaatcaaagggtagagtgacacacaagcagggagcttctcattctcatactaaaatatctaagctaagtggaaagaaaatagaaagaga

SEQ ID NO: 4284 - DNA, 1501 bp, Oryza sativa
tagtgtgcttggattggatccaaagcatcatgtatcagtcagttcctcctatttccaaaaatgttagtcgcctccatctaggtcattcccaaatcacaacttgtgcccttagctaagagcaggtacaatagcaaactattagctaactataaacatattttaatgagataaatgatgagagagaagagcagcgggctacagatctatagccagctgcagcacggactacaagacacactgtatatatgacaggtaggaccatatattaatagtatagtaagcaactattgtatgaattggctataaatgaattggagctagtagtgggctatactattaaacttgctctaagaagattatctaatattagtactagtattttcttaacgagaggcttggaactgtctgagtgcgtatttatttatagacgattctgaaactttttgacaatcatagggccagccagtttgacctcgatgccacaaacttttgaagcaccaaaatggtccaaatctgcaaagaagaagagcagtcgagacaattcttctccctccagaaaagcaagcagagcattgtttgttcctgtgcgcatccgtttggatgtgaagggcgttgaaaattcggccgatccccaaaaaccaccgatggatggaacagcagcctgccatatctggaattcttgattgtgaccgtaaagctactgaggaaagctgccgctgctaccactgcagaaaccacgccaccgatcgcaatacaagctgaagagcgttaagaatcagccgaagccaaaatttaaattctaaaacttaattttgtagctaatttaataataattttaatataataattttcattgatttctaaggttgcgttcgatccagctggttcccaacccctctctcttgttttccgcacacacgcaaactgctaaatggtgtgtgttttgtaaaaagtttatatacgaaagtttaaaaaaaatcatattgacacattttttttaaaaaaatagtaaatatttaatcaatcacaggttaatggaccgttccgttttctgtgccagaagatagcgttcccaacctagggaaactaacgcaacctaagtcgctaagaacacagtagtactttcgtgtcatagagggtgtttagatccagaggtgtaaagttttggcgtgtcacatcggatattatatagggtgtcgcatggggtgtttgggcactagtaaaaaaactaattacagaatccgtcaataaaccgcgagacaaatttattaagcctaattaatccatcattagcaatatttactgtagtaccacattgtcaaataatggagcaattaggcttaaaaattcgtctcgtaaattagttgcaatatgtgcaattagctacttttttagcctatatttacttcatgcaggtgttcaaacgttcgatgtaacggggtgaaaaattttggggtggaaactaaacaggcccataattgcccagcaccctaaacaacac

SEQ ID NO: 4285 - DNA, 1501 bp, Oryza sativa
gccggtagtggcccgtcacggggtcgggcacccacgacacctccctcgccgccgacgacgacgacccgtccttcgcctgcgtcatccccgcagcgcccttcccttccaccgccgccgccgcccgcctcatcgccgacgacgccgccgacgcggcgtaacccctcgtcgtcgtcaccctcgccgcgagcgcccgcgccgcggcggcagcggcagcagcagcagaggtggagagagcgagagccatcggatcactcgatcggacggctgatggcgctccgctcctctccttctctactctgcttcggtgcgacgcgacttgggcttgtgagctctgtgtggggaggagggaggcggaggcggacgcgcatttaaagaggcgagaccgggggggagggggctcgattttattattttttataaaatattttttggtggggtgccacgtggcgtgggaaagcacgtgacgggtcgagggaaacgtcgccgcgggttcgggctgtcggcgacgcgacgcgccgcggagacggtggacgggtcgagtcgtggtctggctatgcagcggtttgcgggtcggtggacgtggtccaccacgccaacgtgagtaaaccgatgatgatgagcgtctctggtttgtctttgtccactgtgaggaagtgagggcatcacattgtgatccataggtaaattataatattttattcacgttgtgtaattagttcctataaaaaacaaccaaagatacctatatacatatattgaataaaaaaaatagtagtattatctatgtctacttctctcttcagataatattacttcgtgtctatatacaatgttgggattgctatagttaaaatctatttacatagattctgtctatattgatcacatttgccatataaattggtgatgccttattattggtggctttttatataagctaaccgatgagtacatttacgttttttaagctgctaaacgatactcccttcatcccaatatataagagattttagatggatgtgatatatcctagtaccatattcagattcgtattactagtgtgttttacatccacctaaaatctcttatattgttggacggaaagaatatattgcaacgtgaaaattttctgtgtagaagttcttttaaaatatcaaatagttttatttaagtttgtaataattaaaattagattaatcatgtgttaatgattttttttcatcgctttatcttccctagaaaaacgaagaccacgtagcatttctctttattctctccatttcaaattacttgtttaaaatactagttattattataattttaaatttctaagcactttttactaaaatgtttcctgtttgctcctcataaatgcattaacacctgtgaccgtaatgtacaggggttgtttcttttgttgcttgatttagatcggcgcaaagtttggcttttggttgaaattagatataatgtgactgaaaagttaggtgtgtatgatagg

SEQ ID NO: 4286 - DNA, 1501 bp, Oryza sativa
agccgcaaaaggccgtcgcagggcccatccaaactccatcacgcccacccttgcctggatgcgtcagctagaggaaagctacactacaagcccagccgttgcccacgctggcttgtgataagtacgatgaattcttccagggtttcccgcgaaccggtccttaagagccatgggcgcgaccaacaaaaccatgcacccacagcccaccatttagttcattttaatttaccaacaccggagcggtggcactaaaccaacatcaacactaaaacctgacgtttaatcattaatgtgatttcccccatggtgtgctggttgaactaagcatggctaagcaatctctagaccaacatctagtcttgttatatcccaagctatcaaaggagcaaggtacaaaaatatcatggctgtaacagtaggtaaacatcccatagtaacattataaaacaatgcggtatttaagggaaaacggtagagcatttgcaatataggatcaacatgttcaagtgacaagcatgacttaccttgctctgctgctagaggagcctcggcgactatttcaaagtacaccggagcgtcaggagagccggaatctaagcgacatacaaagcaaacaatacaaataggctataagactactgaaacagagaacaaaaccattttaatggattctatgcatttttcttgattttctaagacttgaatgggcttaaacggagctcggatgaattttctatgaattttagaagattcactatgttttactataaacagaaaaattcttaattgatttattgcgcaataattaaattcccgggaagagatggggcggcgccgacatgcgggccccacgtggcagtgactcggggggggtgtccacggtggaccgggtccacggaccggggaggagcggcgcaccacgtggtgcacacatggcgccgacgcggcgcacacgtggcggccacgtggcagccgtgcgggcggcggggttggatggccccgatctaccgcccggtagatcagacggtggaggcgtctcgcggccgggcgcgcacgagcacggcccaagccgacccggcggccgtggcgcgcggcagcgcagcgcgacacgacggcgtcgcaaggtggcgaggggccaacggtggagagcagcggcgaccgacgacgagtggcggcgcacggcgagcgacggcggcgcggccccgagtggaaaggcagcggcgctaagagggagagggggaaagacgacggggagatgctcaccggggttcagccggcacgagggggcgatggcgaacggcggtgagggatgacctggggacgacggcgactggcggacggtctccggaaccacctagcgaacaagatgagaggggttagagggagagaggaaaatgggagagggcgaagacgacggccgaaggcggcggccatggcggtgctcaccagcgcacggggcggagagggttccggcagcggattccgacagaggagaggtgga

SEQ ID NO: 4287 - DNA, 1183 bp, Oryza sativa
ttttaatttagtcctcaataaaactcgcacccaaaagaaacccaagaaataccaaattagactcggagttcgactttgtgatctgaccggccacctcgcatggcaagacaggtctcttccaaatttagccacgtttttttttttttggctttccgggaaggatgatagcactatcatatgatccggattcatatagtacaatcctacggtaccaaatctatttctgaatcctattgtttttcattctatgaaacaagagaaactaaccttccatccatatattacttatctgggcgatcacatacgtgtgagaagtgctactaagagttaatagtagtgctaactactagctataggcacatttaaacctaacattttataatagattaggtataaggtgagctctactttttcctccatgtttcttccatataggtttatagtatatttatagtatacttatagctcactattgtccttgttctaattaactaaaagtatacagcaagcttaaatatctgatttgcttgctaggtcatgcattttttttcatatagagttttctattaaaatacttatccgatttacgattctattacaccattataaaaatagattttttaaattatttatagcataatgtaaattacttttagatttgattaaattacttcttatacatcaatgaatgtaaattcaataaagcctaaaagtaattatgtatatgctattaattactactctaatctcggtaccacgcttataaaagattaaggtattctatctaagcggagcgatgagaatatattttacttaaataataagagtaaataccataaagcagtcacaaacacttatatgaaggcaaagcatccgtcgaggtacaagctttgagaagagcgccaacagactcagcacttccccatacttccccctcactctctcctactctaagcattagctatatagagcttcacccttacaatatagcttataattttgtatcttggtgtgtgttgagaatgaggagtatgaagccaatagtgtggaggtgacttgagagagtggagatggcaagagaatattcttcctccagctgtctcaagcccccacttgtcctcaaaccgtcattggatggcagtttccttccatgagccttgcgccatcagctttaggagggcga

SEQ ID NO: 4288 - DNA, 1501 bp, Oryza sativa
gaatcgagctcctttaaccttgatcctccagaaatggtgcccgctgagcaggctgacaaccctccaccggaaaccaaaccggaacgtgaagattccgatgatgatcgtaggagcaaaagggggcgtgaggagaggggaggggagaaagagcggaagcgagaaaggcactcggaaggaaaggagaggaggcgtgacaagcaagagaagaggagtcggcatgagtcggacgacaggtcgaagcgccaccgcaaagacaagcacaagaggaggcatgactctgattccgactagttactgcggctctttcaacctgtctcactgtatcctgccatcatatttcatgccttgctacgtttgcttgatgatgatgtagttgtaaaaacagcttgtatactcttcttgaatacattgtctgtttttaacttgcacatgagaaatatgttgaacctgtaacatcagcggtgcattttggcaatcttctttctgcctatccttgtcttgtgcatttccatcttcacgggatgttaagtgttacggtgtgtagttcacatcaaaattagaagtttaattaaaattaaaacgatgtgacggaaaggttactccctctgttccaaaaaataacaatcttatactggatgagacacatcctaggacaacgattgtccagattcgattcgttgtattagtatgtgtcccatatagtataaggctgctatattttgggacggagggtgtgctctgcttattagttatttcttcaacgatccagtgaaaaccattcttaaatttaacaaacgtttaacacgttaagcggctaattatccaaccagaatttcccaggaggaacacgcagattagcaaaggaaaaataaataaaactagctgagtcaactctctctgtcgtcatcttcttcgtgtgtgcagtgtgcgagtaactcgactcgacgaagggcaaatacgtaactttctcggcaggagaggagttgggttgattcgcagcaaaggcacggcacggcacgcacgcactcgaattcaccttcaccttcagcgcgagccgcgagcgagagaggaaaagggaagcgacgatctctgcccttctagaaggttcgcctcgtcggtccccttccccccctctcctctcaagcttcagagccctctctctcccttacacgaggcgagatctgctccccttctcccgattcaaccaaccaccacctcatctccgattccccctcttcttcttcttcttcttcctcttcttcttggtggggttagtttctgaatcgtctctactgctaacctccgactctgatgccgcttcctcttcccttctctcctaattcacattctattcggatttcctttttgagggtactctagtctcactagtggagtgattgattggttgattggtgttgttgttgttgggaacacaaattagggtttgggatttcttgactggacgacctcgtgcgatttcgggaggcaggagccatgaacg

SEQ ID NO: 4289 - DNA, 1501 bp, Oryza sativa
ttttgtttcaagatcgattaacaatctgtgaggcggtcaggccctggcttcatataatcacacagatgaaccaaaataacgttttcaaagagtagtacaccaaggaaactatttaacttgttgacatagtgcctaccttgcaaggcacgtcgatatatactgatagagtaaattaaagaaaaatacatccatcgctgatgcacatcaacatagatcaatacatttggtactatattagtttgtatatttcaaacagaaaaataaaatatgtgcatgcaccttgaagaggagtatatttagccgtaataacaataagctaatgcctactcttggccatatgggtgggcctaccaaagagatatttaaccatttgccacatttaaatgtagcaattaattttttatcactggacccacatgtcagacacatgtggaaccacgtgtcattgagataggagtgacaaatagttatttaccaaatctaaaagtggcaaatagttaaaagcccccaggatgagtgactgggtcgatatggatcttgagccggcacgcctagctgttgaggttattggagaagaattacgctatgtgagagagcgccatcacaacacatgtcatgctgttgggagctattgggaggggagtctatctgggtatcaatctggctgagacttggagctgttgggaggggagtctatctgggtatcaatctggctgagacttggattgaggaagaagtgttggagtcgaggccggttgcgtcaaatgaaacttatcgctctcctttctacatgaataaatttatagaagtcagattgggcactcccacatccggcgctggaacactgccgtttttccccagcgccgtttttcccgtgttcaaaaatgttcgatgaaattcctagcaaattatgtgtgattctatccatgaaaaccaagggaacacactcttcattgtccattcattccatttttcagtctttgatcacaagttgaggttatggaaactgcgccaatgtcatgtttgtgtccttcatgtgctctaaaatatgcataccagtcaaccgcagccaccagcctacgcctcctccccaggctcctcttcggatgggcggacgtggagtccctgacatcaaacacatacataaccagagaacatcttgctcctgacagctcacttatctagtctaatatgatatcaaagtttttttttatgacatgcaagtctgaattgtagtgacaaataaacaggaatatggtcctgaggtaagaaatatagctaaatgacagtattcatgagaactaactgaccaacatcttgctagtctgattgaatgataaatcacacatggtccctccaatcatatgtacatttgacaaagaatctacccaagagttgatcatgttgattcagatgaaaaggaaatgaatctttacattacaggctaacacaagtacacaaccatggttgccagcatagctaaatgttgacatgattgcta

SEQ ID NO: 4290 - DNA, 1501 bp, Oryza sativa
aaaggaggtccaagcttacttagggaggggatgagcgctttttcacgagagcagtctcctgcctcttatcatcaacaccttctactccaacaaagagatcttgtaatctctcttcctcaatcagcatagcacaggagtagggtattacgtttctcagcggccggaacctgtataaacccctattgtctcatctcccccgaggggcccgaccctctcttgttcacactccaccacagagtcctcgaatctcagtcaccgcccccggccgaacaaaaaaggggacctcacggttccctggcagaggagttcaccctccgacataacaagataggatttagtggatttgttttagttttatatggtgattataagtaattaggtgaaattaaatgggcactgttacgatggaatgaaatgaaaattatgtagaaaaattaaatgagagatgataatgcttgattgagattattgaataagtggagaaaatatgtgataaattttgaaaagcaaaagttaccatatttttaagacgaagggagtaacacagaacgatatagatgcgaataataaatgctaaatgtcatacgcctcttgtacatctgcgtgtatatatgttaccagattttaattgatgttaattaggattaattgatcaaacatgtctgtgcgcatcgtctcagattaatggtgtgtttagttcgcgaaaagaaaaattttaggtgtgatatcggatgtttgaccggatgccggaaggggttttcggacatgaatgaaaaaactaattttataactcatctggaaaccgtaagacgaatctttttagcctaattaagccatcaatagcacacatgggttactatagcacttatggctaatcattgactaattaggctcaaaagattcgtctcgcgatttccatgcaaactatgtaattagtttttgtttttatctatatttaatgctccatgtatatgtcaaagatttgatgtgatgtttttgagaaaaaatatttggggaactaaaccaaccctaaacacaagtgtctgtcttggtcagccaactgctgaacttgttctcagtgctggactttccaggaaactagccacaccaattacaatagtagtatttggtccacgcaagcacatggatcatgcggtcaatgaggatacgaagaacgaagaaagcacctccatgtccatttgcctacccaacaatgtgttatatatgtccttcaaacaacttcttaaactaataagataaagtaatccatgataacatatttgacgccgctatggccaccctacctagcagagtaaaacaaactaagaatttggcgtctttacgtaaccagataatcctcatgtttttagccagcgcccgtgtcacctcgctccatcgcctcctctgcctcgccaccgcccgagcagccgccgacaaagccgggcggcggcaaggacagcggcggcggggccttcttctccctcgcacctcttcccggcgg

SEQ ID NO: 4291 - DNA, 651 bp, Oryza sativa
atttcttcaattgctgctggaagctcaccaagatcttttctctagctctcctctctcacaatgctactctctcttctacagcatgagtgtctcctctcttttgcgcagctcttgtgtgaggggcatcgcgtctctcgcccacttattttatagtgtcagctaagtaaaaaaaaaaagaagacatgattgacgttttcactgtattgacggcgcacattcctattttgtctacttttagcagcagcacgggttgtgggagataatttcacgtggaccagatgataaaagaagcatgcgcgggagagggcaaagggtggggccgggctgtcggtcccacactcccggcgtgcgcgaccgccacggtcccgcagagccagagcgtgcgaccgccctgccactgccacctccaatccatttatttgttttaactgttcccagaattttagcactaccacctacaagttccaatcattttttttgttttaactgttccctgaattttaggagtgattggacctaaagttgaggagtggtttgcttgtttaaatgtacacaaaattttagaagtgactgcaactaaattttaggattaatttaaggaactttcgggggaggggaggggtggcccgggaccgttgcccgtctcgcagg

SEQ ID NO: 4292 - DNA, 1501 bp, Oryza sativa
gtatctcaacttaaatagggagttattggaggctccctgttgaccggttgaggtgggaatcggaaagccacacgcgcgcgcgccgagccggccgggccggggcgagggcgtgggaatggcgtggcgggcgtgcgttgcgcctgcctctaccctttttgcaaccacgatcccacgatcccacgattgcctccgtaacggcgcgtgcacgatcccacgatcccacgattgcctccataatggcgtgtgcggcaactggcggaatcactcgtgctatataaggaggccgctaatccgatcagaactctctcgcttgctttctcttgctggtgttcttcctcctccgcgcgcttgtgctgcctctgttctgcctccccgcttctgatcgcttgcgtgcacgagagatcggaacgagcagggcctccggaaccataccttcgcctgagatctgtaccaggtaggcgggtgatcaagtttttggggagtgcttccgcacgactgctctcgacttctgctctgttcgtcgtcgtctccaccatgtctgcacctggagccggcgcagctaccgccgtccctggagatggcgcgccgggagccggagccgctgcgaacgtcaacgtcaacggaggcagttctgcctcacaatccagcggagagacattctcggggtatatctttctgctactgttaactcattctttgatacctctgttagaattgcgttcttggtatgttcatgatgcttattatactttaagcatgctctggttatgttacattttatcattagatcaccccacattgttcatgccatgattattgtcataatattttgaattaaaatatgccgatatatgaccatatttctaacaggaactatgctaaactactcaatttgagaaaatcataaaatatattcatactaactgaagaaggccctcatagaagcacttccacggaaatttcaggaggccaaaggccaggaattcacatattaatcgggaaagctaaaatttctcacattaataataaaacaaattctcaaatcaataaagagccaaaatgctaataaactaaacagttttggtaaaattatggcaccaccttttcggttgatttcaatcaattttttcatcatgtgatgcaaactaaagttttgtcgttgtccttttgcttatatgatttaagcagataataacagtatcctgaatataagaaaaaattacagcaaattttactgtgtaagaaaactacgctatacatatataaaatttacaatgtaatatatggaatttatagtgtaaatactgttgaaagatttgaactttttttatataatatgacgtcataagtatagccaggtcataaggtactccctccatactcataaaggaagtggtctaggacaatgtttaagtcaaatcttaggaatataaatcataaataactctcaagttgttgagtttgaaaatgtaaaaattatatgaatcgatttgtcttgaaa

SEQ ID NO: 4293 - DNA, 1501 bp, Oryza sativa
actagatctgccaccaccggtcgccgcttcctaaccaatctcgccattttgcctgccgccaatgctagcccattgcccattgccatcctcgtgacttcggtgccgccgcaagcacctcgttgcccgcccgtgtccaccacccacttccggtcctccattgcccatggtcatccctctaaaccccggggaacccccctccctaccaggctaccaccaaccccaacccaaaaccctaattcgcttgtctcctgctggagttgggggtatcaacggcgctagagaagagggggagcttgccggagtcagaggagaagaagcccatgacgaatcttgctgcagaaaattcacgtcccaatggcgtattctgaaagtagtgcgaattaggtggcatatcctgaaaaccgtgcgtactccaccacacgcatatcaccccaccactcccctcgcgcaaaaatcacgctgctcgccgctccctcacgcgctctcctttcccccatcctctcctcccgcccagatcgatccccctccccttgccaccgccacctcctccatcccttgccaccgcaagcaccgccccactccccgccgcggcacccgtgatgctgtctcgttcctcactccaatcgctgaagtcgaagactgccgagcaacactaatgtcccagcacatacaacacaccgaaccagatgaaaggtattgcacttcaagctcaatgggtttaacaactgcagcatactacaggttgataaaatgtcatggcatcctatggcacccagcaacattcatctggattaaggcaataccaaacacttgcaaaattttcctctggctggcctttcatggcagactaaatacgaatgataacagggtcaggaaatgctcggcatctgatccgcattgagctgtttgcccagctattgaatcagcagatcacattgttccatgctgcaagttggcatctgaggtttggaagaaaatcaacctatttgatcaggccacccagagtgcagattgtggagattatggataccccatacctacacggcatgtatagtccgactgggtatggggtgccatgtatagataagatatctttaaagggacttgggttaaattccaaacttgtatgtcaaggaaatacccgggatcccaatcggttatgattgtatattatctgtaactacctattccgttagggatatggactgtactttgtaatacggactccttcccctatataaggaggggtccgggtgcctttgggggcacgattttctcctagatcatacgatcaataatacactcggcggatcaatccccggacaggagtagggtattacttcttgattaagaaggcctgaacctgtataaaattccttgtctctcaacccatccaattttccagcttgatagccaccccctttcagtattgccgaaatcttgtttcgacaattggcgcgccaggtaagggtagcgtcaagttcttcgccgactagtgcga

SEQ ID NO: 4294 - DNA, 1501 bp, Oryza sativa
cattcagtttgccatcaatctgtcagaaagactgcggtattcagaaaatggtgacttttagcaattttatttatagaggaatatttttggccatttaaattagctggcattcctttgtttactcgaaaaggatcagagatcagaggatagaattaatgaaacgacacttgagttataaaatactactactggtacttttcaagttttttgaaggtttggttagcttccaagttagtactactggcagtctggcactgaaagcctgtgaattaatgtacggcaacgggtttgtgaagtgaccagaagaactcatggataaccatttcaatttgcaatcaacaaagtactctggcatgaagatcgaacagcaactgcagattgcaaattatatggaaaagaaaagagaaaaaaaagcagtaattgtacctttctcggaataccattcaggcaagagcctctctccgccgctcccgacgcaggtgtggaatcccggaagtctggctgcatctgtagagagaaagatggatcggaatgaatcagcagcaagaaatggaagagagtaattagtagtatgttgagaaaataaaataaatatgcagggcaggggaggggaggggagggcgtgacgtactctgaggaaagaggtatcccttgctgagagcaggacgctcgtagggagccacctgcagcagaaacacgaagaggaaaaaaaataattaggaattactagtccagtattcattcaggaaggaatcgatggatggatggatggatggatggtttaccgattccttggagatgatggcgagttccccgggcttgacgccctgcttggcgaactcccgcgcagcgtatccctgcacaaatcaaaatgaaaatgagttcatcgatcgtgtgagtgagatgatgtgatggccatgagaaggcaagcgcgtattgaagagagtagaggaggagggtggcgatgttaccgcggcgacgcctccgccgaggatgacgtaggtgaagtgcttcgcggccgccatgtcggagtcggagtgggacaagaggagggagacgacgatggaggggaaggaggacaggtgtggtggtgggagcaagggaggaaagcgcgcggcggaggcccggctctctcgctcgcttgctttttatacgaccgaaccgacgatggagtgacgaggcattagctcgatcgatcggaggaaggaaaggtttgctgcttccgtctcgtttcctctctctccgttcgtttcccccaccaaaccaactaattttggcgcccacgcggcgcgctcttgttcgtcaaacagcgagaggggcgagggcggctagtctcgccggcctagtcgcatagtacataccggatctacgacccagttgaccgttctcacccccacccgggaaaaaagggcaacaacgaatgcgcacacgccattgctgacgcccgttaattagagcacgattgatcaattattaatactccttcattgcaaaatactat

SEQ ID NO: 4295 - DNA, 1501 bp, Oryza sativa
agtcaattttgcctcccttgctattggttgaatctgatttgtatctctcaagtctgaaccgtcgtaaaactaggtatatcaccgtctcctctgatactaaaatcagtttagaatgactcactcggctattttgagattggttttggttgatgtgatgcccaatcaaaaaaaataaaaagtactacctccgttctagaatataacaactattggctatgaatctggacacatagttgtctagattcataggtaaaaatacttatattttaggacggagggagtagacgtgagccctcctcgtgtaagtgactattctatccgtcccaaaaaaagacaaaccctggtttccgtgcctaacatttgaccgtccgtcttatttaaaaaaattatgaaaaaaattaaaaaaacaagtcacgcataaaatattaatcatgttttattatctaacaacaatgaaaatacgaattataaaaaaatttcatataagacggacagtcaaagttgaacacggaaacccagagtttatcttttttttgggacggagggagtacttcccatcttcatagggccacatgtatacatcctctccctctcccctctcttcactacatgactccatctctctctggcagctctcccggagaggactcaaaacagacttttcccaaaataaaactaacaaatatgtggaccgtattatgatgggccgacgctgtgaaaatggaaataggaatgtaggaggaaggaataagttcaccattagtccctcatgttgatgtcgaggttgaatcacatccctaaaccgtaaaactaggtacaacacatccatcatttttcaaaaccaatacaaaatatagtcctaagataatattgaaagcggttttgagtgacatggcgctgatgtggcacaagaagaaaataaaagataacacgaaaccccacatgtaagtgaaacaacgatcttttttttttatcccctttctcactccgtcaggtggcggcggcggagccgcgtggacgacgaggcaaaccatacgggcagtgtggatgttgacatggctggtgacggtgatgctcaagccgaagcacgatcatcgagctgtttcacttacatatgggtcccatgtggttatttatttatttttgcttattgtgccacgttatccaaaaccaccttcaatattgtctcatgactatatttgtaccgattttaaaaaataagggatacgtcatatggtttaaggatatgatttaaactcgacatcaagacgagggacctaaagtttacttatttataggaggaatgaagccactgcagtgattctaacgcctaagcagatgcagatactatttcaattttttctggttgatcttttttattgaaataaaatttctagctgaacattattattactagtacaattttttttttctaaatattactagccatcgattgtgccacgtgatggccggaccaccgcccacttgcacttgctttgtc

SEQ ID NO: 4296 - DNA, 1501 bp, Oryza sativa
gttatttgtaaattgtatttttatacggactctaaacactatttttcattttattatgtttattctgaattttagttagttttaaattcttatatggactctatactctacttctaatattccttattttttaattctgaatttctattttttttcttaattgtatttctatatggactctatactctacttctaatattcgttatttttaattccgaatttttattatttcttaattgtatttctatatggattctatactctacttctaatatttcttatttttaattctaaatttcagtaatttcctaattgtatttctatatggactctagtctcctcttctaatattccttattttttacttccgaacttcaactatccctaaattgtatttctatgtggactctagtcgcctcttctaatattccttattttgtaattccgaatttcagctatttctaaattgtatttctatataaactcatatttcaatattctttaatttttaatttcaaatttcagttacttctaaattgtattcctatattgactttaaactcttcttcccatgtttttcttaattttgaattttagttacttgtaaattgtatttttatacagactctaaactctacttttaattttattacatttattccaaattttagttagttttaaattcctatatgtactctatactctgcttctaatattccttattttttaattccgaatttctattatttcctaatggtatttatatatggattctagctcctcttctaatattccttattttttaattccgaatttcagttatttcctaattgtatttctatatgggctctagtctcctcttctaatatttcttattttttaattccgaattttaactatttctaaattgcatttctatatgaactctagtcttctcttctaatattccttattttttaattctgaatttcagctatttctaaattgtatttctatatggactctgctttttctttttctccgattaatgtgagaatttctagaccatgagagcgaacgtggaggctcctttttttaattccaaatttcagctattactaaattgtatttctatgtggactttgctttttctttttctccgattaatgtgagaatttctagaccatgagagcgaacgtggaagctcctttttttattcctttaataatataatagataataatttataggtaaaattttatatgtgttcttagtgataaaaacaaatattattaaattaaccacgattaaaaaacataaaatcagtttaagttttaaaatgtaaatcttgacttataaagaccaacaagcttcctcaagcccaaactgcagagccacattttcggcccaacagatatttgggcccataagtgaaaaaatgggcttaggcccattcctctcctcctcttccgcgtgtgtgtatataatcttggtaaggtggtgcggcgccggtggccggaga

SEQ ID NO: 4297 - DNA, 1501 bp, Oryza sativa
ctgtgctgtgcatgcatcgttctaaaaaacaagaaatttcggccgtagaaggggtcggatatttcatcgccgaacccctaaatctcgtttaaaaaaaaaagacaaaccccgatcatttggatcggtagagtaaaatttcgtccctctccctccttttccctcttcgatttaattttcgagatcccattaagccttgtttagaaaaaaaaaatcctgtctccgaactccctacacttgttgttttcatcttgaaaagaacaaaaaaacagtaattcgtactgattgggcgattggctggtggtagtattatgtattgtattgtaggcttgtagcccaaaagaataattaagggaaatcccaattagttaattaagggtgtaattagcaaacgaccctaattattcccgattgagaccatccatatatccatccacggtggtcgcgagccatggatagatgggtgcgaccaccggctcctcggcgtacattgggcttttctgcggctgctttgatctatatgggccgtcaacatgtggcccactatgatccatccatatgggccgtagtttctctcatgggcttcctcctagataacgcccagtacagcacagcccatctcgaaggtggagccgttgccttgccatctcaccccccccccctcgtcgtctcgtcgccagccgccgccgccgccgtctcgccgccggctgacctcccgctcgatccccatccgtcttccgcaccatcccccccgccccattcctccccatgcgcttgccgctcggtcgcgccatcctctatctaacctagctcctcgcttctcctccctctgctccgatccgcgcgctcccaccacctgcgcctcgcatcctacctcgcctgccgcttcaatccggtaccttctccacctgcatcctcctcgtcttcagctccgcccagcgaaacaaccggcgtggtcgcgtccagtcagctcgtctgccttggcccgcagccagcgcctgactgccggcaaggtgttcgacacaactcccctgaggaggtcaatctgttatgttcttggccacacgaccatctgggtcgtcgtctctcattaccaggctctgcgtgctccacaccgtttcctggatcgtttcatcgaggcaggtagcgaggttcagcaccggcgtcgacaatgccaatccaggggctcactgccggttgtctgagcttttccggccagttcgcacagagaccagttgcgttattattgggcgagcgctggagtgtgggaggtggtcagagtcggttgagctggagctggagggcctccatgtcgagctggatcctttcgtcgtcaacaaggtgctccgtggcttgttggactcggggatggcagttcggttttactggtgggcagagtcacgccctggattttatcataacaattttgccatagcgtacatcataagcttgctgtttgtagatgacaatttcgccctgctttcggagttcctgggaagagtaa

SEQ ID NO: 4298 - DNA, 1501 bp, Oryza sativa
  unsure (1)..(1501): unsure at all n locations
agccaatgcgagggcgatgatgcagcccatggagtggctgacaagatggaaggagctcaggttgagtggatcgatgaggctccgctcgatcatctcgacgtgatctttcagtctgtacatgcagtttgccggcttgggagacttgccgaagccgaggagatcgaccgccaacattctgcagttgttgaggatggatgattcgcggaacactgttgcccagaacgacgatgacgaggtgaagccgtggatgaagatggcgtcttcttctccactctgctgcgtcgttgtcactgctccatctgcaaaagctaagctcgcgaacgttaatgtcgccgacacggcaaagcgaaaggattgtaacagaaataacggaagcggttgagaccgtttggcggcggcggcggttggttggcgacgaagtgcagccggccgtcgtcgtggcgctgccatgcgcggcacgaatcgcagccgcagtccgaccacctcgggctccgccccttgcgccgctccgtctccgtctccggcgagccgccgctcctgcctctgacgagccccatcagcgcgtctcggagagcgctccgccggtggtacaatgtgtcggagacctcgtcgtcgtcgtccagcgccgccgcgctgtggctcccgtggcagtagcagctgaccgggctgtcctcgaagacggcgtcgaggaagccgtacacgaagcagaggagcacgtcgacgacgtccaggaacgcgaagacggccgccgcgaaagctgaggagacggctctcggccacgcggaaggcgagacgatgaccgcgaacgcgagcatggccggcgacccgccgtagttagggtggacggaggagggaggtagatgggcggatggaagacgatggtgcgagagagtagtaaggctggaaatgcgcgtgcggatgggagcgtgtgtatggcgttgctccacgtcgctaggtggagacgaaaaggaagcagcgactgttcgcgcggttccgcctgccgttcgtcggtcgcgcggtgcttgcgtgagtttgccggcgatatctttgtgttcggtcgccgtgtcaccgtcgcgacatcgccggaattttctcgcctnnnnnnnnnnnnnnnnnnnntcatgcgccttctgttcttactcaccgtcaaggtcaagcccaataaaaagaagtccaaattaatatatgtgacggcccagtagaaggcccaattaagcccacggggcaacgacaagagcccatgtattcagcgccaccaccatcaccgccggcaagcgaagcggccgcctccgcctctccctctcccctccgccgcgtgcgcccgcccgccggccacgctgctgggctctgcttacactccacgccaaggcctccgctactagcgctctcgcttcacgaaaccccatttgctattgctccctcgccgccgcgccgtctccgtcccgcttcccgcccaaaaccctaggctcctccgaccaccggtggggggccatggcgccgc

SEQ ID NO: 4299 - DNA, 1501 bp, Oryza sativa
agaaattcagactcgactttctcagagagggatcgagagcggctgcctgccggtcggcggctgacagcaacatcgacggcgacggcgagtcggcgatcgatcgatcgactgcagtatggagatggagccgctgcaatagtgaaattctctgatctgccgctcgtgggtggtcccttggctcgacaggattacacgtctcgtgcctgcgattggtgggtgctctcaacactgtggatatagatagatccccctgcatgtatatcatacagtggctggcgcaatatttgcagtactggggaacatggatggagatggagatcgtggatatgatacaggtgttggggcctcatttggttcctgcatgcgtttgcacccaatccatctcaacatcggattggtactactactgttactgctactgtacaagtctcgaagtgccaattttcagatgtctcgtgtcatcgtgtgtgtgtgtgctcattgcttgctcaacattcagagagagtaccgagtacgtaccaatcgtacatatcgcaagacggcctcaaattctctttgttggtagcaaaaggaatgataaacacttcaagtcttgaacagttaccagacttagatatggtaatcatgaaattgtatgcatgcagttttgtactctactagtatctagcaacaggaatgctgattgctgaacttatctgtcttccctttcttctctttagcagaggttaagttctgaactttttaaaggaagtgatggcctagtactacatcatggcatggaaaggcaaatctaacaatctgaagtaagtattgaaccagttgtgcttgcctatgttacgtcgtgtccttcaatcttcgtgctctttttatcagcaacgctgaactatcatgtgcctttcatgttctctgttgagggaagcaacaggccggatattatacgttctgtagtacgtataaacgctaggaatctgggtgactatgctacaatagtactcgtttgttattatcctctctgaacagtaacggcgacaggttggaggataacacttgtcggccacccaactcatccaagcgatctctagtatcactgaacctagttcatattcaggctgtcagattattcatacagccatcatatgtacagtgatgagaaatacaaatcgaattcctaagggatcatattgatgcaggaatttacgaattgaaggaatttgggtcgattcaaaatagttgcattcctgggctgaaaccaagcctgaatgagcatgaagaaataatgaagtaaaaatatttaaaacttcgattgagctttggtaaaaataaatttaaaacttagattagattttgtaaacaaaattaaaaatttaagttgagacttggttggggtgcgccaggcccaggctgcagtgcaacgcctgggcgacacgcgagggccccagtggcaagccactatggtggaccctcccccataaaaaataaatttaatatcgaagtgggcaca

SEQ ID NO: 4300 - DNA, 1501 bp, Oryza sativa
acttctaatatttcttatttttaattctaaatttcagtaatttcctaattgtatttctatatggactctagtctcctcttctaatattccttattttttacttccgaacttcaactatccctaaattgtatttctatgtggactctagtcgcctcttctaatattccttattttgtaattccgaatttcagctatttctaaattgtatttctatataaactcatatttcaatattctttaatttttaatttcaaatttcagttacttctaaattgtattcctatattgactttaaactcttcttcccatgtttttcttaattttgaattttagttacttgtaaattgtatttttatacagactctaaactctacttttaattttattacatttattccaaattttagttagttttaaattcctatatgtactctatactctgcttctaatattccttattttttaattccgaatttctattatttcctaatggtatttatatatggattctagctcctcttctaatattccttattttttaattccgaatttcagttatttcctaattgtatttctatatgggctctagtctcctcttctaatatttcttattttttaattccgaattttaactatttctaaattgcatttctatatgaactctagtcttctcttctaatattccttattttttaattctgaatttcaactatttctaaattgtatttttatatggactctgcgttttcttttcttccgattaatgtgagaatttctaggtcatgggagagaacgtggaggctcctttttattccgaattttagttagttttaaattcctatatggactctatactctacttctaatattccttactttttaattccgaatttctattttttcttaattgtatttctatatggactctagtctcctcttctaatattccttattttttaattccaaatttcagctattactaaattgtatttctatatggactctgctttttctttttctccgattaatgtgagaatttctagaccatgagagcgaacgtggaggctcctttttttaattccaaatttcagctattactaaattgtatttctatgtggactttgctttttctttttctccgattaatgtgagaatttctagaccatgagagcgaacgtggaagctcctttttttattcctttaataatataatagataataatttataggtaaaattttatatgtgttcttagtgataaaaacaaatattattaaattaaccacgattaaaaaacataaaatcagtttaagttttaaaatgtaaatcttgacttataaagaccaacaagcttcctcaagcccaaactgcagagccacattttcggcccaacagatatttgggcccataagtgaaaaaatgggcttaggcccattcctctcctcctcttccgcgtgtgtgtatataatcttggtaaggtggtgcggcgccggtggccggaga

SEQ ID NO: 4301 - DNA, 1501 bp, Oryza sativa
cagaaggtcgtatgcggtattccgctggtataacaacttttaggggattgctgtgagtgtagcgtggctccgcctcctatctctcgtttgtttggagtatcctttgtttcatagtagcctcttggtttttcgtccttcccccatcccggcataggcctgtttagtcgattgcgttgtgtaattaaacttaatatattaacgtgtaatcttttacgcgttcacagaaaaaaaaataatattaagtggatgcataggtgagacgttggcaagcatattgcggccgacagacagttgaaaggtcgtgcatggcgaagagaagagactgttgctggcttgctcgcttggccagcagcacagggatcgagcgagttatacctattccatgctcgctacagttagtacgaaacacttggcaattaatcaattaatcagcaactagtactccacatgcatgcagttgagttacctgaaatcgcgaaatggcacagcatcagcatgggctcccaaaccaaaccaccaagcgatatccaataggcgatggatggcatatgccacatgccaccgtcgcgcgtcgacagcgccaccacgcgatacggcgcggcgcggttggcggtggcctccgacacccagacaaaaagcctcacctcaccctcacccgcacacgccgacaccccgacgcgttttccactgggtcccatgggccatggcctctctctatatactcggcccatccccgcctcctcctattcccaccttccacctccacttcctcctctcatcgaagctagctgatctgccatggacgctctctcctgcctggcgccgcacgccgcgctgctgccgtgcgcggccttcaccgacgccgacatcacgcgcgcgctccacttctcctcctccatgcccgacacctcctcctcaccctcctcatcctcctccgcggccttcctcgccgacttctgcggtggtggcgccggaggagggttcgtggtgtcggcgccgccaccgacgatgccggcgatcacctgcgagtccgttctcgtggccgacagcgcgcgcccgtcgccggccgggcctgcgcggcggcaccagcagcagcagctggggctgggccccgcgggtgggcgcgccgggaagcggcggtcgcgggcgtcgaagcgcgcgccgaccacctacatcagcaccgacccggccaacttccgcctcatggtgcagcacgtcaccggcgtccaggccgaccccgcctccctcgccgacggcgccgccggcatccttcccaccaccaccaccactgcgccgttcgacgcctcctccggcctccacatgctcgacaccttcgccgccgccaacccgctgctgcaagccgagcaagcggcggcgcttcagcagcagccgtgcttccccacgctggactcgtcgtggagcgccgtcatgtacgatggcagcgacctcctctgagcattccttcattcccagctgctgctgctgcactgcagtgccaaca

SEQ ID NO: 4302 - DNA, 1501 bp, Oryza sativa
tcgacgcctcctccggcctccacatgctcgacaccttcgccgccgccaacccgctgctgcaagccgagcaagcggcggcgcttcagcagcagccgtgcttccccacgctggactcgtcgtggagcgccgtcatgtacgatggcagcgacctcctctgagcattccttcattcccagctgctgctgctgcactgcagtgccaacactagttaattaggacgccgccgccgacgacgacgacatagctagtagatttcttgctctcgatcgcagtggccggcctagctagctctacatcgatcgatcaatccactaccatttcttacttgattagtttgtcgttggagccaagatcgtatcgatgatgctcgcttgatcaggttaagttgttgagttactgtagggtgttactactagtattattgtacagctagcgcattatgcatgtcatgtcgtcgtccgtcggtcaaacggagtgtggctgctatatatgcccacattttatgcagtagtagctgtctatagctgatctcagttaatttaatttgtactacgtgtatgtcaaagctaattagtcagcagtaaaacatcagtttctctcgcaattaatctggtgaattctagaatgcatgctaaccatcgtactactttcgtttcatattacaaaactttctagtattatcaatatttatatatatgttaataaatctagatatttatatatgtctaaatttattaatatctatataaatataaatataagcaatcctaacctgaaacggaggaatcacatgcatagacaacgacttgctccgtgctggagtaattcattggctcgcaagacctgcgtgttggaggtagttgcagctagcttccaaacccacgatctggacatcattttggatttaagctatatatctgcaggttaattaattattattagtcgcaagaatgaaagatcgagagagatctgttaaagaataaaatatacggtaaacgagcgtactcaattaatattgccgcctttttgataattgaaatgagcacgtcgtgggtcggtggaattgacctggtcgcaccatggatgctgctgcttcgtcatcgacagacggatcatgtatatgatccgatcgagtggagatggaaggccgaggggtttgggccaggcccattcagtctcttgccgcctgtactaggcttttctcatcgataatatatgtgggcccatactaactaaaaaggaattttgcactatttatcacaaaacttcatgtattttacactatttatcataaaactacagatttaagagcttgtttcacaaaattatagatttagtgtctctatttatcacaaaactatatgtattttgtacaatctatcacaaaagaacatatttaagaacttgtttcacaaaactatagatttagtgtatttgtttatcatagaactacacatttagtgtcttgatttatcacaaaactacatattttgtgtctcca

SEQ ID NO: 4303 - DNA, 1501 bp, Oryza sativa
gcatgcgaagcgagcgctctaccatatgagctacacccccatttgtgctattcgttgaactctcacttactaattatatgtaaatacaccatatttttgtgagatgatttgcaccatgtcgccgtcgcctcctcctcctctgtctgcgccgccggccgccggcgacggcttgctcaccaggcgttcctcctttggtgtcccggcgttttcccttgagttgaagtgggcaagtcaaagacggagattagcaagaggaggaggagttggtgagcggaggctaagcggcgggccccaccagcgccgcctgcctatccacaaagttgcgtcacgcgacgagccaactgttgctgggcccacctgtcatcctcaccccaccccatgcaccgagtccaccccgccctccccccactttggcgccttccctctctccacctcctccactctcccaccaccacgagaccttctcgaagcttcctcccccccaaaccccttccgctcctcctcctcctcccaaatccaccacggcgacgccgccgccgcagagcccctagctcccggaggtccctcgcccccgccagctccgacggcctcacggaaggaggagtaacgtgggcgttgattggatttttttgttttccccccaccttgagtgagtctgtgccgtttccccggcggcgagggagggcagagggctgatcatggtcgtgcgccgccggtgccttgccgagatttcccccaaccgccaccgacgatcgttcactgtatgcatgctctcgctccccttcgtttttgagttggtttcgattatcaagtagtatgtatcaggccgggtattagtattaccaccaaattctcttatgctagtgtgcgcccgctattgctctagtatttacaagctgttatttttactccttagtactacttgttttggtcaaaattcaaaacgtctactgtacctgttgtattggaaattttaaatggttcatgaatgaattcactacccaagaacaaagcttgtccagtaatgacattatctattggctcgatttatgtttggtccagtggcacaaaggggagtagcactgtccaagctgttgtggtccgtcagggagattggccaacctgtggggtttcagatcgacataagtacgtcagtgtgcgtattcttgtccccacgtgcttatcatttaaattcttctactattatgttttctactatgtacgattgctgtaactcctgaggagttactgtctttgattagaaagaatttggcgcaagcatgtactgtacgatatccttagctgtttgaggtttcagtatgtaagctactaagtcgtcaaagatttcccttcttttttttaaaaaaaaaatgatctgtagatttcagccatcgatcaatctggcggttcatagggctgtgcttgcaacctttctggcagaaaggagagagcaaagtgatttgctgtctcctgttgattgtggcctgttgaggcccagtaa

SEQ ID NO: 4304 - DNA, 1501 bp, Oryza sativa
agagcttagagagagcagatggttgggagggcgctgtcgtacaaggattggcaggtgaggtgcggccgaagtacgcaaactgctgctgctatgtttgggcgatccgatccagggaggggaggggattgatcaccgatcgatcgatcacctatcctatatatatgcaagcaaccaaacacttctagttctagcttatgtggtagtcgatcttgtgctagtgccatgggttggtggcgtcatcgagcgcgcgcgttacatcccatctacatttcccattccaattttattttaaatactactactacgactactttttttcccttccacacaacacatgcctatcttgccttgtaatccacacgcacaactgcatccaccatgtcatgtaatctctctgtttttcctctcctctccttgttgagtgcaacctactcaacaccgctaccttacctggcgccttcttttctctgcttattttctgtatcttagtgcagttgggtggaatcaacattttcatcttcactaaccacctgctatccgtacgtaccacgcatgggttttaccattttaacttttttttaatcatttatagctagcgtccgttatattcttactgttttcgacattcatctcaatatatacaagatggggtcctgcacatatatctcttctctgccatcttcaaagccaagtcatcctccttccatatgtattcccaccgtgtgtaacccatgcgctcgcggatcatacgtaattaaataactactgcatctaatgttttattctcaatcaccctcctactatatcctaatttatatgggcatggtccgttagaacgtatgagtatgttactggttacaacaaaatgacaatatatttcaagaggcctggatggctgcaaaatttcctaattcttccctctacaacgggtaggaaaggattattttcccttgttatcctataatttattgagtgaatggcaatttgggtcacattttattacacaagtttactttggaccacccttaaaccaatattttcactttggacccgagtaactttgttgttttctcggtttagaccaccccaaacaatttattcatcaccccaacctcaattaaattagttttgatacaccggtgaactttcccgtatatatcttcataaaaatggacggtagatatgaaccgtaaagagagttgggtggtccaaactgaaaatggtaaagttagtccaaagttaaacgattactttaaaggtggtccaaagtgaaactttacgaacaaaaggtggcctaaactataatttactctgatttattcatgcaagccaaatggcatatataaaaattaatccttataaattcaaattatttgttttctctgtgaacctaacaagccgatttgaacctaacaaattcaaattcctatctccgcccctctaccaccggcccagccccctcccccccccccaaaccgccgacccctcccggtagtcaaga

SEQ ID NO: 4305 - DNA, 1501 bp, Oryza sativa
tcgatgcaaagcttccacataatttccctcggattgagccaacatccgttacggtcgttcgttctattcaaaaaaatctatgttccaaaaccgtacatgattttgttgctactagaaaaaatactcatgcgttgcaacatgcaaagatgttttttcagtgatacaacaactattaggaggtgagaaataaattgaaacattagaattgctatacattatagctgaaaaagttaatgacaattcttttttaaggccaaaagctcattctttccttccatttcagccctagctcagttctacctccctccacttgccctgcctcacttcggccatgcccacaagtggagccacaggccctgctcgcatagccgactaccgtctttaacatccggaagaccggaagatagtcccgtgcccgtatgccggagccgatactccccatcaaatccgactgaatctttctcgaactccgaaaatattgagggcttttattcccctcgatctcctattttcgttttctcaaaatcgaagcaaatccacaaaactcgtgataaaaacgaccagggaagctcgccggccggccatcatcaacaaatgagattaaatccagcaaattaaagtcgaattgaaagtggaaatcatgaggaaaataatgggggagggggtgagaaattgatttttgcaattaatttgagaaacgcacggggatacatattgacgttgcggcggcgctagggtttggcctgcggtggcgggatcgaacatgaaaacccagcgatgggaaaaaataggatgacaaaaataccaaatcattataaggcaaaaaaaacagcgaacaaaattcagaaggagaaaaaaccgacaacgtaatcgggaaaaaatagaaaaaaaagaccaaaaactactggaagcttcacatttttaattaggtacggattagataataaaaacacgaataatactttatgtgtgactattttttaaatttttctataatttttttaaataagatggacggtgaaatgttggaaaaaaaaaccacaactacacttataggagtagtagcggcgtgtttggcaactcgagcaaaggggattaggagtttattgatgatgagattaagatagaaatttgattttttaatcccaatatcatagaaatttgattttttaatctcaatatcttgtttggtaaaggcgagggaaattgatagggagtttagttggagattaagtcattaatgaaaacggatggttgtgatttgtttaggtcgagtaaaggaggaattccttcccaattatcaccccatacctaggtattggaaaggagagagtttcttctccaattccttatctccatcctattaaaattttataatttctaaatctaaattaaacaaaacagttaatagtcttatccctctaaattataaatcacttgtaaaaactcctcctaccttataagtagtatttgggtggaagcggaatgaaggagaggtaag

SEQ ID NO: 4306 - DNA, 1501 bp, Oryza sativa
tgccttacctctccttcattccgcttccacccaaatactacttataaggtaggaggagtttttacaagtgatttataatttagagggataagactattaactgttttgtttaatttagatttagaaattataaaattttaataggatggagataaggaattggagaagaaactctctcctttccaatacctaggtatggggtgataattgggaaggaattcctcctttactcgacctaaacaaatcacaaccatccgttttcattaatgacttaatctccaactaaactccctatcaatttccctcgcctttaccaaacaagatattgagattaaaaaatcaaatttctatgatattgggattaaaaaatcaaatttctatcttaatctcatcatcaataaactcctaatcccctttgctcgagttgccaaacacgccgctactactcctataagtgtagttgtggtttttttttccaacatttcaccgtccatcttatttaaaaaaattatagaaaaatttaaaaaatagtcacacataaagtattattcgtgtttttattatctaatccgtacctaattaaaaatgtgaagcttccagtagtttttggtcttttttttctattttttcccgattacgttgtcggttttttctccttctgaattttgttcgctgttttttttgccttataatgatttggtatttttgtcatcctattttttcccatcgctgggttttcatgttcgatcccgccaccgcaggccaaaccctagcgccgccgcaacgtcaatatgtatccccgtgcgtttctcaaattaattgcaaaaatcaatttctcaccccctcccccattattttcctcatgatttccactttcaattcgactttaatttgctggatttaatctcatttgttgatgatggccggccggcgagcttccctggtcgtttttatcacgagttttgtggatttgcttcgattttgagaaaacgaaaataggagatcgaggggaataaaagccctcaatattttcggagttcgagaaagattcagtcggatttgatggggagtatcggctccggcatacgggcacgggactatcttccggtcttccggatgttaaagacggtagtcggctatgcgagcagggcctgtggctccacttgtgggcatggccgaagtgaggcagggcaagtggagggaggtagaactgagctagggctgaaatggaaggaaagaatgagcttttggccttaaaaaagaattgtcattaactttttcagctataatgtatagcaattctaatgtttcaatttatttctcacctcctaatagttgttgtatcactgaaaaaacatctttgcatgttgcaacgcatgagtattttttctagtagcaacaaaatcatgtacggttttggaacatagatttttttgaatagaacgaacgaccgtaacggatgttggctcaatccgagggaaattatgtggaagctttgcat

SEQ ID NO: 4307 - DNA, 1501 bp, Oryza sativa
aaaaaaaaacatggaaaatttgtgattcttatgtgcccaatccaacaaacaaaacaaagatatgatggattgatcaattgcgaagtatgtgttgttttaacttttacatgaatgaatgatagattgtttaactgcggagtgtgggttggcactcccaatctcagtaatctttctctcaagtctatgacttcatctatgaggcggcgacaatagggcttgttgttgtacatcggccatgatttaattttggattatcgtaatggccggccggtgatcgggcacatgtacaggcgccgtgatgaggccggtgagattaagggttggtttgtatacatggatgggccataaacaacgatatcggagtgtaccgtagatgtggtcgccgtgccctaaatcctaatcgccgccgcggaaagaggaatcgccccaacttaattagctggtggtatacatatttaacgacagtttctacagaaaaaaaaaatatactccattaatcttaataaataaaaaagcacttacagtgttgatatgtccggggcagccggcggtcgatccccttgcgcggctcttcttctccgtcgccggctcaatacgagagctctcacggccagcttgcgactgcccctcgagagtgagagtgaggtcgccgtgaggtgacgattgcaggtcgtcgccggcgaccagatcgccgccgggcgccggttaattcgtcggaatgccgccgcttccgacgacgtcgtctgtacgatagggacgagaacgtagaggactgatttacaaaatactcaatcagcccgaaaataagttgggagcttgttctgccaaattttctaaatttaccgtgggctgttcaagttgatgtcatttctaaccataccattatttagcaaagttgttaaagatgtgactatattttttttcaaactttgataaacacgtaacaaatcttgccaaaatgttagtaatattgtcaacttaccaaaattttgacaataccaaatttagtaaggtttattttgaacacaatctgaatagcctcctaaaattttacacagtaatatttatcgggtcctaatcgagaatccattccgctgcgacaggtgcaaggtgttagggttagtgtttggtgacggatgataggaggggaggggcctcacccatagtgaaagaagaagaaaaagggatgtcatgtgctccgaatacaccctaaatgaggaaggcaccaacctatgaagactgagaagtcattctatgaactgtgaagggccaaagggcagggtgtggctaggacttctttcctctccaatctcttctcccatgcatttctttgattgatggtgaatcaaccttaccggtgattaggaatataacattttaatatcagaggctttgttcgatctgtgtgatgtgttgatcgcattctcatcaccttgattggtaaaactcctatagttgagttagtgattctctcaatttcgtgctcgatcggtttatacta

SEQ ID NO: 4308 - DNA, 1501 bp, Oryza sativa
ggaggagttcgacggagggaggaggtgggggtatcggggaaggcgtcatcatggtattggagcatgatcagggactcgactagcgtggaggaggacggggatcttgtgggcggggttagagcggaggaggaagtcgctcttgttgccgaggtcggacgaggatcttcttgactaccgggaggggtcggcggtttgggggggggggagggggctgggccggtggtagaggggcggagataggaatttgaatttgttaggttcaaatcggcttgttaggttcacagagaaaacaaataatttgaatttataaggattaatttttatatatgccatttggcttgcatgaataaatcagagtaaattatagtttaggccaccttttgttcgtaaagtttcactttggaccacctttaaagtaatcgtttaactttggactaactttaccattttcagtttggaccacccaactctctttacggttcatatctaccgtccatttttatgaagatatatacgggaaagttcaccggtgtatcaaaactaatttaattgaggttggggtgatgaataaattgtttggggtggtctaaaccgagaaaacaacaaagttactcgggtccaaagtgaaaatattggtttaagggtggtccaaagtaaacttgtgtaataaaatgtgacccaaattgccattcactcaataaattataggataacaagggaaaataatcctttcctacccgttgtagagggaagaattaggaaattttgcagccatccaggcctcttgaaatatattgtcattttgttgtaaccagtaacatactcatacgttctaacggaccatgcccatataaattaggatatagtaggagggtgattgagaataaaacattagatgcagtagttatttaattacgtatgatccgcgagcgcatgggttacacacggtgggaatacatatggaaggaggatgacttggctttgaagatggcagagaagagatatatgtgcaggaccccatcttgtatatattgagatgaatgtcgaaaacagtaagaatataacggacgctagctataaatgattaaaaaaaagttaaaatggtaaaacccatgcgtggtacgtacggatagcaggtggttagtgaagatgaaaatgttgattccacccaactgcactaagatacagaaaataagcagagaaaagaaggcgccaggtaaggtagcggtgttgagtaggttgcactcaacaaggagaggagaggaaaaacagagagattacatgacatggtggatgcagttgtgcgtgtggattacaaggcaagataggcatgtgttgtgtggaagggaaaaaaagtagtcgtagtagtagtatttaaaataaaattggaatgggaaatgtagatgggatgtaacgcgcgcgctcgatgacgccaccaacccatggcactagcacaagatcgactaccacataagctagaactagaagtgtttggttgctt

SEQ ID NO: 4309 - DNA, 660 bp, Oryza sativa
tggaccccgggggaggcaaaatagacttttgcggaggaatttgatttggaaggatttggattcgggattgaactcgacgatagatcggggatttgagatctgagatggcacggacactagacaacagcaaagaaacaaatttcgcaattagggtttttaagagataattttcccgctaggcgccacgacggaacgggcgctacatcagtgaaattcaataatattcttgagaatattatttctataaattccataaaccatttctcgtattccagaaaattccgataaatctttttcttgtccagaaaatcaagttaagcttccaaaattcatatctcccgatccgtaactccgattgactccgttacacttcctgtaattctctaaaattgagatctatctaatggcactattaattagtctaaatagggtttttcttttggtcttttgtttaggttttcgattgtttgcgtatagtcgcggttaccggatttttgtcgatcgtgggatttctcgaagattcgtgaagcttcgtgaagactttgagcaaggcaagtcaccctttgaccaattgctcctataattggaaaatcattattattttgtttgcaacttgcattattagaatcacccgtttaacttgcttggcctcggtttgca

SEQ ID NO: 4310 - DNA, 1501 bp, Oryza sativa
ggcaattaattgctcctatccaacaggcaccttactgtccggtaccaaatctgagccatccaatcagctcaatcagatggtgaaaaatctgtggtacctccagatacaaatttgctcccatccagcgggtaccatcggtactagaatatttggagtggtggaagggtaattttgtcttttcgcgtagaagtgtccaggggagggaaatagggttttctaccaaatctttgccattcgatccgtgagaggagtaggcggcgagcaaatctccccttcccatccgatccgatccgtgagaggagtaggcggcgtcggcgacttgcttcgtcggcctggacttgatccgcgggaggcggcgggatccgtgggaggcagcggcaacttgcttcgtgggaggaagcggcggcgtcggcgagttgcttccgtcggccggagcgtggatgcggggcgggcagatttggggcgagcctgcgtgtggctcaggtgggcttcgcacgggcggggctgcgctcgccgaggggaggaaaaaaaagagattagatgagaaagcggtgccgcacggagggaggaaacgagaaagagcgaaaaggagaagagggggcgcgactactttctctgtttttcaatcgtacccttctaacatggacggatggatttatctctgtaccttccggtactagtacctaccggtacaagttgctggatgggagcaacgctcttgataatataatatctattgaagtactagtaatttctaactttttcggtaaaaagaactacagatcaaaatttgaggataaacggttcgaatgtcaattattaaatacaaaattactaaacctcgaaaggaaaatagagacaaaatcttgtaaatttctaatcttcagatctactttgcgattcgtactccaatgggcctctcctccaactctgatgactttgatgaacttcggcgactgatggtgacaacctcgaccaattagggccccggatggtggcggtgggagatgggagacagtgagatgccaaagccataggaataggggagactggtgggctagcattgacggtaggggcaaagcgaggcctctgattaggagtcgacggccaatggtgaaaaatctgacagcggagagctgccgaagatgtggaatacggtgggacaggggcacctcgctgtcgctagcttgaggaggagaagaggggtggaagggagagggagagaatcggaggaggggatggttctcaccggtgccgctcgtgcctttgggctttggcagctagcgagcgaggccgggcggtgtaggatgctggtggagcgagtgaggagaattttataatttgtaaaagatttttgaaattgtttttgtctatcaaatgccagtccctagagaaggtatcctatatatatatacatcatcaatcgatcattcaattggactcagctgcatcatatatatcgttctagctagctaggttagctaggttcattccatttcca

SEQ ID NO: 4311 - DNA, 1501 bp, Oryza sativa
atctaccatcactacatcctcaggggcgctgccgccaaggccttcgcctcctcctcctaccgatcaccccatttttaatcccatgcacccttgcaatatattttattattcttcgatctactgttttaatttgttttttataattatatccgtaattcatctgtactgtctgtacgtaatctagctacatacatatatgtatggttgatttttcatatttgcaattcaattattctatattttcctacttcatcttcaaaaattgttgtactgtctccattgtagccacatgcatgtatactcttatatacaggaatgcgctaaagcgcatctgggttattatgccataattaaaacgcactcttcacggatgcacccccacccccatcccctgacaccacccacctcacttttcaaaatgcagtacaataaaatgatcactaagatcttgcttctggcatagtacattaattataagtaaattatctacagtactatacatagaaattggacgatgtatccatctacaccttttaagtagggagtaaattatttgcttgaagtgtaatcctaccatgcccctgtagtcctgcactgcaggtttcactcaacattaattaaaatcattttccgtttgttagatttttactacatgtagtattagaaaacctcacgtacgtataggattaaaacccatgatcttcacaagtgggcctatagctttcagtattttttttttacaattacttgaagacatgtgtattggaatcatccgatcatgaagggagtaaaataaaatattgacgtgtactggagtcatccgatcatagagggattaaaaaaaatagtgatcaagtccataggccgcaaatatttgaaaaaaatgaaattatactgttgaagttttttttaggagaatgacgacagaagatctgccggaatttaattaaggggtcaaaaaccacccaggaagacctagggaagagttacagcaaaaggagaaattaaggtggcctgaaagccactttgcgcaaatctatatcttgttttacccgatatgctactgacaattctgagctagctaaattttggaaaattctactatttctctctagctaaatgtttcaccaagttgtcaggagagcaccgcgagcgagcgttttttgaccttctctttctgcacctttaagctcatcccaccaggttgagatgcgggacggaagggaattgagagctaggggcaaattttgccacatacatactgtagtccatacttgtttaacaaacggacaatccgcgaacagatgattggtgtcttcgaaggcggaggtacacaaacagtaaatccaattacaagaccaatatcttctgagcaaattttgagccattaaagttctttggtggaggacaagccaaccaaaacatttcatttttggctcagcctgggctttacagagcgtggtaaaatcaattgcagtgtatgaaccagcaaactgatata

SEQ ID NO: 4312 - DNA, 1501 bp, Oryza sativa
tgctgccttctcctcctcgggcgcctcctcctctgctgctgctgctgcttccttgttggcgttgccctctgcttcattctgcagcttgctgctgccgtcttccgccgccggcttattttcctcatctttcttgtcagcttcggctgcaggaggaggaggaggcttgtcgtcgttggtcttctcctcctcctcctccttgggctttgggggcgggggcacgacgaccgtggcgagcttgcctgtgcggcggtggatgtactcggcgagcttgtcgcctgagacggtaccggtcaccgtcagcttgccggtgctcaagttggtgtcagcggtttggacccctgcgcaggacacgagtacacgagcagctaattattaagttgctagtcaattactataatatatcgatcgatccatctcaaggctcaagcagacggtacctcacctctcatcttgagaatctttttgtgcagttgctgggcgcaggcctcgcagtgcatgttcaccaggagctccaccgtcgtcacatcgctcacctgcgaatggacgagcggcggccgcggggatggctggtgctggtcttggtcctcggtactagttgggggcggcggcggggagatgacggtggcgttgcgcaaggtcttgtggcggaggcgagcgcagagggcttgagggtctacgatgcccgtgacggtgagctggttgccgcccatgtccacctccacgccctgcacgcccttgctccgcaggatgcaccgcctcatcctcctggcgcaaccggtgcaatgaagctccacgcccaggatcaccggtgccggtggcggcggcacctgctcttcttccttgctccctgcatctgctgctgctgcagcttcctccttcttctctgccgccggtgctacttcttccacctgcttcgaattcttctccttgccgccctcctcctgcataattcactccaccgctcaatactcaatataattatctgcagactactggctgcatatatataataaatgtacacatgcttcgatcgctagcctagctaccttgtcgtcgttgagcttaacttgctcgcccatggcgatcgaattagaaggagtagctcagatcttcttcttcttctcagacgagctagctagctagcttcgaacgtacagaccagtccagatgactgatcgatactcagctagctagccatgtgatattgtgatatgtagtactgcacaatgcggcgacttatatatatgccccacctcagctagctagctagctcaaaatgctgcattgatttttctttttcccggagaatctctactgcctcatgccaaagcttctaataagccgcagccaaatatctatgtcaagcatatgcttagagctccatcgttttgtgttttgcttatctgtcaaaccaaaatctaaattttagaaatcaactttagcgttgattttgattttccttttaagtttatttttccagtattgacttttaatttactat

SEQ ID NO: 4313 - DNA, 1501 bp, Oryza sativa
aagatctctatcaagtagggtgcatgcctgaaatgaatcattgtggggaaggaaagactgcaccttgcattgccggagcagtaataaatctgtcgatttgatcctcgcgtgctgcagaaatgacaccgggcgtcgtggctgcacagcagaacagcacaggggaacgcgatcttttcctgaaatcggatccaatgccatggttgattggttgttctactgctaatcatgctttttccctggcaaaaaggaaggaactttttcgtgcatcatggagattcgagggaggcatgctgcatctgcagttccaattggagggagcatcatttgcgtactgtgtttgcgtctggtgtatgcgccttcttttgcttctctgtcctggtggcacctgtgatcttcttggaatcttggtggtggagaagaatcatatcattctgtaaccactcctttcagaggaaagtttcagttctttggtggtgacagtcaggcgaatcgggtcttagttaacagaaaagaagggtccctgctatctctgaagatcgtgcgtccatctgtttcagataccgagtgatgctgcaggatacttcttcgattagtgcatgcttgcacagagcacagtgccatgaggccattcacaatgcgtcatgggtttttcctggacctgagatgccacgttggatggaactgctgctaagcaactccatccagaatgcaaagcttgtactccacagtataagctactaatgggtcccaccaccaaacacttttgctctctctctttggttcagattttgcagcaaggaactcggtaccaactttggtcacacggaccaggcaaagccacgatccccactcttctccctcctccacgtaagccaggaacaacattgccacacgccacatcgccgcattgtaaatggcttgaccgaggctcccttggcaggccgatctagtaatccatggcatggaatcttttgaaccacagttttttgagatacattgtgtggttttaacctcacgatctcatgctcaatccctaacatgctcataatttctttaaaaaaaaatatttgaagagatgtctctccctccaaatctccttttttttatccttaaaccctaaacccaataaattattgtatacacatttcagggcataaaaaccagggttttaaatctcctgttatagctgtttgaaaagagttctagctatttgatctcatatacaatttgatcgctatagctccatttagcccactataactgtttgagaaattaatcgctaaatgtcttagcccgctatttaaaacattgataaaaacacagattttcagaaagcacagtacatatatagcacatgttcttaaagtgttttctaatattcagacaagttcaacgcatcgcgaagaagttaggtgccatcgtccagtacatggtccttaccaggatcagctatgaggagtgggtgctgctcatgacagtgaaggtgatctctgtctgattt

SEQ ID NO: 4314 - DNA, 1501 bp, Oryza sativa
atctgtcagtaaaccgcgagacaaatttattaagcctaattaatccatcattagcaaatgtttactgtagcatcacattgtcaaatcatggagcaattaggtttaaaagattcgtctcacaaattagtcgtaatctgtgtaattagctatattttagcctatatttaatactttatttaggtgtttaaacgtttgatgtgacagcgtgtaaaatttcaaggcgggatttaaacagaccctaaatttgtatttttggctttttaggctatttgggtcgaagctggcttgcttggtcgggctaggctgctctttaacgggcctagtgcctctactccgtcccaaataagcacagttttacaccgttcatatcaaacgtttgactgatcgtcttatttgaaaattttttacgattgatattttaattgttattagatgataaaatatgaatagtaatttgtgtatgactaattatttttattttttttaaataagatgaacggtcaaacattaaacacgaatatcacagctatacttattttagtacggtggtactgctaaccttcattcattcttcgccgggaaactgttcgttcattaattcacgatcttcagttgcggacgatgttctacagccttgtggctttccatcaccaaggtgaaaatggactgttgttttctctgtataatactgttggtttttgttttgtcagagtgctcaatcaaattgaggtactgtacgtagtactatactccactcctccgtccgtggagtagtcagctgggctcatgcagctgtgcgtactgccacgtactgacgacgctgtcgacgtgtctggcccggtcgttggatcgctggcacggacgcacgcaattatctgccctgcaacgggcaccggtgtagtactactacctgccgtgtggaccagaaattaacaacgatttcgatgccgtctcagctagtatgcggatctggcaccgcagcagccgcagcagcagcaagcggcgccccaacgcgacaaaaacaaacaagctagctgcgcgtcacatgtgccgctgctatctaatccgtgccgacaccatcatggaattaatgccccggcagttccctgctcaatccatggatggatgcgcgtggcccgaatcgctcccgcgaactggaaactgttttaatcattcaatcactcgaatagatgtttatccgagtaattagaatccatttcccctacatctacgtactccctccgtcttactacccgttccaaaatacttgttacttttaagttttttttatcattcatcttattaaaaaatatataattattatttattctatttgtaacttgctttattataaaaacactttatgtatgacttatattttatatttgcactaatttttcaaataaaacgaatggtcaaacgttgcgaaaaaaaaagtcaaagcgacaactaatttgagacaaacgtagttttaaaatataagggattttagatgaatagg

SEQ ID NO: 4315 - DNA, 1501 bp, Oryza sativa
aatcaacgcaaagggtacgtaagctgctgctcgccagtcgcctatagctagccgctgctagctgctctcctgctttacaggtttgcatgagaagagagaacactgaacagatggagatgcgatcggtcgatcgacgtgaagccaagccgccagtcactgctttgtcgatctctttccctccctcccagcagaaacgtgactccggtcgggactgtgttactgtttactccatcattgttacaggaaggaaaaagaaaaagagagaagcgaaagttgcaggaatcatgcatgcaagcatgcaatgagatcgagagagaagccggcctttggactgtttgcagcacgtggtcggtctttgccttccgaccgatggccaatcacatgcatggacagcaggcagggtctgatgcatgttcggtgcgtaattcgtgatcttgtacagtgttcgctagtacagcattcagagttcagattcctccacaactcggtgttcctgatagctaggagaagcccaaatcatggatattcatgcatggttgattggttgaaaatgtaggtgaagccattcatcgacactgtgttcggcgccagcgcacagtgaaaaaaaaaattctgaagcgcgcgcgattcgatccgtgcacgtcgtggcgtctccgcgcgcgcgtcgtcgtgaggagtcggcgtcggcaccgatcgtacgcgtacgcgcgtgtcgctgtacgttttcaggcccatgtaggcgttggccgcgcgcgtcgcgtgcggcgtggttggcgacccggccacttgggccgcgtacgacaaggctcgatagatccgcgcggcgggcgggcatcggtgtcgtcgatgagtgatctgactcgatcgatcgatcgtggtggccgggctggcatcgtcattgtgcagggatatgtgctgctggtttggctcgatcggacgcaacaaacgtacggttggtgtcacgtactataaggtggcatgcacgattgcaccccgcaagttgccctatcaaacgactagtacaactatcaatcctgccttggcttggcaggcatattgatgggtggatggatcttgtcttcatcgagtatttttcatcagaattgtcacccatgcaaaacctttgtgataccttgactgttactactaccagattttgattactctacgagtgtgtggtggggccggtatgtacgtaggatctacatcacgcatgctaatcaattcgtccactttatcatggcgttgtagtggttctgattagatcctaaccgctccgtgattagcaaacaactcgggaacgacggcatgtgcacatcatgcaaacagcggccactgtccaaggaccagcttacccacgtgatgacgtgcactgcagtgcagtccgcagcaggtcgatcgatcgatctccccatgcccccacccgtacgcttttgtttgccgcgcgcacagtgcatcgtcgtcggctaggccacgatttttttttagaaccagaaattta

SEQ ID NO: 4316 - DNA, 1501 bp, Oryza sativa
  unsure (1)..(1501): unsure at all n locations
atgctcccatcccagcaggaaaaacatagcatgtattagccatctctgtatttttctcgaccttccgttttatttttgggcagatgccacatggccaattcctttctagttctttttgcttggtgtacaacctgttcatgatctgatttctaatcctctcaagcatagacaaaataggcatctctctggcatcaagaatgtacttgttaaacacttctgagttattgttaagaaggatatcacacttcggaaagtcactgaaaaaggctcgacaccattggtttggaggaatttcttcaaggtacttataagcttcactacttaatgccttcatcttttccatattggcattccactcgggcacagtgctagatcttgcaatagcccaaagttggttctttagtgtctcccctttatgtaacacttgaaaattttgatatagatgcctcacacagaatctttgttcagcatcagaaaactcccttctcacagctggaacaagcccctggaaacgaattataaagaattatagttaggaactaaaatgtgagttatgtatattatgaaaaaaatcagacaaagtcataccttctgcctatcagtcatcactgtccatgcagatgtattctcaatgccaaggtccttttttagagtgtcaagaaaccaactccagcttttcaagctctcaacttcaactactgcaattgcaatgggaaaaatacagtcatttgggtccataccaacagcagttaggatatggccaccaaattttgttttaatatggcatccatcaagacaaatgataggtctacacccaaacataaaccctctcttgcaagcatcgaatgacatatacaaagtatggaagcaaccaaaatgtaggttcaggtagaatgagctccctgggttagaggttctcaattcttgtccatagtcccataattggttgtactgagatatttcatctccatatatggccctcatagccatccttctagctctacctagcttgtgcctagatggtgttaagtggagttccttctgaattttcttagcaaagctcatcagtgtcattttgtcattatctctaaattcttcaatgtacctttttgcaagatacttagctgtgacggccttgatctcccactgtttagagcaggtgtgcttctctatatattcccttaccactaagcatttgactctattatccatanatnagacaacatccatggacaaccttcagcacacttagcttcaattcttgttttggtattccgtgtcttcttaatagcaacttggttctttatagtatattgatctattgctttcctaagctctacaacatctgcaaacattatgctaaccttaaactcaggtgtctccatgtctacattagccctaaaactcttaaaactgaacttgattttttcttcttcttcttcagaaatatctggcatcatcaacctttcatcttcagatgaaacatagtctgaaccctcct

SEQ ID NO: 4317 - DNA, 1501 bp, Oryza sativa
  unsure (1)..(1501): unsure at all n locations
cagaaaactcccttctcacagctggaacaagcccctggaaacgaattataaagaattatagttaggaactaaaatgtgagttatgtatattatgaaaaaaatcagacaaagtcataccttctgcctatcagtcatcactgtccatgcagatgtattctcaatgccaaggtccttttttagagtgtcaagaaaccaactccagcttttcaagctctcaacttcaactactgcaattgcaatgggaaaaatacagtcatttgggtccataccaacagcagttaggatatggccaccaaattttgttttaatatggcatccatcaagacaaatgataggtctacacccaaacataaaccctctcttgcaagcatcgaatgacatatacaaagtatggaagcaaccaaaatgtaggttcaggtagaatgagctccctgggttagaggttctcaattcttgtccatagtcccataattggttgtactgagatatttcatctccatatatggccctcatagccatccttctagctctacctagcttgtgcctagatggtgttaagtggagttccttctgaattttcttagcaaagctcatcagtgtcattttgtcattatctctaaattcttcaatgtacctttttgcaagatacttagctgtgacggccttgatctcccactgtttagagcaggtgtgcttctctatatattcccttaccactaagcatttgactctattatccatanatnagacaacatccatggacaaccttcagcacacttagcttcaattcttgttttggtattccgtgtcttcttaatagcaacttggttctttatagtatattgatctattgctttcctaagctctacaacatctgcaaacattatgctaaccttaaactcaggtgtctccatgtctacattagccctaaaactcttaaaactgaacttgattttttcttcttcttcttcagaaatatctggcatcatcaacctttcatcttcagatgaaacatagtctgaaccctcctctttattatgcgctaactcaattttcccttcaacacaattatcaaacaagtcatcatccccatgatcaatctcataatcactatcaacaaaatttggatcttcagttcttgactcctcttcatcatcaattttagcgtcggtagcacgtttatctacaatcaactccccaccatcactcttagccctaattattttacttggtttcacaacagtacgcaaagaatctgaaccaataattgccacatcatataagtcaatagcgtcaactatgtcttgatgatctgcatacaaaacaaatgatcggaccctaggtacaagagcgaccatactattagtgtctgcatcacacttaacccttctcaacccatcacttaattgtttgccaggaagcaaccaataaattttggtgttatcagatttctcatatcctagttcttcaatgaaatcatcaacccacaacagtgaccaag

SEQ ID NO: 4318 - DNA, 1448 bp, Oryza sativa
atctttctaatatattcggcaataacttttgccacttgcacttgaaaaaaagtaaaaccgtggtgtgccccaaaaataattgatgaaaaaaaaaagagaaaaaaggatgagggtatgttgaggtagtgggctgcttagctcgccttcagcagcaacagaggctttgggcctttgtccaactagtgttgagcaacagtagttgcagctgcatagcagctcggcaaggtagaaagcagtaacacctgtagcggcaataataccacctcgcttagctaactagagtagcaccgattaatcccattttgaagctaggaagagggttagtgcacatgttatttaactagatgagttgtgtgtttcccaggtttagccacactactgaaaaagcattttcgccaatattaggtatttatttttacagacgggcatgacccttagagccaaatagccgcctacaaaaatgcaaatcggggtgaagggcgctgcggaccacttaagcggtgcctgctattttcgcaggcggaccacataaagtgtgcttgcgaaaattagcgtggtatatatatgtggcacgtgggctgatatttttctaagtgtctttcctctccccttctcctcttatcctctcccctccccttcacctccccgtcggcggaaggggcggtcggcggcggctcccctccctccctcccctccagatctggccggaggggggaggggggaggccggtggggaagggcggacggcgtcaggcaaagcgcggaccggcggccgggcgcagggcggccggcggtggctcccctccctccctcccctccagatctggccggagggggtgggggaggccggcggacggcggtgaaggacggatgccgtcgggcgaggggcggacggcgtcgggtgaagggcgaacggcgtcgggcgtggggtggccggcggcggcttctctccctccctaccctccagatctggccggaggggggtggggggaggccggcggcgcgggacggcgcgaggcggctggcggcggctcccctccctccctccctcccagatctggccgaaggggggaggggggaggccggcgggcgggcggaccggccggcggcacggggcagatggcggcggggtgcgtccgtgcgacggcgatgacgacatccatggaaaatttgtgatttgatttgattgtgaaccactacgatgtctgttaatctgttatgtttttgtgtatttgatttggtttgatgttgaatctggatgagggaatgggaggagaatggaaagctactgctattggctggaacggcagtgggcggtggctgccctttttttttttaatgccaggtgctattttcgcaagcggactagttgtccgcctgtgaaaagtaactattttcacaatcgttcagttgcactcgtccgcctgcaaaaacctgtttaggccgcct

SEQ ID NO: 4319 - DNA, 1114 bp, Oryza sativa
atacagtcgtcggtcagattgcgggcggctagtctgaccgcttgctacaatccggtctgaccagctttagctagccaaatcagctcatcacctcaaaatactgtttattctcatccggtctgaccgatacacacaccccagtctaaccggtgccaaaaccattttgctaataatctccaaatatcaaaaaaccaatattctcaaatagcaattgttaatcacaaaataacaatcaaacacactatgattttacaaaaaacatagtgtaattggctataaaagggaggcaaaggcaaacctatctgcaaatgctcatcaaaggcgggttatgcctgtattatgcatgaaaaaacttataatttgttctaaccctgatcataaaggaaggctagtagttacactatcagtttttcttttgcaagaagaggtgcattgtcatgagtcaacgcgtggagtaactaaacagaagttctgaggataatttggttggtgggcagggaactacaaacattgtttattactccctctatcctattttaagcgcgatcataagtttccgcatcaaatcttgatcgttcgtcttatttgaaaattttataaaaaaaatttaagaacataagtcatgcataaagtaatattcatgttttatcatctaataataataaatgtactaaacataaaaaaaggtcaaataagaaagacgatcaaagttggacacggaaactcatgaccgcacttaaaatgggatggagtgagcacttcctccatacatccacaaatataaatatttctatagtactacttccccattccaatcactcctcgtttaatttcttcatcaacccttatcccaaccaatcaaggattcaaccagatgtatggaagtaattttccgtcaacctaatttttttaaaaaactctaaaagtaaattatattagtggaaggagatcttaacgaatgatggagttatgagctttcaggcgaatcaaggaaacttctccgtgaagaatacaagcacgcatcaaatctaaagaaaacaaaaaaaaagctttaaaatgtcaaaaaagaaacatgtccacatggcttgtttcttcatacaactcatgctctaga

SEQ ID NO: 4320 - DNA, 1501 bp, Oryza sativa
tcaggatccccttgggcctctcacgcgctcatcaccctgcgcgggagggggggggggtgggtggtgaggggaggaacaacagatattaatgtgagtggattaacaggtggcccacttttaaaattttaaaaacttcgtttaggttgtgttctttaatatacttttccaactttatcttttttattttccacgtgcatgctacatataaactgctaaatggtgtgtcttttttacattttttctataaaaaaagttacttttaaaaatcatattaatctattttttatttttaagctaatattaattaatcatacgctaatatgtgcttcatgttgcgtatcggagagagaggctcccaacccctcctctcgaacacaactttaagccatctcttggaggaatcaatatattcaagtttatggattctcaaaacaggattttggggatggaattttggatatcatttggtcaacagtgagaacctgagactccatgtatcactaggttactcgcgattcacgattttttttaagataacggaaatgttttactattgtggttcacgatgtctcaaccacactactacacgattagagtgcttgttgccgccgttggaattaatagatgggtcttagcccacttaaagattaattttttggaaaatcacaaaagcccacctcatggaatggtatgaatggagagtttagtaccaccttgcttattctaggagagggggacctcattaaaagggagaatgtcctcctagccacttgaagtatgtgaggtggagagaagagggggaacacgcgcgcgcaacctacgcgaaaagatttttgggaagcgcttccacgatggctcacgagtaattcctgctgagcaaccgaaataaatctagcggcgcttccacgacggctcgcgagtaattcctgctgagcaaccgaaataaatctagctcgtagactattgagaaggcgacaataaggtttttgagaagcgcttcgcgcgactgctccctgttcgtccgcgacggctcgcgagtaattcctgctgagcaactgatctttcgcgacggctcgcgagtaattcctgctgagcaaccgatctttcggcaacctcggtacatgttcaacatattgcgcatattcgatctgttcatgttttactgtttagtttacatgtgtagatccaatgatgcatttattttagtttacatatgcaatgccatgatttatttatggaataaattaaatcattatgtgcttataatttcaatagctgcaaggcccaaacctcaactgcgtacgttgaaaattagaccgttggatatttttttgttagagcctgccacacctcttaaaagagctcatttttatctgataatgatatgtcttgttacgtattcacttaccttaatgtaatagaactgttctctttttttactgtaaacaaggacacagaagctaggtccaataggagatacatgagagcatggcggacgagt

SEQ ID NO: 4321 - DNA, 1501 bp, Oryza sativa
aaattctttttttatgctagtttaggacgaatttgcgtttcactctgtttcagaacaaagaattacatcacaacatgtccatgacagtaataataagcactaaagcattatgtccaatagggtgtgaactgcgaagctagtcagcgagtaataaggaggtgacagtctgtaaacaggatggtgtatacaactttcgagacatggaggtaggcaggtagcaagtagcaatgtcaagaattcataaaaaaattatagctagacagacagtccatgcttacctccttgcttacaaatatgcgcgccctgcaacgaatttagtcatactaaagttagtgatatataagaaaaggtccagcattttaatttcttgaacaatcatagatcaaacttccattgcatcaacatccttctcacatcagatgctaggcagctagatatacagtgtacaggccaataatttggaactgaacatcacactcttatagaattaatgaaatccaattatcaaaataatatgatgattataataaaaacaggttgaactgaatctgctcgtgatgtctaagttggatctaattaattagctcaaggagatatcaatatattccaatcaactgtaagtagcatgataagaaatcaattccagtaccatgttgttgttacggaaaatatcaaggaaaccaacctgtgttatataaaagtattccgtgtatttttaacatatggtactggcagctacctcttcatgtcatgcaaagcgtatcatatctaaagcatttcgaaagcacgtattcttttgtgaatgtaataaacaagaagcaatccagcaagtaaagtcatcaagtgtggatacaacagaggataaattgtagtccaaagcataattaatcctgcatatatgagacaacaaatcccaatttaagacacagaaaatagggcgcaatacctgagcactgaagacagccgctcctaatccatcgtctgggctatggctacagccagataaagcgagtaaagagaaggtcgcgcagagccacccccttgctccattgtcgggacggcgctgggccaaataggtgcggaaggacggtcaatggtgcagccagcggttatggtgtcacgccagagtattcgtcatcaggctcaggcgcgggaggaaggatcaaatcaagtgggccatcagctaccgctcggcccagacgggagaggcgtgacaacccgcacgtgaaggggaaggattgggtccagtagcttcgggcaaggtctataaatagattacccttgtactgaaatagttgaactgtattgaacaaacatattctgaataccaatcctttccccctctccaagtctgtattcttctctgttccttctaaattccagattctatctctaattcttcttgctgagatctcgggtcgtaacatcttagtatcagagctcgtttccatcctggagaagccaaggttccaaacgcggctacagcttcaagtcgatgcca

SEQ ID NO: 4322 - DNA, 1501 bp, Oryza sativa
agaatagtatgtgagatcatctgagtgaacgaaagtagatcgggatgtcaaacaaacagcgtcaagttatcagagctctccgaatcttatatgtataccttgctataggcagccagcttgggctgcccatggccataatctgatgcctctgaggacactgacgacagcttggcctccaggaccttggcctccatcaccccgtgcagcaaccgctgtgccatggttgcaacctctccctcagcttaccttaatcctgatctctctctctctctctctctctctctctctctctctctgttattgttagtatctgtcctgaacttaatgatttgcgcgcgtatgtgtatatatagctagccagtgcagggttgtgatctgcagtctccttccttccttccgtgaagcacaattaatcagaggacaaagtcgccagccagcgattacagagatacctatatatattaccaggttgcagaattaagtgatctggcagcaagggatactcaggcgcacaaggaaagccaaggataagtgacagtgttctttcgaactggctttgtgcttttctccatcttaagcgaagaaacaggcatctatgttgtagtacttcctagctattaatacaatggttataaggtagagtctctctaccttttgcgttaaaaaaaacttcctaggtatgaattaatgcaaacaacatatactactacggtagagtaacaatggcattaggtgttgatttacgattactcgtaaaaagttgttcttttgtaaaactctctaaaatatgaacctataggctacagatgacttttattagctgcaactaattattggtcaagatatgcaaagtttgagtttctaaaagcctaatatgcgtcctaaaatttaacatgttaattaaaaaaaaatctactttcctctcccaaactatatcaccaaagcatttaatatcctaaactattttctaggctcactttatacctcataaactattaaacatgggccactttacttcttaatgatatctctccttttcttttcttcatatgatttttattttaagctaaaaatttttagagctatagatgacatcattattaaaattgtaaaatatttttcgaaattttcatgattgttgacttgaaatttaaagcctcaatgtttaaatgagttctagtttttaaataaaaattccaaaaaaaatattatatagtgcatctatcaatcacaccaaattttaatgcaaaattcgacttgtatagagagagagaaaaaaaaagaagaaataacattagtgagtaagttgaatgactttcagtagtctggggtataaaatgagtgagaaaattatttatagaggttaagtgctccaatgaaatagcttagaggtgtaaaataagaaaaatattttttgttaaaaaatagaaatatgggcaccgttatattgtggtgtatcaagattataatggagcaaatagccatatagctgtgtgaacaa

SEQ ID NO: 4323 - DNA, 1501 bp, Oryza sativa
tcagtacgaaaggtccaaagccttaatgtctgcacttctattcgttatgttcagaatgcttgaaaacttgttaaagaggatgggtcctcaaaagcatgaaagtggactgcattagtgccggaggcaacatttttgttatttatattatagatttatagtgcaatggtagtcagaatcccaatagaatatacactgaagatgtgccttagaaagcttatactctactactcataaacggtttcctagggacctaacaaatttatatgtacattttataatgaaacatcatgggaaaacaggttatatgataagcatttcagatccagctcatgactcaagtgaaaatagtttaaaatacagtgaaagtagtcttggttgattgactgtgacaggtgcaaaaaaatgaaaaagacatgttctattaagacgaaccgaaattgttttattaggtcctaacttgtgcttaatggactcatgagactaaagtttgagcatgcatagaattttgttaaaacttttcgctcagttattgagctccacgcctccacattactatcactatctaatattagggcttctggagacaattattgctgtcatcagctgttttcatcattagaccaaattagattttggcggaacaggggttttcagcattgttgctcagcagtttatactgagatattgctctaccttcgctatcctcaaattgatgttgctttcaacaaataaaatcagagagattgttacaaaggaagacaatgttcaggctgataaaatgactgtctgggcaggagagagactcgggagaaaggtacagatcttaacctcccttttccatgctagtaaagataaacatcggttaagtcatgtgttacaagaaaaggtgttcgaaactaatctgggatctagtaaagctaggttctctagtccatagtacagaaaatggtactgtactaccattgcattgtcaatatttccggaagcatatgtgttgtcattatcatactataatggtaatattgcatagtcagtcagttggttataagtttgtagttcgtagatcacaacacgttgtaactttgaagtttgcagatcacaaaacgctataatttttaagtgcgcagatgacaacactgtcaacaccctagatgaaggcattgttggccctgttctttgttctttagttctgagtggatgatggattatctgattttgtgataatattttgggggtacaaacgaataaattatctattacaaagttgtaaaagttgttttaaaaattattggaagaaacttatttctagaaaacttttataaaaatcgcaccgtttagaagcttaggaccgtatttgtcagaggtaaagatgatagataatttgtcagaggtaaagatgatagatatggatggaccgtatttgttgaacttattgatatgaacttgaaagtaccgtgtattaaaaaaatgtcattagacatccaaataacctttgaaacgg

SEQ ID NO: 4324 - DNA, 1501 bp, Oryza sativa
acatgaagctgaaataatagagtccacaatagagagagcaatagagagagatgagaggaccaggagatattttctccacttataggccttaatggactggacagtagtacaagataagaccttattatttttttcatttctaatgtactttcggtttttccctcaaaattgaatttatctaattctttttcaaaaaaatttcttcaccatccgccactaaaaatgaagaactatatccacgattttttttcagttttttcagaattttgaatgtgggcaaaattcaccaaaccctaccaccggtaacccctaccgtaccccgcgataaacgcgcagttatcggcattaagagaaaccctgatgagagcatgtttagccttctccgttttgtagaaggaaataatataaaaatagctcctatataaagatattcatttgtttgtaatccaattgtgcaccaccaccgacaaaccctagaataggtgtagaataggtgatatttactggaccggcggcgtctcctcgagtaaaggcttccacccaaattgcatgactaacaggtcttacgtgtaaaggatcatgtacccatgattcaaaatttccttgccaagcgacataaaacagattacccgaaaaggcaaaaatgttataataaagacattcctcactaatatcatcatgacattggaaattaactaatatcatcatgacattggaaattaatctcaaaatcatgtgcggtagcgataccaacccaacaaaataaaaccagtagctagtgggggtccttagctatgccttggcactactagaaaacagcttttcacaggcggcctaaacaggtttttgcaggcggacgagtgcaactgaacgattgtgaaaatagttacttttcacaggcggacaactagtccgcttgcgaaaatagcacctggcattaaaaaaaaaaagggcagccaccgcccactgccgttccagccaatagcagtagctttccattctcctcccattccctcatccagattcaacatcaaaccaaatcaaatacacaaaaacataacagattaacagacatcgtagtggttcacaatcaaatcaaatcacaaattttccatggatgtcgtcatcgccgtcgcacggacgcaccccgccgccatctgccccgtgccgccggccggtccgcccgcccgccggcctcccccctcccccctccggccaaatctgggagggagggagggaggggagccgccgccgaccgccccttccgccgtcggggaggtgtaggggaggggagaggattagaggagtaggggagaggaaagactcttagaaaaatatcagcccacgtgccacatatatataccacgctaattttcgcaagcacactttatgtggtccgcctgcgaaaatagcaggcaccgcttaagtggtccgcagcgcccttcaccccgatttgcatttttgtaggcggctatttggctctaagggtcatgcccgtctg

SEQ ID NO: 4325 - DNA, 1501 bp, Oryza sativa
ctcgcaggttactgcccggccggccgtgattaaactaaacacggtccaaataaaaattaattctcacccacttgcatgaattacacatgcttaagcttaattaacaaccacgtacagcttagtccgtgtacgctgagagagagaagtggagatccaatgcgattttccactccagatgatcagcatgtcatgtgtctcacgcgcccgcgcgcactgcttcttctcgatctttcatttgtttattgttcgacaccaaccaaaccatctctcacagattcttaatatacagaggtttcgaggacgagcagatcgctgcaactgcaagaaagcaaagaccggggtgtagtgagagtgtgtgtgacaagatcgatggccgcggttgagtcgtcgtcgtcgccgtcgttgtggtggtggccgctgccgccgtggctcagcccgggcgccgcgtggttcgtcctgttcaccgtcgttgtcggcgccgtcgctgtgtcgtcccgggcgcatgagcaggcgccgccgccgccgccgtcgtcgaccaggcgcaggctcactcgcagcgcgtcgtccatggtcatggagcggctacggtccttctccgccttctccttcgtccacgcgatctccggtgtgcaagaggacgacatcaccgtaggtccaccgacgtcgccggcggcgtcagggaatgcagaggcggcggaggagaatcccattggattggacgaggcgcacgcgcatccagcggtggccgccgttcggccgccgccgccacaagctgctgctgctgctgctgccaccgccggcgaggtggctgctgctgctacggcggaggagaggccgaggaagaggagggaggcggcgaaggggaggcgcgcgttcgcggaggtggaagggaaggcggaggtgaacgcgagggcggagcggttcatccggcagttcagggaggatctcaggctgcagcgcctcatgtccgtcctcaaccgcacccatgcgctcgccggcgccgcctcgtcgtccgcaccgtagcggcgtatagtagacggtggcgtggctgccggccggccagctagctgcctgccacgccgcggcaacaccattgtactgctccatatatattccattttgctttgcttaattaggatatctaatttaaccttcatcacatgcgaaaagcaagagttatggtatatagttgttttttcttgtcgaggtcagcagggatgaagctagcgctcctcaaattttcttttctggaatgactagtacaagacggtacgaaattctagtgatagagtagaaaaaaattataatattacatcctgtaggtcgtaaccagaaaaaacaaaaaaatgtactgccgcccacacaccgacaacgccaaaccacaagtcctggagaagagtagcaccggactggccgctgctaaactaacaacagaaacaaccgagatcgcccaaaaccctacccttacaaacaacacaaaatccaactttatccacgtctt

SEQ ID NO: 4326 - DNA, 1501 bp, Oryza sativa
acttattactactacctaccatgttttgatacgcttgtctccctttgctcactaacataaatttacattgatcaataagcttcctctatctgtccagtcaaaccgaaacaatacatgttacctctttgtaatctttttttatggttttgtaacatttacataacacaaaacatgtcattgtgttttagtttgagaatgagtggcattggaaaagaagcacattgcgcattcacctgcacaagcacactaattatatcactacaagaaatgtaattattgtcaagagtatttccccttgcaatagtatagccttgcagaagatccttatctgctaccatcactctagttccttgctaataatgtttatttgcaagggtcatgaacgtacccttgtagaatatcgtcatccccaaggcataggcgatggtccttgggattgtatgaaataaagcatccctttgtaatataaattacataatataaattgtacagttagttaattgctagtattacgctagccatgcatggatcttgtgagcttgtttttatttataaatagattaaacattatctaaaaataaaaatatatttaattgatttctgtaaaaaaaaatctataaatagctaaataaaaaacaaaattaaagaattgcaaatgaaattgtgcctgtactgtcaaaaacttcttttacatttactaagttttagtttgctaattaaagtatagctaaccgataaaaattgtatgaaacgtgttaatataaaatgtcgaccacgcgacctcattaccagtactataaaaaaaatataaatgaactattcggaagggcctgcaaatgataaaaacagggcatgtgcgtgtgacatgcataactgtttgtcttccattaatagaaaaacataaattaattatcatgatcttttaataacacgaatattttaatagtagagataccgagtcacatctaaggttatattttagtataggttttatttaaatattacattaataaaatggtgtaacgccatgatatatttttttagccatatctaacaagtgtcatgcaaacgagagaaggctcccaccgttgtatctgccgtataaaaatttatcagtacattggcacctctactctagagggatattttcccatgctagcatgcttgtcactactacctaacactctagtagctactacttgttgtcgccatcacgccaaccctctaatcaatacattaccactgttgtcgttgccgaggtcttatatacactgtctccatggttgacaggttgagtagcattgccactgttctatcttcgtcgtcaagctccatgaccgccacttagtcgaaggtattattgtacacgcctaccacacttatgtcattactggtggctctactcccttagcaacgatcgttataaaaattgaaaaaaataaaaaaattctagattgattatctagaaataaaggatgcaaaatctatatttaaagatggt

SEQ ID NO: 4327 - DNA, 1501 bp, Oryza sativa
ttctttctgtggattataaggatggatcgtactgtgggaatgatattattaattatttaatatgtaactgcctgtcgtggatgtccatatttacaggggagactgtcaaaattttaatgaatttagaacttagtggtttttgttccgtagtgtgtagcattataggtaaaagatacccggagtgttacatttatgctctatgtaaaacattctttgaccatccgctccaaatgttgacatgccatagcaaccaaatcccatcaacccaacttttttttttgtcaaataccatgtcgttcagcatagccataataaatggccgttcctaatagatcgtaaggtttcatatcaattgttagtccgaaaagccaacaactaaacatatacaaaacactatgaggtagtaattaaagttctaaagctatttgtattacagaccgcaccaaacgaggaatacggtattcactagaaaaactagaaaaaccacgtggcttcgccacgcatggtaaagtgaacccagctcattcgactttagtggagtaactaattagggtccctttacttgaaagaaaaatatatgaacttttattctgtatagaaacgataaactttgctataggaaatttttctatatgattctttgaaccaaaggattattgaaaactattgagtcttatcaaatttctaaggaatgccccaattcatacaagttttggagtatttttaacatgaggttcaatatcatgcgaagtctcttatgagtttatctctctcatctaattcttgcatttttcgtacggtccaatcaaacgattatttcatatatttttatgtgttttataattctttgttttgcgcttgattttttgtgagaattctagtttttcctattcatccctcaatcttcgtttcaaagtagccctcacaagacatatataggttgcattggaccgagggagaacagagaaagggacaattttgtttgtacaattgtacccctactttgatgtccaataccgattttaccctacattttagggttgttgttttttgcctacattttagggttgttgttttttgccctatttttttcaatgaatgaggcgtttacccctgtttttgatggaagtgagtgggattggacttagtgcggtaaagaattagagaaagaaagagataatgattttttaaattattgattgacccttttacccctagaaaatatgcatgtaccgcttggtgtccctccaagcttgggcacttggcatcaactcttcccttcctaaacccgaatccccgttgtgaaacagtggcggcagtgtccgtgggccggccaggcaacggggacgacccgagcaagtgtaggccacccaacccagttgcaacgtgtaggaggaggctaggcattgcacaagaggccatggtagagaggaggacaatggcggctgctgtagctcagcgtagggaggaggtgcggctgctcgacgtgtcgaggaggcga

SEQ ID NO: 4328 - DNA, 1501 bp, Oryza sativa
gcgagggatgagtcacgcgttttgatttttggaagatggaacgatgccgccctgatttctggtcgccgattcgccgccctggctccctgatgagttgtcgcgcgcgcatggatcgatcaaaacacgtgcagtgcgactcctcatctcctctcggctaggccttctccaccaatatagaatctatgggctggccggctgggccttatcgagtagaagttttgggctagacaaatggaggggttcctcagtttgggctagaggggtgcccatgtggtggaggtataggggttacaagctatttcgaattttaggtcgggttcctgggcacccccctgggtctgttgggctccgcccctatttttgcatgcgagagaagaaagaaaaccgagcgaggcggcagtgtttgcttcggcgcgcgagggctgagaggagaataggggatccatgtgtggcgaggtgggcggaggggatcgagagggttctatgtgggacccatataaacatattttttttatcatatcttatggctgcacgcgagcgatacagttttgggagctgtgcacgcgtcggtgctaaaacaagcgcccacttgtttctttctctatgattttctttccttaatcccagattaagctgattaacaagttttggagctggcttaataatgctattttactgctctaagggcctgtagcctagtggttacaagagcctcagtagcaccttagatcctgggttcgactccccgtggaagcgaattttccaggatttaacggctttgtgctttcagtggtaggcaacgtacccgtcgacagcgaggcgcccatggtgacttcgtcaatctccaagatggatttgccggcccagtcttcgaaaatgctcacaggggtagggtttgcgtgcgttcataggggtgagtgtgcgtacgttgtattgtgtaattctaaaaaaataaaataaaaactaatgatagtcatactagcaaaagtgatgaggtggcaaataaatacgtggacaaaagtagcgtgtgactaaatagtgaccaagtatacataatcttctatactactccctccgtcctaaaatataagaacccatctgatcctacgttcttatattttaggatggagggagcaataagcagcacctgcttcttccgatcgaagtagtatccaagtattttcaggatttttcttgaaatcatttgagcattggaagtatttttaacaattcaaagatcatttcagtgattattttaattggaaaaggtttttaaatcctctcctaagccgttgggttgatttcagcccaacatctctctccctcgcgcgcgtgctgtgcagcccaagccaagtcgagctgctctgatctgttctaagccatccgaaagtctaatttgcctccctccttcaatcgggccgaggaaatgaagcccggcaggaagtctgttttgcatccctctgctacagtgtcgcccctaacctccagccggtcgatctcc

SEQ ID NO: 4329 - DNA, 1501 bp, Oryza sativa
cgtttctcatgtagtgtgcaaagcaggaccaaggaactaacttgtgcagctactacgtatgcgagtatgcccactgcctatcaacccaaatctacaccacacgagagctcgatgtacgtatatataaaccattcaaaatttcattgtgtatcgatttgctctttattaatttcatatattgatatgtcattatttttcgaatgatagcgtattcacataagagacaatctcccacacaaggattttatcacggctgttcaagaacaactgatgggattcatcaacgaagaagtccataatcccaagggtgaattctactacgacggatcgacaattcataacatcggtccttcttcttctgacataacgccggcgtcgaagtcatagctagctagctagcgagcaaatgaattgtactatacatgcatgtatatgtttatagatgtacacatttactttagtgtaaatatatattttggtaatatatatgcacataaaatgttaagtgctttaaattatacatgtgtaatttataatatatgtatttatacatatacatatgtatatatatatatatatatatggaatacatatatatatatatatatatatatatatatatatataaaattaaccatgcagcaacgaacagggccatgcaaataaaaaaaattagtagatcgatctttagtcccggttggtgtctttagtcccggattcgtagtcccggttggataaccgggactaaagggggttacgaaccaagaggaaaaagggtttctccaccagtgttctgagcctccaatactccgtgtagcctccattgaactcgacgaaaatgcaatgctgcctagcttggcctgctgccgatgtgcccagggccctgggcgaccgcaccggtttggcgcgcataatgactgtaatgttggttgtagcaacatacacatcaatatgcaagaccctaatgccacccactcccaagataaaaaactcttgcatgatctgtgtagtgtgcatgttaggaattaaattgaataaaatgaagagatagcagtggttaattatttcatttggcagataaatggaaagaggaagcaggccttgcactgtgatcgatcagtatatataggtgggaaagtgagaaaaatgaataatatatacaagtataataataggggttggtggttgtcacaagatgttttaaatagaaagtcagttcggaagtaaataaagaaggtacatcactcaaaactaacctttggacagaggaagaaaaatcaaacatgtgtaaatttagtaaaactacgtagagtgaaatacatgaccggtccttaaacttgtggtgtggtgtcacttaggtccgcgaacttgaaaattgcatgttttggtatgtgaacttagtttaatgtacctgcaccccggtcctatcatcctttgaccacatttgaccgtcaacgtggcatgccacgttggcaacatttttgtgcgcagccccctccac

SEQ ID NO: 4330 - DNA, 1501 bp, Oryza sativa
gcactcattcgtgagagaaggttcagtgctactagtacgtgagagaagggtcctgtgctgctagtacagctatgtgagaaaatgtcccgttgttacctgtgcacataatgcatatctatttgttttctttttatagaattttctctcaaattatttatccaatctacaatcagattacaccattatgtttgttgcaattaaatctttacaacaagatcttacatgattatattatgatgaaaaaatatttatatttttaaattacttttattatcggaaacgctatatttgtgatgccacaaatttgtttgttttgcagtcagatattttgactgttgatgttgctttaagatctgtgttatatattgccgtggcaacttacgttgcggctgtgattaattaaaacttagcatcttcattagttcaagctttaaagctattctttatataaatttataatgtagttacacaccacttatatcctacttacacgccacttacacatgtaattactatataattttgagacttacatatgtatttttgaaacttacattataaatacactaaatttacatatgtaatttatggacttacaatgtaaataaatgctgactattttttaataaaaaatatggtgctataaatatagctattccctttattatatatgtaagttacttttatcatatatataagttacttttagatttgactaaattacttctattcattcataatgcttttagttgattatttttattattgtttttagttaattctatattttgtggactttataaatcttatctacactttacttgcgaatttactctacatagttcttatttcagctcactcacaatataattatttctactacagagagttactccccccgttttataatgtaagtcattttagcattgtccacattcatatagatgttaatgaatctagatatagttctaaattaaagttactttccttttgttataagttacttctataatatatgtaaattacttttaagctttactgatcttaacttagtgaaatctagaagtaatttagacatatcataaaagtaatttatgatttttcaatgtaatatcttgttgtaaagatttaattgttacgaacacaacggtgtaatcggattataaatcggatgagtaatttaagagaaacttctctaagaagaaaaaaatacatagatatttagggtactagtagctttttttttttggaaagaagggtatctctctttagcagtatccagctacatgttaacccgtactacacacatcgtagataagttcgctggtgggagtgggtggcattggaatatatagaaacacaccggcatatttccctctaaagtagattagccaaaccaatgtctctgcccgggcaaattggctgggctagctactgccagtcttgtcagggcatctctttagcttagacttgccataccaacaaagctagatagttgctg

SEQ ID NO: 4331 - DNA, 564 bp, Oryza sativa
cttattcaatgttttaatcttacaaaattttcttacttttcactcaccataacatgcacatgcatagccttagttgtataaatgtataatatataatataaacttgctgcatactctgagggatggcttggtcccagcaaccttcatgacagcgctgataacccattgcctatagctgtgatagcccaccacccgttgccatttttccatggctcggatattttttagaggaaaggccacaaggacccagatttttaaaaaaagcatgagtcttatatagttttcacataacactggggtggcacagttttcagggctagccttgggcctaggccggttatgtgacacctagggcccaggccggaggggggtggggcatcaccacctcccagcccagcggcagccagcccggcaatcccaggcaaagcatgctgcgcgcaagctaggagggagggaggtgagaggccacgtcgctactcatctccacgcgactcttcgttttctgtttttttttttacgcgactccacctctgcgaccggcgactccgctctgcgcgttgcagc

SEQ ID NO: 4332 - DNA, 1501 bp, Oryza sativa
tgttccttgacttggaagtcacgtgcacgtcatctcggtcgtgggaccggtcaaatcgaaccggctgacataggggacgcccgtttcattcatcatttaatgggtgaagacttctgggttcctgtttgcaccgggaaatgggaaccctgcttgactagagcggatgaaccaactccggctgggaaagcctctcatcatcatgacgtgacggggcatggcaggctgcacaccgcctgacacatggtcaatgcgtaggcgcactaccccagtcccatcagtcattcgaccgttcatagactggttaggcgcgcagcacgccgcattaaatgcggcgtgacacgcccgttcggtctgatttaaatgcggttaggtgggcggtgggcgcgcccacccaactcgcaggagtaggctgatgcgccgagggggtcgggacggcccgacccccaagcgaggaggggtcggccgccactccaccctaggctcgaccctactcggggaagtgcaacgtgggtctaagggcagcctcctccctccaatctcggtaccccaagctggagaggggcagccgccgctccaccccaggcccgatctccctggagggggggcatgtgggttcgggggtagcctcctccctgtaaagatgatatccccaggtccatatcaccgataaacttcactagcagtgtagctattttcaataacgtgaagagttacttttgtataacagttactttccttatagcagtgtagttgccgtgaaaacttaattctatctagtagtagagttagttatttatatattatctttttatagtcacttccctttaggagtgtatttattatgaagagttacttataaaaattacttttctctaataatgaagttatttctaatatcgtgaagagttaatttctatatgatgcaaaatttttgttttcaaaaataatatagtgattactttgaaaatataatacatgtatttacttgaaaatcttgtgtaaactttacttgaaaatttactccacatattttttatttgaattcggtcctaatgtaattacttctaatagtacaaagagttaattctaagttacttttaaatttaatatattttcctgtaatctattttctttttctttctttctttctttttctttgtatatgtcgatcccttatttaatatattatcgcagtaggagcctctcctgcggtttcccgtcaaaaaaataacttttaaatttaagtaaattacttttaaattaataaaatatctgaatatacgaattgtattacgaacaccgtacctaaaataattccaccgttagaaatagtaaaaagggcaaacgaaaagagggttgccttgtgttgaagacgagtatgggcaagaagagtcaaacagaagacgggagagagaaagaaagaaagagcagagtgtcgagaggttgaagacgaagcagccttggaacagagcgaaggaagaagcgaggagaggcgaggcga

SEQ ID NO: 4333 - DNA, 1501 bp, Oryza sativa
gccggctggagctgcgctggcatgcagggagatgggacacggccggcgcacgggaggaggatgcggtggactggcgtgtcgacgacggcgatagccagagaggaggcgaggaaggaggtgaccggcaatggggaagaaggagagcgacggccgcatgcgggcatggtgggttgtgggcgacagcgacggcgtgagcagtttgatggctgcggagcaaggccggaggctgacacggcgcgaggaggcgcggacgatggcgatggaggccgacacggcgcgaggagatgccaccggtggcaacggaggccggcgcagcacgtcgaggcgcggtcggcaggtggtggaggctggcgcggcacgcaaaggctaaccggtggggagagccggtgcagtgaagcccacgcgcctgtggaggcttgacggtggtggagcaacggggcatcatttgtagactcgcaggcggtaggcgacgggtaaaaacctagcccggccttggccttggccgggctagcaacgacggcattttcgaacgtctttacccttcttgagggcgttgtcgtgccgccccttcacctccagtggggctatcgggtgaaaacccagtcttggccctcttgaggccttgacggacaacggcggcggtgtatccatcgctcctctcgttagagatgccgtgtaggcacccccttgccaaaatctcccaagcaattggtgcaagctctctctaattcatattctcttatgtcggcatcctagcttccgcaagttggccacgttggagggcttagggggagaatggctgcattcttctctctcaccctctcaccctcaatcccaaagatttagatagagctgtgttttgtgtcagttgtaatggtcgggttttgggcgatgtcggctgtgttccgttgtacggcttagtggctgtcggttacacttagcggtggctggtctgatgctagccttctcctgagtctatgtgttggcgttgtgggtgtgtgagtggtagtatactttttttttctttttcctggttaccatcttcaagggttgtaattttgttattttttcctactctatcagtagaactttacactctctagtgcgattcgttaaaaaaaaacaaagaccatctcgttcagtttcctttatatggcctacatggtatatatagttatcaacttctgatcaacttaagtgtatttttgcaggtggacaacgatttcacctcacggttgtcattttcgcaggtggtcatttagctcggagaggcctacctacctgaaaaaaatgtcatcgtctggaaatttgcttttctagccgtgctttcttcaaagttaagaaagtactccctccgggttgataattcttgtcattttggacaagagcatggtctcaaaaaaacaactttgaccattatttttcattataatatgtataagaatgttaaaaaatatatgattttattaaagtactttttaagactaatctatacatgtaa

SEQ ID NO: 4334 - DNA, 1501 bp, Oryza sativa
catccaagaaaaccattcacaaatcatacacaatcatccactatacatgcccttccgcaatccaccaatcatccccaaatcaacaaacaaatctacacatcaattcacaaaataaaaaaaaaagctccttagtgtcaggagccaagatctgaactcgctcctaacaattgaacttacccggcctcacacttagggaggccagtcaccgccggcctcatccagcgtgggccgccgccgccaccgcccggccacctgccacgcagccagctcgctcagccgccgccgcccgaccggctgccacatggccgccgccacccgtccgctgcacagccgcctgccgcgcggccggctcgctccgccgccgccgcccggccgccgcggagaggggaaggaggaggaggaggcggggagggggatcagaggagaggggaaggtggaagaaggggaaaggaaggggaagaggcctctctgatcgatcgatctgttcgggataccgagtcttaatgaaggagagaacgaaaggggaggggataccgagaagataagatcggcacgcgactcggctgtttatttttgtcccggttgatataaacaaccggtattaaaaatagatctttagtcccggttgtttataccaatcgtcccggttgtttataccaatcaggactaaaagataattggggcctgactcagacccgccaacttctttgaactaagactaaaaataatctttaataatttttagtcccgattcctattcaaactaggactattatgtttttggacgaccgacgaaagatggtaacgtgtctaatattcgcagtatatctctcgtctactatcaatatggtatccaagcgggtgatgtagggtcgccgccgctcgcgcttctgctcgtcgccccggggagcatttcgatctcacgggggcgggcaccattttttgttttccttttttttttgggttcgtcgtcatggtggttgcccgtgagggatcgatctcgatcttctccagtgaccctcgtcggcgtcatggtggtttgagtcaagcatcagccgcagtaacgcatggatctaccggtcgtcgcgtcgcgagttctcgtcatcgagccatccccgccgccgccgggtggacggtcgcttcttcctcaccgcgtcgaggtgcacggccggcgtcgccgagccccgaccgcccccggcctggcgcgctctgccggcaccaccccgtcgacctctccacccggccgccggactccttccgcaccgcctccgtcttgctgcgccgacgccctccgtcagcatctctggctggacagtcgttggccgagcgccctgtgaccactttctgcagtgcctccttttgaccctgttgactagccatcgtctctgctgtgatctcgtgcgttgctgccaagtgagaggagagagactgattggtgtggagatatctaggcttgttgacttcgttgacgtcatggtgaccagacctgcatgagttgcgt

SEQ ID NO: 4335 - DNA, 1501 bp, Oryza sativa
attgtttcaatgagaaaatttttgaaaaattaagaattctagtattttttttattccttcagaaatagataagaattagtttggtgaatcggaaactatttttcaattttatagaaaaagtccatgtaattttatgatcaataatagttttcgttttccccaaaccgtctaaactcttatccacattctgatttaatagctcaaaaattagaaaataaactattccctttgtttcatattatatgtcatttatttatttttcttaatcaaacttttttaagtacgaccaagttaatagaaaaataaagtagcattttcaacatcttcaatataaaattagtttcattaaatttaacactgaatatattttgatataatgtttgttttgtattgaaaatgttactttatttttaaacttgcaaacttaaataagtctaactaaaaaaataaatctaactaaaaaaaagtcaaacgacttataatatggacagagggaggccccgtttggcatagttccagctcccaactccaacttacctagagccggagttgcgccaaacagtccagatcctccatttttggaagtggagctggtagagctactcctaaaaaatcaactatgggggtggagctggatttttgctgctccacagctccactccacccaaaagacccactaccctttaaaatttttatgtatttacacaaaaataccactgaactaccccttcacatctcctctcctcccattctctctccccatcttcctccctccctacagcagtcaacaacgagccagcgacggacgacggcgtcaacgtcggcggcggcaggcggtggtggcacggcgcggcgcgtgagagccacgggcggcggcggcgtcagcgggcacgtgggcgatggtggtgcacgggaggcgcgcgagccacggtggcgcatgggttgtggtggccaaggtggtgcacgggcagtggtgacagtggtggcagcgggcgagcgacagcggccgcggccgtgtagggcgacgcgtgggtggcggcggcgacgacagtagcaaggcgatgccaaccatgtgttcgacaaaatgcctacaaggaacgtggtggagtggagctgactaatctagccaaacactctcgtacccacttcagtttctataggagttagctcttgctggagttagagtttaaaaccctatcaaacggggtcggagtattaaggatctcaggcttttaaaacagtgcccaaggttccctctgggtccgggccaaaaggccctaaacctattcaggctctgtacacgtggcggccccaaggtgcttatcctggcccggaagcaaccgaacaagagttcccttcctttttagccggcggcgaggggcataatcgtcttcttccctccctcccttccccactactctactcccccactcgccgtcgcaactcccgccgccgcaccgccgcaccgccacaccgcccccgccgcaaatggcggcctcgc

SEQ ID NO: 4336 - DNA, 1501 bp, Oryza sativa
taaatctcttggtgcccaaggaaatgttaagcaagtactccctctgtattttaatatatgacgctgttgactttttaaccaatgtttgaccattcgtcttattcaatttttttttatgtaaatacaaaaatgcttgtcatgcttaaagaacatttgatgataaattaaatcacaataaaataaatgataattacataaatttttttgaataagacgaaaggtcaaacgtttgttaaaaagtcaatggcgtcatacattaaaatacggatggagtaattaacaagtcctacccttccacagattatacaatacgagtggaccttttgcaatccacgtatatggaatcccatcatgccgcagggtatcgtttttccaacttaaataacagagttgtttaaacaaattcaacctataccacacacttgaagtccattgtcactttgtgaggtacaagtacaagccccttgtacgaaatcctcccctctcgctctacatgtttgactttgacttggtttttggatatttcatttgatttgtcaaagattctctcttcacgataacatggtttagatgcacgttgcaattaatttctcctcttcgatcttgttgttcttcaacgcagattttgttctttcttcgcctcgaatccaagcctagtgattagtgaatgccaatagtaaatttattatttttacataatgctcgtcaaacctagggtgcgtaataacaacggaccgacacccaaagtctcgacaaatgctccaataattagtttcgacaaaaaggccagttacgcatgtttctaacacttaacacaagcgggaaatgccaaaagtattttcttatcaaacatgtttagatttcaccaaatagcaactcttgatcaattcgtccttagcagtacattggcagttggcactcatcctagtgatctcttaacctttttcttattaccaaacatgctaacggtattcagatttcaggaggcagtgtgtactgaaccgtgggctaacggcctccctgacggaggacagtgaccctaacggctaacagattttgcatccaaccccctcccaacttctctttattacaatacggtccctcgcggagagcgaccaccacccccccccccttcttccctttacggtggcggcgtgacgacgcagatttggcgggagccatttgaaaatggcggctataaagcccggagacgaaggcgatcgccggtgcagcgtagcttctccccccacctccttcgcctccgacgatggcagacacctcctcctcgtcgtcgtcgaggggcgccgccggattcgccacgcaggccaatgccctcctccgcaagaacctctgcttccaggtcccctcctccctctttctttcttggcgcgtctccccgatttcgcaggttttggttcgatttcctcaccgtttcttgcttgcttgcgatttcttgctttgatgcagaggaggaacatgaagacgaacgcgtgcatcacgg

SEQ ID NO: 4337 - DNA, 1501 bp, Oryza sativa
ccacgtggcgttgacgtgacacttatgctgcattaaaattaaaaaatatatgcgaagcccaattgtcattcacacaaaaataattgtgggccccactgacatgtggttcctacatgtcatcctctctctcaccacccttctttttcctcctctctcccttatttctctctctccccttgacatgagccggcggcaggtgggggctcgagcggcggtgcggtcggagagctcggcgaggagcgcgttgacggagagcagcgcggcggtggagcccgcgatgacaccgagcacgacgcctgtggtgcccaccaccttcccgggcaccggccactcgatcttcgacatctcctgcgcgacgccgacccaccacccgctgctgatggccgcggtctcggcctccttcagctccgccgccaccgtctcggggctcttctcccctcctcctccttcccggcctcctctgcgccgtccaccaccgtcatggacgcctcctgctgctcctgctcttgccccttcttgttctcctccgctcttgcgcccttggacttggagccgcgagggcgaggcggccgcggcagctggcggcggcggagcgggagagggatagggagatcgcgggagggtagaaggtggagaaggaagcgcgcgaggcagcggcggcggcggctgggacgaggcgggcggcgtggtcgccatggcttcccggtttgatgggtccagcggcccgtccgccaccgccattcggagctctggatctaggccgtcgccaccgccgattcggacgccgctccccacgcacaaagagaaagagggagagatagagaagggaggagagggaggaggaagaagggataaagagaggatgacacgtgggacccacatgtcagcggggcctacaattatttttgtgtgaatgacaaatggacccacatatattttaaattttaatgccatgtaagcgccacgtcaatgccacgtgggacaaagaccaaatcaacgctgccacgtatatgccacatcagcaaaaccactctccaaaaccaccaagggagtcaaatcgtaccgattttgtaagttgggggttcaagatttctggtattgcggttgagggatacgatttagattcggtggtcagttgagggagtcaaagtgatcttccattacggttacggtaaatagtttatccgatccgtttgccttggtggacggcccaatacatcatcacggcctatcgaagttcggcagcccgtacgggcccatgactagcgaccacagtccgggcccacacccacaccgcccaaccaccccactcccctccccgccacgtcgccattcttcccgctcctgacctttctctacccttctcctcttctcttctcctctcctcccccaaataaccaaaccaaaccctgtataggctcgtataggccaaggcagaagcttcccaaaccctcgctctgcccgtcgatctccgtcgccttctgatccccgcgcgcgcggc

SEQ ID NO: 4338 - DNA, 385 bp, Oryza sativa
attgtgcatcaccatgtgcgctggttgtctcatttgtgctataattttactctatactccaaagaattttctctctgacttattgaacataattttttttgttaaaaaattcagcagatatgatactgattttgaaatttattttgcatatactgcaaatctgcaaagaagcacaacttattccctgatctagcaaattctctttccaaatgcaccaataatcaatagaacattgggtatatgaatacgttttgaaaatccattatggaacatatcagcacagcttctcttaccagcactcttctagaagttcttgaagattccacattctttataccattttcttggtctatttcagtccaactattgcactttttggaacagg

SEQ ID NO: 4339 - DNA, 1501 bp, Oryza sativa
ctaatttggttcgggtttttgtgcttggtggtggtggtgggtgatttgcaggggcggtgaatcggtgatcgatgagcgggctggatctccgggagatgttaagcagcgctgcgcggcggcatacgtggaggagaagcggatggggggcggagtggggcggcggcgacgacgctcgctcggccgcgcttccggctcgctgtcctcctccccctcctcctcgtcgtcccgcggctgcgggtgggcgtggcgacgaggggagcggtggagtgcgggggcgcggggaggaggggacgagtcgtggtggaagcggagcgaggcgcgaggacgcggcggggaccgggaggaatgcggtggccgtcgtcgccggtggctcggccacgtccggcgcggagcgggttgctgcgcgagcggaggacggtaggaggacgcctctgtttcggttcatcacgtcctctgcttgggttcgtcgtatggattgcctatgtaacggctaaatttgttgcggtttgtgttcggtggtggtgattgtagggcggcgatcgatggacgggccgacgctggaactctccgagatgatgctccacgcggcgcagccatggagaagccgatgcacgcagcgtgacgttcgcccgggcgcggttcctcctcgtcccgtcgctgcggatgggcgaggcgagggcaccagtacagtgcgagggcgcgtgctggaggggacgactcgtggtggaggcagaggaggtggaatggagcgtgagcgcgaggtggtggcgccggcgagaaatgcggtggccgtcgccggtgatttggccacgcacggcggcgagcgggttgctggccccttggtggcgaaggagaagagaaatggcggcggtgagttggggacgaagagggggctagagaagcgggccccgcttccgccgcccaagcgcagggtggtgtccgctaagcgccagtttccaccagatttcggtagggactctgctgttccactcggccgcggccggggccgtggtggtggtgttcgtccgtcggatggggcgcctgcccgtgctgttctgggtgagaaggtggcgtctgcgggtaatggtgattcaatggcgaatgtgcatcatcatgctgtgatggacacggtcttgatgaaatcttcacatgcttcggatgagaatctggttgctttcaaagttggttcaccagagaatggtgcagaaggggcagcaaggggaaagggagcacacaatggtgaattgctgggaaagagggaagtgttggctcaagctgtgaatttgcttcccatgaggaggactgtatctgcgacgcaccgcttcactgctgggtgtgggagggacgctgcagctccacttgctcgcagagaagagggtaaggtgggttcaggtttggaagtcatgcctgttgatgttggtgggggtgtgtcaaaggaggtgatggctacggatggcagtaaacattcggttaaccagtgtacggcgaacattgttggagc

SEQ ID NO: 4340 - DNA, 1501 bp, Oryza sativa
gcttgatcaacatcctcgccgatttcttcttcatccagagcttgttcaatggatggatctagggcaggcagatcatcagttggcttcgttttctttgacttgactttcttctttggagcttgagccgatagatccgcagtcgatgacctggtttttctctttttaccggtatcggctggttctctgatgaacccttggagaagagttgaagtcctgggggcacgataaccaatgacatggggagatggcccgcctccattaggaatcagacctggagcatattcgatatttctaccactattgctctgatgaggaggagagaattctgtcgtctgcaagtcaaaaagaaaattagtcaagttatgaatcggctaagcaattattcagacaaagttaaatcggggcatacctgagggataacatctggaaagaggtatgtcatgtacatggaagccgattgatagaataggtgcagtttccattcaccccaccatctgttaaagtttttgctcctgaacattgccagctctatattctcaatgctgcccagaggaggtccttgaaggttgagcagccgatccatcatcaaggttgatgaaattaaccttgagctcccatcggactttaggtttgaggacattaatcatgaaagataccaaaagtccagggaagttttctcagctgcaatcagcccatgcatccttcctgtcggcatccatcaggaagaaatatccaagtctcttatgagttctatcatccaatgagctcagctagacaacttggaatgggccaactcccaatcggcttattctttgccgataagatccagtgccgagtggaacttacctcagcgtactcggctgacagcgcggcagacgggctatcggaggacgacatcgccgtgggcagagatttggccaaaaatgaagtctcctggggatctccttgtgcgtcggagaaatcgccggagagagagaagacagagttggcttcggcggtgaaaacggaagaagacggtgtgagatttctcgggggtaacggttagtatttaaagcgatggaataacagtcgaaaaacggcaagagcgaatttcgctcggagttgatatatggcaaatccgaaacattgctaaatattccggacttggggggcatgtgttaacgaccaaatttggtaatatcagcattggagatggagattagatcgaggcagaatcaaagatgaagatcgtttaggaaacagagtaaaattggctggagtccaaatcggctacgaccaggatcagctgagtccgagtcagactgtgtgagccgatatagcccattccgacaatacaactcggtatacgtcctcgggttgagttggtatgcttcaagatgattgccatgcatggatagagtcctgagaaggcaattgtatctattaattaggatattttatgtaatttccttagagatatatttgggcaaaagtctgccgcaaagacttatggtatcttagg

SEQ ID NO: 4341 - DNA, 1501 bp, Oryza sativa
ctcgcgctcgtcgtcgtcgccgccgcctccgcctcctccaccgccgcgccgcatctctggggtgagagccgccgccgcctccctctcatcgctatctctctccgatctcgatctctctctctctccctctcggttgccgacgccgacgccgacgtcgtcacgacacgacgccgcgccacgacgccgcggcggcacgacacgagacgtacgagacgccacgatgccgccgccgcgcaacgccgccaccgggctgcgcgccacgccgccaccgcgccgcgcgccgcacgccgccgccgcgccacgtcgatgccgcgcgcggcgccacgccgccgccgcgccgccccgccgccacgaacgaacgtgaacgagaacgtgaacgtccgaacgaacgtgaacgagaacgcgaacgagcgaacgaacgtgaacgagaattgaacgtgaaagaacaaacgaacgtgaacgagaacgtgaacgaaacatgaacgtgaacgaacgtgaacgtgaaatgcaatataggtaggtgaatgaacgtgaacgaacgaacgtacgtgaacgaacgtaggtgaatgaaacgtgaccttaacgagaacgcgaacgtgaacgatcgtgaacgaaacgtgaacgtcaaatgcaatatatgttacttcgcgtttatcctaatacatctttttgtatcctgcagaaaagacgttgtcgaagtcgtccctcaagccggagtggtagctagccctcgaaggaattcgcgcaggcaagtgacgtaattatatatatgattgttatatttgtaatgcaattaagactattggatttaatatacgtcacctagacttagcatttatcactatttgagttttagtataagattattagatttgtaattagacttagcatataagattgtgtagggttctaatatacgacagttacacttagcacacatgactatttgagttttagtctaagattatttgagttttaatataagattatcatgcatgtaattagacttagtatataattattgactagctagggtcctataatatacgtcacctatacttagcatttatcactatttgagttttagtataagattattagatttgtaattagacttagcatataagattgtgtagggttctaatatacgacagttacacttagcacacatgactatttgagttttagtctaagattatttgagttttaatataagattattatatttgtaattagacttagtatataattattgactggctagggtcctataatatacgtcacctagacttagcatttatcactatttgagttttagtataagattatttgagttttaatataagattattagatttgtaattagacttactatataatttattgactagctagggtcctataatatacgtcacctagacttagcatatgattgttagcatataagattgttaaaacataaatgtctcatgacttagcagatgtttcctgtatgaacaga

SEQ ID NO: 4342 - DNA, 1501 bp, Oryza sativa
tacattttgtgccgcgttaattattccagtgggtataacacatcaatatatttcatctgcttgagttatccatgtgctagaatacccaccggccggaacaattccattagcctataattcaattaatttgcatgcatggtaattatcatgtaattattccgtgtcaactgcaattgaactgacaatactcacaatagtatatgtacattgaacacttaacagttcttttagataattgaccacgtaaaaggttaataataaaaaccatacatcatagaaagaattattaaagctatatatagagggaatctacaagggttttgcctcgaagtgcacgcaatgacgatatcccgatagattcctgcatccaatgtccatttattcatgacgactgcaaaatcaatattattccattaacatttgcggacaaactttgagcataatatgggatatataactaattaaagggccaaaatagataaacgacctagagtcgttattatgtataacaacttacaaggtgtggaattttgaagtggtcagtaaatttgagttgacaaatgaaattacttcaaaaactaaagaaataatatgtgtagacagtgactttttttttctctttgccagggtacgatgatagtgatctactgtaggttgtagatattggttcttttttctggtcttatatacattgtatggttcgacaagtcaagaaagaatcagagttctcaaaaggaaaaagagaaaaatatcgtagaacgaggtttgcacttgtttttttttggtaaaaattaatggagatttattccactacatataatcttgcttacaatcattatcaaggaaaggtaaaataaagcctgcaggaacatataaacacaggttgtaaagcaacacgagaagaaatactctccttcgctacacaccttcgctaatggctagcatgtgtgctgtaccgtgttcgccgttcgacgtacccaacaaaacttcatctcttggaaattaaccaactaatttgaacttcaaatcttgattcaatgtagtatggattgacctatcaaattgtttgctaaccaccacaagggaatctgtttcaaatataattcttgtagcttcctaatcataagcaatcaattatgtgcttgcaaaagggtatgtagccaagtggttttaaagggctaagtttccaatttaaaaggctgcatatattcgattggcgatatagaggctgggtaaaaaaatacccttctctgatacaaaaagttcttatgtaagtttgctagtaggtaactgaagacatattaggcttggtattttagtttatctcaatataattacttttctctgttgttcgataattgtagagctaggaaacattattctacataaaaagtttctatataccagttgatgtttcttgatatttttataaaatttgtgtatagttgtgctgcgttaattattccactcggttacatctggcacatcaatagttacatat

SEQ ID NO: 4343 - DNA, 1501 bp, Oryza sativa
gtcagcatcatcgggcatagtgtaaggtgatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgatactaattgaaagaccaagaacggctatagagggggggtgaatatagcaattcaaatctttcccccgaaaatactcatcaagccggatttctcaaaatccttactagaaccgcggctattagagaagccggatctagaaaagaagagagaaaaagaagagagaaggaattcccgaaactagaagaggaagagaaaaggaattcccgaaaactagaagagaggttaggaggagagagcaaaactcatcatcgcaaagttcaaatttcaagcggaatttaaattgcggaatttaaatggacaaggcaaaaacgaaatccttcaaatcatttcattcataggtgatgcaaaataaccgctcaactaggagcaaacaaacaccttcagaggaacaataacacaaacttaaaatctctcggacaaacacactccaaactaatcttaatacaaaagcctctcgggcaaacacactccaaactcacacggaaactctctcaccgagcatctcaaaaggattacaaaaggagcaacctccacccttgcatccatccctctatttatagcctaagacccctaagacattgtctcaaatacccgtggggcgaaaccctagccttgataaaatcctggatgtccattgttccttagatccgaaggaaacctcctggatagtcgccacgttgttgatccgagctcttcacgtcgcgtgccctcgtgcgatccgcgtgattccactccaagccaatcagtgtacaccgatccgcgtcgtgctcctccaagccaatgcatccgcgccacgcgtcccagagagcccgcgcccgctcctctcgcacctgcgcgccacaagtcagaagccgccatgtcgccgttcctcccgccgagccgcttctgcgcgcgctcgcgaaaaccacgttcccgcgcgcgccatgtgaaaaaccgcgggggacccggtcccacgagtctccgcttccttgacgaacagaaggccgccacgcctccaggtgccgtacgatctcccgcctccgcgcgcgcatgcacacgcctgtgcatttgccgagccgagctgggccgtcgtcatgtctagggtctgctcggcctggccttcaccatcttgagtcagcaacgtgcttgggccgaccgagctcccgagctggacaggccggattggacttgatgccaaccgacccaatgatctccttgggccacgtggaacggctggattggcttggcctccctgccaaccaatcacagcacacatgcacagcttctgcaagctcctccttgcacaagtacattacgtgta

SEQ ID NO: 4344 - DNA, 1501 bp, Oryza sativa
gttaaggtcacgtttcattcacctacgttcgttcacgtacgttcgttcgttcacgttcattcacctacctatattgcatttcacgttcacgttcgttcacgttcatgtttcgttcacgttctcgttcacgttcgtttgttctttcacgttcaattctcgttcacgttcgttcgctcgttcgcgttctcgttcacgttcgttcggacgttcacgttctcgttcacgttcgttcgtggcggcggggcggcgcggcggcggcgtggcgccgcgcgcggcatcgacgtggcgcggcggcggcgtgcggcgcgcggcgcggtggcggcgtggcgcgcagcccggtggcggcgttgcgcggcggcggcatcgtggcgtctcgtacgtctcgtgtcgtgccgccgcggcgtcgtggcgcggcgtcgtgtcgtgacgacgtcggcgtcggcgtcggcaaccgagagggagagagagagagatcgagatcggagagagatagcgatgagagggaggcggcggcggctctcaccccagagatgcggcgcggcggtggaggaggcggaggcggcggcgacgacgacgagcgcgagacgacggcgagatatggggatgccctaggcagtggcggtgaaggagaagtcgagagagatcgatcgggcaaaaacttctaagtgttggtggagaagacgagggcgcgcatcaggaatatatatacccatagatctttagtcccggttgatgagaacaatctttactcccggttgttctcatcaaccgggactaaagatattttcccgctatttccaaattctttttaaacccggttaggattaagaaccgggactactgataagcgcactgaatattattttccattacatatgtgctcctaaaatagaaaataatgctttaaaattattaatgacaattacttcgaaaaattattgttgtctgtaatgaattaagtggataaaacgtaataagcaaatatatgatttaaaattaataaaaattctaataatcatatatacttagcatatgaatgatattaaattggtaaaaactctaattaacatatgtatatacatacggcatgatttaaaattaataaaaattgtaataatcatatatacttagcatatgaatgatattaaattaattgttaaaaactctaattaacatatgtaaatgccacatgcatgatgtaaaaattttgaaaattcgaatagtcatatataattagcatatgaatgatagtaaattaattgttaaaaactctaattaacatatgtaaatgctacatgcatgatttaaaacttttaaaaattcgaatagtcatatataattagcatatgaatgatagtaaattaattgttaaaaactctaattaacatatgtaaatgccacatgcatgatttaaaacttttaaaaattgtaagtatcgcatataactagcatatacatgattaaaacctctaataatcgtgcataattaacatatgccata

SEQ ID NO: 4345 - DNA, 1501 bp, Oryza sativa
gatgcagatcgcttttgagctgctgtgtgctagattcagttcgggtcaggggcgccgagatccattgctccatccatccgccatcccatgaaaaaaaatgcaaaaggagtaaatcggtcactcccgatgtgtacctgctcctggccgcacaaactttgcagctcgagatctaggggcaagcagacaggattcgaaacaacaaattccacaaaacaaaatgaaaaccttcgaatgggaaacaaaaatggaaatgaaacaaaatcatgagccaatcgaacagagtgaaaaccttcgaatgtggcatgttgaccaagcgcttcggctgactcgaaatgattttgttgaatcgaatagcaaatgatcaatggtgtttgggtaggttacctttgcgggtgcgcttgaggagtcggtgccacgggcgaggagttcttggctgcagatggtgaggaagttgttgtcgtcgtcgtcgtcgccgaagctgttgctcgtgttgctgccgttgccacggtggcggtggtgatgctgctgcttctgggcgttgtgtttgtagtgttggtgatggttgatggcagcgatggcgttcttctcgacggggatcacagcggccacgttccacacgtccctgaacgccctcgccttgaccgtcgccacgcctctcaatgctgcgttcagatatcaagaacaagatcaatcacggtgcctcgatggagatgatgtgaatgggtggaacagcgagggcgaaccgttgccccattggcagcggcggcggtgatggtgacgatgtcgccgggaggcggacgctgacagtgaaggcgacggcggcggtgaggtggtcgcgctcggcaccgagggactcggcggcctcgacgcactgggcggggaacagcttcgccgcggacggaatggtcatgttggtgcgcgcagtgcggtcgtccctgccactgctggaggacgcggtggtggtggccaccgctgccaccgacacggcggcgtggacctgcgcgttgtgcgcacgcgtctcctcccgtcttcttctcattccctccttcagccacctccccaccgtcttcccaccgctgccgccgccgcatcgatacggctgcagcttcggcgtgctcaccgctctgcaaaacaacacattttttttcaaaaaaaaaatttgttaaattagcaaataactaaggaagaggggtaccagctccggcgccgccggcagccaccgccgcgaggtgaggaagaagaagacggagagggacatcgacgtcgaatccgacgcgccacgcgtcccgacgacaccgtaaggggaaggggagggggacaacggcaccggcctcgacgccgtcgcaaggggaagaagaagaatgttagttgcgatccaaattcatttgtacttaataaaggccagcttctgccgtagcggagtggatcatcatcccttttagggttccaccacatatatatatatacctgttgtaagccgccgtgcggcgatataacctca

SEQ ID NO: 4346 - DNA, 1501 bp, Oryza sativa
cattatattgaatgagaaaaggtcgctcgtgcaacaaatggacgtagtggtgtaagtgggctaacccacgaattcccttatagactaatggaataagttcatctgagatcccttaatttgtcaacgaatccgattttcgtccttcaaccggaaaatcagatacaacgggtccttgaactatcaaaaccagtgcagatgaagtccctcagcggtttagatggcggttttggctgatgtggcgcctatgtggctaatttgactcggtcttcaactgacgtggcattcacgtagcgcttacgtgacaattcgatctggaaaaataataaaacccgcgggacccacatgtcagtttcacacataaaataatttcaaaatggtggggcccacgtgggccccacatgttagcctcactccaccctttatccctctccctcggcttcctcgccatcgtcgacctcgacggtcgccgcgtcgtcttcctcggcacctccaacatctacggcttcctcgccaccgtcgacgtcgacggccaccgcgccgtctccctcagcacctccaacatcatgctccgcaactgcgagctcaagataacgacctgggccatcggcgtcgcggtctacaccgtgcgggacaccaaggtcaagtgcagccgcctggagacccacacgaaccgcgagaccatcgtgctcactctcctctgcaccctcgtctccctcctcgccggcatctggctgagcgaccacagcaacgagctaggcgtcatcccctacttccgcaagaaggacttctccaatcccaacgagatcgagaactacaaatggtacagcacaactcccaggtggtgggcaccgtggcaggggccggggtggtggggctggtcggaacgctcaaccgcgggctccgacgacgaggacgaccactccggtgccatcgccaccgcgtgcgccaagaaggcaccgccctccatcgccgtcaggctcgagaaggagatggcattctacggcgacggcggtggtactgagggcggggatgtggccagcgcaggaccccgcggcagcgctattgacagtcgttatcgatcagtttcgaccgtcaatattattaaaacaggcgagaactagtgatgcttgcgatgcatatatctgttagaataataatattccactagttttagatatactaaccttttgcagagaatgacaataaagtagaggagaatcgacatcaacacagacgataaatcaatcggacgatgtcgagaaccagacttgtgtatgatgggccaagaacgcagacttgacacgatgaatcaggccaaaattcacaagtctacgaagtgaagcaacagaggaggccgctagccgaaattgggctggattgggccagccccaggttcggccgaacctccctcgcctccgttggatccaggttttggatggacggtggagatgaagccgcaatgacggttggaggtattaccgactattccaaccgtcatagc

SEQ ID NO: 4347 - DNA, 1501 bp, Oryza sativa
ctgcgctattactgggaattatatttctagtaatgtcgttaagaaataccaacagtaggcgccacgtcagccaaaaccgccttctaaaccgtagagggaccttgtttgcaccggttttgatagttcagggaccggttatatctggttttggtgttgaaggatgaaaatcggattcggtgtaaagttaaggggactcagatgtacttattcctatactaatttataggctgaccaacgaattacctgcttatttagcccataattggctttgtgagacagcccacttacacccctaagttacgaattgctttgaatctttgcttgcaccggcacgcgttcaattatttttaaagaaatacaaaatatagcaccgctcaacgtgtggttcatgggcacagcataagttggttcaacatgagctctcctagctagtaacgtccaacacacaccaacactgaatggacgaacacctataggcgagaaaacagtgcaagaaacagaaaccgatcgagttggtgctgccaaaacttggtagcttttgtgtggttctttcattgcttaaaaaaaataaactgaaacacaatatcgtggtggttataagccgccctaaacgcacgccatgacgaccattagtccattaacatcgaccatatatcctatggaccaggttacaacgcatgtaacaacgcgccagaagcagaaaaacacagaaccccgcatcaacagagcatatgtgtcgagcacaaacagatgagcccgcacgacgctcacgcgaattcaaggggcaaggccgcaagcatccttcaggaaaacaacattgcatgctttcagttcaggctggacagacaaacataaccgaacacgcccgatcgattattgacttccatcgtccacccgagcacaaaacaaataatagcccataaattctacccctacatttctacaacagagtaaagtgaaatgttactacttccgtccctattgcctttttccgttatgaacctagagagtgatgcagggatggagctaatttggtgagctaatttggagagtgatgtaggggaggggtcggagacgagtggttttttttctctctttagcctggtcacatacacaattttcacatagaggccgtttggtttatgaaagatattttttagtgggatgacttttatgtggatggattaatatgctaccggcaaaagtgtggatggtgtggagattatgggtaccccatacccacacggcatggttatccgactgttataagggatagcttatatctatggaatttgtaacagatcataacttgggtattacgtttccatgtatattatggaacggcctaaagtcctggtttgataaaattgtaaagtagatttaggaaaccgataccgtattgattaagatttctatcttgtaatcctggcccccatcctatataaggtgggcaggaggccctctagggggcatgagatacaatcagatcataatatctata

SEQ ID NO: 4348 - DNA, 1501 bp, Oryza sativa; identical to SEQ ID NO: 4343

SEQ ID NO: 4349 - DNA, 1501 bp, Oryza sativa
atttcatctgcttgagttatccatgtgctagaatacccaccggccggaacaattccattagcctataattcaattaatttgcatgcatggtaattatcatgtaattattccgtgtcaactgcaattgaactgacaatactcacaatagtatatgtacattgaacacttaacagttcttttagataattgaccacgtaaaaggttaataataaaaaccatacatcatagaaagaattattaaagctatatatagagggaatctacaagggttttgcctcgaagtgcacgcaatgacgatatcccgatagattcctgcatccaatgtccatttattcatgacgactgcaaaatcaatattattccattaacatttgcggacaaactttgagcataatatgggatatataactaattaaagggccaaaatagataaacgacctagagtcgttattatgtataacaacttacaaggtgtggaattttgaagtggtcagtaaatttgagttgacaaatgaaattacttcaaaaactaaagaaataatatgtgtagacagtgactttttttttctctttgccagggtacgatgatagtgatctactgtaggttgtagatattggttcttttttctggtcttatatacattgtatggttcgacaagtcaagaaagaatcagagttctcaaaaggaaaaagagaaaaatatcgtagaacgaggtttgcacttgtttttttttggtaaaaattaatggagatttattccactacatataatcttgcttacaatcattatcaaggaaaggtaaaataaagcctgcaggaacatataaacacaggttgtaaagcaacacgagaagaaatactctccttcgctacacaccttcgctaatggctagcatgtgtgctgtaccgtgttcgccgttcgacgtacccaacaaaacttcatctcttggaaattaaccaactaatttgaacttcaaatcttgattcaatgtagtatggattgacctatcaaattgtttgctaaccaccacaagggaatctgtttcaaatataattcttgtagcttcctaatcataagcaatcaattatgtgcttgcaaaagggtatgtagccaagtggttttaaagggctaagtttccaatttaaaaggctgcatatattcgattggcgatatagaggctgggtaaaaaaatacccttctctgatacaaaaagttcttatgtaagtttgctagtaggtaactgaagacatattaggcttggtattttagtttatctcaatataattacttttctctgttgttcgataattgtagagctaggaaacattattctacataaaaagtttctatataccagttgatgtttcttgatatttttataaaatttgtgtatagttgtgctgcgttaattattccactcggttacatctggcacatcaatagttacatatttttccagtgaaattatcattatgtgccagaatatgtaattctattact

SEQ ID NO: 4350 - DNA, 1501 bp, Oryza sativa
catgagcggactggtggtgttgaacacgattaaattcaccagaagaaattccaccaatgattgcatttcttgcacgataattaaaatcaacttgagccacatttgcaggcgtgatgtcagcatcatcgggcatagtgtaaggtgatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgatactaattgaaagaccaagaacggctatagagggggggtgaatatagcaattcaaatctttcccccgaaaatactcatcaagccggatttctcaaaatccttactagaaccgcggctattagagaagccggatctagaaaagaagagagaaaaagaagagagaaggaattcccgaaactagaagaggaagagaaaaggaattcccgaaaactagaagagaggttaggaggagagagcaaaactcatcatcgcaaagttcaaatttcaagcggaatttaaattgcggaatttaaatggacaaggcaaaaacgaaatccttcaaatcatttcattcataggtgatgcaaaataaccgctcaactaggagcaaacaaacaccttcagaggaacaataacacaaacttaaaatctctcggacaaacacactccaaactaatcttaatacaaaagcctctcgggcaaacacactccaaactcacacggaaactctctcaccgagcatctcaaaaggattacaaaaggagcaacctccacccttgcatccatccctctatttatagcctaagacccctaagacattgtctcaaatacccgtggggcgaaaccctagccttgataaaatcctggatgtccattgttccttagatccgaaggaaacctcctggatagtcgccacgttgttgatccgagctcttcacgtcgcgtgccctcgtgcgatccgcgtgattccactccaagccaatcagtgtacaccgatccgcgtcgtgctcctccaagccaatgcatccgcgccacgcgtcccagagagcccgcgcccgctcctctcgcacctgcgcgccacaagtcagaagccgccatgtcgccgttcctcccgccgagccgcttctgcgcgcgctcgcgaaaaccacgttcccgcgcgcgccatgtgaaaaaccgcgggggacccggtcccacgagtctccgcttccttgacgaacagaaggccgccacgcctccaggtgccgtacgatctcccgcctccgcgcgcgcatgcacacgcctgtgcatttgccgagccgagctgggccgtcgtcatgtctagggtctgctcggcctggccttcaccatcttgagtcagcaacgtgcttgggccgaccgagctcccgagctggacaggccggattggacttgatgccaaccgaccca

SEQ ID NO: 4351 - DNA, 1501 bp, Oryza sativa
acttgtgaaacctgaatttttatgaagagatcaagaagaggaggaaggaaggaaggtaagctattccctcaatttctaaacactcctatatgacaaattgacactttaccttttaaatatgatgtttaacaattcgttttatttagacatggattgcaaatatgtaatgtacgtcatgtgtaaagcacatttaataataaaataaatcgcaacaatataaataatattatattatcttaataagacagatgataaacatcacacatcatcatatatttaaaaacagatgtagtatcagggttttctctatcttttttttagagtttaccgctaccaaaagcattgcggttaggtaactgagaaaaactgagaatcaaccacgagcaataatcacgcgatattgtaacccatgctaagtgctccatgtggagtactaggtagagaagaagattggtggaaataatgatggttccatgtggaagtaggtggtggcttagcttaacttacatgatttgtgctaattgtgcggaccaaaaatgtgaattgcatatgcagcatatgcctacataatacataatacagtcatacagaggttgtactactactcttcttcttacctgtgacattcagagtagtcagctactagcttcgttcctgtgacatagtggcatggccatggtgttgctctgctcatcagatgaggagcccctccctctcctctgcatagagtagaggctcaggttctcctcctcctaatcatgcttgcatcgccattgtcgcgctggatatatcatcaccaatcacctactcgtatgtgccaacactgccaatgtactggagtactttatattgcccagtactccctccgtattttaatgtatgacaccgttgatttttttaagacaaacatttgatcattcgttttatttaaaatttttatgcaaatatgaaggtatttatatcatgcttaaagaacatttgatgataaatcgagtcacaataaaataaatgataattgtataaatttttttaaataagacgaataatcaaacgttggataaaaaatcaatggcgtcatacattaaaaatatgaagttagtagtagattttttttattatataggagaaaaatatattatgtacattaatcacgaatacagtccttttaacacatgtccaaagaggacaaatagataataaaaatcttttaaccacatacaatttctattcaaataagaaagaacacccatgtacatatgtatgcacatggagcagattggccacttcaattaaattactttattgatcctatcccaaggagaatgctactagtgtcaaccatgcaaaagactttatataaagacagagagtgagagattagggcacggaaatcacaagggtgattaagcagtaatcgtggtgttaatcctgttcccctttaaatttgagtcgttggcctgcatcacccaccctcggcctctactctacaaactcctccctc

SEQ ID NO: 4352 - DNA, 1501 bp, Oryza sativa
tcgtcgggtctcgaggtttccttgctcgggaaggcatgtttcgggtttcctttggattctatcccgagtcgaacgtggaggagggcctgtagagggcaagaccaacccctatataagggacaaggccggtttaattgtaatctatcaatcaactatcaatcaatcgaatcgttcttttacttttgcttctagttttagtttagtttgtccatctttgtcgatttgcgttgtaaatcgtccgccgccgttgcgagaatgcgacacctctttgtaggtttgttctgaaaaccttccgttttgcccacaagacgggtagttatctatcgttctatctatatctgctccgctagccggtttagtttattaaaacccatcttggtttagcttttgcttgattgaggtggttggcgactctagaatcaccgcaaagctttaggtgctgcgatcgtgcttgtcaacttgtcacaaaaagttgccaacacgatttttggcggctccgctggggaaatcagctcaacgtcgtctcaacttcgacgccgccatgacgaaaatgaccaagccagaggtggaaccatccaatatcatgccaatctcattggaggatcttgatggggaagcacacaagatcatggaggagcacatcaaggcggtcacgcaggagatgctgatgagatcgtgcaccaagacctgtggttctcaagcctagaccgttgcctaaatctacttttgattcggtaggtgctgaagaggtaccaattcctatccaaaatctcgtggcaatacaatagattcatccattgttgcttcaaataataaattagatgcatcttttgaatctcgttttgatgcgcgaattgaagattttatgaggaataaattcggttcttttttagccgattttcagactaaagcctctaccagtactagcaaagcccttgttgatcaaatatacaacaaaaccgatgggggcgaatatgcaaacaaccggtgagggataagctgtgcattcagccggtccgaccgggccagatggccggtccgaccgcgcgtttaccgccggtcagaccggccagatggccggttagaccgggttctttcccggtctgaccgcgcctctggatgctggtcagaccgggccttggaccggtcagaccggcgcaattatcccgatacaggggattgatccaatgacaaataatgggcttttataccatattccagcacatgattcccctatatctactgttagtcctcaagttcccccacatatccctaatatttataatgatcttactagaagatatcctcccaatactaggtatggccaatataattatattgtgccgcaaccacaacctcttatgccaccaaacccaccaccaaatcagcataggcctgagaatatagaggaattgattagtggtattattagggataaattcgggattgaagctaggaatcatgctaaggtttaccaaaagccgtaacctgattactatga

SEQ ID NO: 4353 - DNA, 1501 bp, Oryza sativa
ccaaagtttggattttggatctaaactttggtcttttttcatcacatcaacctgtcatacacacataacttttcagtcacatcatctttaatttcaaccaaaatctaaactttacgctgaactaaacataaccataggtaatcacagaactgtctcttaacgcggttttgcatctgcaggagaatgttttttagcagagtcaaggatgatgatcccggactgccatataatcgacttggaactccactttcagatctgaaagcaactctggtactagtgaatgtgaaatacaagctgctactagtgaaattcgaaatttgcaaccattttcttctccgtttgcaggttgaattggacgagtcaaatgaacatgatgccgagattggagaggctttcttttatgccgtagatgaagatgaagattaagttaagtgttttacgcaaaacgagatgatattaacgtatgattaattaagttgtaattattataaacttgaaaaatatatttatgatattcaactgcttttataaagaaattttttgcatgaagcatattgtttagcagtttgaaaaatgtgacataaatatccaaattttcatctaacttttgttggagaaagaacgggcctgagggtacaatcacagaagtcgaaactgtattctcaagctctcacttttctgaaataccagaaagaatctgagtttcttgacgtcttgagttgagtggctcttcttctaacaggacgcattctgtgaactcctgaattatgttttgctgttgtgaatggaatattgcttgcatgatttacagtctccatgtgcagattacagtcttactatgtcagttgtcgctgcctagtgcctactctattaagtcaattatgtctattatgtcaattatttctagtgcctagtgcctagttgtcttattatgtctgttggagttgttgtcagtacatactctggttaatctgcaattctgcatgtttgagtcagttttctattaagtgctgaaacgttggcggaattgctggtcaagcattggttaatcagagataatcatagtattaaaaaatgtttaatcagacatgattattagtcagacgacgaatagttgtgaggtgatgctgagatcttcatttctgaataccttgtggaatccggatggaatttacaagattctgaaaacgaaaaatcctgtgggagaagacaaggtcacgaatcccgatgcagcacggagccatgatccaaccgcgcggaacccctccttatctgatcccgagattcctctgcccccgccgtcctggaatcccacgtatcccttcccaccacggaaaaaaaaaatcccacccaaaaaaaccaaccaaacagagcaaaaaaataaaaagaaaaagaaaaaatcagctcgaaaaaatcactatccacaccccacaaagatccccacgaaaaactctctcacacacacactctctctctcctctctctctctctctctagactc

SEQ ID NO: 4354 - DNA, 1501 bp, Oryza sativa
agcagtaactgaatttggatatacctttttgtccacttctgtcttcaattcatgaaatttctttactaaaaatatttacttcgaggaaatttcagaaaaccctgagttttgggtcatgggtctcacaaaacacagtttttaccatggaaaacaacttttgtttgctaataaaatgcagtgaggattacacaaggctggagaaagagtatggccaactagaataactcccatgaagccttttcctaaaaatgtgttaaaatttttcaaccagattcccaatcctacggtccaataaccagatcatagatttacatgatgatcgatctggaaaagagaatagttattagcacgatgtgatcaggatttgatttgcagcctctacactgagctgatacactagcttcaatcaaatgaaaatttaattatttaaagaccacatctgattgattgtggttcatatagagtattttgaatgcaatcatcatttaagcatgctctctgaggtcccagatgctgatagtgcaaaccgcaacaacaattgtactttaatttgctgaaacctgaaactaccccctaacaaactgacttaaatggacccaattacaccggcaagcgactgcaagataccagctaagaagaaaaagctttcaccgataaacactaaaaccgccataactaagacagattagttagggctacaactaaccaattattcgagcttttattcttttccccgaggaatcaattattccagctttaaggaactttaagaaacactggagcaaaccctaaaatcgcaaccatactaagctccgtccatccagaaaaagcaaaagcgactccagagcagccgcaaaaaagaccaaagcctcacatccccaaacacaaaaaatttagctcaaacacatgaacatcggggagctagcctcaccggggtcgcactgccggtagaacttctccacatctgcacaaccacacaaaaaaaagaacagcaaatccatcaaatcaatcaatcaatcaatcagcaaagagcatcccaaacaacaccgaagagagctacccaccggtggtgagcgccttgacgatgcccgcgcggcgcgcgcggaagtcgcggaagacgtcctccgcggaccgcgcgttgtggtgcaccgccgcccccgccgcgttcccggcggcggcagccgcagcaccagcgccgcctccctcgtccatccgccgggagctccttgctagggtttcaggcgagtgggagtggggggagcgagcgagagtggtggtggtggtggcctcgtagtggagagcgagagaggattagagaggaggggcaaaatcgcagccaggtccagacgaggacctaaacgcaaataaacaaaattacagggggctagcacgaaaacgaaatcccagtttccaccctgggtggggtggggcccacctgtcggggcggttgatgggctcttctagagttttgtctcgtggcccacggagaagagtcagagac

SEQ ID NO: 4355 - DNA, 1501 bp, Oryza sativa
cgtcgggtctcgaggtttccttgctcgggaaggcatgtttcgggtttcctttggattctatcccgagtcgaacgtggaggagggcctgtagagggcaagaccaacccctatataagggacaaggccggtttaattgtaatctatcaatcaactatcaatcaatcgaatcgttcttttacttttgcttctagttttagtttagtttgtccatctttgtcgatttgcgttgtaaatcgtccgccgccgttgcgagaatgcgacacctctttgtaggtttgttctgaaaaccttccgttttgcccacaagacgggtagttatctatcgttctatctatatctgctccgctagccggtttagtttattaaaacccatcttggtttagcttttgcttgattgaggtggttggcgactctagaatcaccgcaaagctttaggtgctgcgatcgtgcttgtcaacttgtcacaaaaagttgccaacacgatttttggcggctccgctggggaaatcagctcaacgtcgtctcaacttcgacgccgccatgacgaaaatgaccaagccagaggtggaaccatccaatatcatgccaatctcattggaggatcttgatggggaagcacacaagatcatggaggagcacatcaaggcggtcacgcaggagatgctgatgagatcgtgcaccaagacctgtggttctcaagcctagaccgttgcctaaatctacttttgattcggtaggtgctgaagaggtaccaattcctatccaaaatctcgtggcaatacaatagattcatccattgttgcttcaaataataaattagatgcatcttttgaatctcgttttgatgcgcgaattgaagattttatgaggaataaattcggttcttttttagccgattttcagactaaagcctctaccagtactagcaaagcccttgttgatcaaatatacaacaaaaccgatgggggcgaatatgcaaacaaccggtgagggataagctgtgcattcagccggtccgaccgggccagatggccggtccgaccgcgcgtttaccgccggtcagaccggccagatggccggttagaccgggttctttcccggtctgaccgcgcctctggatgctggtcagaccgggccttggaccggtcagaccggcgcaattatcccgatacaggggattgatccaatgacaaataatgggcttttataccatattccagcacatgattcccctatatctactgttagtcctcaagttcccccacatatccctaatatttataatgatcttactagaagatatcctcccaatactaggtatggccaatataattatattgtgccgcaaccacaacctcttatgccaccaaacccaccaccaaatcagcataggcctgagaatatagaggaattgattagtggtattattagggataaattcgggattgaagctaggaatcatgctaaggtttaccaaaagccgtaacctgattactatgat

SEQ ID NO: 4356 - DNA, 652 bp, Oryza sativa
cagatagagtaatggtccggcctttttgttcgttcctccctgttgtttccttttttttcctttatttgtttcttttcttttttttatatggtaagggtagaatggtcatttcatttgtattgttgcatgcaagaatgacttggcatgcttatgtggtattttttgtgggtccaaggactatgttaatccaaataattaatttagaggacttgtttggacgttttgaaacctcaaggactaaacttagcccaaaacgaaacttcaaggacgcattataaaatatgaagaagagattgtaattggttgagaaaaataaaactgatagaaaaattaaatggagaatagatatatgaatggtttgagacgtgggagtaggtgaagaaataattgtattgtaaaataatatttaaataattagaaatagtttatttttagacgaaggggatcgtagatgcctatggtgttggtgccgaggacatggagacacacataaagaaaacgttcagaaaagataggagtagctactaggccgagatggatggcatagcccatcgtacaggacgccccggtagatgggacagtaagacgctttgaaagaaaacctcagctcaggcttgctctttttttaagttactcttttttttttcacaga

SEQ ID NO: 4357 - DNA, 1501 bp, Oryza sativa
cgttggcaacaaagtaagcacatccaaaatagctatcttaccaaaatttgataatattgccaaccttactaaaattttggtattgccagaaattgataaggtttaaaatgacattaaagtgaacagggccgagaaggcggtgatgaagctcgccacccgccgttttcttcttcccaagactcaccagctgtcgatgctgatctagatactagcttcgtgaggttaattaatccattcaccgtcgtgggccgaccgagtctcccataacacgaattaagtttgcggcagcacccagcattccagcatgcactgcagagaatcagtcttagaggcaaaatgaatggcaaatagaaccaggagcacggcagccgctgataccctcatctctggtcgccatgaagcgtcattgatgctcttagcctcttaccatgcatgctcgtcctcggtggccagccacttgccgagccttccgatctcctccaccctcctccagtactgctctgcggatgttctatttagttcacatcaaaattaaaagtttgattgaaattggaatgttgtgatggaaagattagaaatttgtgtgtatagtaaagtttcgatgtgatgaaaaagttgtaagtttgaaaaaaaagttaggaactaaggatacattagtcccaggactaggactaaagtttagccccaagactaaaacattagtcctttttagtcatagcctgtttggttgaagggactaaatagtactaaaatggtagcccgcaccagatcctccatggcctgaggcagctagcgtggggtagcggcgtgagcttgcgcacggcggcggaggcggcggctgcgggagctcgcgcgcgacggcgtcggtgggagctcgagcgcgacggaggcggcaggccgcgtgagctcgcggcttaggtggcaggccgcgtgagctcgcggcgtcggcggcggccgcgggagctcgcgcgcggcggcgttggcagcggcgtgagcttgcgccttgcgccggatggggagagcggagtagtcgagtagtacaggagagagaatgaagtgagagagagagagagtgaagtgagagcgagagcaacaggatagggttgggatcgcttttctataggtttttagcctatgctgttttagtctgtttaagtccctcccgtttggtagtttagaggctaaaagggacttatcataagtccctccaaccaaacaccacctgatccaggcctagttgccgctgccgcatcctcctgtcccggccaccacaggtgcgtcatccacctttccgggcgcagctagcgaaggtgcgcgtggtggggtagagggagaggtaataggttatgagagagcgaagtatttggtagtggggcggcgctggctgcttgtcataatgtcatggcctgacactaggatcttgtcgatcggtgtggttcagtttgctgtaagagcaggtacaatagcgctattagccagctataaacatattttaataaga

SEQ ID NO: 4358 - DNA, 1501 bp, Oryza sativa
cgtttcacaatgtaagtcattctagcattttccatatttatattgatgccaataaatctagacatatatatatatctatctaaatttattggcatcaatataaatgtagaaaatattataatgacttacattgtgaaacggaggaagtaacattgatatatacatgtatggttgtgggacgtactagtggtgtgacggtaaagtcgtgtgggtacatgatttcaaccacggattcaaattttattgtacatgaatgttgtgaatatgtaggtgtgctttcaataagaatttagtgaaatgtgttatggacgtatttgcggaaaagatatacatgcatgctagcaacaaaaatatcaagtctaaactagactgatgacacaccgaggaaggaaaaaaacaaatacatcatatatatgaacaatacctagctgctattcacacagaaatttgttcaaatttttcttgatgtgtaggtagattaagtgtaaacttgaattttgctgaagtctatatttcaatgttgtttttgaacttttttaactatttgtatcaagtttgacaggtgattaaaaacaagtcaaggatattcctagctctcgatggattaacccatcctctgaccagcggatgactaattgactaattgtcaccgctagtagaggtagtactatttaacttaaggctatgtttttcttcataaaatcactatctaactcctatgatactaatagtgttatgcccactggaactttgacacgtgactataaatataagcatattctgcaaattagtaagagtgcccccacatttgaaaacgtgtgttcccacgactgtaaaggagtgggccactggtagtagctggattgtagaaagtagatctatttttcttcactgttaaactattttaaaaattatatttgattgatgaagttcgtcgtcgatgcttaccctcggattaacccaatgcaatccctgattgctaccgtgctaccttgtcttggtttttggcaacctttgccgcccggccaaccgctagctagctagtagaaccgtgcactgcatatgcattcaaatgaaaggaactttgtcgaggttatatgcatgcatgccggtagtacaattcgaatgaaaaacttttgtcttgcaaaagctatatacggtgacagagaaaagatgtatgaaatgtgtacgcaatagataaccaacaagaaattatttagagtggcagatcgaatggatgctagctagcttgcatgcatgcattggatgaggattagttggtggataatcctcatcgatcgatcaatataccaaagcaatgatttattgattaatgattctaggttctctagcattctcattttcattttttttaaaaaaaaggttctctagcattctaaccaaaccctaccacttgcaacttgcaagagctttatcatggtgaaattggtgatccattcttaagagcacacaataagatatttttatgcagatggcatgg

SEQ ID NO: 4359 - DNA, 1501 bp, Oryza sativa
aattccctcctcatatgtgcaccacacattataatcaacatccaacttggtatgatcatccaatcttggttcgcaaacaccagaagagattgtgcatacatgagcgttttataagtttgtacactaaattacatccaactaacaaattcatatgccatcaatgcaatttgctaacaatgagtttaatagcaaaatgctatactttctatgggtaaattgacactcattttgatgtttgtccattgacaatacaggaaactattctaaactctcgagagaatatcctctcattgtttgcatgtcatccaaatgattataattttctttttaaaaaataagcaagataaattaatatgtgataaatcactccacaagcatgcaaggttaaatttaacttcaacatgttgcaatgagaaaaaaaacaaatttgactatgaatatatgttaactagcttttttttttgcagattgtggaagttaaaatttaacttacatgtttatgcagtgatatatcatatattaatcaattttcttaatttttcataactatttgtatgacatgcaaacaataatgggatatcctttggagagtttaaaatccactccattgacgatatattgtaatactagcataatgctcatgctttgctccatgtaaaggaatatatattatgacagtattatagataaaacatattttttatcgaaaatatatcagtatcacttgtttgcttattatttacatatatggtattcacttatttaaaacgagaaccctagccctagcaaaaccgggccgggctgggccgggcttcactgctttacaagagccagcttagtgaacctaataattctgctcctgtcctccttatcctgatcagtcctcggtcggcttttcctctctctctctctctctctcataaaacagagacctttaatgcgtcgtgatctctcccctccaatcccgacaaagtacacacaccatcgtctccccctcctgcctcgatgctagctctcccattcccatctctccactctccctcctatcatatgctcctcccttctccactcttcttctcaaatcctctctcttcctcttcgtcctcctcctcttgcaaccaaaaaacaccataaaatagtaatcccaatccacaagctcacctctctcttgcacacacacacacctgacacaacacttacacatcataccagaagaaaaaccaattcgattttgccaaattacctagctatagcatataggtaggtagctaggtagcttggttttccctaatagctctagcttgatctctttctagctctaccggcggcgtggcggcggcggcggcggccgcaccactctacatcatcacgtacacctgaccagcttagcgggaagccccacaagaagagtttgtaggtcaccaatcagatcatcagttcatctttgtggttgtgtgggtgtgtgtgtatatatataccatggcgtgagagtagccatgga

SEQ ID NO: 4360 - DNA, 1501 bp, Oryza sativa
agtacaaatttaaggcttgtagtaatatatagtaaagtaacaaagcaaaacacagtcgttccccaattcaggcagaaaaaatggtgggattgaatacgagtattatctcccaaatatgaaggggttaggtcaggggactacgactggtgaatgaattaacttattattgattaattaatctccaatctctagagagaagaatcctaaaccaaaagatgtttccccggccaaaagaggcacctaccacctgctacgtcgtcttcctccacggaagcggaagcggcggaggcgcacttgcagttggtcaagagggcgatgtgtttggcatgagcatgacgccggcggcgaggctggggcaagaggcgaagaagcggcgggcggggagaaggagaaggctcggtggtgatggagttggcatgggtgattcccatgtgctgctgaagcagaggtagcatgtactccactactgaagaagaagaagaggggaaggaggctgctatgcctgtgcgctttgctgtggatgaactgagtgactggcacttgacacaagaccagcgataacccttcggatatttctcctcgaaaagggtcttttatatatcaaagtttatatttagaccgagttctttttctcaggttatatacagatttccaacgcatacgaaacatgaaaactcattagtacatataattaattaaatattaataattataaacttaaaaatagatttattttaatttttgaaacaacatggatatggaaagttttagaaaaaaaatcatttaatagtttgaaaaacgtgctaatgaaataatagtgattggtttcacaattaataatattggaatcgaactacacttaatacggtagagaaaaataatacaaatatgatgcgcacttacatgaggctatagatttttaatcattctaaacgtgtgtgtgagtgtatgtaggggtggaaatggtgtttatgtgtgtgagtatgttattccttcattctataaaaaaataaatctaataaggatgtatcacatctcgcagtaggtatgtttttataggacggaggtaagtacgtgataaaaagacccatatagtttattcatggttaaagcactaaactacttaattagccatgtataacatgttagatgtgttatacattagctgaatcttcctctagtcaattcagctaatgttgttgtagaataaaaaaatgccaaagatagtttttcgctttcagtttaataaaaatttgttatagaatagtaatgaaaaatgggtaaaagagagggggttttagaagggtttcgttcggtgcttccattcctttcttcctccccaaaccaacgaaatcgagcttccctttcacagggcgcgcgccgcgccgccacatcccccgcccccgccccctcccctcgcccaaaccctagctagaatcgctcgaccccctcatgctgcgcgccgcggcggccgccgccgccgtcttcccctcgcggttcg

SEQ ID NO: 4361 - DNA, 1501 bp, Oryza sativa
tatgctcttaagcaacatgataatcgtcactatgtcatcgcacactaggattttagttcttaggatagaatgaatggcatctctctttggcggtcttaggggtccaaacaagtcacctctcttattatgtttgacattgatcttcaggaatacccttcaaattctacaaacatcaattacatttttctcttttaacaacatcaatatgagcaagacattatgatgttaaggtgttgtaattcagataggtaaaaaaaatattattgatcggatttgcataacataggcatgaggttttagctagtgaggaggtagactttggcgggaaatttattggcggatactccattaaaaaccacttattactatttatgcaggttcttagtgagtgttcctaatagtgatatccattaatcggaataaatgtcacgaagctatacctattttatcaagattagcatttggcaaaaattgtagcttgacatattaaagaaaaactatattgcttgaaaaacactttacctttaatattcaccgtgcaattttagaatggaacagaggaagtacatatgtagatataagagtcttaggccctgtttctttcagcttgggattattataatctagattattgagttagattactataagctagattgttataatctgtagtagaataagcggttagttgtttctttccagattattagagcctagattattgagtttgcaagtctaaaaagggagtggggtggcatggtgagtaatttttcactcaataatctagaaaaagctcacctaaatgagtttatcagattataataagctgggctctagattataataagctacttcaataagttatccgtttctttcaacttactcctaataatctggattataataatcccaagctgaaaaaacatggccttagatgagtcatcctacttgtggcatatatatacccattactagcaaggcaaacgaaaagttcaaggaaattgacagttgaagaaaaaaagttttctaaaatgtgctaaatttactaatttggaaataaaggcccataaagcatttccccttccacacctccacccctctctccgtctcgctttatcttcgattctccgtttgcgctatcgtaacccttgtttgcgaagagaaacgccgttcccggcggaggcacggccggaaaacttccgccgcctcgcctcgctccggcgcacgtcgccggcgacgaggggccgggggcaaaccggtggtcggtcggcctgctcctctcctccccgcccgtgcgccttctcccctgctgcccgcgagcaggtgcgaatcgaatcgaatcgaaggtatttttcatctctatctctctcgtagccctccctcgtcggagatccaatccggagttgggatcgattcgatttgttcttccttcccgatttggttcgtttgatgcgcgcgtggtgtagcttttgatgataggttttcgttcgtttgtttgccc

SEQ ID NO: 4362 - DNA, 1501 bp, Oryza sativa
  unsure (1)..(1501): unsure at all n locations
atcggctagtctcagcctatccctgcaccctaggggcatcgcaactggccaaaacctctgcaagggtggcacatttgcgatctctacacgtggatctatcctatcagtcagcctcgccaacctacattgcaagttacatcgctgggggaccgagtacacatgtcgtattctggtccaccctctcgtattagataagtgtatcgatgtcttggtcaaagaaggatgttttctatgtatatactccctccgtcctaaaatatagcaacttttggttggatgcgacatattctaatactacgaatatggataagaggcctgtccaaattcatattactatgatatgtcatatccatccaaaagttgctatattttgggatagagggagtaccgaatacgttacaattgtattagagtaagcaaaactaattaacggtcagatcgtaacaacatttatgtataggttggctatgttttcggccttcgatcacccttagatcaattgttcagctagccattgtcaaagaattgttaatgtttatttatgtttcaatagaacaaaatggagcaaaattcagtggagtagagcaggggaaccgcgttgactatccactgtcgagtgtcgtcgacacggtacgtagtttagaactaatcttatgatcgaatttgatctattctaaaattgcgattagaatgtctgtcttgactcccgatatctatccagcctggccggatcttgctcccatgcatactcccacctaaaccaactactcccaatcttaatacctcactgacaagtggacccaatgtaacgagccccacatgtcattgacacgaatcaccttctcatgaatccaacggtgcccccaccagtcagtcagttaatcaaatgattaataatgtccccaccttaattaaacccacgacttaatccaccaataataacatcctataaacaaataacctagtaaatctaacctcaccgacaagcccacccactgtttacgccgggatacccgaccccgcgcccactgacaccgcgggcccacccgtctccttcatcagtctcagatccgcgacgcgcttcccactccagtccccctcccctccactgctccgatggccggcggccgcgcgttccggccgtcggcgccgcgccgcgcggcgttcgcggcgctcctgacgctgctcctgctggcgacgctctcgttcctcctatcctcgccgcctccgacgcacgcctcgcaccgctcctcctacctcggcgcatcgccgccgtcccgcctcgccgccatccgacgccacgcggcggaccacgcggcggtgctggccgcgtacgccgcgcacgcgcggaggctcaaggaggcgtngggcggnganncgctgtccttcgccacgatgtcgtccgacctgtcggcgctctcgtcgcgcctcgcctcccacctgtccctcccggaggacgcggtgaagcccctggagaaggaggcgcgcgaccgcatcaagc

SEQ ID NO: 4363 - DNA, 1501 bp, Oryza sativa
cctcacgaggaggcgatgaagatttggggattttgggacgatgggtgcgctgattggttaggagcgatgacggaggggatcggggtgatgcggctatgaggcgtagacggatggatcgatgaacccgtggacatcgtcccggacggtgcatcaagggtgaggtcctgtagtactgtagcaggctttctgggctgagaatcgtcgattcactgttggtagtgggtcacaaaaactaaagatttaatatgatatgatatgattcaagtcaatggttttttttttaagaagggcaagagctttgaggatctgaaaagctttcaagtcaatggtcttttggtgagcatactttttagtttctacacatttcagttgcaaattgtcctattgatttgagtgcacataagccttccatttcataaagaaaacatctgcaaatgactcggatgatatgcaaacccatataataattcaagccatcatgctgggacttggatgtcagcgacaaccactgtatagacagtactgcaagacagtccctatccatgtgtgttggtacttgtaatgaggatactattcagtttctacgcactttgtttacaaattctatgattgatttggatgcgcatgtgtttatgtatgcgttttccatataatataatcggaaaaaaaagttctacgattgactcgagccaatttgattcgagccaatttcctagtgggcaggatactgcttagtttcacggtttgattaattgcaaattctataaatggcgcttgttcgtgttcttgttccatgtaatcggaaaaaagaatatgatttgcacatatacattgtaatggatcaagctcatacaattgaagattgactgggtgggtgaattaagaataaaacactgcacgggtcagatatatatttcgggattggctcggtttgtggttacctaagaaaagtaccggatgacacttacggtgggaaaggggtgcaagaggatgactccgttttcaaaatagtagacaaatgatagaaaaggttgtgtgtgtgtgttttgggctagtttaccacacagaaatcagaaatgttaactttcggccttgctgcatggctgatggctagttgatacccagactgcccaggccgtcatcttatctgaagcaattggcccatatcaccacatgcatcggccgaaagggcccgacgtccaacaggaactcactatttttggcccaatattaaacacgagagtggcgactggctgctttgggccggctctatgggaaacaaaggccgtcttctaagcccaccacttatttaaaatttatttgcatctgattcatgatcaatttagggtgtataggtatgcaacattctgcaatttatttggttaaaaaactttcaaatgcaattatattataataaaatgtgatcagcagcatatttctctcaactaccccattgatatcttatttgtttcttgcatggctgcatgtatttttttttaga

SEQ ID NO: 4364 - DNA, 1501 bp, Oryza sativa
cgggtgcatggctctactattcaaaccgtaatgttcatcggaatataaagggcttgtttggggtagcttctcgctgcaacagtttcttccagaatcagaagctctccaaataattcagcttttgatcaaaatttactagattctcagaagctggctaccaactagctgcttctcagaatcttaaacttccccaaacaggccaaagaaagatacgtacgtaagaatgtgttcacaaatagagatgtatggatccttagttggcatagaggtcaaaagttgtgctttctctataaatatatgcattattgtgatctctttctctatgtgtgtgtattatatgtgctagttgaagggtaggatggaagtgcgtgttggtacaaggaaaatgggttgtcatatcaacttaggctaatgccagtggcgaatctacaactaaagttattgggtgtctaagcatattaatacatttttatacaatgaaagaatttcactaaaatgaaattataacctacctctgtattatctaccatgaatgtacacaaactagaaaggaaaaggggaaaaaaaactaagataaacacaaacatatcatattgtcttacatcaattcactcataaaactaagacaaaacataaaaaatactaactagacgtttactatagaacaacactttaaagaatgacccaacacttgtctgctactatcctctaacagtggactagctttccatccaaagtacgagatgtcaccttcaacaaaggagccgactagaaaagcattgacattatcaaatatgctagatgaactatatcagtgttttcaccctagagccatcgtctagtactccatgctaccgtccagctacttaaagctagcaagtcagaaaaaacaaatgtccatatatatcgattgttgcccgccaaaactatctcgaaaaaggtttacatggacacgatcgatcttagccgctgaaacaacttcggctgtcactaaccaatcttcctgattaaaagggaagtcatcatcccttatctaatcaccaataacaaacacaaatcagtaacaatgtgcaaagaccatggataaaacaccagtcttctctatttgtctccatttgggcaaataggataaccttgtcatataggacaaggtcctattttttttgatttaggaaaggcaaactcctagttttggagaatcaaagaaagtcattcattgatttatgaggagcattctccatcattgaccaggctaaccaacctcgtttggattatggtgaagcgcctccgcaccacaacaccagtctacaaaattgtgcattcctcccactagtttaatttgtccctcttccaatagctgccttggtcaataggtgtgacatcccagcctagggcttaataggattaatagaatactcatatcaacatgcaacttttttttccggaagccgatctctaaagaactccagggttaagcgtgcttggcctggaacaatttagg

SEQ ID NO: 4365 - DNA, 1501 bp, Oryza sativa
atataaaatacaatatgaatatgacacattagtagttttgtaaagttattgcaaaatttaaaattatgtttaaatataaagttttaatatatttgaataatataatgagaaaacatatatgctattatatgagagaaaatataacaatgctagccgcgcaatctgcgcgggccaccatgctagttatgtagtaactcgatcaaactaacccatgcgtgacattcatattgaactatatatatatatatatatatatatataaaatatttattatgtattttttaattttaaattttagttacttttaaattgaaattctatatggactctagacttctctttcaatattccttatttttttaatttctattttccattatttataatttttattcctatgtggactctagactcctcttccaataatcctttttcttaattccgaattttgttatttgtgaattgtatttatatatgaactctaaatcttcttttaatattccttattttttaaaaaaattctaattttcataatttgtaaattgtattactatatgaactctatatattttctcaatattccttttttttattcagaattttagttatgtacaaattgtattgctatatggactctagactttttttttcctaatatttctttttttaaaaaaatgaattactgttatttatcaaatgtattcctatatggactctaaactcttcccccaatcttccttttttttcaatttcgaattttagttatttttaaattatatttttatatggactctaaattcatttttcaatattccttattttttattctaattttcagtttttttctaaattatattctatatggactatagactcctctttcaacattccttttttttaatttggaattgtagttatttctaaattgtatttatatgtggactctcacctgtactttaaattttcttattttttaattataaattttaattagctctaaattgtataccttatggactgtagtctctttttataatattccttattttaaaattctgaatttcagtaatttttaaattgtacttctatatgaactctatcttttctttttttctccgattaatatgagaatttctagaccaatgagagcgaacgtggtgactcctttttctattactatactaataagttaatagatagaaggggtgagttttcaaacccaggtcgactagcccaccaccttgtatagctagccgaaagacccctagtcttttctctctattttgacttccatggcacctaagtttcttgtcgttaatgtacaaatgagaaaagttgcatgtactttatacagatgattcgttgtagagatgactagttctgtagtagtatctgcccctcaactcattgacttggttaaaacatttttgtttggaaaaagtatgaattaccactcttaactatcgcggttgaccgaattaccctcctcaacccgaaaagc

SEQ ID NO: 4366 - DNA, 1501 bp, Oryza sativa
tcgccactggcattagcctaagttgatatgacaacccattttccttgtaccaacacgcacttccatcctacccttcaactagcacatataatacacacacatagagaaagagatcacaataatgcatatatttatagagaaagcacaacttttgacctctatgccaactaaggatccatacatctctatttgtgaacacattcttacgtacgtatctttctttggcctgtttggggaagtttaagattctgagaagcagctagttggtagccagcttctgagaatctagtaaattttgatcaaaagctgaattatttggagagcttctgattctggaagaaactgttgcagcgagaagctaccccaaacaagccctttatattccgatgaacattacggtttgaatagtagagccatgcacccgtacacccactactccactctcacactatattgcttccctgataatgcagatagatgatagaggaatatgctaatgcccatgcaattaatcactacatatatccatatagtatctaaaatatttgtgcacgttgttgtttgattgagtctcacatcgggtatccccggccgtcccatgcgctgccggccggcaggaggggggtccgcggccatgagcccataactaacgcatatatatgcaactgccaatatatccaccgtccgtcgtcgtcgtggtcgtcgccctcagatttgaggtcacggtggcgcgcggggcgccatttgcatatggtcgatcgcgtcgtcgccgccaatggtggtcgaccgaccggcggtcggatcgacagaccaaataccaacagtcgccatgacagggagatggtgcatgcatatcggattaggattaatcgatctagctagatgacacttctacaaaacgattttccaaacggagaaaactcatttttccaaaccgttgggcctctcgtctgtccgaaaagatctgcaaaaacagtgattattttttcatgcaggtgacgcacccgtatgtaaaaatcggaagtttatgtacggaactcgattcagacacaatcagctatgatccgtttacaatataaaaggagtcttatccagaaagaaattcttttttagtagtgcgataaaatgcaatgctgcacagtggccattgttgtgtagaacagtagtgcctagtcttttgggacgcatgcagtgccgtccattattagctagtcgggcgtgtggtactacgagtttggaataattaacagtagtgtgtgtgccactaattaatccctgttctgattctgacgatcgatcgatatatatcgatccttagctggtgcatgcatgtacgactgactggtcatgatcgatcggggtttaattttctcttcccagcaaaccatcattattccctcggagaaaattggtctatagactttagattccccacgtttttttattttttttctttcttgttatattttgaaaagtagtcatgttgacattgactatattc

SEQ ID NO: 4367 - DNA, 1501 bp, Oryza sativa
ccctccgtttacaaatgtaagtcattctagcattttccatatttatattgatgctaataaatctagacatatatatatatctatctaaatttattggcatcaatataaatgtagaaaaaattataatgacttacattgtgtgacggcggaggaaacacaccatatttccttatggtgggggcgacccctggtgtggcacggaaagcccgtggggggcattaatttacccccggttcaaactctattgtacatgacagaagtggagaaaaatgggggcgcccctccccaaaaaattaaaaaaagggttggcgccctttcggaaaagatatacatgcatgctagcaacaaaaatatcaagtctaaactagactgatgacacaccgaggaaggaaaaaaacaaatacatcatatatatgaacaatacctagctgctattcacacagaaatttgttcaaatttttcttgatgtgtaggtagattaagtgtaaacttgaattttgctgaagtctatatttcaatgttgtttttgaacttttttaactatttgtatcaagtttgacaggtgattaaaaacaagtcaaggatattcctagctctcgatggattaacccatcctctgaccagcggatgactaattgactaattgtcaccgctagtagaggtagtactatttaacttaaggctatgtttttcttcataaaatcactatctaactcctatgatactaatagtgttatgcccactggaactttgacacgtgactataaatataagcatattctgcaaattagtaagagtgcccccacatttgaaaacgtgtgttcccacgactgtaaaggagtgggccactggtagtagctggattgtagaaagtagatctatttttcttcactgttaaactattttaaaaattatatttgattgatgaagttcgtcgtcgatgcttaccctcggattaacccaatgcaatccctgattgctaccgtgctaccttgtcttggtttttggcaacctttgccgcccggccaaccgctagctagctagtagaaccgtgcactgcatatgcattcaaatgaaaggaactttgtcgaggttatatgcatgcatgccggtagtacaattcgaatgaaaaacttttgtcttgcaaaagctatatacggtgacagagaaaagatgtatgaaatgtgtacgcaatagataaccaacaagaaattatttagagtggcagatcgaatggatgctagctagcttgcatgcatgcattggatgaggattagttggtggataatcctcatcgatcgatcaatataccaaagcaatgatttattgattaatgattctaggttctctagcattctcattttcattttttttaaaaaaaaggttctctagcattctaaccaaaccctaccacttgcaacttgcaagagctttatcatggtgaaattggtgatccattcttaagagcacacaataagatatttttatgcagatggcatgg

SEQ ID NO: 4368 - DNA, 1501 bp, Oryza sativa; identical to SEQ ID NO: 4359

SEQ ID NO: 4369 - DNA, 1501 bp, Oryza sativa
atttgcagaatatgcttatatttatagtcacgtgtcaaagttccagtgggcataacactattagtatcataggagttagatagtgattttatgaagaaaaacatagccttaagttaaatagtactacctctactagcggtgacaattagtcaattagtcatccgctggtcagaggatgggttaatccatcgagagctaggaatatccttgacttgtttttaatcacctgtcaaacttgatacaaatagttaaaaaagttcaaaaacaacattgaaatatagacttcagcaaaattcaagtttacacttaatctacctacacatcaagaaaaatttgaacaaatttctgtgtgaatagcagctaggtattgttcatatatatgatgtatttgtttttttccttcctcggtgtgtcatcagtctagtttagacttgatatttttgttgctagcatgcatgtatatcttttccgaaagggcgccaaccctttttttaattttttggggaggggcgcccccatttttctccacttctgtcatgtacaatagagtttgaaccgggggtaaattaatgccccccacgggctttccgtgccacaccaggggtcgcccccaccataaggaaatatggtgtgtttcctccgccgtcacacaatgtaagtcattataattttttctacatttatattgatgccaataaatttagatagatatatatatatgtctagatttattagcatcaatataaatatggaaaatgctagaatgacttacatttgtaaacggaggggagtaccaaatatttcaaaaacatgtggaaattgtccgcgcgtcgtatctttggagtggaggaacgtacgtaggtgggtggggattttgtaatatggagagctagcttaggttatatatccagtacccccgatcgaggcaccaaccaccaacaccaagccatccatccgactatccgtgagcacaccgaggcccccaacgccgactgatccccaccccccaccgcgaggcggcgcgcgtacgtctcaccgatcgagcgaaacgaaacgaaacgctgcctgccacggtgcatgcgcgcccggcggcccgtgcgcccgcgggatggatgggtagatgcgggcggccccgcgcgtacgtacgggacgggaggaagagatcgtacatcgcgcgagcgagcgcgaccggcccacgcgcgcctactggcgctggctggctgcaaaccgatctcgcgatcgatagcgcgcggggagatggagcgggaagcgcgtggtccacgcctttctccgccagcgcgcaagcgcaaacggagcccctgtgcccgcccgcctgcaggtgcaggggggcactgtcgcgccggtctcccccgcggctagctagcttcatcaatacaatcgcccgcctgcgcggacgtacactgcaggtggagggccggagcatgtaccccgcatcgcatcgcgcatgcatgctatgctatgctccaccaaagggtacgtt

SEQ ID NO: 4370 - DNA, 1501 bp, Oryza sativa
ccaccgtcttctggacaaaaaagcagaagtaccaacaggtaaggtgaaaatgcccaaaatcatcttctattttgcaatctggctactcttttgcatgtattcttctgccatatgggctggaaggggtgaatatgaaactttcagattaattaatgtgttgcagtttgccgaataaacaaatcaacagttctttatattatattggtattagaatgtggttaagaaacttgttttctactggattcatgttttttctctaacgatttgtttactacacgcttgcagacaattatctgaaccacaaggggatatcacaccaactcactctctcggcttgtttctggtatttatcatacccaacctgttctccaaacataatatttgtaccgcaactcacatattagaattactgtaccattgtttcaatagatgggaacacttcaatcaaaagttgtgttgtctcactttcgttataaaataaaataaaatccagtgctcttcaaccatgttggcaacatagccgagtgtgaattgttggggatgattattcttttttgattgtttggtgagatttgataattctaattattctatacaattctctattcttgtgaattactgatatttttttgagtcttttagaaggataccctagagttgatgccgataaattgaggtttatttgttggtaaaggatatttgtaggctatttgattcgttctataaattgcagagcacctatgcaaaatacaagtgttgtagggctaacccttacaattttggatcattttggttgctatacatgtcatcctgaagcaacacttctttccaaatactacacatcaccatagcagcttaccatggtgatctaatcatggcagttaggagggcagtaaatggtgatgtatgttgactagatactttggaaattaaatgaaggcattgagctggcaatttgggcaaagtagatgggaaatgttgagcactattagtatgcacatataattagaacttacaacatgcactttagtttacaactctctaatgttttctgccaagaagttccatatcaaaatgcctgctaaaatatttctgggtgtttgctttcagaaatattgctatatataatagaaatgtaaaatcaatcagggttgtcaaatcaaggcataaggcgtaatgttaagatttagtaaggactgctagccctgttaaccagttcagcatgcatgcctgaattcatttttctttcttactgccacctaattgtaatatttgattgatgtgaaacagggttgtggtccgacgtgagaatctgaacagctattcatatcctagatatcatcttcctaagattttctttttcagtaatagatttgagattcatgcagttaaaattactgcagagtatatcaactttacagtgacatgctatgagcctatgagttatgatcttgttcttttcttttcaagttctccaaaaattggaactacaccaagcagt

SEQ ID NO: 4371 - DNA, 1501 bp, Oryza sativa
taatccatcgctctgttttctgtgcgagaggtgagggaacacagccttagtagtacctttcactgtaagagcaagtataataaaaggccgttagaaggttgaatgctaacgtggatgagagaggagagagagagggaaagcgagtggtatgcttaaaactagcttaggcataggaaccaagaaaatatgtgagagaaacatgggaaccatatagtttatagttaagagctaactactacatgagttggctgagaggtagactgtgaagatcttataccacatttgacgtgatttgggctcgtcgtctactccctccgtcccaaaataactcaatataggataggatgttacatattctaagacaacgaatctagattgagttattttgtgattctctccatcccaaagaaaccaacctaagaggggatttgacccctcccagtacaacgaatctggacactacatctcctcttaggttgggtttttttttacggaggaagtatttcttacggatagtaactttaggggcctatttatgaaaaaaaataaaaaggggcttaaatgtaaaattttcagtcgaaaaacacgaggtcctcatccgaaattcctaattggcgactggtcgcgtgccccctcaccccgcgcggatggacgcgtggcgcgcgtaggagggggagggggcgcggcggccgcgcacagtgggaggcccgcgttctttttttttcgccggtttttatggttgttttcttcggttctttgtttttttaaaaaaaaaacatcacatatataaagtttgtatatacagtatacaaagtttatatacatacgtatataaagtttatatatatgcgtatagtgtatatataaaatttatatacgtgatggttttcctctatttttttttattttttaaaatgaacatatataaagtttgtatatatatcataaactttgttatacgttatatataaacttttgtatatgcgtatatatttacatataaaatatattttttaaatagtactagtagtatataataacagtagtagtggtgtagtggtcctagttaccagtactagtagtactagtactagttctagttagctgtgtttattctagagtaaagtttagattttggttgaaattgaagatgatgtgactgaaaagttatgtgtgtatgatagattgatgtgatagaaaaggactgaagtttagatccaaactttggatctaaacacagccttagtagtagtagttagtagtactccagttactactacttcctccgttttacaatgtaagtcattctagtatttttcatattcatattgatgttaacgtgtaataaatgctagaataatttatattatgaaacggagggagtagtagtttaaagtagtacagtggtagtagtactagtagtactttaagtatatactgtactccgtatagcagtaccagtcgcccattagccacccccggtcctcatccacctaggctt

SEQ ID NO: 4372 - DNA, 1049 bp, Oryza sativa
gagtttacctatggtcaaaccacctccaaattggaccacaccgtcccccaccacagaggatccacgtcaccccctgaaacaacagtcagactgacaccacctggcccatctcgatccacgtgtccccccgcctctctctccgcgccctccatggaccgggtgtacgaggactacccactgacacgtgggccccacttccgcatcttctccggaatcctcatgcaccgagtctacggacgagtccggaaatcccccgctaattacattcctaattacattcccttcacgcgctctgcgccaccgcagtagtaaacaaattgtgttttttctttttttttttcaaaaagtaatctcaaccttttggccaaaggaatgtgatttagattatgttaattaacggattagggtgttaattaattactcgaggcgctcctcttcttcctcttcttcccccatatcgccattggccctcgcctcctcctcctcctcctgcgaagccagtgcacggcccacttccgccgcgcccgcgcccgcgcgctgcgtcggggtaggcctagggtgggaggcggcgcaatgcggaggccttcgtcggcgtcggcgtcggcggcggcgggggcgtcgtgccgccggcgcgcgatcgaggtgctcgccgcggtgctcgtcctgtacgcggtgctcgtgttcgtcctcgagtcgccgctcgtgtcgacgtctctgtcgggtggtgggggaggtggagggggaggtggtggtggcgcgaggtatctgcggctggcgggggcggggtgcgggcggccccggcgcgcccggcgaaggagccccgcctggcggcgtccgcgtcggtctcggggccctccgcacgagggcggcgcctctcggggatggtctctggtctcgacctcggcctcctcaactcgtcccgcgccggcccgctccgccgcccgattgccggcgccgtcgagacgggcgcccgcgtgttcgcggaactcgaggacctcgacaccgccgccttcgagtcgccgtccgccgagggggaggcggaggcggcc

SEQ ID NO: 4373 - DNA, 1501 bp, Oryza sativa
tccacactgaagtgaaccacctataaatttactttacatttttaaaatacaaatgaaattcaatcataaataagaaacggaggatttgtacagtacaaagaattcaaggttttataaattaagcagcactaatttgcgggtcaactacaagttcttgaaatgacaaaaagaacaacatcacatatactcccgaaatcgttttggtgatgtgtgactaacccaaggaacaacggaacagtccagcaaatacagtgtctcaactaaactaacaatatgcttgaattacccaaggtctgatggagtgatggtgccatcaatatatgacagctttgaatatgcaaaggctcaagcaccaacaaaataaattcatacttcaactgtcatgctacagcttcagaaagttagcaacatcctagactaaggctaggatgccaatgaacccaaatgaactgacatgcccgcatatctgattcccactctacaaggcactgaccagtattgagcatttcaaaatcatttatcagtattggacactggcatggacttggcatttggaagattttgatctgtgttaactaggtttggcgctgctcaagcactgaagctaaactgctccccacgctgctactgccatagctacagtagcagcagcgcatgtgcatccacatggacaagcagatcacggcgaacagggccatcaaaaaccacgattccacagcttccccccttgctttgcaacccccaaccccgaaacccaccaaccccaacacagatcgcgcccaatgcggttcccccacggccttaccgagtcctgcccgccgccgccgccgccgccggaggcggcggaggtggagacgaccttggacaagtcgtcgtcctcgggccccgcgtcgctccgcggcctcctgcgcccgcttcctcctccgccgcggcttccgctcccctggtcggtgacgacggacgacgcctcgaagtggtggcggtggtgatgcggccgccagagctccgccgcgagcgagggggccgggtccattcgccgcctgggcggcgcgggaggagaggggaggggcctagggtttcgcgagctcgcctgcggcggcggcggcggcggcgatgtggcggcgaggcggaggtggtcggtcagtgaagtgcacgggggagaagaagagctgtgatgagagagaagaggaaaaataataatttaaaaatagtggggccttttggatttggaaagagattggtggaggttattgggggttgggcccagcactttgatgggctggacctgtgggccggtttaaattttagggtaaagtcattttttggtactatgaactttgctcgaaatctatttatcaccaccttattatatgctgtaagatcgattgcttttcaccttttaacataggatactgttgattttttattacatgtttgaccattcgtcttaattttttgaataagatgaatggtcaaatatgtgtttaaaagtcaatggtgt

SEQ ID NO: 4374 - DNA, 1501 bp, Oryza sativa
catctcacatatgaatttcaatacattccccaagttactatatgatcgacgacgacatgtaactccttttttttaacacttaaatttcttctaattactaggcgtattgacattgaactatgtattctctccggtccgttccaaaatataagcatttccgtctatgtattttggaatggttaggaatatttcatatgagaaaaagaatatttgtgaatttgtggctgacctcgggagcggcatattctcggcttccgcatgacgcgctgagcaccttgttgtgcctgaagaacttgctgaaaccgaagtcgacgatcttgacgttcatctctgaatccatcaggatgttctccagtttcaggtcacggtggacgaccatgttgtggtggcagtattcggcgcctgatataatctgcctccatcgaattgaccaattaaaaaaaatgcattcgttgttgcatcatcaaattaacaacatttcattaaaatgtttatgtcgtctgactttctttctcctctttctcagagtaaaatttttcaaagtttggaacatggaaatcggcgttcatcaaaccataaaaaaatctcgtagactaacacaaatcattgtcgaaatttcagttcaaaatggggagcaataaatcggtgcaaaaatgcagagttcttcttcttttttgttaactctgaacttgtgaagagctgaagaaagcagggttttcaacctgctggaagatcctgcgagcgtcatcctcgcggaggcggccgagctgggtgacgtaatcgtagagctgcccctgcgtcgcgagctccatcacgatgtacacgtggccgccgccgtcgccgccggcgatcgcctcgtggaaccgcacgatgtgcgggtggttcagcagcctcatcaccgcgatctccctctccactgccgccgccgccgccgatcgaaaattcaggagagaaagaaaatcaagaattcaagatgagagacggatcgctcgagctcgacgatcggagaggaagaagaagaagaagacgaaggcggtggctgcttgcctttgcggatggggatgccgctggcgagaagtccggcgaggttgaggatcttgacggcgacgctgaggccggtgcggcggtggcgagcctcccacacctgcgcgaagctaccgcgcccccgcacccgcaccagctcgtaccgctcgagcagctcccggtgctgctgcgtcgccgccgccgccgccgccgccgccgccgacgccgcgccgccgccgccctgcatcctcgatcgcctcactgagcgtgtgtgtgtgtcaagtagtagtagtaattagtatgtgaaactatgggtagcttaagctactagtactaggattatggatgtattagtaaagctaattaggtagtgattattgcgagattaagaacgagattatatgcaaagtagtactccctccgtctcataaaaaataaatctacaactagatgtaacatattctagtacgatgaatct

SEQ ID NO: 4375 - DNA, 1501 bp, Oryza sativa
tccagcccatcaaagtgctgggcccaacccccaataacctccaccaatctctttccaaatccaaaaggccccactatttttaaattattatttttcctcttctctctcatcacagctcttcttctcccccgtgcacttcactgaccgaccacctccgcctcgccgccacatcgccgccgccgccgccgccgcaggcgagctcgcgaaaccctaggcccctcccctctcctcccgcgccgcccaggcggcgaatggacccggccccctcgctcgcggcggagctctggcggccgcatcaccaccgccaccacttcgaggcgtcgtccgtcgtcaccgaccaggggagcggaagccgcggcggaggaggaagcgggcgcaggaggccgcggagcgacgcggggcccgaggacgacgacttgtccaaggtcgtctccacctccgccgcctccggcggcggcggcggcggcgggcaggactcggtaaggccgtgggggaaccgcattgggcgcgatctgtgttggggttggtgggtttcggggttgggggttgcaaagcaaggggggaagctgtggaatcgtggtttttgatggccctgttcgccgtgatctgcttgtccatgtggatgcacatgcgctgctgctactgtagctatggcagtagcagcgtggggagcagtttagcttcagtgcttgagcagcgccaaacctagttaacacagatcaaaatcttccaaatgccaagtccatgccagtgtccaatactgataaatgattttgaaatgctcaatactggtcagtgccttgtagagtgggaatcagatatgcgggcatgtcagttcatttgggttcattggcatcctagccttagtctaggatgttgctaactttctgaagctgtagcatgacagttgaagtatgaatttattttgttggtgcttgagcctttgcatattcaaagctgtcatatattgatggcaccatcactccatcagaccttgggtaattcaagcatattgttagtttagttgagacactgtatttgctggactgttccgttgttccttgggttagtcacacatcaccaaaacgatttcgggagtatatgtgatgttgttctttttgtcatttcaagaacttgtagttgacccgcaaattagtgctgcttaatttataaaaccttgaattctttgtactgtacaaatcctccgtttcttatttatgattgaatttcatttgtattttaaaaatgtaaagtaaatttataggtggttcacttcagtgtggatgatatatctggatacttgtgtttatacttcatcgactatctacatggatattcaaatcaactgaaagtcaccaccctactttccaggatgctccagaagcaaaacgtttgaaaccaatgaaatctagtgataagaatgatagtttaaggacagaagctggaaccgattcaggaaacagcagtaaggctgctgataaaaatgctacaccaccagagc

SEQ ID NO: 4376 - DNA, 1501 bp, Oryza sativa
tgctgggtcttatctcattctgaaaaataaccgtgggacccttaaaaaaataaaaaataaccgtagggcccttaaaaaaagaaaaaaaataactgtgggacccctaaaagaataaaataaccatgggacccttaaaaaaggagaaataaccgtgggacccctgaaaaagagaggaaaacgtgggctggggccggatgtagtcacaagaccacagtcgcaattgcgtcggtttgatatatacactctgaattttcttggtttaacgaaagcctcagtttgaacgatcaagttgagaatttggtacgaaacaaaggcagcagctgcaaaccaaatttttgcagttgcaaaatgttaagactctgctgaaaaatacaaaagaaaaagggagaaaacatttcaggatttcaggaattcgcaactagaaatatccaccccattgacctttgtttgatctgaaggtgtattgcgcacaatgcaaagtgatgggttcaagaatgtcaaaacataagctggtgtaactgattatgatctgccagacagcatcttcagttagcaatggtgaaagaaaaaaggaacaaaattctgaacagatacagtggttcaaattgtctggtgattcagaggcctactgcatgttacctctgcagataaatatggtccaagagaccaagatctttgtgtggctggaagtcgatctcaacactagcaaccagaaatagccaatatctcccaggacagtttgtgctacatttttctatgactgaataatcttgtgctactcaaacatgcttaaaaaaaatgaattcagactagcactataccattgcagatttgcaggtgcgtatatatagttgatgatactacgtaagtattacatctagctagaatcaaaatgtaatgcatttgctgcacagtgccactccatgcaagttcagaggaatttgttttttagaaggatagttcagaggaattaggcaatccaggagatctgaatccggatgagttaacagttaactcatgtacatacaaaagggaatactactggatgatgcatcggttcaacgagcagacattaatagggggattttcttaacttggtgctaaccaggtgaaaaccacattcttgatcttaaaaggggtaaccacttattattcccaaactgtttcaattcattaagcataatgtccttttttattgtcttctcaactaaatgtttcccatgtttcagtccttcaagttcagaatgggtaaaattcttcagttctttcaagaaaagatttcttcagaattcaggggatggcattaggctgcgaatccagagcattttgcagtgtcaacgtcagcaatagcgcaacactaaaaatctcagttcgaaattcgaagctattccaaataacttccaaactgaataaaattgcatcaaactttcaaacagaaaaggggaaatttccacacggctgagccctagcctgatctccccgcgcgcgcccgcgaagccgc

SEQ ID NO: 4377 - DNA, 1501 bp, Oryza sativa
gaattctgaagaaatcttttcttgaaagaactgaagaattttacccattctgaacttgaaggactgaaacatgggaaacatttagttgagaagacaataaaaaaggacattatgcttaatgaattgaaacagtttgggaataataagtggttaccccttttaagatcaagaatgtggttttcacctggttagcaccaagttaagaaaatccccctattaatgtctgctcgttgaaccgatgcatcatccagtagtattcccttttgtatgtacatgagttaactgttaactcatccggattcagatctcctggattgcctaattcctctgaactatccttctaaaaaacaaattcctctgaacttgcatggagtggcactgtgcagcaaatgcattacattttgattctagctagatgtaatacttacgtagtatcatcaactatatatacgcacctgcaaatctgcaatggtatagtgctagtctgaattcattttttttaagcatgtttgagtagcacaagattattcagtcatagaaaaatgtagcacaaactgtcctgggagatattggctatttctggttgctagtgttgagatcgacttccagccacacaaagatcttggtctcttggaccatatttatctgcagaggtaacatgcagtaggcctctgaatcaccagacaatttgaaccactgtatctgttcagaattttgttccttttttctttcaccattgctaactgaagatgctgtctggcagatcataatcagttacaccagcttatgttttgacattcttgaacccatcactttgcattgtgcgcaatacaccttcagatcaaacaaaggtcaatggggtggatatttctagttgcgaattcctgaaatcctgaaatgttttctccctttttcttttgtatttttcagcagagtcttaacattttgcaactgcaaaaatttggtttgcagctgctgcctttgtttcgtaccaaattctcaacttgatcgttcaaactgaggctttcgttaaaccaagaaaattcagagtgtatatatcaaaccgacgcaattgcgactgtggtcttgtgactacatccggccccagcccacgttttcctctctttttcaggggtcccacggttatttctccttttttaagggtcccatggttattttattcttttaggggtcccacagttattttttttctttttttaagggccctacggttattttttatttttttaagggtcccacggttatttttcagaatgagataagacccagcaaaagcagagacacatcccgagtccccgactcatccgagtctccggcgagagccgccgccgccgacgtgccggactccggccgcaccaccggccaccgcgctagctccgcttcaggtaaatcccctgagcagagaagatgggttgaaatctcatccgtttttttttgatttgaggtctcctacctccggcgatggagtcggcggcggcgg

SEQ ID NO: 4378 - DNA, 1501 bp, Oryza sativa
tgaattttacaagattaaatctaattaaagtccatttaaaaagacttaaataaatttaattcaatttatggacaattttaatatgtagatctttattttagaaaaatttagcaacttgaaccacctgaaacggatctatggttatttagttatgattttccgaagatttcatctattagaaaaaaggaaaaaaaagaaaggatgatgatgtcagcatgacatcacccacggaggccggctagggttggcgacctcgccggagctagggaccttggccgggtgattggaggacacctacgcgtagaggacgacgaggcgaacccaacggtactcaccacaatgacaaacgacgaacgatgatggccggcgacgaagaggacggcggcggcggctcggcttgacggcgacggcggagctccggtggtcggcggcgaagggggacgggcggccgaggttctcctcaccacggcgcacctaacggcggcggcggcaagcggcggcgacgacgcaagcgacggcgcggcgtggctgaagacggccggcggcggcggcgaactaggtgcgcgcggcggcgactctacggagcacgggagaccacgggagatggggcaaacgaaagaggggaactagggggtcctatttatagccttggattgaagagatcggactcctcccgcaagaaatcgatccgagaaaactcggttttggagataaactcgaaaacgagtttgattcgggcaagatactcaaccatttgctccgattcttgaggggaaagatagaggaggataagaggaatatttcccctcaactaattttagaaaaacacaaggggaaaggtcagatttggaggagaaaaaccgagccaaatcggtctcagttcggctgctagaggtggaagataaacagtgtcgagggaggcaaattagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttgaattgttacgccgcccagaaattcactagtaatttccgaacttatttgtgcataaaatcctcgtccaggaatcagccgaggtacacaaactgacaatttaatatacagaatcatcactatttatagtgttacatactttcaaaagaaaagaaaactgcagcggaattacggtctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagca

SEQ ID NO: 4379 - DNA, 1501 bp, Oryza sativa
acacgacgtcgtaggcggcgaggtcggtggtgacgtgggccacgtcggaggtgtggaaggccatgcgcgcggacaggtcgcggtcggcgcggacgaggcggctggcgcggcggttggcgtcggcgcagatgtcgtagttgtgaagaagtcgccggggaggtggcggccggcgaggacgagggagctgagcgggagcgggccggagccgaggaaggcgaggcgggagggcggcggggcggcggggaggtggcgggcgaggagggcgtactcgagctgggcgagctggatgtagttgttgaagtaggggaagagggcgaggtggtcgagcgggttgtcgtgggcggcgaggacgtcggagtagtgcgcctcgaggtggccctcggcgtcggcgcagaggcggatgaggcggccgcgcatgtcctgcgcctccgcccccagctgctccacgtccacgctgctgggcgggatgcaggtcatcaccagctccgtgaacagcgcgttcacctccggcgacgggctcagcgacggcagcttgccgatggccgccgccagcccggtgatcttctcaaccaacttctcgatcacctcctcctcctccggctgctcctccttcgccatggtcaccgcctccacttccaccgtcatactctctctctcgatcgattagctccaactggtgatcagtcgaacactcgatcgagctgctttgcttgattatacttttggattggagtgcaatggtgagccgcgggggcgccattatttatagcataggacggtttggatgggtggcccacgtgtcagcgggtacctatctctaagctgcccctatatctaactttttgttttgagatatagcatctatctatctacggagtacctacgattttttttaaaaaaaattattttagtttttaattttaaaaacatatcttttcaaaacttatttttaaatcagtatctttttgaccaaaccaatcaagaaggcgtgacgaaacaatattatcacgtgggtctaaatgacgtgacaacgttatttagtcatgtgtaactagctagcgtaaccacaccaatatagctggcatggtaggacaaaactatcattgccgctgcaggtgacgtaatgtgttattttgtcacgccaaataagctggcataacaaaaaggttcatattttaaaaatgaattttacaaagatttatttttaaaatttaaaatttaaaaaataataaaagttatctatctacacctatctatctatcaatctatcagttagtcttgatcacttcaccgatcactacttggactttttgttattatattattttaagttaaaatagtgggtatttgcagattatatattagtagagtagacaaattaattactacacaacgtatgcaaatgaggaggctagagctagatacgacagccaatagatagctagcgcattacgatatactatatgatatggttcggttgactttaatttgttggggcaaa

SEQ ID NO: 4380 - DNA, 1501 bp, Oryza sativa
tgcatttcattggtagaaattggggttcaaaccaaaatagccctcgaaatccattcttgaattaatagatttataaagcgcctatcttaaccagtgatttttttctcaggaacattacaagtcaatgggattatgaaaagtgcatcgtgcaaaatcttgtttttctccctggctcacgtgcaagtgcatatcaggtctcacgtagttccctgcacttctactatacttcagctgtgtacaacctcctcctctacagttttcactcgtactggagtacaactgttgcaagatgtgacaagacgccatgtgattcgattcaactgggggtgttaaatgttcagttgacagccaattcaagaagaatacgctctaattggcgcacttaattatgttgctactacctgtgcaaagtctgtgtgtacgagatggatgctgatcttgtgccaaaatctctgaaactgtgaacaaagagaatgctaattcattggtgtaccggtgattaacataactgttgctgagaaaatgtgttgaaggacactgaactaatcggtttttcagcggcgaaaattggctggtgcattgcatttgcatatgcaataacttttagagccaaatgtcgcaggcttgaatcttgggtaaaatgaattaaaatatttgaattctaattttattcataaagggggattcacacgaggaagaatgcccctctttttttgtcagaataaattgtggattaggacgtattagtggcgtgcaatatgtatctcatcacagacaataattctccgctagaatttgtgttcaccagctttcccacccaacaagagaacttgacaagtattgacccttttgatcgctgacttctaaatggcaagtagtcaactatggctcgtctaattcaattgctaccgcaatcattatgactattaaaaaccagtataggtgatggcgagagctcgagcaaaatctcgaacagggacttgtagatgcatataactctattgttattatagtacgaattcatgctaacataaaagaaatgctgatcagttctacaaactgtgtgctaaaatacaacctgtgctacaatatacaaatatataaactactatctctattcaaaagtgttaggagctgcctaagttagcacgtttaatactccctctgttccataatataagagattatagtgcgatgtgacaccagtcatatgaatataaacacctctctatcaacatgcgtgattctataatgtgtgatataccatcaaaattacttatattatggggcgatataatgaattttaccgtaatgtgacacattctagtattatgaatctagacacctctctgtccaaattcatagtactaagatgtgtctcatcccaccaaaatcccttatattatgggatgaagggagtagtatagccaactactagctctaattatatataaccaatttaatagtccattcatacaatagttaactataaatatatatt

SEQ ID NO: 4381 - DNA, 1501 bp, Oryza sativa
tctaatagattaaatcttcggaaattcataactaaatcatcgtaactcggttttgagtggttcaagttgctaaattcatctaaaatcaggatctacatgtttgtttactttatatgtactttttatttggtttttattagtctttttcttcgttttgcgtgttagtttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaaactattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcatgttatgataattaattgataactaaaacttgacaatggtgggttgtgagcacatggttttgaaggtcatgctcatgataattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccaggatcgcgacgcatggtagacatgatgaggaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgaaagtatgta

SEQ ID NO: 4382 - DNA, 1501 bp, Oryza sativa
gcgccgcgcgccgccttcgccgccgccggcggcggagggggaagccgtcgtccccgcctcgccgctcaccttggcgcactggctccgcgacgccattgctgacaaacacacaccaaatcagcaagacactttactacctcgagcacataaatatctttaaaccgataatctttccgacttacgtgtagactattcttttatgataatcttctcaacttacgtgtagactatgtagatgtcgctggagaagtgatttgagatgatccaaaagtgcaacaacgataatcttatctggtccaaaatgaaagtattagctagagaattatccaaagtgaaattttaataatataaaatatggatcaaagtacaattaacttaaaaaaacaacgaaacggaagatataaaagaacagtcgatgcgacgacgacgacacagcgcgcgattctggtggcgaagaaatcaagaaccctagctagctagatagtacgaaggggaagattagcgggggttggtttcagatccgacgccgacgaactccggtggaaactaaccttcgtctacctcacctccggtgcggcggcgaagagaggaggggatctccttgcaatggtggcgatggtgggaggaggaggaggaggaggagcaccattatttgtgtccgtggaaagagtggggcagcaacaattcagccaatgagaaggctacaactcctgtgtgcatggtacgacgacgatggagtgatactgaagattttttttttttggaggttagttcaagaaaaacgtgggaatccaatatggatgtttgttttggaagaaaaaaaatgaaatgattattcaaatgcttggaaggacggtttgatagggactggtcgctggacgggatcggttttcgacaagcaggaaaccacggctgatgaagcctgttgtggtttttctttttctttttttttttggagaagtctactttacgtccctagaatatgggtactaggtaggttccaataatattcttcaaccgcaaaattggatagagcactgtcacgcccggaatttctatacaaaattccaaacgcttacatgtgtgttacatcctcgtccaggaatcagccgaggcacacaataacaaattgataatagagtactattaaacagctaattaatattcgcaaaatagcaaattattacagaggtggatagttcctctcaaagaataaaattctacgcagcggaaataaaacaaaatacagaacagctatggcgactccactccacaagcaacttaacccggacaaagcctagtcctccaaatcattaccttcactgaaatactcctcctctgatgaatgaatattgcaagaatgagcatatgacatactcaacaagccacacaacaaatatgcaagtgcacaggataacaaaggatggcatagtaaagctcatttgcataaataacatttattaaacctttgagagaataataaaacagttgaataattaat

SEQ ID NO: 4383 - DNA, 1501 bp, Oryza sativa
gagaggttataaattataatcacatcttatcttttcggaaatgatattatcacaagttgactgaacacatatatacatgagtgtgatgtcacatgagagtggccgtcatgcactagtcctattccaagatacaacgaactgattgcaatgtccatttcttttttgctcctttttaatttgttgacttgcaagaacaagcaaatgtccatagaaatgttgtaataaataatgcacaactagcacaaagtcaactatttggttccttgaaatagatatactaacttacaatttttctttctcaaaaatcttctgtggctgaagattatttcctccttggataatcacacggtacacaagagcatacgtgcataacaatatcaccttaattaagggcctaattaaacatgtagatgatgccatgatctcactttagatagcaatagcttcccattatagcatataaatctatatcttgtgagttgtgacaatgctataagaaagttttaaaatactgtaagatataaaaaggagaatttgatatcaatttaattaagaaaaaaacccaatccaggttgatggtgagagctagagagtcttctgccaaaacccaatccaccccgttcaaagcttaaacctgagcgctggcatgacatgatcagcctgtttctgaaatgcgaaaaaaagtttgaattcacttcaaattcggttcatatttgatacttcatttattttttaatgtatgacgtcattgaccttttgagatacgttcgatcattcgccttattcaaaagaaagtaactattatttatttttattgtgacttaatttattatcaaatattttttaagcatgatttaaatatttttatatttgcacaaggattttgaataagataaatagtcaaatgttgattaaaaaatcaacaacgttatacattaaaaaataaatatagtatgtctttggctcaaatcaaatgcatggaaaaatatcttgctttacagtttacacagctgcacaatgcaagggggcagcgaaaaagatactccctccatttaaaaaaaatgtacgacgatgttattttttttttactataacgtttgatcatttgtgttatttaaattttttttaaatataaaaatatttataccattgcttaaagaatatttgatgataaatcaagttaaaataaaataaatgatattattacataattttttaataagacgaatggtaattaaaaaagttaatgccgtcatagaaggaacagtaattaaaatgagcaattagcctacaccggccggcttagcggcggcggggcccacactgcaacgacggcaacgaagcgccgtatatataggccaagtagttaagcatttttgttttggaaagtcattagcttgttggcttggcgtgagtccagtggagaggacgacggcgacgttggtgtccactgtccacggcgaggagaagtctccgaggggaggagagggagagggagcaa

SEQ ID NO: 4384 - DNA, 1501 bp, Oryza sativa
gtaaacaaaacgttgaagtgatttcgtcaatttcatgtattacctcggtaacaaaaaaaatataatagattacatgtatttatactttattttcttaaaaaaatccctgtaaaattacctaccgatttttatctattttatttacatgggcctaaattggacatggtccaacgcgtataacgtaaaggaataagttcatctgatgtctcttaacttgtcaatgaatccgattttcgtccatcaaccgaaaaccaaatgcaacgggtccctcatctatcaaaaccagtgcagatgaggtccctcagcggtttagatggcggttttagctgacgtggcgcttacgtggctaatttgactcggtcttcatctgacgtagcattgatgtgacgcttacgtggcaattcgatccgaaaaataataaatcttatgggacccacatgtcagtttgaatgaattaaaaaatgatgggtaacattctcacccctcctctctccccatctctcccctctcctctctctagcgccacggggtcacggggaggtctggcggcggcggccgacgacgcgggggaagggtggggcgtcagtggcgggagtgttgggggacgcgccgtagcctaccacggtgacgctgtggttgacgtcggcggacggcggtgcacggccccgtgtagacaccgctgccgtagagctagaacatgaagttgccggcgtcgacggtgacggacaccggctgcgccgccacagccctcgccaagtcgggctcgctgctggtgtcacgttctggtagcccgcgatgctgaccgcgctctggttcagtttcgccgcctggcacgcgccgttcgcggcgtggtacggctagctcgcctccgtggtgactagtgaggccgtggttgccgacgatgaactcgaacagctcatgtacccaccgccgcaccccacagcctcgtcgttgcagtctacgagctcctgctctgacagcgacaccagctcgccgttcttgttgatcccctctatcaccgccacggcggagaacgcccagcaagaacctgcatccacacaacacccagatttccatcgattaatctccaacatttttacaggtttgaatctttctttaccatgctattgctcacacaccacaatcttcttggtactccacttccaccactgctcctttcttcctccaatctacgctcttcggcagaatatcatcactgctctctccaggcattgctttgaggaattgcgacatgaggtctgaaccccagcatcttggctctgaactcctcgttcgtcaggtcggcgaacgtacttcttgtcagccagcttgtagccattgcacatggagttgaacttctcaaataactcaacgttgctcctgtacacctcgaacctcctctgcttctcttcggcagtcgtgcagctcccggcaccacgctcgcacgagctccagctcgtcggagacgggcggcgccgcggccccgatctcctccacgagc

SEQ ID NO: 4385 - DNA, 1501 bp, Oryza sativa
taatcaatatttttattgttgttagatgataaaacataattaatactttatgcgtgacttgtttttttaatttttttttatattttttttaaataagacggttaaacatttaacatgaaatcggtcgtagcagttaagagcaaccaacaaaacacaagaggagaccaaatcaagcgcgacagctaggcgtgtacagccccccgtacaggcgtgcagccagcgcgacgcccccctgtggtgcgctggtagttcagccttcgcgcgcgggcggcaaaacacggcacgccacgccaatacgtgcgcgcgtcccgcgccgtcacgccgtgccgtgacgccgcccgctgtcgctcgcgccgcgtccgcgtggtgtgtctttcccctctcgcgaagcgaagcgaaatacaaagacacccaaacccccaccaccacgacgtctcgttccctcgtactagctcgtctcgtctcttctctaccccaatcccgttctctccctttccccccaccccacccccaaccccgtgccgcggcctcgccgatcgatcgatcgtgcgctccacctcctcgagctccctccctcgccgccgccgccgccgcgcgccgccggttcgacgccttcttcgcgctctcaggtgaaatcatcttctctctcaggttcaggaatgaatgcgtgggggatgggggttgatcggtttcggctagggggtgctggattggtgggtggggggtggcgcaatgctgctgcggcggggtggcgtttttgccgggtcgaggcgggcggaattgtggggaattttttttttttgcgtgcgcaattttggcgtggctcgggatgatggctgggtggcgtacggcggcgtgagctagggggaactcgcagcggcgccgggggtgggtttcggtggtggtttgtgtgagtcatttgtctcatcgagctccaagtttggaggtggtgttatgctgttttagcactggaggttttgtagtacggacttgcttggatgtggaggatatggtcatgtttttgttgattcccggaggccacctcttgtttctgatttccttttggtttgtgtcattggttcatcaggtagcggtagacactgaacatgatgattcaattggtgtgacggatgagtctggttggccatgcatagaattagacaggcggatgcgtaggttagtaaaatatccatgtgaatgaagctgagcgacaactgaaacaaaaataaatgcaggaccaaacttgatgttgattgggacataggcatgtgaaatttgcccatgttcacaggatgaacggcagaaacccagaaaagaacataaaaatggaacatgaaaatgatagttcacttgcttgggtggttggcaatcggcagaagaggatgcaatccctctcccttaatcgcactgcctatccatgattaatgtccatgtgcttcagtactagattttttttttaatttggaccacttcagttctgattatgagttttgtcattgaa

SEQ ID NO: 4386 - DNA, 1501 bp, Oryza sativa
aatctaaagtttttaagtttcaccctttctccgtggagatttcaaacaaaaaccacacaagattctacgacttcatttaaaaaaccatgccaatcaccaactgattcttatctattttatcaagtcaaggcacaaaaagaataaaaaggacactagaatccttaagttttcaaatgccatattttccctgtaaagaattcgcatataaaccacacaagatcctactataattttgttagaaaaaaatatgcgccaatcaccaactaagtattactctattcgttatactatagtattatactataggccgttttaacttttcttctaatcaatttttaaaatttgatcaagtttatataaaatatagtaatattttcaacacaaaacaagcatactattaaaatatattcaatgttacttctaataaaacttatttagtgttgtagatgttactaaggtttctataaatccaaagaaatttaactcgagaaaaagtcaaagcgacttataatatgaaacggaattagtatctattttctcaagaataaaagaaactaaataaaaagcactcttagaatccttaacgtttcaaatttcatccttccccgtaaagaattcgtattcagaatcagggacttaatttgcaattagtaatttaaaacagggttggatcgtataataaaaaagtactccacccccacccccgtatttgatcctagtcagccacccctgcttccttcttcttcccaagttctcatcgagggttttcctctctctctctcgcatcgcatccatcccctcgtgtcgccgccggcggaggctgcggcgagccttcaccccccacccgcccaccgccggcgagccacggcgtgggcgacctcctctcctctcccgatcccctctcgcccttaggtaggggcttctccccagtccccaccacacgcgcgtgcgtggccgacgagcaccccaggttcggatcggatggaaggtatgatgatgatttgttctcgtctcggtgatctccctcctcgtcgtccttctccggcgcgtcgctttcgtgagtagatcggagatccgttcgggggttgggggtttgatttggggtttagtgaacaccctccccaatcccacgtagccgcatcgttaggtccgcctcccagtgattatctagattgagatttcgatcttgcagtttatggtgtacagtatttagagtgacaggtcgaggtgaaaggaaattgaatctcccttgctgctgtcgtgagatttaacttgcgtgtggacaggtctaggtgaagggaattcaacttcacctgctgatattataagatctagctttgggtattgctgctttataagaattattagctttttattttttttcatatcaatcaattcgaagtccttcactggtaaagattcttaactcttgagtagtgcttgtgatctggcttatgcgagtagtttgcatcaagcaatgaataaattattctatagcctc

SEQ ID NO: 4387 - DNA, 1501 bp, Oryza sativa
acacttatattgattttaattgaattatgacgcaataatgaattatttttgaaaaggaaaaagggatttattgcgtcagcggctagggtttcacggtggaccgggcgcacggcgacggttcacgcgaacggacggccgagatcgatccatccaaaacggacggccgagatcgatcggtccacgaccggctcacgggagacggggacgatgacgtcagcgatgacgtcaccaccggcggcggcggctcggcggctcgacagctcggacggcgcaagctcaccggcgaacggcggtgcttcggcacgaacggaggacaccaacgggtagagcgcgacgcggcgaactcactgacgacgaaaggagcggcggaagaccaacggacggcgacagtgacgaggttgaaacggcggagctcttcggcttgacgatggcgacggtgctcgggcggtcttcggcgacggcgaaggggcggacgaggacggcggtgacttggcgaccacgacggcggtcttcccgagcgacggcgatgaccggaacggcggcggcgcacggctggagcgacggcggcgacggcggcgcgaagctacacggcgctagggcgctacggacgacgagaggcgaaggcgaaggtggcgacgggtagagaagacaccgggggtccttttaaaggggctaggaggcggcagcgaaggcccacggcggccggcgcccgtagacccggtccgcgcgcccctccccctcggctgacgcaataaaccctttttaaatttaaatttaaatgaatcaattcgcaaatattcatttaaagagcatataaccttcaaatggccataacttggccatttgaactcagaattggaccattcaagtctctaatttttccttaagaagtcaagaacccatttttgtgctttgttcctgcttgttatatggagtttattagagtaaaagccttttttttctttccgttggtcgtgtagacgctgcagcttcggaagatccgctcttcgtggaggttgaagccgacctttgggaaagcgagcaaggcaagtcacatcatccttgaacatattgaatcccattttataaaattattttgatttaaattattgcattatcgctttatttaaattcccgcgttatcactgttttattcagccatgcctatttacctttgttatgaccttattattatttctattgttattattattaccttgttcaccctagaataaacaaaaccccaactagtgggcactccactcatggtaccactagtatgaatttaggtagatgcttcgctggttaattaggcaacattaggtggttttacaactttagactttgggaatattcatatcacctggacactatggaatggttggattattgtggaattggattcacacctccccctctattcaaaaccctcaaaatggttttaggctgggcacggggtgcatggttttgatggtagcacctcggccatataaggaccggt

SEQ ID NO: 4388 - DNA, 703 bp, Oryza sativa
cgtgactctaacatagttatttatatacttatcgctcacatgatttcaaacaaactcctaccatttgtttctcatgtacttcctccgttccataatataaggcacaactacttttttttatgttccataatataaggcatgcatgcatgcatacaattaattaggacctcttctccattaaattattgcttttttaagtcctccaccctcaagatctctaattctattggatgcatgcattatatttattagggtgatccaaactatgagatgataataattatttcttgatctttgggttaagggtggttgtgccttatattttggaacggatggagtataaagcattacttgagtctgttcaggtttgggttataaggcataagtattctatgaaacctcacacattttaggctgaaaatgcacgtgtggccatggattatgaactagaatgctattatttttcatgttttacattgttgagcatcttaatttagtatcatatatattcaccagttgattattttagcatactttttggaacagttgtttttgttttttcccatgtgatcatgccagtcatatgttaatctatggaaacctggccattgtgcatccatatgtgctcatatcactcagttgattcattgtgcaattcaagttggttgacatatttcctgcccattgacttatttatatcagc

SEQ ID NO: 4389 - DNA, 1501 bp, Oryza sativa
ttgaatttattactgctattaaattggttcattaaagttcaagttgcttaggcaaataaaataaaggcaggctccgacacagttatgccacacaccggcataaccatgccccacacaactccaacaagaagacaaacgagaaagaacacacgcgcaagcctactaactgctcgtctaccgctgcgacgggccaggacggaaggtgagcaacagcgcatcttccgtgctgccaacgccggaggcttccccctcctggggaaccacgggcgcggtgtcacatcctgattttcgtttcaggatttataaattatttaataaattaataatagaatttatattaaatgttcattaatttacaagtgaagttaattgtgggaaataaaatctcctaaatataaagcatggatggatttaattttttttaattctccatggttaattatactctctggaattttctcggatttttcggagctcaattcctaaatgatacaaagaacagttcagtaattatttgatcaataatgatctaattataattgttaagtgcttttcttgtttaaaatccttaagttataaattgttgtttaaaaggaattattagaaatgattttaaaagcttaaaagagaagatctaattttaatttgctaaatctcaatataaaattgagctagataaaattttattaaatactttgcttgttcctctattttctagaattttctgggaattgtttgagcaagggaagtatttttaataaatgaaacatcatttcatgaattattttaattgaaaaagttttaaaaaccctcccttaagtcgttgggctgaattcggcccaacattctttctccccgcgcgcggccgaaccggcccaagccggcccagccgacgccgcccgccccctctccctctagccgccgacatgtggggcccacatgtcagaggtttcttcaacctccggcctcgcccaagccggccgagatgccgagcccgagccgctcctttctcctctcaaatccgcacccaatccggcctcttttcttccgattgtttgaggggattttatcctctcgttctcctctatctttcccctcaagaatcggagcaaatcgttgggtattttatccgaatcaaactcgttttcgagtttatctccaaaaccgagtttttgatttctcggatcgatttcttgcgggaggagtccgatctcttcaatccaaggctataaataggaccctctagtactcctctttcgtttgccccttttcccgagctctctagtgccccgtagcctcgtcgccgcgtcgtccaactcgccgccgccgccggccgagcttcggcgaggtcgcgccgccgcccctgccgtcgctgccgttgccgccgccgccaagaggtgcgccgaggagtgaggaagctcggccacccgtcccctttcgtcgccggccaccggagctccatctccggcgaggtctgagccgccgccgccgttcatctcgt

SEQ ID NO: 4390 - DNA, 1501 bp, Oryza sativa
ggccgagcttcctcactcctcggcgcacctcttggcggcggcggcaacggcagcgacggcaggggcggcggcgcgacctcgccgaagctcggccggcggcggcggcgagttggacgacgcggcgacgaggctacggggcactagagagctcgggaaaaggggcaaacgaaagaggagtactagagggtcctatttatagccttggattgaagagatcggactcctcccgcaagaaatcgatccgagaaatcaaaaactcggttttggagataaactcgaaaacgagtttgattcggataaaatacccaacgatttgctccgattcttgaggggaaagatagaggagaacgagaggataaaatcccctcaaacaatcggaagaaaagaggccggattgggtgcggatttgagaggagaaaggagcggctcgggctcggcatctcggccggcttgggcgaggccggaggttgaagaaacctctgacatgtgggccccacatgtcggcggctagagggagagggggcgggcggcgtcggctgggccggcttgggccggttcggccgcgcgcggggagaaagaatgttgggccgaattcagcccaacgacttaagggagggtttttaaaactttttcaattaaaataattcatgaaatgatgtttcatttattaaaaatacttcccttgctcaaacaattcccagaaaattctagaaaatagaggaacaagcaaagtatttaataaaattttatctagctcaattttatattgagatttagcaaattaaaattagatcttctcttttaagcttttaaaatcatttctaataattccttttaaacaacaatttataacttaaggattttaaacaagaaaagcacttaacaattataattagatcattattgatcaaataattactgaactgttctttgtatcatttaggaattgagctccgaaaaatccgagaaaattccagagagtataattaaccatggagaattaaaaaaaattaaatccatccatgctttatatttaggagattttatttcccacaattaacttcacttgtaaattaatgaacatttaatataaattctattattaatttattaaataatttataaatcctgaaacgaaaatcaggatgtgacaccgcgcccgtggttccccaggagggggaagcctccggcgttggcagcacggaagatgcgctgttgctcaccttccgtcctggcccgtcgcagcggtagacgagcagttagtaggcttgcgcgtgtgttctttctcgtttgtcttcttgttggagttgtgtggggcatggttatgccggtgtgtggcataactgtgtcggagcctgcctttattttatttgcctaagcaacttgaactttaatgaaccaatttaatagcagtaataaattcaagaattatggtagtcgtgggtggttagctttaattgtcagctctctctgtttgttggttctgtgtggggttttcaga

SEQ ID NO: 4391 - DNA, 1501 bp, Oryza sativa
tttccgtatcgttgctcgacgcggagaagtcgcttaccagttggagctgcccgcatccttgggcaacgtgcatgatgtgttccatgtgtcgcaactcaagaaatgtcttcgagtgccatccgagcaggccgattcagagcaaattgacgttcgcgaagacttgacctatgtagagagaccagtaaaaatcctggacaccatggagcgcaggaccaagaaccgggtaatccgtttttgcaaggtctaatggagcaaccacgctgaggaagaaggtacttgggaacgtgaagacgagctgaaggcagcccatcccgatctcttcgccagttcttccgaatcctggggtcaagattccgtttaaggggggtaggtttgtcacgtcccaaaatgaccctaaaatatatcctttaaattatgcctagaataattaaaatccatgtgaaagcctccaaaaattaaaatgtgcaaagtaaaagtcaaacaaggcttagaggatttttgtatatttcctaaaagcctaaaatgtgtaaataaattttagtggaattttcagagcacaaataataattaagaagaaataaacaaagttaaaatgattttataaaaagaaaaaccttaaaatttcccccctccccctcttgggccggctcggcccatctccccccctctctctctcctctcccccgcggcccattcggcccctccccgcgctcacgccgctgacgggcgggcccgcccaccaccctcgctgacgggtggggcccacccgtcatccccgacctcccgccgctcccgccgtctcgcccgcgcctagccccgccgccgccgcgaatcccgccgcctcccgtcgtccccgcgtgcaataaagtggggggaatcattccccgtgatcccctctccctttccccccatttttccctctctctctcgcgttcaaacgggcggatttgcccccgcaaatctcgccggcaccattgatggcggccggacctcccgtgccggtttccttcccctctggccgctctctcccccttccaaccctatttaaaccctccccgcacttcatccgaccgttttcgcctctcgccgcccttccttctcgccggattcgagctcgcgacgtcgctctctctctccgccgtcgccgccgagctctggtccgccgccgtcgtcgccccggaccgcctcccacctcggcgccgcctcctttggcttcaccgcatcctcgccgacctcgtccacctctccgtttcggtcgccaaccgccggagcgccgtcgtccccgtcgacccgatccgcgccaccgcctccctccgctccggccgcctcccccgtcgccgccgtcgccccgggatgagctgtggaccgtcgcctcctttccccttcccttccctctctcggccgccgctccgccgcgccggtggtcgccggctccgaccatcggagcgtgggcgcgccgcctcccgccgaccgcgcaagcatggccgccctcgggcgtgcc

SEQ ID NO: 4392 - DNA, 1501 bp, Oryza sativa
tctgtttttctcccctcgaattcgcgtgaaccctagcttctgttctagatctgggaaggtttttttttctctcttagtttgcgttaaatttggtactaatattgtcacatgtttgatcctcccctccccgcccctgggagctaacgcgtacaggacagtttgctatcgaggggggaaaagttgggagaattaagtaataattccgtagtttggaaatttacgccggtaggagtacgagcgggtaggtggtaattcactaattctagtgcggttaaaaaggactaaagcgtcctctcgactctgggtaatcggaggaggtatttgaataggtcgctgctgctgctgctgcagtgttgatttgagcatgttggttatgcgctgtgtatgcaaaaggctgatttgcagtgttgatgaaaggacatgtgcaattgtaaagcgtttattaaatgcttgctcatgtagaacgagttgatagttttggtggagtaaaaaccataatatgcatttatggtttgtaggatatagttactttctatatatatttatatatctgtggagttacttcgctcattttttaagttttgataaccgctatgaggatgttacaatctttgtaactctgcttgttatgtagattgcatgattccaccacaatcagaaattgtaggtgagaacaacgcatccaagagtgctgctaaagagcaggtaattgtcttatcagttttttttccctacaataggtgtcgcgctatttactaatggttgattttctctgcatcagattctttctagtacaaatgagaaaatgactactagtgttccccagggtgctagctcctcaaaatcaccaaagggtgcacaggagaaggctagttttttgggtaaaggtggagaacaacctttctaccaacccaatgtgtacgcacctcagccacaaacaatctattctggaggttaggttacattcatttttatgtgttattattgacgattgaactctgttggacaatttaatccccaaatgtacacaaccatggtattagaagataaagtttcagatatttaactctaaatttggttttctctgtactaacatgattgattgttgctatcagttttaagtgttcatcagtccttactattttgatctcactattgtttaactgcctctattgaaatcttgagagagagaggcgaacatattattcaatctgcgtatcttgttctttaacaaggtaactcctttggaagtgttattatttaatattctttgcttttttttcccctgtaggatacctgaaccatttgggccaatgggaagaatacccccattatgtcaatatggaaggactccattctgtatcacctgtaagtactatgactactgaagttattttccatttttcatagtttagttttcttaatcttgttttgctgaagggaatttacaacgacaaccagtcaatcatgttatctcctggatatgcaaacaaccctcaaa

SEQ ID NO: 4393 - DNA, 1501 bp, Oryza sativa
gcagttaaacaatagtgagatcaaaatagtaaggactgatgaacacttaaaactgatagcaacaatcaatcatgttagtacagagaaaaccaaatttagagttaaatatctgaaactttatcttctaataccatggttgtgtacatttggggattaaattgtccaacagagttcaatcgtcaataataacacataaaaatgaatgtaacctaacctccagaatagattgtttgtggctgaggtgcgtacacattgggttggtagaaaggttgttctccacctttacccaaaaaactagccttctcctgtgcaccctttggtgattttgaggagctagcaccctggggaacactagtagtcattttctcatttgtactagaaagaatctgatgcagagaaaatcaaccattagtaaatagcgcgacacctattgtagggaaaaaaaactgataagacaattacctgctctttagcagcactcttggatgcgttgttctcacctacaatttctgattgtggtggaatcatgcaatctacataacaagcagagttacaaagattgtaacatcctcatagcggttatcaaaacttaaaaaatgagcgaagtaactccacagatatataaatatatatagaaagtaactatatcctacaaaccataaatgcatattatggtttttactccaccaaaactatcaactcgttctacatgagcaagcatttaataaacgctttacaattgcacatgtcctttcatcaacactgcaaatcagccttttgcatacacagcgcataaccaacatgctcaaatcaacactgcagcagcagcagcagcgacctattcaaatacctcctccgattacccagagtcgagaggacgctttagtcctttttaaccgcactagaattagtgaattaccacctacccgctcgtactcctaccggcgtaaatttccaaactacggaattattacttaattctcccaacttttcccccctcgatagcaaactgtcctgtacgcgttagctcccaggggcggggaggggaggatcaaacatgtgacaatattagtaccaaatttaacgcaaactaagagagaaaaaaaaaccttcccagatctagaacagaagctagggttcacgcgaattcgaggggagaaaaacagaaagagcgcgtgggtagagagagagatgaggaagaggacgatggaagcttaccggcggaagcagccgggcggacggcggcgcctcgccggatggagatcggcgcaggcggcgggcgaactcgcgcgaggagacggagtttgggggggagtcgacgccgaggggaacgggaagactttggtttttgacaatctagccccttttagaaaacttattttgtaaatagaccctcctaaaagctcgttttcgtggataaggcctttcagcggtctatctatacattaagctttttctaaaagggccagattgtcaaaaatccaggaacagctatagacca

SEQ ID NO: 4394 - DNA, 1501 bp, Oryza sativa
gcttccgctgggagtcaccaatccaatccctaatcccgcgcttcttactctccgccatctccatgctacgctcgctatgttccaagtgattgtcgatggggctatctatgatttttgggtggttgggaacagaagcctcaagtatagttccctatgtatttcagttggattcatgttgcaagttacagataaatttttggcctgtactagttttacttgtttgttaatctgtatgttacttgttcggctgtgatatccatctcttttgcaaattataccgctatatcatgtaacgcttaatcacattcgtgagctaacttacacctcacggtggtaatatggattgtgcatctcctcatataaattgttcttctactcattgagcttgcttcttccacttcaggtgtgtagagaaggggcaagcaacatctgcacaaaatctgctggaggcatcgtctatgattgctgattcctcatcctcttctcagccaaaggcagtagcggtagctcacgataccattgagttctccgaaccatcagggcactgcgccactgcctttctttgtctcctgtctcacgcatttggtcccgactgatgcgtcaatggggatggcggcgggcaggagcaggccgacgtcggcatcaagtagcgagcgggggaggaggtggtcggcgcggctcactgcgaggagcagggtgggcgacatcagggcggcgccggcagaacgatgtggtcgcggcggcaaggatcctggtgagccgccacgcccttgcgcatgtccggcttggaaggggagagagagaagggagagaaggaggaggaaggaaggagacacggaggactgacatgtgggcccgcatgtcagtgggcccacatttctttgtgtgaatgactaatgggtcccacgcatattttttaattctaatgccacgtcaacaccacgtgaaacgaatactcggtcaatgtcgccacttaggcgccacagcagcaaaatcgtcctccaaaaccgttgagggagtcaaattgcaccggttttaacagtttagggggttaagatatctggttttggggttcagggccatgaattagattcgggtcacttttgagggagtcaaagtgaacttattctgcgcctaaatgcacgggtgaaaacggtagggcattgggcctttggttttgctctggacaatgggccgaggcctgagtacgaacagtactccaccaaatacggagtgcatcgtatccgtatacgtatccgggtgccaattcaatcattggttttcccgatccaaaaaaaaatcggagaaatacgccctactcggatttcaccattgagcccctccaaaacctgctatatttacatctccgcccctcccatcgaaggcgagagctcttcttcttcccctcctccaagcaaaaggcaaaaaaagccgaagcagcgccgacgagacgagcatccaaatcgtcgaatccagcggcggcggaggcgggagatggcgg

SEQ ID NO: 4395 - DNA, 1501 bp, Oryza sativa
gcccgcccccttgtgccgctgacgtgcggggcctgcgtgtcggcgccggcgccccttgctgacgtcagcgaatgccttttcctttgagaaaataattgataattgcgcaataaatcattaataattatagaaatccatttaaatggctcaaaacttctaaaattcatatctaattcattcgaactccgaattgggccattcaaattgcaaaattcatctaaaattgagttctacatgtttgtttacttttttatgtactgtttgcttggtttttattagggtttttcctcgttttgcgtgccagcgtgtagaatccgtcgtttcggaagatcgcggttgcgaggaaaagagttcagaaaatccaagtgaagaagcaaggcaagtcacacattccccttgagcatgttgttcccaatttataaatgttttaccgtttgcaaataaatatgcatgttttgctaattacatgggatcagggtttacctatctgctcgcttgtgccatgtttacttgatatctgtcctttgtcaaccatgggtgataaatcgcttagcttgtgttactttgatgacctagctagaactatatgcttagccatgcttaattaccactagctcagtcgatgggataattacagtattagacattctagtatcttgttgagctgcgtgctcgagacatctggccatgtttcatagtcgtaattatccaactaaaatgcgactgaatggtgggctgtgggtgcatggttttgtgagtcgcacctatggcaattaaggaccggttcacgagaaaccctggaagacttacagcgcttgccacaagcgggagtgggtaactgcttgatctgaagtatagctcgaccctttcctaggcatcggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtcttgtcacaatcactcgacatggtgacgtgtgcatcatgggcacatgatgacgcggtgacatgtcggtgggttgtgtcttgtgggtacagttgtgcacctctggccagagtaaaactattcgaatagccatgcccgcggttatgggcgatcgaccagattcaccgtgattagtctcacccttaataaatcgactcaatgcactgtagtacaggtgggttggttgggcctgttcaacgtggtgtagcgttgatcagtggagatctaatttttcttaattattcaacagttttactgtttgctaaataaaatgttttacaaccgtctttatgcaaatagccacaaaccgtccttgtatccctttgcacgtctgcatcattggtgtggcttgctgagtacggtggttgtactcagccttgctattattcccccttttcagaagtgtagtgcttctgagctgaa

SEQ ID NO: 4396 - DNA, 1501 bp, Oryza sativa
caaccaatgctgccaactgcctctggtcgaattcctcatcttcatataagctctcactgtaacaagtatataacattataaaataagtaaccagaaacacttcatgcttaatagagaagtccttgaaaatattaagttctaccaagttattaagtgacaatgaataaagaacataatttccagaaactataataccaaattgcaactgccaaaacatttaatggacatgcctcttccaatgtatctagctcccattaaatcccatgaacaaatcataaacaagaaacgagacgacacatgtcttagctcaatgtttttacttgacaggacaagcgctaaagatcaaacaaaatgttcctgcgtatagtcttgcaattcagacacttcaaagtcaaggattatgcatattcctcaaaccaaccataataaacagaaaaaaagaagtctcaacctaggctccacctgctcgttttcagattaaaattatgcttcattagaacccttcaaacaaaagccttggcaatccgagcctaaacgcaaattatttttaaaaaattaatattttttctcgaccacagcaactcctcgaagaataatacatgaatgaaccacaacagttagggaagtttgagttatctataatccatacacaaagcctaggttttctagtaccagtgaaactaaccgcccattataatcccctcccgaaatctccagcctaacagatcaaaccaacctagggttcatccaaaaaaatcgccagatcgaatctaaccaggccaaacgacactaatcgcatgaatcctccctccacacggcaccttcctagccgaaccccacctctcatccaaatcatcatcatcacatacatagagcaccaaaccccaaccccccactccacgaatcgaaccgaatcgcgcgaaacgccgcatcgggcgcagcgggccggcggggagggaaaactacagctgaaggtgggtgggggtggagcaactcacatggcggggacgctggtggagatctcgggccagaagacgtggacgagggagttgaggttggcgagcgcgtgcagcttgagctccgccgccggctcctgcagcatcgccagcagcccgctcgccgagctcaccatcaccgccgccgccgccatctcccgcctccgccgccgctggattcgacgatttggatgctcgtctcgtcggcgctgcttcggctttttttgccttttgcttggaggaggggaagaagaagagctctcgccttcgatgggaggggcggagatgtaaatatagcaggttttggaggggctcaatggtgaaatccgagtagggcgtatttctccgatttttttttggatcgggaaaaccaatgattgaattggcacccggatacgtatacggatacgatgcactccgtatttggtggagtactgttcgtactcaggcctcggcccattgtccagagcaaaaccaaaggcccaatgccctaccgttttcacccg

SEQ ID NO: 4397 - DNA, 1501 bp, Oryza sativa
tttacatgatatttaaaatattgtagataataattgctagtgggtttatgtggtacacttgcatgttaaacttttaagagtcaataaatatcaactttatagtattatatgattcatgcaactagcttggggctatatgaagagtatagtcagcgaggaacattatcggccttataaatcgaccacctggaaaccacttgataaaattaattaagctcatactctctctgttctacgagataaaatattttactcttctattttatcctaaaatataagatattttattcctcaatttctaacttttctactatttattccctatctactaacttttgtagttatattcctataactatcacttttgtatcacgactttgctacttccttaattttggaaaaagaaaaggtttaatcccttgtgtggttatgggatggatgaagtaaattcaattgtttgataaattttgatcaaatttgattggcagccagttagttatggaggttatggatgaaactgctaggcaacaatgggtcattttggatcaatgctaaaacgtgtcataccaattgttttggtagtttgagcagtaaatacgatggtttggtttgatgccaaatgatgggtaatgcacatgctcagtttgaaacaattctagaactttctttgctattatataaattttggcttccaattaatatcaattcgaacaaattcatttataatactctagagttattttggtgggctactaaaccaaacaaactttatatatatagggaataattaactatttgccgctcttacaagtgataattaaggatttgccactaggcacacatgtcatagattgcgagtggtaaatctttaattgccacatttcaaagtggcaaaaagttaaataccccgatatatagcgttgtgttgatttttaagactctactgaggatcaatgaggcttcccttgaagcatatgattttttggaaaaacttaggaggagctaaaatatttcctgtcaaaatcttataagattcatgcgttccaaggagccctaaatttggccatggaaacacatgaattatcaaacaaaaaaaggtaacagtatttgctcaagagaaagatataacacatattggcgtgaagtgagtataacttaattggttagtttcttcgtggtgcaatctatccacccgggtttttatagggataggtgacttcgtgaatctcaagatatacttatacaatcttcaaaggtgctcaaagggatagagtgattgcgtgcacatttatatgagcatctgttgttttaaaaaaaatgcaacaccacctagtcaaccctttgctaaggtgtggccaagatctattgttcacaccttaggcaaggtaaggggaaaaattaaatatggcgagtggagtctgtggctaggtaagaagaaaaaatataaggtggtgtttggatacagggacttaattttagtctctatatttagacactaatt

SEQ ID NO: 4398 - DNA, 1501 bp, Oryza sativa
  unsure (1)..(1501): unsure at all n locations
gtgggccaaacatggctcatcctcacattcaatgttattttcaatttatacatgctcagtgttattgagtaagttttccctctgaaatattataaatgcttattaagtcaaaaaaaaacattatgaatgcttcatccaataacaatttaagctgcaaatagcttcaaaactcaggagctaagtttgaacaatgtatcttacttgatacattcaagtttcaaccaatctttggcccataaaagttatatactagtagatgacaatataacacagttaatatttatcagctaaccaaaattattaagtaatcaactatgttccatgatctcataatccctaaatactcagcataagaaagcttacaatgcctaattgcccaataatctgcttcttctttttgtgatacaaagaaagatgcacatgtgcacacacacagaaacatgagcacatgcataagtgcgcctccttttaacacatactcaaacacacaggccaaggatanatccatgaacctcaataaatttcctagtgaaagtgcacatagagaacattatcgttaggaggcttcaacgagtagtggacataatcatatgactagttcctacaacctgtttttcaaaacaaaaatatatgtgcagcttttttttttaaaaaaaaaagaaaaaacatggacattaggactatggaagttcaaccccactcccaaggacattgatgctacggtacgtattagaggtttcagggtactcaccggacgaagtggaagacaaagggagttgaccatatagcctgatttaggtgcactcaactctcgggggtgatgatatttacatgtagctccaaatttgcaatctcctgttctcatataatattgacaatcaggctgccctggccgctcagggaatccatgttcttgttgattgttgcttgattgtccagttgaggaagcatatggaacgtaaggaccaccataagcaattgtagaggaagatccatggtgccccatgccgtacacaggtccagcttgaacattttgttgagctccacctgacactacagggtttaccgaagcctgtataaaatagaagagttaaaaccacaatgagaagactccatcatggcatgtgtcaattattttgtcccatctgattgtttgcttaacacttaaacactggctggttattcaggcagcacatcagtgagtgccttccagctcttgcctaaaagacaataagcacattctacatctttcgtctagattacaaagaacctgcttcacaaatcatgacacaagtatgctgtcgtgcctcatttgttgattcactttgcatttcatagtataagttggctgtcatgtccaatttgtttatcagttttgcatttataggtatgctgtttatttttccacaatagaacatgtaattcaaatcaattaccggataagggctccatccttgcaatgggatcattccagatgagagcatcattggggtgtatgagc

SEQ ID NO: 4399 - DNA, 1501 bp, Oryza sativa
gagtgttatagccaaagattatttgacttgtccgaccatgtatagaacatatgaactttaagacagtaccaaattaggccaatatgctcatatggagattgtgaatagcctacagatgtttttagcgttgatgtttttgtagatatgaacatgttactgagcgctgttttcttctctgattatgttgaatgcagttcactgaaaagcagcatgaatgcttagacgaggatatcgatttgagagctttggagaatggatttgtgagccctccttcccttgctctgtgtgtgcacatgcatgtataagtgtaaagtggctaaccgtatacctctctttacaacctacagatatctgtcactcctctgaatatacacggaaatgtggctcctgaaactggagcacctgcttcagattggctctcggtagctgtgggtctagacaaagcaaaggaagattctgtagttacagcagaagaacaagatgctccagctgtagctgaggaaaaggaagctccttcagcaacctaaaactcgcaagacatgtatacattccctagctgtcgtagttctttctcacctttgtttatcggttaatcggtttgatttgcttgttagtcttttgcagttcatatttgcccactgcaatctttattttttgttcatgttctctgatgattgccagttttttttttatcatgtgaaatgatttagtgctggaaaccctacagtttggatgtaaccacgtagggcaatgcatctacttgatgaaatacttgcctcctgccaccaccactattttttttagtgtggtttgttccagtaaggtgttgtattcagcattggatggatgaatattgatttttttccccatctgggagatggccgacaaagtatcatgacctgatgtaacctgatgcaatcctagcaatttatagtgtatccccttactccagccaggtgtggggggcacacgtacttgttgaggaaggctactaatatatcccggcctcctgtggtaggataagttgtcaatgaggaaatgattatgccaagttgactcgctagttcatccaagtgaatagttcaggaatgttatttaagtttatccactggttgccttagctgtttatcgcacaacaattttatttatggtaatttggaaccatgccattataattttgcaaagtttaagatatatcatcggtatctcaatgacatgtaggacccatatgagtcaatgacatgttggtcagaatgacatatcttaaattttgtaaaattataatggcatggtttcaattttcccttttattatttaacccctacaagaatatagttgttcgctaaagtttctaagtgtcaaacaaggcctacttatgcaagtttggctatttattcgcagatttacaactggtatacgtttctatctgtttggtaccacaaatcaataaaatgcagtaaatcatgcaagactccatttcattgaaccggatgaaaggatg

SEQ ID NO: 4400 - DNA, 1501 bp, Oryza sativa
aaattagcctttccgcacggcgcgggcgggtggatccgacgaggagataggccggcccgcccccaccaccagtccaccacggcacccacccccgcggggcgatctgccgatctatcgctcggcgaggcattggaagtttggaaccgaccgccgcactggctggctacggcttctcacatgagttctgagacggaggcacatgggggtggcaggggtagtgagctagcgccgcgctcccacgacgactgttgcctgggtgggtcgcagcaaccgtgcgtccgcgcgcgcgcgcgtctcccgcccggctacgtacgtgcaacgtgcgcacctcgcacgacgaggagtcgtcgtggtgtggtgggtgtcgaggggcgaggggagcgaccgagcgagctcgtcttgcgtttgtcctcgtgcttggtggtacaacgggaattaatctggacgggcgaaccctaaagcgtttacgcccgcgggttggcccactcgcttagatggacgtggtcaagggaggatccggctgatcctgcaccgtacgagcgtagttacgtactaacgttgtactacaacgagtacctctcccactacattggcctgcatcttcaacacagcaacgtttcactttcatatcatctgattattaagcagttttgatatttcacgaacaaaagttttttggacttctatctttcagttttttttcattggatcatacatcaagatttacattcctttatacctaacttatagctacactcagttactgcatcaaaattagattttacaactactccctccgtctcaaaatatagcaactttgggtggatgggacatatctactcctgtccagattcgtagtactaggatatgtcccaaccagctaaaagttcctatattttagaacagatggagtattttatctctagatttactatttttggtgtatttgtttttttcatttaaaataggctgtaccattgttggtaaaaaaatatgtaaaattttgtaatccatgttaagaaaagattccaccccatactagccacagagttccgtgttcatgcccgcatgttggtcacaataataccagtaaaactattattttggttgatgatagtggatttggtatcggaacgggagaatcacggattcttgccacgctttgctgaggcaagttgggagtagtcgtcgagtagataacgctttcccacgtatctgtgcaggtcaaaacagagacctgcctccctctacacgtaaagcgggccccggtctagaaatccattaactatgcgatggcgcgcccagcccatttcagtccatttcctctctctctctctctctctctctctctcttcccccctcgcgttccaacccctcctctctctcttcccttcattcgtccgtacatctctctctctctctctctctctcctccacgcccaaacacctctccggcgaggcgaagcgaagggaagcccgatggccgcgagctccggcgacg

SEQ ID NO: 4401 - DNA, 1501 bp, Oryza sativa
cgaataaaataactttttttttctggcaggctaggaacaaggaacactggcgatctgtttatgtgactaactttgccaaaccaaattttaggtaaactgggcacataaccacacgttaatcaagctcatgtgaaattgacagttgatatttgagattatatactaatccctctgtcccatttcaagtacaactataaatttccgtgtccaactttaatcattcatcttatttaaaaaacttttataattaatatttttattattatgagatgataaaatatgaatagtattttatatgcgacttatgtttttaattttttaaaaaaattaaataagatgaacggtcaaagttgtacacggaaaattatctctgtattttaaatgggatggaaggagtagataaaattggtatggcaactcacgattataataacgaatcaaacgacatcctagaaagttctggcatataagatttgacctggtaagttaagactatgaatcaaagtatttttgtatccggccaataacacgtattatgagcttggaagccaacctactattccctccatttcatttcaaattatgagttgttttaatcttagtgtcaaactgcttcaattttatcaaaatttatagaaaatgtagtaatattttcaacgcaagacaaatatattatgaaaatatactcaattataaattcaatgaaactaatttggtattataaatattactatatttatctataaacttagttaaatgatttataatctgaaacggagggattagctacaacttgtgaagttttaattctcctatatttttcttctaagattttttattttaaacgtacggttgctgagtcgatctccatttttcctccacttccttagttatgccacttgtttaatgaactaatttatttgactttgtaatatccttttgtctgttcaagttgacgtggctagcagcctagcacattgctgtacctactactcctatgttgttatgaaattcaatatgcattgattacatcgatgacattccaacacacaaggggcgcaatcgaattaccacatccgtacgtttgtgacgacttagtatttgtttgtcactcgatacgggcatggtgataaattatcactcgatacatatttgtttgtcatgacttaaatatacacaatcatataattctctcggccggtactcctacaagattaatcagtttgctggacgctattattaggcatttccatgattaaccaatcgttgccaccttttcaggcctacccacaaattatttaagctatatgtagcttacgcacaaaacacctgtcatccacatacgccaccttaatttagcacgcaccagagaaactaaaccgttcactaactaaacacgactagctagctagcgaacgaaacaaaacaccaggcatttatacgttacgttgcatcttgagcaagccgcacttgcatagccttgggccaaattaattaaccg

SEQ ID NO: 4402 - DNA, 1501 bp, Oryza sativa
aaacaatgccacaaatcatagctcaaattctacacgaatatgaaaaaaaaatttgaatttggttgtgctttttctagggcacctgcgaggcaagtatttttaggtgagaaacataaaagtacttaagcaaatgccaaacagttactgtgctagctataattgaccaatttccatcctacaatagtaagtgtatcctaatatttagatgcgattcatcccatcagggatggaaaacaattgattctattaatgctttccttcagtggcaatgactttttcgtagaatagcttgcttcttaaaccgcgctattgtggtctggttgaattttgctccttttactttgtagccaagggaggaactcaaacggaaagagaaagatcacctacaagtaaggctggcctgaccatagttgtactaaaaaaaatgcacttctatacgcagtattgccaatcaaatttagcaaagaaaaacggtttttctatgtacgagcaactgagcagccggaaggaggtttggtggaacagcgacacccggcctcccaccccacgggttccgagagattctttggcggtaggtgatcccaaccaacgtcgtccaggccccaccccgcagatccaccaaaccacacacggccgtcgctgactcaccgatgcaccatcgccaaccgtactcagcgaccccgcgcgtcagtgggcggatcggaccgacgagccgcgctgctgggtgcactgtgcagcgcccacccccgcgacccacgtgttcccgtccccgcccatgcttgaatctggttacgttagctagatccctcgctccgtccgcggtcgcggtcgctagcgccgcgctgttttggcgactagttccgtcgtaccgggcgtttgccgctgccacaccgaggtgaggtggagtccccgacccccggtggaacggacgccgcaaaaaatgcgtcctcgcgggcgcgctgccgatttcccctgcgcgcacaaattttctgcggggaaagcgataaggctcccgccgcaccggcgtcgcccgcgcgtcgtgcccgcagctctccctctccctcgagtcaccccctgataccgctcctccccgcatgttcccacggtcgccgcgagcgacgtgctcgattctgtggcggggccttatataccggcaccggctcgcctcctcgtccatccaaacgccatccgcttcctccgcctcccgttgcaaataactgtgtcagcgcccacgtcatcaccggtcggaggggaaaaacatctcccgtgttctccacctcactccacaataacttggcggctgctcgtcaccggagaaagaaagaaaaacgcctgtttttttttcccctctctcacaatgcgccgatatatattagccaaccaaatcactccgtaaccgagcacccaaaccacacagccgctcttctcggcaggagtggaggccctcaccgggggacttccatttcctgctcctcgtgttctcccacctccaatctcagga

SEQ ID NO: 4403 - DNA, 1501 bp, Oryza sativa
tcgcgtagggtgttactgtgggcaggaaaactaaagatttaatatgatatgatatgatatgatatgcacgcacagaaaccgtataaaactcttatgtgcatatgggcctaaggcccaaaatggtggttaacgttgggcttcaagcccaaccaaaagccgaggaggactccgagtctccgactaggccttggccatgctgtagtctggacggcggtgcacgttggccaacgtgcccagacgcttcgacaaggtggggcccacaggaacaaatcacgctgtcacgccgatccgggccgtccgatcccgccacgtggacgacggaaaccccctggtctctcgaacatggcggatcaaatcggggacgagacgacgacgcccaaaacaaaaccgctaatctgactggaaacccagatcgccttcttcgctgggggtggggcgacgaaacttgcgcgatctcccctctcctctcctccgctcgaatctgcggtacgcacgcctccctcctcctcctcctcctcctcctcactccttccggccccgatcctatagctcctccgctcgccgcggggatctgcttacgacgaggcccggcacccccgccgccgccggatcgtggtttggcgcttcagacccgtgcgtagcgtgtaggatcaattggcgctccacgttccccgatgttgccgaattttcagagtttgttgggtagattgacccccgctacctccactgtggaggtatgcagagctgcccgtgcgaggagatggggtttgtcgattagtgttctgtcgagagcgctaggactaggatcttcgtagtgttgttgtttaagaagtgagatacagtacaaagctcgtttctgcctcagttcttctagggagcttacatgtaatgatcaatgtgtctgaaacatgattttttttttcagagatgtagggttggtttttggactagaaagggttctggtgaagtacatatgattcgattggcgatgttctatcactgccttttatgtttttactgcttactagaatagtagctcatggagctagatccttctagtatttccagaaaattggaacaacataatctttctagagttaatcttttgctaattcgaatagcaggatagtgtttgcctatttggcatatctactaactatacatttcaccttgtagttgatatcagctttagctttgtcagcatctgattgattttagattggcaaagtatctggcctttgttgctggtaatttaggaaatatagaagtgacagttaatgccatgaatttgttgttttaatttctaatctaaatcgcaaaactaaaagagaagataagtatgcggccagtgaagaaagggtttaatggtgatgcataccccatttatctagggaacttgagaaaacagatacacgacagattgtccatagaatattcttctgagtatattttattgactcaaatacttacctacagcaggcttcttctacaatctcaaaca

SEQ ID NO: 4404 - DNA, 1501 bp, Oryza sativa
acggcggtcaccgggatgtgcgcgccgtcgccgaccttggacacgccgttgacgacgatatcgaacgcgcagagcgtggcgagcgacgcgccgaggctgtgccccgtgcagacgacgccgaggctctcgttcctgtacctcgccaccagctcgcgcacggcggcgagcatctggtcgcgggcgctgtacttggagaaaggggagcgctcgtcggtggagctgtagatgaggtaccaccccttcatgacgcgcgaccggccgcgccccgggtgcccctcggggaggatgtcgtcgtggtcgaccaggtccggcttgagcacgtcgacccactccagcgaccggatggtgccgcgccacgcgacgtagatgacgcgctggcccgaggcggccgctgcggcgtcgttggacacggcgacgtagccgatccagttggactccttgctccacgcctcgcgcgacatcgagtacaccatgctccccgggaacgccgtggcgtcggaggtggcgtagaggtaggcggcgacggagaggtcgccggcggccgggaactgcgtgcggtcgaggagcgtggacctggagaagcggcaggtgccgcagtacttggagtgggagtcggagttgaaggagtcgtaggtgacctggcagaggtcgccgcagagcaggatgaggcggcgcagcgtgaggtcgagcgggtcgaggaggccgtcccagtgggcggagccgagcagctccggccacggccgggagccggccccgacgttgctggacagtaggactccctggctcttgtccatgtgcgtagcagcagcgtgctgagccgccgctcggtaaggtgccggggtctgcggggtgtgtgtgtgtgaatgtgtgaggagaagaagattaggtggagtgtgtgtactgggttgagtgagtcgcgcgggagcggatatagcgagcggagactggacaactggaggagagtgaccgcgtgagtggactggtgggcgcgggagaggtgcagcgtgtgattaaaaccattcgtgtaaactgtacgcggcggcatggcattaacgtcggccggtgacagttcgggcccaaggcccgcatagcgctttcattgcaccgatgtaagtatagtaaaattgagtttactataacaaatgtactgacatggacatatttaaactttgtaaatttgatttaactcatgaatataaaatttgagttcatggttcttcttcttcttactgggcacaaaccgcacatacttctaaaacagtgctactgctttctttggccgagtttagttccaaatttttcttcaaacttccaactttttcatcacatcaaaactttcgtacacagacaaacttccaacttttccgtcacatcgtttcaatttcaaccaaacttacaattttgacgtcaactaaacacaccctttgtctggaatcttttggcgatctttcgagttccgacttccaactatagtactccaaatttcctgcaaaaaaaaaat

SEQ ID NO: 4405 - DNA, 1501 bp, Oryza sativa
agtttattgagctacttttaggtgcattagtccaaggtgtggaagatggatgcttggagaccccccaaaagtataaaatcaaagcagaccggaactcgaggagtgcataggatagtttatttattgcaatcgagtttttaggaaaaaccgtattattaaggggggttccaggtggtgctctaagatatgtcaagtgttcttaggttgaaccaagtgacaagtttccctaggagttatttttgcaaatactccatctgtccaaaaatgcaagtccggaacttcctgtcttccaggtccggaacttcctgtcttgtgaaaaagattttcctaagtgtagtccggaagttcctgtcttccaggtccgaaacttcctgtctagtttccaattcaaaattgtgagtaacggctagatgacgtcacctagccgttatacatatccagctcgtttccagctcgttctttggccattccactttcacttttggaccctagagctgttgctagcctctcccaagtgtttcttgccttctccactcaatcttgagcctaattcttgtgagaaagagagattgagagggagagaagaagatttggagaggtgtgaagattaggatcttgggtgagcacttggaatatctcgtgggctgtcatctcggtgcttattactcttggagatgatctcctagacggttaggtgtcgcccgcgagaatccgttgcatattgtggatgtcccgggtaagtttgtgaaggatctcctctcctccgaaagggaacgaggtaagttaatgaagttcttgtgctgagattctagaggctttccaagtagagcaacctacacttgtggcggatttctagaagttggttgagttcgatcttggtggtcactcaattctagaaatttgcctaggagtgtttgcgattgaaagctgtggatttcctctgggtttttgcacaagtgaggcaagagattaatcgagacctagctctttggagctcctcaacggagagtaggatcgcaagatccgaacttcgggaaaaatcgctcttgtcttttctgtgatgtttctgtggatgtttctgtgatctatcctctgcttagaatacctgtgcttcatcttgtgaagattggcttagtctcttgtttcgaaatttgaatttcatccttgttctgttactcggaagttccgggcctggcagaccggaagttccggtgttccttactaggaagttcagggtctgtttgaattttaccgctgtgatttgtttttaagttttcagggacagcctattcacccccacccccctctaggcttcatcagcacgttcaattggtatcagagccttgtgctcctgattcaagcttcaccgcttggagtgatccgatgtcgcatcaagagggaaacggagagatagatgaaggggacaagggagacgcttccagcaccgaggagattgcatcaaagggggctactattcactttgattacagcaaacttaatg

SEQ ID NO: 4406 - DNA, 1501 bp, Oryza sativa
ctcactccaataggctctccatccaccctctctattctgagtgtatgacactgggaccgtatgtcagtctctcgctccttcctcccccttcactttcctcccaactacatcaccaacggcaggccacgagaagggaaaagccggcggggggcgacgcaggcgaaggggcggcgcggaggggcgacgccggcgaagtcgcggcggtgtcgtaggcgcgggcggcggcctcggcggagtcgcggcggcgtccctcgtaggcgcgggcggcggctaccttcccttcccccgaccccagcccgccgccatcgcctcgaggttggcgacgcaggcggagggccgactcgtcgtcgccgtcgccgttgttgtcgccgttgccgtcgccgccccgctccagatctcggagagtcgaggggaaggcaaagggcggtggagccggaaggatgacggcggcggcggcgccgggaggatggcagcggcggcgacgggaagacgacggcgacgacgctaggcggaatgggcggcgggcaggaagggagccatgatgggatggggaaagagggagagagaggagagaggggtgggacccacatcatatggccagccgtcctggctggccaactttggctagtgaggtgggaaatttagccagctagatggcttggagagccatttggctagtctattggagtagatttttttgtccaaattagctaaaatttaacttagagagccatttggctagtctcttggagatgctctagaggcaaacacaatgttgtatttagaggaggttctataggagagagaagggacaagagctaaccatactcattaattatatggttctactccctccatttcaggttttaaaatgtttttgacttggtcaaagttaaactattttaaatttggccaagtttataaaaaagataatattttgatacaagataaattattataaaaaatatatttaattattaatttaataaaactaatttggtaatttaaatattattatatttgtctataaacttagttaaacttaaagcagtttaactttaaccaaaatcaaaacatcttataacctgaaacagaagaagtagataagagagaatatatctggcccgcatgtcagatgcctacagctatgaagaagaagagatccgtgctaatatcttggttttcgcaagttgaacaacatgttatattcaagaatgagggacctaaagtaaacttattccctgtcaaaatcgtaaaggaagcccacgtccattggcccaatttgtgatcagggtatagaaggaaggggtaaacactagatcccggtcccagccgcccgcgtcgttcctcttcttcctcaaaacgcaatctctccgaattctccccatcatcgccatcgacggcttcccaggccgggggaggaagaactccgtttcggacccggcgtccgtgtccgttatcgtccgtcggtttccgtgtccgattctgttcttctccatat

SEQ ID NO: 4407 - DNA, 1501 bp, Oryza sativa
ttatcttattaaaatatgtttatactccctccgttttacaatgtaagtcatccagtatttcccatatttatattgatgttaataaatctagatagatatatatgtctagatttattaatattaatataaatgtgaaaaatgctagaatgaattacatttagtagctagctaatagcccagctattgtacatgctatagcctgttattatacatgctcttttacgcacgcaacggcgcacgctcttcctcctcttcccctctcctcctcggccacgggcccccctcctcccttgctctctccctcccacgctttccgccgcagcggcggtcgcggagcacagttacgtctcgtgtccagcgcccaagtgtgtggggggtgacttcgggagggggaaggggaagcgggttgcttcggctcgaagcttccgccgccagccatgggcgacgccgccgccgccgccccggcagccgcggcggcggggccgagcagcacgcggggggagccgaaggatccgaggacgatcgcgcgcaagtgagtaccgcccgtcctcctcctcctcctactactaccgcgtccgcgtcttcctcgttagtttttttttttggttattttgtgggggatttttgatgcgtcgtggatggtggtgggtgggacgaagtgaaatcgctgctgtttgttccctcgaaacgacgataccttcgcgtttcgtgattgattcgtggtttttgttactcgggagtattgggaggttttaggtgggttttatggagcgtttttttttttgtgtggagcattttcatgctctattctctgctgtctggtagaccgatctgattcaagcataggtcagcggatcaatcttaaggagacagtgagtccgtaaaatgtttttctattagttaattttaaggttttactactcgtaatttgcaaagcaatccccgtttttattgcctacgattcgatactgtcagatgctttctcaggggaagcggttgcatatctgctaataattggtactactcttcacatattgatggctgttgatgcgcattcaaagcctgtgtttatgtagactgcgccgttactcggtggcaatgcagtgtgccagataatctgtagtagtaatatcatctccatgcataaatgaactacattccctttattataccagattgtgtgccatttgcctcgtttctgcaatggaagcgggagagatctgcctctctttgtcaaaaaaaaaaaaagagaagagaaaagattctgtggcatttgcacccattttagctcccttgcacccatactctggcaggacacggcaccctttcatcgagttcagaatggtgcagcacctggcgaactatcttgttttgttgcatttctttagcttttttaatccattcctccgctttgttcaactatgtgtaatttatgtttttttttgtgagggcgtaatttatagaatagcattgaagattgttttaattttgtgtatttagg

SEQ ID NO: 4408 - DNA, 1501 bp, Oryza sativa
ctcccgcttccattgcagaaacgaggcaaatggcacacaatctggtataataaagggaatgtagttcatttatgcatggagatgatattactactacagattatctggcacactgcattgccaccgagtaacggcgcagtctacataaacacaggctttgaatgcgcatcaacagccatcaatatgtgaagagtagtaccaattattagcagatatgcaaccgcttcccctgagaaagcatctgacagtatcgaatcgtaggcaataaaaacggggattgctttgcaaattacgagtagtaaaaccttaaaattaactaatagaaaaacattttacggactcactgtctccttaagattgatccgctgacctatgcttgaatcagatcggtctaccagacagcagagaatagagcatgaaaatgctccacacaaaaaaaaaaacgctccataaaacccacctaaaacctcccaatactcccgagtaacaaaaaccacgaatcaatcacgaaacgcgaaggtatcgtcgtttcgagggaacaaacagcagcgatttcacttcgtcccacccaccaccatccacgacgcatcaaaaatcccccacaaaataaccaaaaaaaaaaactaacgaggaagacgcggacgcggtagtagtaggaggaggaggaggacgggcggtactcacttgcgcgcgatcgtcctcggatccttcggctccccccgcgtgctgctcggccccgccgccgcggctgccggggcggcggcggcggcgtcgcccatggctggcggcggaagcttcgagccgaagcaacccgcttccccttccccctcccgaagtcaccccccacacacttgggcgctggacacgagacgtaactgtgctccgcgaccgccgctgcggcggaaagcgtgggagggagagagcaagggaggaggggggcccgtggccgaggaggagaggggaagaggaggaagagcgtgcgccgttgcgtgcgtaaaagagcatgtataataacaggctatagcatgtacaatagctgggctattagctagctactaaatgtaattcattctagcatttttcacatttatattaatattaataaatctagacatatatatctatctagatttattaacatcaatataaatatgggaaatactggatgacttacattgtaaaacggagggagtataaacatattttaataagataaaagatgagagagaaaagcagcaggctacagatctatagccagctgcagcacggagtctaagacgtaatgtgtgtataacaggtgggaccggctacagatatgtagctagctgcagtacagactctaagacgtaatgtgtgtataacatgtgggaccaggtattaatagtatagtaagcaactattgtatgaattggctattacattgtctatagatgatttgaagttagtagtgagattagagcaggtacaatagcagactattagccagctacaaatatatttt

SEQ ID NO: 4409 - DNA, 1501 bp, Oryza sativa
ttctcaacttgcaatttgattatgtttaaacggggagtgcatgattggtgttcgcatggttttaaatcagattttataaactgatgctcgtcaagagacgacaaggggccagattagggcagcagagtacgtgcttgcttgaattctgaagcatgtacgaaataaatacgatagaaatttcttaagaaattatgtatttttctgaacctccaataagatcgcgtggttgccagtattgcacgtcgactactacatatctgaattcagaacaatccagaagagatgttactgttgatatttctacgtataaaaaaaacatcaaaatgctttgtatattacgaaaacagagcgagttcccttattgaccagagcaaaaaggttgagcctgattaaacaaagtctatgagcttgcaggatgcgtctcttcccaaatttattcacaccaaagtcctcttcgatgacatcgccctatttgaatcttatcgttgacattgctcattttgctctttagttaatctgggcaaatgattggcggtggtacttcgtgatgtggaacagtgaaactgtttgtcaatctgtgcgctcgaggtacaaccaggtcggttcctttgctgttttattaataaaaggagcataaattagcgccaaaactcaagttttaccacaaaaaaacagtcagttttaataaagattaagcaaacccttgaattgcactctgtaaaatgtttgtttcccctcaaaagctgataaggacggacgccgatgtgaaacgaaacctgctatttcaaccatgtacatatataatcaagaatttcctacacgacttccattttttgtgtgttgactagtttctctccttcctggaggtgttaaaagagttccgattctgtcaaaacttccatacagataaatccaacctgtcaaactaccagctgtttaattattccttttcccattttgttatggtacacaaaggcacataaccatttacacggagcagaacagaataggatatgtattaaaaaaacagaatggagaaaaatcctgagtcacaagcacgaaaaatgaaggcgagattaattcgaaaccatacacatcatcatccacatctcgtcgtttgtctcacaggacatgacacagggagcgaaaaccacatcattaatcgcggcctacagctacacatccagattctcccgggatccccgaaacggctcccaccccgcaaccgccgcaagccgacccagccaaaggagatccccctccaccacggaagattcactgcgcggtgggccccgccgccaaaaaccaaaacgacgaaaccattccgcgtcatctctcccgcacggcgagcgagcgagcgagcgacctgacctcctcctcctataaatccggcgccagcgtttctccccaacctcccacgcccaatcctgccgccgtttcagcagctctagtttgaacgagggatcgtagagaggagggtttggtgagggagggaggaaga

SEQ ID NO: 4410 - DNA, 1501 bp, Oryza sativa
ccaaagcattccatccagttgtgaaggttgctcgcttatccttgaatttcatcagtttcatccgcatccaaccatcgccggcctcccgccgatgcagcgccgccgtcgcatcgaggccgttgccctccgaccctgacgaatcgccaccgccaccgatgcagcacagccgtcgcatccagacagccatgcccgccatcgccgacgaatcgccgccgccgccaatgcagcgcagccgtcgcatccagactgccgcgcccgccgccgttgacgattcgccggggctacccgatctaggccaccatcgggtcgccagtccaacctactcccgccgccatctatcgccgccatgcattctagggtttctttctctcgctgctctagcccgtcgaatacgcggcttctgttctctcgccaaacagagaagtaaacagagaaggaagggatgctgcgtgcgtgatgcggaatagacgcgaaagtacataactaccctcccacccacggtaccacttcaaggcagaggtgtggtaccatgaggtacagatgatttttgaccgtccgatgagacctgatcaacggtcacgatttggtactgcacagcctcaaggacagtaaaaatgctcaaatcctaatgacggcttcagtgtttcgccacgtcgtcttcgtcctctaacatcagtacatcaacccgactagctcgatctccataagactgcactgcacgtgaagcttatagagcacagcaactatgcggcgtccatgaaccgggcctagctcgagctcgtctcgtcgtcgtcctcaaggagctcttcggctaagccgatgatgtggctgaagccttcctctgtcaacgcgtcgtcctcatcgctgcccacctcctcttcggtctcgacgacgtcgtcaccgctgtggcgagacgcgagcgcgcgcgcggccgcctcctctccctggagggcgttcactctggcgcagaagctggcgacgtcctcctccgcctcgacggcagggccggccctgacgggggacgagcagtgcggccgctccgggcccccgtatcgtaggggccccaccccacccccaggccaccccctgccgtggttggcccaacaggccatgcagacgatgagacgctgaggcggaacagaagacgcgagggtttccgattgacgcgcgttagccgccgcccacgtcctcacgctcacgcaaaatcacatcgcgcattcatcccgcagccacagccgcagaccgcatcggcgccgcgttgtcgtccgtcgcccacgccgacgcatcagccatccacggcgggcttcctcttccgcgcgaggcgctgaggcacagccatcaggtgagcagcagcaacacgccaacaccattggtccattgccaatttgccatcgccttatgaaaaattgaaagattgtaactgattctatatgtaatctgttggctgttgccatgtaagtatgtactgatgttcagtagccgtgcattttgctgtcctgtg

SEQ ID NO: 4411 - DNA, 655 bp, Oryza sativa
cggcggagctcggggcgaggatacgatggcaccggcgctgggaggcgggaggcggcgacggcgacaatggtttgaggggcgcggcggcggagctcggggcggggatggcgatggcggcggcggctcgcgacgacgaccccgacgacgacgacggcgccccgacgacctcgcgaggagtacagttgctgcgggccggtttggcgaggcgttttggctggccaaatctagccagccagccagcgattttggccaggcttggccatccggttgaccagtctgttggacctcgtttttgtggttgaatggctaaaatttggcttggagaggctagtagagaggccgttgaagatgctctaagaaagtagcgaatagcaaagtaaggagtgagctggtcacaagcgtccgacgtttttttatctaattggacgttccaactggagcattttcggagttttgccctctcgttggtggggtgcagcaatcgtgtgataaagatatgaaaagaagaggcgaatgtcatggcaagcacacaagaaaggatcccaacgggccgcgccgcgctcctctcgctccctcgcctccgcggagctcgattcctaaaccctacctcgccgcgccccgccgccgccgcgggccggggagatcgccctcgcca

SEQ ID NO: 4412 - DNA, 1501 bp, Oryza sativa
agtaataaattttgttttcatagtatagaaaatcctattttaaaaaaaaaccgttaattttttctactgatatatgtatatattttttaggtcttatacctttttcttattactcgtgcatacgtgtaagtttttcaagtgtaggtacgtatttatcgtaggtatgtactttatggatagtactgtacgtacgatcacgatcacgatgccatcggcaggtttagtttttttttttttcccgtcgtatgtatatacgccacagtaagtttttccggtatatatattgaaaggaagtattagatttaatctaatggcttaaaataatgggtccaccaatttaaatgaaaattgatgatgagattataaactgccacgtggcaacctaggagtgtttgtaggagcgccacatggcggcttaggaatgtttataggaagattaatggatttttagtatataatagatagatagatagattgatagatagatagatagatatagctactatttctaaatctcttatctcaaccaatatttacaacaatcttttatttaattttttcatatattttatcaacccaaccgatcactatcatttctcttttagtttcacgtcccttcttaatcctgtgaaaaacatcagaagtgcttgtgttttttatatgggaatcatttttcaaccttgatttctggaccgtttatgaatacaagtagtatatgattacagtatatgtcagggttatggataccacatatctaatagtagttgactaaatctcgacaggacccactacataccatgttctatacagaagcaatcttcggatataggaagagttccggataaggaaagacaaccagagttctacgtgaaaacgacaaggactactcggattgtatccatattggtttccctagttctacttgtataagaggacacctatgggtataaatacaagcccccctaggaggaggagaggggggagaatgaacacccaacataatcgacatagaagccacaacatagaagcctacatacgctaagacacgccgccggatatcgacttcagggataaacacggctagtaccctacggtgtctccggatactgtcaggagagatgaaagcgctatctctgatctcgccgggcacggattcgaggagaaaggctaccctgttgtcgactacgggtcagatcgtcagaccgctatgtcgacaacagttagataggctaccctaaatattatactggtatgattatcatgaataagagcaatactggcttcagccaacaggatatagggttattacctgacaattcaggggcccgaatctgtataaaaatcctcgcctccgtctctttacctcagtctcgcgtatatcctagtaccaacgatccctataccatgcaaataccgtagtcgagacatcaaacgtcgacagtggcgcgccaggtagggggattttggtgcttcaggatttcgacaagatgggtttaagaga

SEQ ID NO: 4413 - DNA, 1074 bp, Oryza sativa
acaatttcaaccaatggttttgaatcgtgatttatacggttccagggcagtgtgcccaaaaggcggttagtaacatcacaacagccctcaatttttcattccacagccaccacgattttatatacacatgagcttatcatttgaccaccaaaaaacatgatagcgccatgacagcccctgatttgaaaaacactggttgcaagtttcaacatcttgtttagaaagctgtgtgccaaacatgcttcttagttctcagccacaccgcaagcagaaacgtgcacgcacgcacgcacgcactggtaacagagtgtcatcatcttgtcccaaaaatcactacgtatgcgtttctgaactttgactgatcaaggttcattcactttgggcagagcctggattgagctgatgctgaaagtatctggcagaacattcccagcctgaaccggaactgaagaaaaggatcagaggaacatggcctgccggaatccggcaccgatcgccacccatgtgaaggagaagaaggctggccgcatcgccgggtggacgcatgtcgccgcagcccgcatgtgttgggtgcagggatttagctttgcgaagatttcaaagtaaaaaccgctcctcaccggttttccaaaatctgataaaaaacccggtaaaaaccaatgactttgggttgacgcccgtgcgaaaaccgtctaataccaatcggttttcataaaccaagacctagcggtttcacgaaagtcgatcggttctcgctaaattccatcggttgggtgcataaaaaaaaaacagaaggcgaaacagccatcagcagggaaacctgattaactgacagctccaccccgttttgctattccaggggggccctctgcaacaacacaaggtttgcctccacctctcttgcatttcctattctctcaaatactaggacgcgcaccccgcgcgccattccgcttccccctcccctcctctcgctctcgcttgcggccgcgcgcgcgggcccccggtggtgcgagcagtcgtcgtcgtcgtcgtcatcgtcttcgtccggggccaggtggtcggggggcgagg

SEQ ID NO: 4414 - DNA, 1501 bp, Oryza sativa
cccattgccgaaaactcactggacgtccgttttcccgtacaccggtgagaccttcctcccttccttccctctccggccggccatgtcgccgccccgtcctccctaacgcctcccctcccatcccagggtgcagctgccgctcatccgcctcttcccgagcgccgcccgccgtcggagacgccgtttcgccgcctcccgtgccaccgccggctgcttccccggtgtcatctcgtcgtcgccgccctcggggagaacccttcctccctctgtctccccttcaccggccgccttgcgacgcgccaccactgccggtggccgtccggccggttcatcaccaccgcgccgctgccggctatgctgggcagccggttgccgcctccccttgctgcgccgcgccaccgccgcccgcatgcgccgctgctccccgcgccatcgccggccgtcgtcgccggtggccgcgctgccgcgcgccgtcgctcggtcgggccggcttgagccgtgcctgtgtcccggctgcgccgccccgtggccgcccgatcggctaggaccgatccgggccgtcggttcccgtggaccggcagtggaccgcctcggtggtcccggtccacggtggaccggcgcccttgtgtcgctgaccggtggggcccgcttgccggcgccgcccctcccccttgatgacgtcagcgcgtcccttttcctttcagaaaataattaataattgcgcaataaatcagtaataattctagaaattcatttaaatggctcgaaacttctaaaattcatatctaattcatatgaactccgaattgagccattcaacttgcaaaattcatctaaaattgagctctacatgtttgtttagtttttatgtactttttcgttggtttttattagagtttttcctcgttttgcgtgccagtgtgtagaatccgtcgttttgaaagttcgcggtcgcaaggataagagttcggaagattgtttgaagaagcaatgcaagtcacacattccccttgagcattttgatcctaatttacaaatattttatcgtttgcaaataaaattgcatgtcttgctaattacatgggatccgggtattacgtgccatgtttacttgatatctgtactttgtcaacattgggtaataaatcgactagctcatgttacttatgtgacctagctagaactttatgcttagccatgcttaattaccactagctcagttgatgcgataattacagtattagacctttttagtatcagaatgagctgcgtgctcgagacatctggccatgcttcatggtcgtaattatccaactaaaatgcgactgaatggtgggctgtaggtgtatggttttgctagtcgcacccatggcaattaaggaccggttcgcgggatgccctggaagaacttatcgtacataccacaagccagcgtgggcaacggctgggcttgtagtgtagctttcctctagctgacgcatccaggcaagggtgggcgtga

SEQ ID NO: 4415 - DNA, 1501 bp, Oryza sativa
gcagggcccaggtcggaaagaatatatacgggtgaactttttttttccaaagacaggcgagaaaaagaaactctcgtaacacgcgcgcaccttattcttacgagcgactttgaatgtatcatgtagagtactcactaaaattcagaccatctttgagatctgtttgtactaacgagtattctcagccctagccggattacttaatttctatccaatcgtgacggggttataataaattctaaagagggtgagatctatttttttttaataatggaatataacgtcctggcctctgctcaggagagttacagtttattgttacaatctaacactctaaaatgagtttagttcaaataagaaaaaaaaacaccacacaaatataaaaattaaccaatataagataaggagaacacattattgaagtctatttgtgaatctccatctataattggcaaaagttgcataaccgttgtctcaagcttacgacgtgcaacttttaagaactcttcgagttcatcacacctttgtagttgtgcccaaaaccagagcaaatatgttgccctgaaaattatctgcatatataaaatagatgatgatttgtcagaaaccatatcattcctactcaaccacaaagcccaacatattgcataagctcccactaatataagtttactctttttattgttcaccccaacagccgcccataaaaaatatgagatatgctaataggaaggtataaaagataactgaactgctctccatataaactttgcataatgacaatccataaaaagatgttgaattatctcattttccatacagaaaacaacatcaaaataaagtgctaaaataaattacttcaaatcaatgaatcatgatttacaacaaaatacctcaactggtcacattagtgttgtacatgacttcagttccatcgttttgcccataagccgttatgcttattggcgggaaaaaaatgtgcataaaactttttatatttgtgttttagaaattaaattaaaataaagaaacattaaaatcaactaactgtaaaattttgaattttgattgtgactagtaagttgaaacgcaaaagatgactcatggttgacatggtggacattcaccaaacatattaccccttggtttttcttttggtccgagcataaagtatatggtggttttcgagttaatttaatttcaaaaccttttaagaaaacataattttaaatttacaattcaatccagtgttctctattttcttagcaaggatttttcattcaaaataaatacatcgacaacgatttcgatggattgttgtgaagtatcaggcaaagatttcatcagaatataccccgacaatgacatcagaaacagcatcttccacaagcacagtatcttcctgctactttagatcttttttttttcagaaaaaatgcatcaaaaactcaaacctgtggcccaaaaatgtgacaaaaaaagtttcaaaaagaaaagaaaa

SEQ ID NO: 4416 - DNA, 1501 bp, Oryza sativa; identical to SEQ ID NO: 2820

SEQ ID NO: 4417 - DNA, 1501 bp, Oryza sativa
cggcctcgtcgtcgctgcctgctcagtggctccccggcgcagcggctcccccatggctcgggacctccacgacggtgaggtggcgaggaggaagttgggtgaggagcagcagaagcctcccgctcacccctccttcctcctctgtgatgttggattatctcctatcctggaattttttttttagctgatttcgattggattgggttagatttgtgatgatttgggattggtcgtgggatcttcagagcggatgaatcagagggaggaggtgcgcaatgcatggactaagacggatttgtgcggtttttattattcttctcgttcgatttcgcttcctctacgttctatgtttggttagattttgtattcgattgaatttgtgtaatatcgatgtgtggcgcgtgtgggaacggagggctcgattccgattgggattgtgggggtgggggtgggggggaggggattgcgatggacggatgaaaaggcgaacgttcgaggtgacgaacggaaaaatccaaatcttttaattagttaagatttaggttacatgcaagagggttggaaacactttacctttttctagaatataaatagaatagtatatactcctatatcgtatcaatagtaggatattaaaagtttcattattaggctctgttcgtttcctggagttcccaactcccccatctcattttccgcgcgcacgcttttcaaactgctaaacggtgtgttttttgcaaaaagtttatatacgaaagttgcttaaaaaattatattgatccatttttgaaaaaaaaattagcaaataattaattaatcacgtgctaatggactgcttcgttttccgtaccggagggatgggttcccaactcaaccaaaagaacagagccttagtgtttttcacgtattttggtaaaataataggacgccctgtaccaccctatccttcaaatctgtattagcgcactctgcataataattgaggccatatttctcatagtagcttgcttatatgaaagggtacctggaggtaaatctatatagaattttcatgtagtggcggagccaaaaataagatttttgagcccagacaaactttaatataactagtatttgagataaaaatttcaacgtcaatttacttatcaatctaaagttgtgttctcaccaacgagcctgggcggccacccggactagccactgttttcatgtgggataaacactcggacctaacggtttaaaccggaaccggaacataaattaacatgctgaggtattacacgtcccttgaacagatcaaagttatatgtacatgcaccatttaaatacgtactggttttcaaatacatagcttcctaaaatccgtagtcaaaccttaaaatcttgaaacattaatatgcaaaatccattatactgaatggtcttaatagatttatcatgaaaaatgataaggactaaattaaacctgtccattaaagatgtgtccttgcgaaagggcctg

SEQ ID NO: 4418 - DNA, 1501 bp, Oryza sativa
aggtcaaacgaaagagacacgagtcgtcgtctcgacgtccacgccaatttccggcgctggccaatcgcggcgcggcacgcacccacccacgtcttccccaccatgcttttctaatccccaccaaaaatattaaacaaaaccgcagcaactttagattgaaaaaaacgttgattattcagacatcgaagactagttgttgttgtggagtagtagtaatactagtaaaagattattactaattgctcattcagagtacccgcaatggtaaaataatatgctatctatagaactacatctcagcaatagactagattaatagtaaaccacttcaatgatatgtctacatgggtatctatagctctctaatccattgtctctttttctctatagactatttccaggttaatagatagttttgctctctctcttcatttaatctcttctaagtaggaaaatatgctgacatggatctcttgtatagagcctataaataaccattgtgagtgcccttaacacaacttcgcttcgtcgaaccgaagtccaaccaaacaatttcaacttcatctaaaaaattaaagctagctaaaatactctcacaaaattaactagagagatgtacttaggtttaaacctacaatagaaagttataaatccacttaatacatagagaatatacaaaaaatataaagaatgatggttctcgtacaaaagctaacttaatacgtgctctaaaaccaatatattaatatataagtgagagagaaggatatgagatgataaattgaagctaaccttattgtaaatatattatatatacgttaactttaaaatatgctaatagctaacagtgagctgtactattaaactcgcttcttaaacagattcacaactttatttgaaacccaaatattagtaaaattaaatttagatgtctgagtctctaccgaacgagctccaagtccaacggagacacacacgttgcagtaagggtgggccccacgggcgtccggaccgtgcgtcgcgtgcgtcgccgtcgaacacggcacagcgacgcgcgtgtccaatggacggtcgccactgcattattccgggtgcgaatgcgattagattaggatttgatctcgcgattagattgggcgtgtactcgtggtagtagcattactactagtacgtggcgacgacgaatgacagcgatatatttttctttttctcttttgcgttggtggtagcttcgtcacgtgtccgggcctgggtgggtggtcgccgtttggtgtggacgcgaaggacacgtgtcgcgtggcggtgcgcggcggggaggcgggactcgtggacggcccggatgcggccgaacccaccacctgtcgcggcatcgacgactgatcgcgacgcgaggcgtcctttatattgcggccccgctttcgtctccgcctctctcattctctctctcgttgctcctgagatcgtctcgtctcgtggtggtggtggtggccattgccggagc

SEQ ID NO: 4419 - DNA, 1501 bp, Oryza sativa
tgatcccggttttgtcctacgtagctgctgagtcagcgtgggacccacgtgggccccacatgtcatcgtgccacgtcagcatactctctcttttcccctcttctcatctctctcactctatcttctcaggacggagggggaaggagcggaggccaccagcaagggcggcgtaggccaccggcgaagaagcagccgaggccatcggcgagggcggcgtaggcggaggtgaggctgcgcatggcgtcgggggcctcctagtagaggaactcgaggagggcgatgaggcagaagccctcggcgagaccgttggacaccgattgccggtgccgcacggcctctcactgccgtcctcccacgccgccaccgtcgccgggggaggagctgagcgcgaccgtcgggggaggagcagggtgcggccatcgggggcagagtagtgcgcagccggcgacatggagcttggcgcgggcggcatggttaccaggagaggagctgggtggcggcgggtgagggtgggcgcgggaggccgtcgccgcggttctcgccctctcccctgccccaccgtcttagggtcagagaggcccaggaggtgggagaaagaggaggacgtcggcgtcggcgggggcagcgccgttggagaaggggagggtgtcgccgcgcaggcgagctcgagggtgttgatggcgatgtcgtggccgtggttgagcttgatggcaccgtcgatggagccgccggcgtaggtctggcagaagctgtagaggccgtcgaagacgggctagtcctcgccgacattgaagcgcttgagcgcccgaatctggtcctactgggtctccggcacacccgccgcttcgccccgttgacgccggtcccgcctcgccccaccggcctcctcacatacactcgccttcctgccaccgtcgcagtgcccgggtctacgccagccatggcgaactgggcagagacggcgcggccgtcgacgacgacgacgtcgtcgcggcccacctcacggagcacgtggcgggcggtggcgcgggacccgcgccccactggcctcctccccctaacgtcggctagtctacgccaccctcgccagtggcctccgctccttcccccgccgccctgagaagagagagtgagagagatgagaagaggggaaaatagagagtaggctgatgtggcacgatgacatgtggggcccacgtgggtcccacgctgactcagcagctacgtaggacaaaaccgggatcaaaaccgccaagagacctattctgaccggttttgtatagttaagggaccctcggtatctggttttacggttcgaggacgttcttgtatcccgatttcaagttgagggaccttcggtgtacgttttcctttaagctacgatgggaggccggaggcccagttaattaagcacaacttggcatgggccagggcccgtttagcccaacacagaacatggataaatacaccacccattcgccaaagagcaaggtaggcaagg

SEQ ID NO: 4420 - DNA, 1501 bp, Oryza sativa
gaattgaattaatttctaacaaaaccttgaaaaattcaaagttgtttgcatcgtttttttactctcttcatgtcaaaatacatgactggtccctaaacgtgtggagtggtgtcacttagatccatgagcttaaaaattacgcgtgtagatccatgaaattggtttagtgtatcaccctcggttcaatcgccttttgaccgcggctgaccgccagcatgacgcgctacgtagacaacatttttgcactttatccccctttgtatatattttcttacataatttgcccttatcagtgcattccaaacagaacctcccaaatatctctgaatcggctagggttttgacgacgaggttagcaacgggaggtagcgcagtgtggatcaattagtggggggaggcggggtagtgccgcttgcacacttgccatccccatggcttctccaaactcgtcctcgtcttatagtcgccagaagaaggtaccgttgataaagtgctcgttgtgcaagaagaggaccattgtggagtgcacaacaatgacgattattaattagggcatcattttctgtatgtgcaaggagaggaatgagagggaggaaggatttggggatatttttagggggattcgggtgtcattgtagctaaagagggtatatgtggcgcactgtgatgcggaggggtctaagcgcaaaagtattgcctgcgtggcacgtcacctaagcagttagctgtgtcaaagagcgattggaccgggagtggtaaattaaacaaagttcacggatctaaatgtataattttcaatttcacggacctaaatgacaccacccccacaagtttagggactgatcatttatgttacttataaaagaactttggaaattcaacaagccccgcccttaaataattaacttataccttgggtcctacaatcttagtgatatatatagtagtatttggatataatttatataacatgtgcaatcagatttaaacccctaatttatactccaggatggattagtcccaacattcagccaccaattcctaattgtttaataagggacataatgaacttttatctcactgcttaattggtcataaaattgacaaaagtccttatattttgagagatataaggagtagtacttaaattgagaaatcatgtcatctagacattcatttactcaaatttggagagctggattccgcgagaagcactcagcgaatacacaattgatgagaacctagataagttggccaactttagatcaccaatcatttaatggattatgtagctatctactcagaagtcgaaatatctagactattcaggggagcgagaaaatgtctagctacacttgttaaagttttctccaaagatgcccttattaaaatatcaacatgtgtatatataatttctttgaaaatatttatgtaagtactccctctatcaaaaacaaagtcaacttttacacatgaatctagatatagtctgtgtctaaat

SEQ ID NO: 4421 - DNA, 1501 bp, Oryza sativa
acctcaggtgctactgaggctcttgtaaccattaggctacaagccctttcgcacacggagtcctttcaaaaccacataaattcaaaaaattgtcagatagtttaaattttggtttaattttattaacttctgttggcttactaagcggatcatcaactctatccatctttgaaacctccaagtttcacaagcggttatgtgaaccctatatataacctgagagcacccgcaatggtaaagtaaggtgctctctataaaatatatacatctcaacaatagactagactaatagtaaatcatcccaatagtatgtctacatggatatctatagctctctcatccattacctcgtttttctctatagactatctccaagttattagatagttttactctctctctcttcatttaatctctttcaagtaggaaaatatactgatatggatatcttatagagagtctatagataactattgtggatgccctgatattttataatatactccagctaccacctacgactggagtgtagaaccatggtgatgcacagacgcactgtactagaggtgtacacgcatgtttgcgataataccactacttgtccgtaccggtgtactacactaccgatagtatacgtactagtatttgtgatttgtgcagcagcaattattgtgcccatttgccacagatgctccaatactgctagtagtagtaagtagtagtatacgctagtggcagtatatctgtaccatcatcagttgtgtattccatggctataaggtatacgtagttactccgtatctcttttcccaccggaactagaagctgaggtagctcccaactggctgacagaaatggacccaggtgggccccagcggcagaggcccgcgtaggcagacggcgcgagcgcgtgtagcgcgcgcgagtgagctgtacgcctgtacagctggacgagtcaacgggtcaaacccaccgcaaaagtcccccgagtctctccaacccgtgtacgtacgtacgcgggcgattaaattagcggcgtggttaattaatcctaatcgcatgattatccctaattaaccacgatgggggttaatcgcctaaacttttggcttttaaagaagaagaagggaaaaaaaaacttcaaaaaaggcgtaaactaatctccccggttgcggcgttctcccccacatggtcctttctttccaagtcgtccagcccagcctacccgcctctttcttctttcttattcttactcctcgcgctcctcccgtctatataaaccccgacacctccctccccgtctcccgccagtttcatcgcagcacacatccatccatccatccatctatccagagagcacagcaacggcgcatatatagtacccctctaccaaagcacaacaaccagaatctcctgagctcgatctagctactagcttgatctatccgatcaatcgactggcccgcgaggatcgatcgagactcgaaagggagggattttg

SEQ ID NO: 4422 - DNA, 1154 bp, Oryza sativa
ttggataaatcctagttttcctgtgttttccatttgccattaaatgaaaatactttgtattagagtcaccgtccataatatccttagtcttagcccgctgataccatttaatttcttcttcccttaagatcgcagataacctattccttaaaaaccatctaagatcaacctcctcttgagacaaaacaacagtctcagcctttttatctagcgcatccaacttatttaagatctgctttttctcttttttgcataaaccactagtgtgtttagcccagcccctaagatgttgtcttaagcggcgaatttttgcctgccaacgctccataggagtattgccttcatcaacccagaccaaacctcctttaccatatccacaaaaccatcacgtaacagccaaccaagttcaaactgaaaacaatgttgagcgtcactaaaagaggaagattttgtatttagaagcaaaggaacgtgatctgataaatctctgtttagagcaacaacagaagataaaggatacttttgctcccattccgttgatactaacactctatccaatttctcataggttgggtttgctagattatttgcccaagtaaagttcctaccagacaactgtatctccctaaggcacaacccatcaataacagcattaaacaaaaagggccatctatcatcataattggtattactcttatcattaggactacgaagaatattaaaatcaccaccaataagaattggtatagtctcatgactgcacatgttaactaattcttcaagggattgatctttaagctcattctgggccgggcccatcaccaaaacttaagcccatttaaaaatatcaagcctaattccgtaaagaaaattggatttaaaaatccccctcatcaatcaaaccaatgtcaaaatttagaagattaattcctaaagaagaccaccagatctgcctctaggagattacagtgccacaaaaaatctttactaacacaaagattattcagagcagatgtagaaaattccttcttaaccgtctcagataaaacaataaaatcaagttgatgttctttggttaaatcagaaacaaacttatgtttttttcgggtccttgaacccgtcacaattccaaaaaaacttctcccactattaga

SEQ ID NO: 4423 - DNA, 540 bp, Oryza sativa
ttgttcaagattttattcctgtccaaaaaaaaggcaaaagaaggctactaatgaacattgtgaaactagcattattcctgttcctagtgaatcttcagcccaaaatccttgcttagctccaactatgtcatacccaccaaccaaaagctgccaaagtgggaaaaaaaggacatactattacttcatcagattcaattaggtattttggttttcagatttcattttcactgatcattttgttttttagttacattttcctttcaaagattattgtcttacatttatgtgaatcttcagatcaagatcagtgacaggatccaaccaaccggaacctttgagtgtgctgatgccactaccagcactagcacctgacaagtgcaaggccaaggccaaacccaagacaaagactaaagccaaggtagccactaagaaaaacaaggaagatagcactgatgctacacctttggctcaaatcaagcgaaaaaaagttgttcccgtgactccagatagtccagcaatggggacaagaagcaaaaagaa

SEQ ID NO: 4424 - DNA, 1501 bp, Oryza sativa
tttagccagcgcgagcgactttggccagccaggctgttggagtgcaaatttgagccaaaattgctataatataacttggaaagtgggataaggaggctgttaaagatgctcttagcggatctcaatctaccttagcagattgggaaagaaccaccactccaccagtaggcagtagcagaagaattatctgcgagtttgttttctacaagaagaataaacaaaacctgcagggcggcgatggtttatcttctcttctctgcatagaagggagtggttcccccacccacgtaactgctactagaaaattgatcgttcgccctgtccttccagggaaaaaaaacgaacagtttctctagaaaaaccagccaatgttttttagaaactactccctctgtttcacaatgtaagtcattctaacattttctatattcataataataataatgttaatgaatatatatatatatatatatatatatatatatagattcattaacatcaatataaatacattgtgaaacggagagagtaaaaactaactgcctacttaaaaacacggcaaaccggtttgtttttataccattagatgacatgggtaatttgctagttactgaagaagtattactactgcatgaaaactatcgtgcatcgtatggtacaaatgcaaacttaaacatagtagactagccaacttgagggtttgtttgtcacaactctagttttagctccatctcttagagcatctccaacagcttctctaaaatagactctccaaacatccatatagccagctacccatttgatttagcaagttaaagttgttgctcgcttcaacagcctccctatctaccctctccattacaagtctataaccaatgggacccatatgtcagtctctataaccttcttcctcctcttccaccccattttccccactcatacataaaccttcctcctcctactggacttgcctctgatgctgcggcgacgggtgtgcgggacgggcttcagcgagcagcggcgaggcgacaggcagcggcgagcggaggccgcggttgcaacgagcagaggcggcgcgctgcgccaagcggatgccggcggctgcggcgagcggcggggggggggggggggggggggcacccctagcggaggccgcggttgcgacgagcggaggcggcgcgctatgccgagcggatgccgacggctgcggcgagcggcggggcgggccacgccgagcggaggccgcggttgcgacctgcagaggcggccgaatgaagacttctccttctcatcaccgtcccagcagttccaccactcgcacggcgtgccgatgcagcagcagcagcgagcgtcgtccacgcctatggggacgccgccgacgccgccgctgtcgacttcgtccaccgcggcgggcgctgggcacgacctgttcgaggcggcggagggcagtgctaaagagagagagagtgaggctactcggagggacggcggtgctgcaacg

SEQ ID NO: 4425 - DNA, 1501 bp, Oryza sativa; identical to SEQ ID NO: 2821

SEQ ID NO: 4426 - DNA, 1501 bp, Oryza sativa
aaactttttactcaaatttcgaaatccttccactacaaatttagaactttcaactattttaaaagttgtaactaaactattttaaaagttgtaactaaattatgtatatatggtttttctttaaaatagtgctaatgatggcaattaatgctaattacttaattcgtgggtgtgcctgagcactggggagtcgagacggaaaaagtgtgcgctacttctcctccttgcacgtctgcacgaactaggcacccccagataactaaattccgatgctatctctatcgataatcacaaaacaagctagatattatagttctagatattacttaatagatcgaactcaactgatgcagcattaagcataaagagaaacataagatctaagcaaattgatgaaaacctctatgagatggtaaatatactatataatctagatcaacgttgatatttagccctatcagctatcctccaatgatagatgttgaccgatctaaggttagatagaaatattgataaagattatatagcacatacgataactcgacgattcacataaacaagattagagtgtcatgaagatgtaagcactaatcctgagaacacaagccgtcatgacaagttttacctcttgtcggagatcgaattaacccgatgcagcccaactcgaaagcaagaactcgtccaaacaatgaaagtaggaaaaggtggcgatgcgccgaaagtgttatacatggtcttgggtcatatttatacccaaaatacataatgtatccttgccggacacgactctaaatctgttacaaccgttaagatacgaacaagtcttttaggcgaactcttgccgataaatatctctaaggaaactattcaaaatatcctaattaatagatacaattgcctatccttgagcttattcaaaatatcctaattaatagatacaattgcctatccttgagcttatcctaatcatggcaatacttatgcagcacgttgatcaatcccgaagatgattttagaaccaccttagcgaaatcgattacatcggctattttctatccaatccaatatcagccgatgtaatcgctagccgatgccttccgtagccaatgcttactctgtttcctccaccaaatccacttcgatctcagcttcgaatttgatgcatgatctaccaaatttggtcttcaacaggtccccatagcttctccaagtgcaggtgcggaggataacatgcatactattttgtgcagaattcgtcagaagtagaaaacttcaattattttatgcagaaagtttcacagtgagtagaaaatgattcaatttcgagtcaaattaatgtatgttcctctgtatcttcttacactccccctgttcccaactcctctttctcgtttttcgtgcgcacgcttttcaaactgctattttggtgcgttttttgcaaaaagtttctatacgaaagttgtttaaaaaatcatattgttccatttttgaaaaaaataag

SEQ ID NO: 4427 - DNA, 1501 bp, Oryza sativa
agaacgacgggaacggtgacaccaacatcaaccccaacaccaacaccgcctctggatcccgggtatgtcactctattcactttagtgttaaacatgttactctatcatctttttattcacatctcatgtttagtattttgtttttctagtttaaaatacttccaacatatgaattatgactatacttccaacaggtactatgagcggagagcaagatgcttagaaagatgaacatccagcttggcccaaaaactggcaaggcatgttttcatgtttcttgcggggattaaacttttcatataaatcggtgcaaaaacttagttccgatcaaaaatttgaaaaatgacctaaaaagagaatttcttggtccacatgaatatgacgaaacaatgaaccatagccgaagtttcttatatccattccttcttcctctcatcacttcctagtttcctactatgtgccactaacaagaagacatgaacactataagcgtccaccaaaagagaaacaaatagaagagccttcagcccttcgtgctgccaacgcttttaacccatagtggatatatgtcgtcccagatcgattgatcgagtaacgaacagcaagtagccaagctgacattccccggtttcagagttcagaccgacgacgatgccaaaacgacgtgtgcatcaattactgcatttcgcccatgtcagctcagctcgatccgatccattcatgccacaagtcagagcggcatctgaacccaacaagtcagaatttgttgcgtcgcccaagctacacagttgctcataaatacacgcagagtcgcacagggaatgagatttgagatatcatcgatctggtagttgcttccagtctctactctctactccttgctattgcattccaccagttcagttcggcacgacttatcgacgacaagatatatggttaatccggcgacgatgatttcacctataaatacagggcagccaccgtgcatgatagatcatcgctagctgcagtcagtcaccacgtcaagccagtggacacgacaggcaagacgagagagctagcatggctttagctcacgaggtcgctttcgaggtgaacctgatcgaggacgacggcggcctcgccggctgggcgccggtgggcacgcgcacggcgctgtcctcgcacgccgagcgcgacacggccatgctgatctcgggcgccgtgtcggccgcggagccgaatgagcgtattagacgatcaagcggacggtacatcgtcgcgtcgcgccgcgccgacgaggaggacgggctgcggcgcgcggttccggcgggcgcgctcgtgccacgggtcacgtaccgtgtcgtcgggtgggtcagcgtgcagggccagggcgacgggaggcaccatgcggtgcgcgtcggcctccgcgtggacggcgacggcggcgacgacgagcgcggcagctggctagactgcggcgcggcacgcgtcgaggtgggcggcgggtgggcggagatca

SEQ ID NO: 4428 - DNA, 1501 bp, Oryza sativa
aaacttatttatggttaaagttataaaagtttgacctcaatcttgtccaaaacgtcaattattatagaaccagagggagtatctggttaagatgatacatcctatcgggcttttaggtcaagatttttagtgttcttgccttctattttcctttctaattgcagttgtaagattttaatccgttagatgatgatgataattgtgatgtgttgtagtgaaaagaatattttggacaatattgagcacaatattgttcttaatgattttgaataaagaaatgagtaaatttcacaatggtctgccttttcttaccaatgttttacattgggctagggttaggtcaaaattttcactaacaccatatatatttgccaagagttgcactttgggctaggctccaggatttgagcccatctggatgagcagacatcttctccctcccacaagggcatgcgcaacctcgccgccgccacttctgtcgctggtcgggagttgagtgcaaggggacacgatgggggttagccaaggagaagggcgatgcagcaggcactgctctgttgttgttttcccttgctgtccagtagttcaaggggctgacgagattggctagaggatagagattaagcgcgccggcgaagtgagtggcggagtggttattggaaggaaaagcgttagagttggggacaacggccatggccatgaagctgacagtggcagaatcaaggtcaatgaaacaacattaggggacaagtgcttgttcttcttctccagctctagcatgggattgacatgaagctcgtttcgcgtgtgattgacatatccagttgaattaggggcagggcatagcaaacggtggagaagctgtgctccagagttggaaggagagaggaggctcccagcttgcccatttatctcctaatctcgctgacaagtgagccaccggtccaaactgaaattttttgctgtaagacctagcctaaagtgaaaacattgtctataggatggtccaaactagaactttggtaaatataactagaccaatgtgcaatttactctaaagaaattccagaagttcttttttaatcacatattggatatttgccgttttctctttttgaagcatcgtcaataaagttgttggagtttagtggttatttgccgttttctctttttttcaatttttttcaatgaagcatcaacgctatttatcgatattaagaccatattgcaatgtcacgttaggggattaatggattataatgtgtcttataactaaaaggaaatatctagtctaagggactattgtttcgagtttgcatagggtcctagaaaacgtagtagctttgccccctagtttgctacatctctatctatcagacggcttggtgttttccgtcggctgccggtcgaaggcttggtgagaatgtgagagatgggaagagagggaagagggaggatagaggaggaagaagaggtggttgttgacatgtggggcctattg

SEQ ID NO: 4429 - DNA, 1501 bp, Oryza sativa
atttggccctagcgtcgagccggtcattgccgtgcaccgcacccgctgttgtccgctgctagccgccgcgtagccgctgccctagtgcacgtactgcagtcgccgcgccgctgtcgtgcatcgctaccgctgccgcgttcctggcttagcagagccattgctaccgctcggtagccgtcttgctaagtcgttgttgagtcgctgccgctgctgcgccttgctgtcgtgctgtgccgtcgctgctgtgccgtgttgtagccgtgtgccgcttaaacctagccgccgctttatcccgttgctcagtagtcgagttatctagccgtaggcaaggttgtcaagatcgggatactatgtagtatcgttttgctcaaagtaatatcgtaccgtaagatcgtatcgtagtatcgagatactatgatattttctttttttaagtttaattaatatttatattaattatatatatagccattctatataaaaaatgtagtaatgatatatgtcatgcaaatagagatatttatcaagagaaaccacgctggttttgatatatttaactgaattttatataaatttgagcatatttatttacattattttcaaaccatgttattttaaataatattttgtagtatcgtagggatcgtagaatcgggataccacctaagatttcgtaggatcgtgtagtaatgaatagtaggatcaagatactataaaaattaggatactaggtgggatcggtatcgtttcggcttagtaggatcgtagtatcgtaagatacttggatacgaatcgggatactgacaaccttggccataggtgcaactctaggttcctaccggcctatcgtttgccgtatcggggctttatcgtgaatcgtttctagcccaccggtttagccgcagccgttgttgagtcgttcgctcgttcgttggaacgaggtgttccccgtgcttcgttcgttcatccgtgtggagtcgtcctttagtttagagctgttcagagccaccggttccgttcgccggtttcggttgatcatttgggtgatcccgtgtcacgtagaattgactcgttgagtcggtatctcatgaggcccgcttgccagatcaatccaagccatccaatcttcgtcgactcggtcaagattaatctcagcaatccaaaattgatataaatccgttctcttttttcaatggcatattattcctttttaatatatgtcatctaccaaatatgatctaatcttttccggaggttgctttaatcttttatctccattataaatcatttgtaaatgatttaattaatttggaatagtcttttctttaataggtttaattggaattaaatcttgtaaaatttgtaattaattcatatgaagttggaatgaggcagttcaagtctcataattcatctaaaatcatgatctacatgcttgtttacttttcatgtactgtttatttggtttttattagtctttttctccgttttgcgtgttagc

SEQ ID NO: 4430 - DNA, 1501 bp, Oryza sativa
actgcaagaccattcacctccatgcacatgatgcactctctaaaaaagttacattctaccagttcattatctcatttgtcatgtgcagaaaattgtttgattaactttgttagtattatgagtcattcgggatcatcaacttgagatgatattaagtcgtgtcgatatgttggaactgggaatttgcacgtgctttcctatcttacacttatgccactgacagttgggctctgttttaatttaaaacacaggaatttcacagatatcagttcaattcctacacaaaccagaaaaaatctcacattacatttgggccttaatgttctaatgtttttaccgtatttgcatatctccaactatatgttattatttttctttctggcatcatgcatcatcaattttcctgcatgaaaacatgatgaagccatttaacattatatgactttggcagctttcgtgagtgaggatttctcaaacttcatttattttccatcactgggaggtgttgaagcttaatcatgaggtcaattcttgcttcctacctttggacatatttctgctggtttgcataccttaggcccacgcccataacacgttaccaagaagtatgtttggtaaattctgaggattatttgttattttccagttgctatgatatgtaaattaaaaaaacaaaactcggccggcgggggaaagaccgccccctcatcttttcaagctaagaagaaaccacagacaaagctagtcaagaaaggccacgaaccctgggcccttgacaaagaatcaatttaagcagcacctctttgtttacagttgtttttcctttttttttcctttttaccttacaaaagttaaggttccagccaggcagttattaatatgaggtggtgtaaagattcagcagtttcaatgatgatgaaatcagtggttccattccggattacttcagggtcaaatattgtttagatgggactcaatgttgagaatttagagctgtatgattgtatgattgtttagtaaaatcaaatattactataaatactaaaaagttgagaatttagagctgtatgattgttgaagtatgatgtctcaatcttttaggcccagaaatagtagtttgttgatttatgctgcttggatttcagaacctgatacgttaaaactgaagggatgaaagggcaaacagagcttgtcaaagttttgtgttaagaaaaaggtgacacggctccttttgatgatggtaccatggtggaataacttacaataaggccctaagtgcttagacagatacaccatagctgctgatttgtacatgaattttgtttcgaaaaactgtttgatttttagattaaagaactttatggagttttagattcatacaccatctttttttcttttttggtgtggaaatgctggactgttaagagctagttgaaaaaaaactactgcacaagcgtgagtttagagtttacttaatttgattttactgtttttctttagc

SEQ ID NO: 4431 - DNA, 1256 bp, Oryza sativa
tatatatatatatatatatacatatatatatatatatacatacatatatatacatatatacatacatatatacatatatatatatatatacatatatacacatatatatacatatatatatatatatatacatacacacacacacacatatcatgatagtaagttacttggctagagaatttgttttgaatacatcattcgcattgaggtacgactaattgattgtattagtactttcaaaaactaaaattctatcttttcagttttatatgtaataacaagttgtgcattctacagttttatcatgagttcgtatgcaaaattgattaatcacttcgatttatcatcacacatggtatttagaaaatctcacttgacgatggccatccgatctaaagatacttcgactatagatttaatgtaatacctcatcaaaagtgctatttgctgcagagtttacgataacatccactatcaagatccgaccgccatcttcaaaaggaactccgaataatactaagtggatctgaataatatgaaatgcatcgatcgattaaaaccttgcttttttaaagtaatcaacatatacaaaattactagcacacgtaatcctgaaactaatacctagcacacgtttttagtacctttccacgggtaccttcactacgccagatcctcacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgatgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcaga

SEQ ID NO: 4432 - DNA, 1501 bp, Oryza sativa
taccatggacttccttataccacctaataagtatttggctactaggtccactctattcagggaatgtatttgttaacattgtttctttattttgatattgctaggcagccaaaggtttatctaaactacatgagtgggtatgttagttgtcggagtcatatgactgggatccaccatccactcttcctcattgactcatgaggtgtgaaggccatgttggtggggcaaccagccatccgcttttccaccttaaatgggtggatgaaaattttgttttggattcatatgtagtgacaaattattgttagactttatatttggatctattgaaaaattatattcaatttatgaatcactcgtttactttagaatacaacgactatagagaaaaatataaatacaacattaatgtggttgaatagacatagtatttaataacatgggttttaataggggttgcactacttctacattttaatagtgcagcggccaaaggtccggctaaaacagatgggttgtgttgtgtgtgcaaggtgtgagaagtgtatgagtaggctccatcgttcgctctttatccttgtgactcaggaggtgtgagggggcacgttggtgggcctaccaaccatccacttgtccaccttcttaaataggtggatgggaatttgtttttgacttatcttcaacgacagattggtagtaacgtttgtatatttggatctttcaaaaaaatcaatatttgaatcgctggtttacattgaaatgcgtcaactatacggcaaatatattaatacaaaggtaaaataggtgagtacatctaatagttaatagcatatgtttcttccttttttttaaaaaaaaactaataacataggtttcaatacagggattggactacctcctcctcatcatgggcttctttgtaccatctaagactctggctactaggtccactcgattcagggaaggtgtttgttattgttgtttcttactttaagaatgcaataggcagccaaaggttcgtttagagtagatgagggggtatgctagttgtgagaatcatatgattgggacccatcatccgctctttctcctcatgactcatgagctgtgagagggcatacccacctaatgtattataaataatatataattctaatctattatataatagtattttctaaaggtaaggccttattttatattaggcacgaggccccaaattactagggacaaccctgcactgaacatccttacaatcatatgtacgcaacaaaagaaacatcctcagccagttcattgtctgaccatgttgactagatagtggaaatgaactggctagactgtccggcagctctcgaattgtctgatgcctagttaatttggcaactagcggacagttcgacacgacgtcggttaatctggcatgttcattcgattgttactggtcattggtttttgaacattgcggattgtccgacaccgtgtggacaaaggggtcctg

SEQ ID NO: 4433 - DNA, 1501 bp, Oryza sativa
tgggagcgatggagaaatatgacagaagtacggacccagaagaatttctgcaagtctactccacaattcactacaccgctggcgcagacgacaacgcattggctaattatttgcgagccgcgttgaaaggctctgctcgttcatggcttgtccacctcccgccctgctcaatctcttcgtgggaagacttatggcaacagttcgtcaccaactttcaagggacatacaagcgccacgcgatcgaagacgacctgcacgctctaacttagaacccgagcgagtcattgagggactatattcgacgctttaacgagtgcaggaatacgatccccaagatcaccgatgcttctgtcattcgagcattcaaatcaggcgtccgagatcgatataccacaaagaagctgacgacgcgccgaattacgtctgccctaaagttgttcgagatcattgataggtgcgctcatgcagacaatgctctgaggcgcaaggagggaaaaagcaaagcgggagaggagaagaaatcgaccaataaggatgcaccagagtcaagcaaaaagagaaatcgcaagagtgggaagtgcaagtcctcaggagaggtcctcgccactgagcaaaaggaatcacctaggcgccctaacccccagaacgacgactcacgcaagacttggtgtccaatccacaagactagcaatcacaccatggaggattgttacgttatcaaaaaggagctcgcgagacaacatgcaatcgaaagggggaagcgagtacgtgttgttgaaacggcggaagaagccgccaccggtgactctgactccgccttcctagagtatgacctacatgtctcccacatcttcggcggttccacgttgtacacctcaaagagggagtacaaaaaagtggaacgcgaagtctgcttcacgtcgcagacgagtacaaccaagatgaagtggtctcaacacaagatcgaggtcttttggatcaccccaagatcgcgactacgcctgacagatatccaactgtggttgaacccactatacggaacatcaaagtggcgagagtcctcgttgacagcgggagctcaatcaacctactctttgccagcaccttagacgcgatgggaatacctcgaagcgaactgacgcccacagatcagcccttccatggaattaccctggaatcatcgtctaaaccattgggcaaaatcacgctacccgtcaccttcagacaagctgagaacttccgaacatagcagatcacctttgatgtcgcagaattcgacaccgcctataatgccatcattgggagaactgcgctcgcgaagtttatggtagcgtcacattatgcttaccaagtgctcaaaatgccgggaccaaaagggacaatcgctatctaggagaacgccaagttggcggtatagtgcgacaagcggagtctcaacatggtcgagcatactcccaacccgcccgccacaaccaattcggagtctcccatcacgattagt

SEQ ID NO: 4434 - DNA, 1501 bp, Oryza sativa
acacaccttctattttgttgaatagtatagggagagaggaatactgcgtaacgtgggacgattttattgagtctcagggctggtatatataggagtacatggggaggagataaggaaggattacagatatggaaggagtccacacaaattaatcctatcctaatatgactctaactaccatatactttaacatccccccgcagtccaagcgtgagcagcgcggacacttggactggagaaaaaaccggcaagagtactcaacacgatgatagccctttgtgccgtagtcgatgtagccaaagcgaaggagccgaaagcgcaaatattcatgacttcatttagttttttcttcaatggttaaattctttttgttaagtactaccaaacaaattactgcaaatgtgcttctgctaggaatgatttcaaataatagcactgccacatacaagatgagggttctaaactaactttcacaacctgggcattagactgttagctgttacctaacatccttagctatttagcctcaatttagtaatgcctcacttcacaccattcctgtcttcgatgttgcagttagtcattttcctcaacacatataattatcacttctatactgtccatggtatgagcctggctgcatcaattactcagagctctctgtcggaacaacttacgtaagaggaatgtatcgcatggtgggtgatgacatgttaaagaaacctaatggcaccatctcacatgttatcactttctataatttattttaatatagcttgcagttttcgttccattctccataatttccactcttgtagtgggcaaattcttttgggtacctatgttttttgggcacctataattgtgctgagatcagattgcgaagtttttatttttattttgttcaggccatgcagtttgtatctcccaaagggctgcttaattatttcacgggtggaaatagttcgatatttgctagtaatgaaggtaagaatttctatataggttctgtatgttcatttttaatgaataatttgaataatcaatcaatcctggctaatcatccgggtcagtaacttgatttgatttgtgctgaaaaaagaccatggggtgttatgtgagatttgatgctacatattttttttgttccatctggcattatatggcagcttcattttagtccgttagactagatttgctagtcaactttggtgagtactacagtgaaactagcttggaagaaatcggatccaaaactaattaaagattggccttggtcttttgattcgattcacaatcttttctcttacatactgcacactctgccttgtttctataggagaacaactcacatcaagggttcaacaaataaagaagtatttagctgattttgaaactgggtaggtaactaagtacatgttcatcaattttcaaggtctaatgcttcatgctgaggttgatttttatttttactgaagcactaatttacttccaaactgtt

SEQ ID NO: 4435 - DNA, 1501 bp, Oryza sativa
actaaccatcactattaaaaaaacatatattttgtaaacatgcaaaatagatttttccagacggccatccaccccgcctgcacataaaggcctgtgaaaatgcacgatttttgtaggcgcctcttcatttttgcaggcggtacaaccacccgcctgcgaaaatatactctatgaaaaaaacccccgccaccacccctacccgccatcgtcgcctgctgtggcccacgccctccgctggatctaggtgggagagggaagggagggaagccggatctgggagggtgggaggaagctaggggatgggagcgccgccaccgtcgctccctctacgccgccgccgccgccctccccctccaaccgaatctgagaggtcggggaggggagaggagtgccgccgaccggatatgagagggagggagggaactaggggaggggagtgcttccactgacgctcccgtctccgccacactgcatgtggtggccaccatatctccttccacaccgccccctccaccgcttgcggtggtcgctcccctggcctcttcctatcggatccatgagcgaggagggagagaggggagtagagcaccgccaccattgttccctccatgcgtgttgcctccgctgttgcatgcagtggccgtcactccacctcctccaggcagatctaggagtggggaaggagggagaggaggggagtatcgcctccacaccaccgccctcccctcctccggtcggatctaggagggccacacagcctgctgagaggggtggagggtgaggtgagggagatgggatgagcgatgggaggggagaggacttggtgaaaattaggctaggtagctaggtgatgatttttatgaggtatgaccttttcacaggcagacatattaagacctcgcctgtgaaaatcgattttcacaagtgggactaggtttatggtatctttaggtatttttatgaacattgattttatggtcgcttggaaaaataaatcgtaatgtttggaaaaatcgtttttctattagtgcatgatgcgttagctcatctcaattttaatgcacaataattattttatttaagtacctagctaaatggcagctactaattaacattcatatatacctaccggcttggtggactacgtgagaatgctattctagttttttctggcatttgtcgtaatggaaaatgtctaatatatgatcatcggattgagcagtcgcctaattgcgaaaagcgcgtgacttctccatcaatagcatgcagcctgcctactgtcatgattgatgaatatttgttcctcttcttgctcatcattattgtgtcgtttgcgtatttagaaacaacaattgttgcagtaaaatacaaatgtattggtgctgtgtggattgggaactggcagatctagtgatgcaagcaactaattagagacggaaaggtagagggaggacgagagaaacacatacctctacggctttacatcatgtcattgcgagaa

SEQ ID NO: 4436 - DNA, 1501 bp, Oryza sativa; identical to SEQ ID NO: 4432

SEQ ID NO: 4437 - DNA, 1501 bp, Oryza sativa
gcagaaacataatttggggaggagcttacagttgcgtttgtgcagctgaagctgctgacacggccctgagctcccctgtagaacctgaagaatggcagaacatgaacatggaggctgtagcacattgacttgtgcttctcgtagttcacttgcaagaacagcacctccgggttcttctcggctagttgagcaatctgcacggcacaatcaaacagattctcatcagcaaccaaaaaaaggaaaaagaacacttgcagttattggaaactgaagaggatttgggcgtggattctaccttggggtgtagggcgcggcagccaccgcagcccggggagaagaagtcgacgacgacgagcttgtcgccggcgttgaggagggagtcggcgaggtcttgcgccgactcgatctccctcatgttgggctgcaggcacttctcccaccacctcatggccttcccaatcgtcaggttcatctgtaaaaagcaacaaaacttgaaaacgttagcatgcatccgacgcgaactcagctaacttctccaactgctcgaactaaatcccaaccccaaaaagagttaaaaatagcatgcttgcagtattatccaaaagcctagaactaaaaatatgaaattatgtgctgaaaaatctcctgaagaactgacgaacagacctgcccatgcgccgcttcgagattccgtggcaggggcctcgccttcctctccgtgagcgccaccctcccactcgggaacgtgctcttgctgctgtacccaccaatcggcacagactccgcgagcgccgccgccgccgcggcgcccctcacaaggccggcggcgaaccccacacccacctccccgcacggggacgcgacgctgccgctgcacagtgcctcagccatggctacctcaaatcaattgaaccccctcctacagcgaccaagcacgcgagagggagaggagagacgtcggagagcacgcacagagagagagatggaagaagaggatgagaacacaacaatggcggatggggagatgcggcgaaggagaaaagaggcgcctttttaatgcccacgagaggagggagaaacagaaaggaaaaaaaagcgcactccttttacccctttcaccttttcaccgcaacggctttcacatggggtaaatcctggagaccgtccgatgctcactggacgttgcggatgggggacacgtggaggaaagcggttgccgcgcgtcggtttttttggcgtgggtaaaaagggttgggggggtgagtggataagattaaaagctgggggcctcacgagcggtggttgggtatataggtattggtgggttgagatgccacgtgtattggtgcacgctcgggggacgtgtggcaaatgtgctttttggtcaagtctcggtggggaccacgttacagcgaaagggagcgttgatgggtgacccaccacccccaatctgccttcgtaataaatgtactttaccactgtaaaagacttgatagtgaca

SEQ ID NO: 4438 - DNA, 1501 bp, Oryza sativa
cttcttctcacctaaatcgaccaaactaagcatccgtttagttacaccgtcactcgcaaatccgatggcgtgtggggcccacaagctctgaaatgcctcactgcccccactgtcagtgaccgtggaatctcttgctcggtcccacatggcagcgtcggcaagctcgcgctccctcgtacgacgcgcacatccacccgccgctttaaaccgcgcttctctttttttttttcttcgcacctaattttcttcgtcctctccctctcttcttctcttctcttctctgctcggctcctgtacgcggctggatccgagcggcgcaggaaggaggcggggcggatgctgtagagagaatggcggaggcgatcgcgtccgcgggtgggatcgccatggccgcctcgacctccctcacgccgggccaggtgagccctaaatcgcaccgtcgatccggggaggggggggctgctgctctgttgttggtgcgggtgcggggaccgcgcggcatttgctgccccctaggcgatttcgtcgggggaatccgcggttggcgaggtggctcaaggatttcgtcggggggaatgggaaggcatcgcccgtgtgccgggcgccgggcgcggccgcggccgcggaagtgcggcttgggttttgggtttaggtggctgggactgggaggaagcgcgctggagatgatggcatgcgcgtggaatctctggcgggagcttgtgttgctttaacgctgctgttggctaaattggcgggattgggtgatgatcggtgagatggttgtggatatcggttggttgtctggtttgcttttttgttgatacgacaagtattagtgctaggttttaggattcggtggtattcggataggaggctaactattttggctgatgcgggatttgaatttgtggctggtttcagggatgtggatcaaagggtgtaaatcatcaggtcatagctgtgcttttgtatggtaggctagtagcaccaaatatatggtggaggtttcattcatccgagctgttggaaaattggcgatataatagcttatatgtagggtttaaggttggaaattcgtaagtggctgcggtttcagatctggaggtattggatgttagagtaagaccgtcattaagatctggcagcatgggctattctgttatattttctaagagatggtagcagtatcgatgtgctgaccaacctgttagaattggtgtcaatctgcttgattttctagcgcacggttgttccttactttggtagttgttaggaagttcaggttggtaaaaatactaaaactagatagtaatttagttgcagaaatacatattggtgtggattgcaagaatccggactatgatgagctacttttaccccacaagttcaaataacacaattacagtgtttgattgcaacttgaaagccgtagaactattgtctactatacagatgactgagtgatattcttctaatagtaggattttgttttgggggtcct

SEQ ID NO: 4439 - DNA, 1501 bp, Oryza sativa
ttgctctagaaaattactgctgccattacttagtttcaccaatgtgcaacacgtacagtaaatttggaacgtttttcaccttaaatataagcctcttcagactgaatttggtactgaatcagatcactaaaccagaaatgtgtcaatcattaaccggctagccagctacttgtacggtgagatttgtgcatcataattaacacaggcagggacagggttaatcaacttgtgcaacttgtgttttccaagaaataatgatgaagaaagtattagcaaaaatcacagtattgtttagaagcttagaaagtgggcacgcgctaatccgtcatccattagctacaaagaacatgccattcttggctccttactcttccctccttacctatgctccttgatatattcaggtactctccttaattcggtgaagcagatcaccctcactctcatgtgctccatgcccccaataatgcagaagtattagtccccatcatagattgaattcatcaccatagattaaaagaaagaaaaagaaattccataaggaccatcatgtatggctacatgcaaaggaggagatggagtgttcgttctggtggtatagggtgagaaaggacatcgtattccgcacgcacgcttcccaaactactaaacggtgtgtttttttgttaaaaatttctataggaaagttgctttaaaaaattatattaatccatttttaaaattttaaatagttaatacgtaattaatcatacgctaatagctcacctcgttttacatatcttcccaatattctcaatccctttctcctcaaactcaccctaattgtcgaacgctgtacaagaataaattttcagaagacggaaggtaatccttgattgcacatgtcgaactcagaggacgggagatcttgattgcacatgtcgaacgcagtatgagaattaatctgcttagagcaagtttaatagtatagccaactactatctccaattcatctataactaatctaatagctcatttatacaatagttacatactacattattaatatctggccccaccaatcatacacacattgcgtctaggagtctgtgctacagctggctataaatctttagcccgctgttcttctttctccttatttatcttcttaaacgcaaaatctaaatcgagagcgctctcgatttagtcataacgagcgacgctagccattgtccagatacgatcaaccattgtccagatatgtgtcttgaagaatcttactttactatagtacttgatcaagcaagtagaaaaaatattcctaccatctatgcttcaaatacaattttctcttaagctactcatccgatctacgatccgattacaccgttgtgttcataacaattaaatctttacaacaagatctcatataattatattttgataaaaaaaatcacaaattacttttataatatatctaaattacttttagatttcactaagttacttcttaaatatataa

SEQ ID NO: 4440 - DNA, 1501 bp, Oryza sativa
tgtacatgagagtatatttaacaataaatcaaatgatatgaaaagaataaataattacttaatttttttaaataagacgaatgatcaaacacgtactaaaaagtcaacggtgtcaaacattttgaaacggagagagtacatccgattggtaggatggccacgggagttgccatgcatcccattgaccagggatgaaccggccatcgtgtggcccattcattcattgacttgccttagtccggctggaccaaaggcggtttattgcccggttcatcacaaaaccggccgccaacctctggttccgatttttttccggttaaactgtcagtccgttccagttttttttccactatgcaattaacgccatgttgtagaaaaccaccgtacaacttgccaataaggtagcttccttcttctttcttttttttttttgagaactaggttagcttccttctagagctccttgtacgacctcgttggaaaactcattgttggacctaattcatcactctttttatttcaaactaaagggtttcctttttagacttttctaattgttccaaactaatagaggtggcatcaatcaaatttgctctttcttgtcctatctaagagtatcttgatgaaactcttatctttatcgactttcgtaatcaaaattttagttttttcaagctgctcaatggtcactttacgacatgattagtgttatgctcggtattattgtagttgagggagaataagtgtaacttccgttcatgatcggcccgttaagaatttagacccattagtcccacccccaactcccttttcttttcttcctttttggccaaattttcaaatttctggtggatacactgcacgcccggggaattttctgtcgaaaaattgtataggtaatccctaataaatttctaaatgtgcttggctgattccttttcttctcgatcgatcccgttattcctttttaatcttttcttgtgcggaattgcagcactttttctctgcttgatcacaacgcagcaaggacatgagaatacgtgagattctccgggcgatggagctgcaccgtgtgctttgctatcgtctcgcgtcgcgctcgcctgcaataatacggcagccagatcgagatggttcccaaaacgactagaaacggaatcacgtaaagcaccatggatggatggaatcaccttttccccaggaaagcgcaagtgtggaatggcatcatctatcctaccaagttcctaagcccctgaccatgcagtgcacgaataatgcacatcgatcagctatctagagagagagagagagagagagagagagatagatagcatctcgatcagtgctactgatcaatcgatcatcccctataaatcccccatcccattgccatgcatagaggcagcacatcaacgatcgaacgaacaacgcactctgcagctagctatacaatctctgtttaattagctaggtagctagcgagtcataaatcaagaagcca

SEQ ID NO: 4441 - DNA, 1501 bp, Oryza sativa
aagcaaattgtttgttttcatgcttttatgtaattggacccggattaattaaccattgaatttgtgccggaagtacatggcaaagattgtgaaaaggaaatgaagaagaactatttgtaaatttacaaatatatatatatatatatatatatatatatataaacaattcatgtgtagcctctgtaagttagttttcttttgaattcatgtaaggctcatctctccagtctagacccaaagaattatgatggcggtatattcaagaagatcgatgcttgagagaattgggagaacccaaaggatcctgatgaagtacgtggcatattgcaaagaagacatcattacgatggacaggttgcttgctttttactaagataggcagatggttgcgctggtagtgatgatagtgttgatgggtaggttttttctaagatggaagacattaatgttccaccagcgcgatgcaatactattgtagctaatttagttatttaaaaatgatgtcgatgctaagactccagaaggtaatttatttagattttcttcaatgtttttgggaatgatacttgtgatcttgtttgaatatggagttagaaactttttgaaacatatgttgttaccttttggttgtttgctttgcattataaataacgtcgtagcgttagcacggacatgttagttgtttaaattgaaggcaatgtatttctggattttagataaacccattacccataccgccttgatttcggatgattttccgtgttttaattaagaaaacctgatactatttgttttgccagcgatgaaagcagtgtcgcttgctcgccaattccaatgcgaattttgcttctcctcctatgcggacacgccgccacccacgaggccacggcttgctcgccacatgttcggctcccgccgtcccgcggcccgtgttaattacggacagaataacctccatatacgtggtcactcctacgccgtccgatctcgcggttgccctaaggttaacacttctcctaaactgaaactaccccattgttaacgagttgatcgcagtcgccattacccgttctagagactctctcctccgtcggcgaatcaaatcccccaccgaatccgatcgaagcagcgagatttcttcttccgcaatccaaatcgccaccgatggcggccgccgccatctcccacctccgccgcggcgcgccgcgccacgcccgcgcgctcctctacctctcgacccgccgcttctcctcctcctccgccgcgggggtggctcccctcgccgcggtcgccgcctcagcccgccgccttctctccacgtcggtggactccggcgcgtcctcgacgggggagagctacaagccgccgctcttcgaccccttccgcgccgccagcctcgcctcgtcggccccgccgctggagtcgccccccatcgaggagctccccgatgacgcgactcctcccccggaggaagagcctgggctacccgcgcccgagaagg

SEQ ID NO: 4442 - DNA, 1501 bp, Oryza sativa
aaaaacaccacatatacaaactttatatacgtgcatacaaactttgtatacgtaaatacatacatatttaaaaaaccgaaaaccaagaaaaaaaacaaaaaaacaccacatatacaaactttgtattcgtatgtatacaaactttatatacgtacgaaaacaaaatttatatacatataagtttaaaaccgaaagaaaccagggaaaaaaccagaaaaaaagaaaaaaactgaaagaaaaaaaaaaagagaaacgccaaatcagggaaaaaaaaccagaaaaaccgaaaagaaaaaccgaaaggaaaaaagggaaagaaaaaaggagaaacgtgtgcacgtggcgctcccgcgccattccactgcggcccccctctccgcgcgtgccacgtggccgcgccgtgcgggaggggaggcgcgcgactgatcgctttttagcgattgcgctagttcttagccaagtagaaaaaaaggggtggaaatcatatatgagtacaaacgagtttggtacttgaactcaggttgttcacaggttggatccaacccggttaaaccggttgttgtcaaaacgacaaccgcatacgtcgaaagacgtggtcactcaacagtagttgggaaagaagtaaagtgtattaaattgagaatttttcttgggatccccctattacatggccctatggggctatttatagccccattacaggtttttactactagggttttggttatacaagggaatttacatggttgcccttatgaaagggacatttacatgggtacacagtgtaattgtggttcatgggcccttaacgggccgtcaggcgattgtcgacccaattagcccttagacttgatgggccaggatggcttctacggtcctcccggggccgaatcttgctatggcgaagtcgtcccccttcggcatatactcttcgccctacatccttcgcccaggaggcctctggcttggcgaggtacccgcacgattccctgcctctcgccatccttgcttcctagtcttcgctagggagggagggatcttcgccctgactaaccttgacgtttcgggcataaattcttactggattcggcaagtttggtcgaagggcctcatgccatatcgccaacaagcccctcacgagcaagagtaagataggagcttcggccgagaccgtgcaaactatgtggtatggtatgtggcgccccctttcgatcggtgctcctgccgaaacctatattgttcctgctagtaaagtttgttttgtttttatgcttagaaaaatttcttgagaaaatctcctcttcgcatccgttgcaaagcgtcgaagggggctatttagtctcttttattactatgaatagtaatgggccccatggacttttccttctccgtaatcgggctttttactgtttggctccgtcccaatgggaatttaccgtttcgtctgtccttggacacgtgtcagggctcgattggttggcaggcgaacggtctcgcgacg

SEQ ID NO: 4443 - DNA, 1501 bp, Oryza sativa; identical to SEQ ID NO: 4420

SEQ ID NO: 4444 - DNA, 1501 bp, Oryza sativa
acctcaggtgctactgaggctcttgtaaccattaggctacaagccctttcgcacacggagtcctttcaaaaccacataaattcaaaaaattgtcagatagtttaaattttggtttaattttattaacttctgttggcttactaagcggatcatcaactctatccatctttgaaacctccaagtttcacaagcggttatgtgaaccctatatataacctgagagcacccgcaatggtaaagtaaggtgctctctataaaatatatacatctcaacaatagactagactaatagtaaatcatcccaatagtatgtctacatggatatctatagctctctcatccattacctcgtttttctctatagactatctccaagttattagatagttttactctctctctcttcatttaatctctttcaagtaggaaaatatactgatatggatatcttatagagagtctatagataactattgtggatgccctgatattttataatatactccagctaccacctacgactggagtgtagaaccatggtgatgcacagacgcactgtactagaggtgtacacgcatgtttgcgataataccactacttgtccgtaccggtgtactacactaccgatagtatacgtactagtatttgtgatttgtgcagcagcaattattgtgcccatttgccacagatgctccaatactgctagtagtagtaagtagtagtatacgctagtggcagtatatctgtaccatcatcagttgtgtattccatggctataaggtatacgtagttactccgtatctcttttcccaccggaactagaagctgaggtagctcccaactggctgacagaaatggacccaggtgggccccagcggcagaggcccgcgtaggcagacggcgcgagcgcgtgtagcgcgcgcgagtgagctgtacgcctgtacagctggacgagtcaacgggtcaaacccaccgcaaaagtcccccgagtctctccaacccgtgtacgtacgtacgcgggcgattaaattagcggcgtggttaattaatcctaatcgcatgattatccctaattaaccacgatgggggttaatcgcctaaacttttggcttttaaagaagaagaagggaaaaaaaaacttcaaaaaaggcgtaaactaatctccccggttgcggcgttctcccccacatggtcctttctttccaagtcgtccagcccagcctacccgcctctttcttctttcttcttcttcctcctcgcgctcctcccgtctatataaaccccgacacctccctccccgtctcccgccagtttcatcgcagcacacatccatccatccatccatctatccagagagcacagcaacggcgcatatatagtacccctctaccaaagcacaacaaccagaatctcctgagctcgatctagctactagcttgatctatccgatcaatcgactggcccgcgaggatcgatcgagactcgaaagggagggattttg

SEQ ID NO: 4445 - DNA, 1501 bp, Oryza sativa
aggtgaggagaaggcggatcccctcggcggcggcggacctaggagcggcagatgcctgggaattcgggtgaaagaggatttcctcgactgtgactgcagaggactctggcggagctgacggccctaggggcggtggtgagctaggagtccaggaggggcaagaagatcctgaagatgacagcggctctaggggcggcaaaggtctaggaatccacgaagcgagtggaagtggatcttgttagctcatgtttggtcggctagttcttgctgaacatcgacggatgaaggtgggctaaaccggcgacgtgtggcatcaactcatttgaagcgcttggagatggcatcattggaggctcgccacgatgaagcactaagggcggcggtgactagacgaattccacttgccgaatctcgatgtttcaggatagaatgccaggaagcaatgatgtgccgaggtcgtttgtttttcttttggttttgtgctctcctctttttaaggcgtgagtctaagtcctcttgtatctttttggctgtgtatcctttgtggatacataggccggattaatgaaaatccattattaaaaaaacaaatccttctcacctatatgtttattacatagcatcctaattaacacttaaatcagtaagatcacccattccgccatttgtgtccttttaacctttgtttgcacgcataagaaatattgtgtaccaaaacaagcgtttcgcaagtttatgcactagataacacccattgaaaaagtttatatactaccaatgcaattttttttctgttgttactgataaaacatccgtccatacaccgtcacaacagttgaatatatacttcgtactgttcatcgactactttatgatatagcataaaagacactaagcatgatatttatgaacggcgtctagtcgaagcctacatccttgaaacactgataatcgctttttcttaattcatatgattacaatatattagagttataactatcctcgatgaaaccacttgatcagtagtttcctctcgttattattaagtggccatgcgcaaattctattaatccgaatccgtcactccctaggcagtgtttggctaataggaataggaaataatttttcacctactaaaagacatcgttaagttctaaccattcattccctcttttctatttaatcctaacccttcgtttattttctaatctcaatcctacttctattttctattatcctaacacaccctagaccggtcctttcctcattaatagctgaattaaccgagacggaatactaacacacacagtttgcgagggaattcttacctgggctggcccaaaaccacccatcgcctatcctaaacggctaaacccccacggccaccggataacacagccaccctccctcaacccgaaaagctgccgtcgcctcgtctcgtcgccccgaagcaccacaccacaaccacaacacaccacagcgggtaggccgagagcgcgaa

SEQ ID NO: 4446 - DNA, 1501 bp, Oryza sativa
ttgccttggaggtttaaaatatcggactatccgatctcgtatcggactatccgacgtgggctgaaagattcccctccaacggtcacattttggggatctatataaaccccccaccaacccttttctagggctgcccaaactgattacattcctatcttgctttgggttgagctttgtgctaagtgctttggatttttgagctctctccctctctatctcaaatcccccttgttctttatgacttggatctttgtgtgtgaatttggagtttgggagcctagtgtgtgtttctcttaatcttgagcactaggatttgtccaagagttgtgtggtgtttattactcttggaggttgaggactcctagacggctaggtgtcgttcttgggccaccgatctacgtgtggttggccaagagaagtttgtgaaggccggatcttgcctccgcaaggaaagagatacccttagtggaaggaggagtgcatttgtgcaacctcacgaggatagggttgaaaaagatccggctctttgcgagcccctcaacggagactagaatcccctcaaggatttgaactccgggaaatacatcggcggataaacctcggtgatatcctcactctctttaccttcttgttccattgctttgtgctatgctaatattgttgttggtcgagctctcctctttgcttgtggattgaatctagatctcttaggttgttctcttgtttgtattgttgttgtgcaggtcagatagtctgatctcagttcagactatctgatcacataggactatccgacctgatatcagacaatccgaccctattttgttttagcttccgcatttatttttaaaaccgactattcacccccccctctaggcgacatcaaggtcctttcaggcgtgcacgttgatccgtcagcttcgcctcgtcctttcctgtctgtcccgtcccatgcttttccgactcgatctcgtcgtctcctctttctcaattcgaactgatctctagcgtctcactgcctccacgtaacaacgcccaaatcagggttgtttcattaatcgcacggtctcttttcatgtttggccaaggaggacgaggccggggaactgttttaaacactcgggtggacgtccacccgagatattagaatctatcctcggatgaggccaggtagctgcaccggccttggtaggagtccatgacctccggtgagcatgctgctccatccttgtacgcaatggctgtgagcttgtttacttgaaggcaaggttgtcaggatcgggatactaggtagtatcgttttgctcaaagtaatatcgtatcgtaggatcgtatcgtagtatcgggatactatgagattttattttttttaagtttaattaatatttatattaattatatatagccattctatatagaaaaatatagtgatgatatatatcatgcaaatagagacatttatcaagagaaaccacgttggttttgatatatttaactgatt

SEQ ID NO: 4447 - DNA, 1501 bp, Oryza sativa
acttttttatgtgaactctaatgaagacaaacttgatatcaaaattgtagccctcgatgcgacctacaactttgtagttgaaaagtttttgaattaaaactgtttagggtcccaaaatattgttgcatgtttatagattttgaaattttaattttaaaattacattttgggacaaaaaattacttaaaataaaaaaaaattcaacaacaaagttgtagatcgcgtcgagggctacaagtttgatataaagtttgtctttattagagttcacatgaaaaagttatgaattatttttaaatataaagtatttagatcgtcctatttgacccagatgatattcaaattcaagtttagggaccggggtgacacaactgaacaagttggaggacctaaacgagtaatctgcaagtttagggatcgagatgatacaatcgaacaagtttgagaatctaaacgatcgatttgcgagtttaggtaccgagatgacacagcagtataagtttagggacaggtgacggactttactctattattattattattattattattattattattattattattattatttcttacaagttacaatcgaaccgtaattgtaaagaaaaatatcattttaaaaatcttaaaaattcaatagaaaaaaataaataaaaaaacctagatatatattattgccttaatgtctatttagcaacagtttaactcttgattcttgttccttagagttagaattgaagatagagctaaactaaactttactatctttttcaatcttatatgagtgaaatagatggatttgctaaaaaaatattaaaaaatcgagctaactttttataagggcatccacattgttgctttttagccggtaataagcaatacatgctctcttcctacccggtaggaagcattgtgagagtggcaaagagttaaaacctggtcatacagctactaccgatgaacaagagataaacaatattatttgtacagtgtttctgacagaactcgtgggaaggagtcatgcagcagtcacgggaattttactatcggtgatttttttttagctgggcccatcttattcctctccaacgcgcataaacaatgtgaagggtgcgatggtttaataccgtctgacctcttagcccacagtattgccgaagtcggcagctaacattgtgcttgccttaaccccaactatatacgagtttataccggactccacgtaaagagccaggtagaaatgtagaatatgactacaacacgtatactgagtaaaaggaaatacgccttctgaaccggttaacggaaaagaagcccgttcgcggttcgccccttccaaaccgacttccaatcgcgcaattcccaaatataaatctggcgaccccaacagagccgagctagggtttcgcctcccccgccccgcctcctcctcctccgcaccgcgcgaaccgacccgacccccacttcgccgccgccgccgcagccgcagccgcga

SEQ ID NO: 4448 - DNA, 1501 bp, Oryza sativa; identical to SEQ ID NO: 4428

SEQ ID NO: 4449 - DNA, 1501 bp, Oryza sativa
  unsure (1)..(1501): unsure at all n locations
catgtcccaaaaattcctggttctagtgtggttgaatcatcactacctttgtgagaatatatcatatgatggtacttgaaatcagaatacagtgcttagagtggtttgactcaagtttcataaggtactgagccgatccttaattccttatcagcagaactagtgttctagctatcttatgagttgctttggtagcttgtcattcaaataatctttcttctgtctattttttcacatgtttttagataatgtatatttttcacataagctaaaagtttttgtctgccattaattttcacaacattcatcttttgatcattcacctgaagtcagatataacctcagtcgctccctcctcatttctgcaaaggtaacatccatccatctggcaccatgaataagtagccacccactacatggtcatgactccttttttgcatttagccatgcataatggtgcttatgtattatttatttattaatttgtaatctatggtgaattcaatctatgatggggactaatacttctgcattattgaaggcatggagcacatgagagtgagggtggtctacttcaccaaattaaggagagtaactgtctgtttatatgaatatatcagggagcttggtgaagggaggagggaagaataaggaagcaaggatggcctgttatttatagttagcagatgacagattaacgcaggcagactacccaagctcctaaatggtacgatttttgcaaaaaactttcttcatcaacatttcttagataacttgtttaaatcaacttccaatatttaattatgccctcgaataattgtcatgaactctgtgtcatccatcacccatcatctatttagggtgggatcttaaggggtgcaataagcttgcaacctttattggtatgtttagctttgtcgttggaagttttgaagttgggacaacatgttatcacacttattgcactggaaaacaataaagagaagatctgtagatgtttttttttccatagagaaaagaggaatgtaggtcaattccgttgttttgtttctaaggcatttgtttgttacaaaatatgtccatgttaattattatgaatttatgatgtacaagttgcagccgtacaggcagctagctnnnnnnnnnnnnnnnnnnnnnacatttctggttcagcgatcttattcagtattaaattcaagtctaaagaggcttatatttaaggtgaacaacactcaaaatttactgttgtgcatattgacgaaactaagtaattccaaacaaattttgcaagaagataatcattttgtattgactttctaacaaagaagaatttacggtgtgaaatgtgagatgagatccaccttgacaaagtgatagatgacctgctaaattaattattggactgaggggatttcattatatgacaaagtgaaagtgactggcctatcttaaaactgcacgggcaaatactactggaagagtttttctgtcagttccttgc

SEQ ID NO: 4450 - DNA, 1501 bp, Oryza sativa
gcagaacaactttggcactaccgtaccattatctcccttgagggaaaaaataatacaagtctaactgactaacataacaaatgcaaggagaaaacaatacaagtctaattgacagaacaacaatcattgctaaagggaaaaagagaatacaagtgtagttgagtaacatcaacaaatgcatggaaatgacaaatcatttatgcaagagaaacagcatttcgaagataagatccaaccccaaaaaactaacaatgattttgccgccatgaatttgtgataatgcaatgaaagcccaattgcatcagactgttgcgtggtcaacccaaccatcattgccgatccacaagttgtgggcaactcactccatatattttgttaaagaattatccacgtgcaaggtctagctggacaaccatctctgcaactgcaactggctaactggtcagtggtcacttgctccaccctaaaatacgtactccctccgtccaaaaaaagacaaaccctggtttccgtgtctaatgtttaatcgtccgtcttatttgaaaaaattatgaaaaaaaattaaaaagataagtcacgcataaagcataaagtattaatcatgttttatcatctaacaacaatgaaaatactaattataaaaaaatttcatataaaacggacagtcaaacattgacacggaaactcagggtttacctttttttggaacggagggagtagaatagtgctccctccgtcctataaaaatgaatctaggatcggatgtgacatgtgctagtacaatgaatctggacatatgtatgtctagattcatagtactaggatatgtcacatctgatactaggttgggtttttataggacggagtgcgtatatatcaatctatatcggattagacacattcactccaatcaaaatcgatttgaatcacttttttttttcattacactatttcgattagacatatttagcactataagaccctgtttggatccactgacaaatttttacaccatgtcacatcaaatgtttggacacatgtatagagtattaaatatagatgaaaaaataactaattacacatattgcgtataaatcgcgagacgaatcttttaatcctaattgcgccatgatttgacaatgtggtgctacattaaatatttgctaatgatagattaattaggcttaataaatttgtctagcggtttatagcagtttataggcagattccgtaatttgttttgttattagattacgtttaatacttcaaatgtgtgtccgtatatccgatgtgacacgctaaaactttacacccttagatctaaacacagcgtaaatcccggtcaaattcatagctttagaatgtatataatctgaaagcatattattatattttgggacgaaaaaagtattagacaagagtgatgctctggtactctttactggttactaccagtatcgtcagaggtaaattagtaatttacaattataatgattagaat

SEQ ID NO: 4451 - DNA, 1501 bp, Oryza sativa
tagcaagattcggcctcgggaggaccgaagaagccatcctggcccatcaagtctaagggctaattgggtcgacaatcacttgacggcccgttaagggcccatgaaacacaattacactgtgtacccatgtaaatgtccctttcataagggcaaccatgtaaattctcctgtataaccaaaaccctagtagtaagaacctataatggggatataaatagccccatagggccatgtaatagggggatcccaagaaaaattatcaatttaatacactttacttctttcccaactactgttgagtgaccacgtctttcgacgtatgcggtagtcgtttcgacaacagctggcgccgaccatggggatttccgagcgaaaccactgagagcaaatgccaccgaaaagggtcgtgaaggagaaggttacaaggcgaaaggaaagcgaagccgaggtggagatggtcgccgaagagggagcagagccttcggcgccagttgccgaagatggaggagcattgtctgcctccgcacctgcaccatcactactgccttcggctcctgccacctctgcgcaggtgctgaatgcggctgacatggcgaaggcagccgcggcggcaagggcactccagaccaggcggagatcctttcgacaagccaactgctggtgctccaagccgctccgtcgcagctggcagcagcctcgattgcgctcgccgctgtacaagcccaagtcaacccagaccccgaaacacaaatcgaagccgacatggaagccatgcgacagaacatgacacgactccaagacatgcttcgccaaatgcaagaacagcatcaggcgtatcaggcggcgaggcggtccaaggtcgcttcggccccagtcctccaatatttggcaagctacgtcccaccccaagtctatccacaagcaccgatccagccccttccgccacaagttacgcaagcgccagtatacttcaccgggcagccctcgaccgcagcagtgcatccagctcctcacgtgcaactgcaggctcagccggtcgctgcccaagtacaccctcaaccgcctggccaagtgtcacaagcaatggcagaatgggcttcggctctgcaggcgcagctccaagctttccttcagcatctcagctaaccccacagcatttcaggtacagccccttcggtccacccggaggggaatacaagtcaaggtgcacctagttggttgccgtcgaatcagccaggtctgggggcttcgccttggagtcaaagaccgcaattcgacttcatcaatgcccctcaggcaccaaccgttcggccgcaagcaccaacgccaggcttcggagcaaaccaagcaccaaatcaggtcgccatagcatggtcccagcaaacgttcgacccatccatggcggctcaacaagcatcaccaatcagagccgggtagccgaatgccatggcccatcctcaggcgcaagccgtgatttcacccttcgccacgccatacccgc

SEQ ID NO: 4452 - DNA, 1501 bp, Oryza sativa
aagaatttatgcccgaaacgtcaaggttagtcagggcgaagatccctccctccctagcgaagactaggaagcaaggatggcgagaggcagggaatcgtgcgggtacctcgccaagccagaggcctcctgggcgaaggatgtagggcgaagagtatatgccgaagggggacgacttcgccatagcaagattcggccccgggaggaccgtagaagccatcctggcccatcaagtctaagggctaattgggtcgacaatcgcctgacggcccgttaagggcccatgaaccacaattacactgtgtacccatgtaaatgtccctttcataagggcaaccatgtaaattcccttgtataaccaaaaccctagtagtaaaaacctgtaatggggctataaatagccccatagggccatgtaatagggggatcccaagaaaaattctcaatttaatacactttacttctttcccaactactgttgagtgaccacgtctttcgacgtatgcggttgtcgttttgacaacaaccggtttaaccgggttggatccaacctgtgaacaacctgagttcaagtaccaaactcgtttgtactcatatatgatttccacccctttttttctacttggctaagaactagcgcaatcgctaaaaagcgatcagtcgcgcgcctcccctcccgcacggcgcggccacgtggcacgcgcggagaggggggccgcagtggaatggcgcgggagcgccacgtgcacacgtttctccttttttctttcccttttttcctttcggtttttcttttcggtttttctggttttttttccctgatttggcgtttctctttttttttttctttcagtttttttctttttttctggttttttccctggtttctttcggttttaaacttatatgtatataaattttgttttcgtacgtatataaagtttgtatacatacgaatacaaagtttgtatatgtggtgtttttttgttttttttcttggttttcggttttttaaatatgtatgtatttacgtatacaaagtttgtatgcacgtatataaagtttgtatatgtggtgtttttttttcttggtttttggttttttcaatatgtatgtatttacgtatataaagtttttatacgcatatacaaacacaaagttcgtatacaacagtgtagtagtagtactagtagtatagtactagggcctgtttggtacagctccaactcctaaatttagctccaggagttgagtctggagtggagttgtggagctgactaaacccaactccacaactctagttcattttgtgagatagctccacccaactccactcccagttttggtggagctgaaactgtttggctgagcttcagcttcaggagggctggaggtgtgccaaacaggctcatagtaacagtgtagtcgtactactagtagtagtatatgagcagcagtagtagtagtaggtggtatatgagtagtagtagtaggtggtactagt

SEQ ID NO: 4453 - DNA, 1501 bp, Oryza sativa
attgctagtctgtaaatcgactcttctctgggtcaatctcgtatgctcatgtcggcaatgtatgccacgattctataaaacttgatattgaacttctgtttcctacagctgcaatgcccaaagttcatcgcaaattcttggcgagagaaggaaagctaaaaatctgttcggttgtagttccatataaccttagccggaagaggaccctctgactttcttccttctgactttgagtcactgatacgtgagtttattgggtagagggtccacatatcaatgatataagttaaatataagtaggttagagcatctctaacagtctatccaaatttgactgtccaaatgtctatttggccaactctccatttaatttagcaagtcaaattgtcttttactccaacagccactctattcgtcctctatattttgagtttattacaattgggctcacatgtcagtctctacacctccttctccctcatctttctcccattctctccaaaccccccttccctctctcatctgccgccgccgccccatccccatccccaccgccgctcgggctgtgtccccatccgccgccgccgctgctcaggctccacccgtcggtgccgctcttggcggcaaatccgtgcgcacgcaaggcaggctcgaggcgacggcgagggaaggccacaatggcggcgctagggcggctgacactgggaggacgacggcggcggcgctgtgagggcgacaacgacgacggagccgggaggacgacgacgtcggcactgggcagatggtggggcaggcagggagggagctctcttcgccggcacagggagggagctctcttcgccggcggaggggtggcgcggatgggcggcgtcggcggagagaatgctacgggcggcactggatttgggaggaggagagaggctacaggagggagagagaatagaggtggggcccacgatttagccagcgcgagcgactttggccagccaggctgttggagtgcaaatttgagccaaaattgctataatataacttggaaagtgggataaggaggctgttaaagatgctcttagcggatctcaatctaccttagcagattgggaaagaaccaccactccaccagtaggcagtagcagaagaattatctgcgagtttgttttctacaagaagaataaacaaaacctgcagggcggcgatggtttatcttctcttctctgcatagaagggagtggttcccccacccacgtaactgctactagaaaattgatcgttcgccctgtccttccagggaaaaaaaacgaacagtttctctagaaaaaccagccaatgttttttagaaactactccctctgtttcacaatgtaagtcattctaacattttctatattcataataataataatgttaatgaatatatatatatatatatatatatatatatatagattcattaacatcaatataaatacattgtgaaacggagagagtaaaaactaactgc

SEQ ID NO: 4454 - DNA, 1501 bp, Oryza sativa
tgttgaccatccaacagtatcaataagctagtttgttgagaaatgaccattatttagtgtttccctacacacattccatacagctattagaaccataattagacactgtgcaagcatctccaggtaagaattgaaaagttacctatgcagaaccaattagtagcatacatgcacgataatcttcctataaaccaaattaaattagcattcattacattgtatcttttaagggaacaggactcaatctaggcaagtttatttgggaatctctatgtgctgcatgacaataacacttctaattgaatattacgcgtgtatatgtgaaatcttgaactatttagaaactattaatgaaattgaactgtcgaaacttatcgctgaactcttcactgtccatttctgttgctccctaactaactatcgttgcatacaaactaccattgaagtgattaaattgcctaagtattgcctaacttggtattgaagtacttcctgatagtgtgcattcaagtaacccaatcctaacaaccacttgatctaaacacatacggagatgaaatatatgatgatcgaaaagcacacctcgtcaaacttggtggagaataggttgagagaggtgaggataccgccattggggccaagaccatactccttcatcacctccttgtaccgaacggtatcacggatatctatgttggccccaaacggcagcgtcatcaccgcagggtcaaggttgagcacataacccctcatgtttgaagcctgggtgtggcataccagtcggtgcataaaagttgtcttccccgtccctacatcacataaaccgagacccttgaggcctgagctcccaatcccaaaattactcaacaagagctcattgtatgacaggttggttgccactaaacatcaaaggatgaaccaatcagcatgcgaaatcgatgtaccggccatgccgatgacgatgatgatcaccggcttcttcttgaaattggtgcgctccgggccgatggagaggctcccgatggagtccgcgagctcctcgctcttccccttccccttcgcgtcagtctgcacagggtccatcatcaggggcaaaaaaaaaacagtcacaatcaaaaactgaaggtagaatccccgtggggaggagtcgggcggcggcggcggcggcatgcctggtcctcgaggtccatctgggtgggcttgcccgcggcggctgggtcggagtcgacgtccatcggcggtggcgcggggagaaggcggcggccacgcggcgagcgggtggaggacaaccgcccgctaaaaccctagagactactgcgctgcgactgcgaggagaggagagagagcttgagaaaggaggaagtggccgaacgtggatgggaagggagatggtcagtactcggcagtgtgaacatgctttaaggttttggacttaccgactttagttgacccatgctggcccatcaaattttgcgggctgacccacaaggtttcgtgccgg

SEQ ID NO: 4455 - DNA, 1501 bp, Oryza sativa
cactggtcactatcaatttttggaatgattactggctgctaaacaagcctctctgctaacaatttcaagccctgcattttcactctatgcacaaacttgtctctgttgtagtgacaattcaaatggggctgagcgaatcctcggtgccacgcctttcttcggctgtagagcagcaattgacacgccgcccaaaccctgacagatcaacaagatctcaaaaaatagctgtccccgatagatttactggagctctcaccaccaagcaagcctatgagctcctgctaccttcatctcaaatggacaagaactgccccccccccccccacccccgaagatacatttttttgttggcttctatcaaaagagcgcctaccaacaaaacaaaaaagaacctgcatgctaagacaattgtctcatccccaacttgtgatatctgtggactcaacgatggaacggccagccaccttatacctgctgtgccctttcacctgcaacttctgggcagccctctttattgaccctggaatctctgatgtacgagatgtcggctgcatttgccccctgcaactgcaaccataccggtggcgcaccatcggaccttcttttttttttttttgagaaccatcggaccttcttcttgctctgctggtggtgtatgtggaaccgctgacacgatgtcatcttcagaaatgagcaaccttccctacgactactccttcaacgctgttttgatgaagctaacttgtgggctgagcgtatccggcgccctgatcagattgtagtttcagcctggaaagaaattttctcccgtcctatgcaactccaacatatgtaatggcaacggcactgtcgttctgcccgtcccatataaccctctttgtaatgaaacctcttatcaaaaaaaaattcaagtggggaatctctcctatccggtgattatccaaaaaagataagtgatcactatcaattttcttccctcatgttaccaaacaaatccggaatttctctttctacacaactgtttgcgtcaacatatagatttacggtcaataattctaggcagcaagcaaccagccaccaccagcagcatcagcagctagcaagttcgcgatattcgcaagcctgccagataatcgtgcccacgctgccggcgaatggacatgcatcccttgtggcaaattcggcgtgcagtggatatggatttgcccacaatctctgaatgcaaccacctgaacagtcaaataaggtctgcaagcaagaacaaagattctttgcggccggcgaacgactttcgacggcccggcgagaaataaaagaacaaggattttgatactacgctcctgttttggctagctgtttcccctgcaagcacatctctccttccccatccactcatctttataagctccaaccagcgaaccgaagacacaacacgcatctaacatctgtacagctactcgtactagctaataacttgtctgtgtaattggcgctatggcgt

SEQ ID NO: 4456 - DNA, 1501 bp, Oryza sativa
ttcactgcaacattagatttataaatagtaaaacattgtaagtacattaggtgaaacatatatttggtgaaaacaaaaggagggagaagtaggtgggcccacgtggggggaggggcgcacggggagtgcctgatccggctctcccgcgccggtcgcgcgacgtagagattttcgaaagaaaggcgatccagacgttggatttcgcaatcgatccaacggttcatactccgcgggtctgcctggcgaaggatttttaatactactagagattatgccaagaccacctatacttgtttgtatatatataaagaaaaaagacgccctgaacatcaagtgcagcccatcaaaaagaaagagttgtacgcatgcctaaaccacctatacttatttgcttggttttctttataaatttgtcatactatcaagagaggtgataatcttggcaaacatataagagcagctctagcctgcacctaaaatcgatttcaacgtaaaaagaaccgaactatgcacactgtgggaagcgaactgcatgtgtcagatgaaaaagcaactccaaaacaaaagtcgaacactgatgataaaaaattgcttgttgctataggtgggattaagattttttttatgggtcccacccaaaatcgattttaacgttgtaggggtcgaatcgaatgtttatttgacttttgtggactagacttttgtgttcgcaagtgcaggatgggaacacatccctcctgcacgtaaaacggagcgtccttttaacatatgattaattaagtattggctatttttttttcaaaaatggattaatttgattttttaagcaactttcgtatagaaaatttttacaaaaaaacgtaccgtctagtagtttgaaaagcgtgcggacaaaaaacgagggagaggggttgggaacaggcgttgcaaatacagccttaccgaaccaacactacaaatgccctaagcaaacacacgccacattagtacacgagcgcgttttttttatttgtagctttgattttgttttctgtgtacgagaatctatacgataggacatcaagcacacatgagacaaagattatactggttcaggtcccttgcgaggaagccctaatccagtttatatgggattatggagaaaaccatatagattataatagagaacaatggaaccctgagattgccgacgagatccctatcaagaacggctcgacgagatccaccggtgagttggcttcgcgttctcttgattgtttctgctatggtgtgtgtcttgcgctaagattcgatgccatgtgcccctccagggtcctgtatttatatcgtaggttatcttgacctccagtagaactcggagatacctttctacgtatgggatcacaaatcccctatttcttccgaatatgactcttgtcgacgtttgatgtcgcgattccggtatttgtatggtatggggatcgtcggtgctaggatatatgcgagactgaggtaaaagaga

SEQ ID NO: 4457 - DNA, 1501 bp, Oryza sativa
ataatattttgcaaccagatttgtttggtatttactagacgtcagatttacgtcaacaacaacctagctcaaatgacacttgtaccaccacctaaggtctggtgttggtttctaccattaaatccacatattaatcatcctcacatccaaatttgtaataatataactttagtaggatatcaatacgcgtccctccctccatgccgcggccgcctataaaaccaccccatagcccttcccccctcccccatcggccatccatctaccatcacattcacaaactcacaatttttcacatcaccatgttctttagttccttaggcttgagagcaaaccctacccagggtagcccaagctggatctgaactttgtgttcttcacataatcaatcacacacacatcccgaccgggtccgaatagaagtatagaacacaaagagggggctgacgctgaccggtggggcccaccggcccggcccgaccacaactcctagtgggggtcccccgtggtgcagcgcacgtgcgaggtcgttacccctctccgactccctcccccgtaaaaccaagccgcggacttctcttttttcttttcttttctctatggagatagcttccgcggccgcccaccaaatctcgcccatggtttcctcccgcgaccccggcgaggaggccagcgcgccgccgcccccgcccccgcgccgcggcgagaagcggcgaatgcgcggccgcaccccgtcgccggagccggcctccgcgccgcaggtacgtgcttacgaggccggatttgcatgtggtgttagtagggtagatcaggggggaacacgccgccttcttcgtcgtcgtacgtggtggtggattcctttttgtttgttatatatataatttttgttccgtctcgcccttcacgtttcgaggaactgttcatttggtaggcgactgttgcacgtaaggaatcgttgccgtgggtttggggttcgttcgttttgattggagaggatagaattctgtctgtatggatcgtgaatttagttctctggtatggagcatgtggggggagtttctatttgtgtgttgtttgggtgctatcaggtcggatgagtagcaatgagatgcgaatttctggatgcgatgcgtttgatttggggttcttagattaggtcgggagagcattgggtggatcgatgaataatgtgtcctagagagaaaaacttatggatcctgagaattgtaggtttaaaattgatatgcgattcggatgccgcaacagattggcatcttcccctaggtaactctgggttctgttgttcctgatttgagattaaaggaataatttcccccaacctatcatgtcgatctgtaaattggtgatgcaaatttgtgtgtgatttcagtggctgtaactaattcgatgttcttggcctattgggggaatttgggatttggcccggcgaaaaaacttggatttgcccttgtgctagtagattgacaaatccatgaattga

SEQ ID NO: 4458 - DNA, 1317 bp, Oryza sativa
ccaatccctcaattagagatggtaaattaaatgcaagactagcaagctaggagtagctagagtgattcataagattaattcctcgcaaacacaagactaagacaatgaagtcactacctatgctgattgcattgtgtggaagatttggtgtgaaagaaacaaaagtgctttcagaaataaagaaactccaatgcaacagctaatggttaaaatcatagataaaattaatctaggtgtgaggtatatatatatatgtatggcgccaaagatatcgcaagaatattataccttagttcatatctagtgcctatgcaaagatataaatgtatttttgttgtttttattcctttcttctttgcgccgttagtgaatatgtaaatatactcaattcctatttaatataacagcagcaagtctggcttcgtttttatttaaaaaaaatgctcgcaaaaagaataaaaggagtaattaacctcaagaaataaattgggggatgttaaatttcacatgcatgtacacacagcgggcagccagactgtaccacaggtaaataatccacgtgatgaactatgtggtctccaaacaaagtggtgaaatactgtttaaaaaatgttgtaaactgaagttaaaactgaacaagagttccctctaaaaaaaagagttaccttgagagaaccacatgtacccaatcagcgcgagagcacgcccacggcgccttcacggaaaactgcgcccatagattggcgatatgtgcagttagtagagctaagctagcatggggtagcctgaacaaggcgacaataccgcgcggtttgcagagaggctttttttttttttttttggagaagcaaaaattggcaggaggataggccgccgcggcgcggctctgctgccggtagataatgaggtgaagaagagagagaataagccatccctcatagcaggtacaatagtatactattagctagctataaacatattttaataagataaaagatgatagagaagaacaacgggctacagatctgtagccagctgcagcacggactccaagacacaatatgtatatgacatgtgggaccatatattaaaagtataataagcaactattgtatgaattagctattagattggctacggatgaattgaagctagtagtatgctatactattaaacttgctcttatacaaggggcaagctctacacaatctccaagaaaagtgaaaaatgatgtgagagtaaactaatattttggtttgtgtattagatgtgatatgttgtatgcgttgccttttaattaataagaagacgatgaca

SEQ ID NO: 4459 - DNA, 1501 bp, Oryza sativa
tttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagtttggcctctttggtttgcgggaaaaatcttggtcgttctttcggatcggattttttttttttaaaaaaaaaaaattagctcaatctagggctttagaaaaattttagttgcagtttattcgacagtcagtcgggaatttattgggggttatgcattaggtggtgtctatattcgatgggggcaatgttatgcgcatcattttccatgcaactagtctatgcattaatttattgtttagttgcattagtgtctttatttgagttcatgaaaaatgttctatgcataaaaatcatcgtgctcggttatttatttgagtcttcttttgctttgtttaattcggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 4460 - DNA, 1034 bp, Oryza sativa
attcacttgatcgaaaataaatattagaccattataatatcagaaaatatcatgaattaatttgtatagtgtacaaaaagtagtttttacaatagtataggaaattactccatccgttattccatagagaatgttactgtaagattcaaaattattactctggatactaatataattcctgtcaattacctctctttttttttcttccaacacccaaccactctgccactcctgagttaggagtcataaccttacatcatttaacaagcgaaaatatagtacgtagtatttcttttctcaaaccttaatctctactaaaaaatactccctccggcccaaaataagtgtagttttgcactattcacgtttaacatttgaccgttcgtcttatttgaaaaatttttatgattagtatttttattgctaatagatgataaaacatgaatagtactttatgtgtgactaaatattttttaaattttcacaaatttttcaaataagacggacggtcaaacgttgagcacggatatccacggctgcacttattttgggacggaggtagtatataataacttttctaaaacatatgaagtattttacatgtgcttaaaaaaagtcataaatttatccttagtaaaagcaattctatatcagagtatcggtttcacattctctaccacaatgaataatgatactatcattatagacactgacatgtggggtaataggaaggtaaaactcacattaggggcagagctaaaacgagatgcacggagaaggtgccacttgtttaatttgctctgcttaatttatatcaagtttaaactaatgcgagtgtttaaatttgtattgaagggggtgcacatatggttgaaatagatcaggtatagctacaaatttatcttgattgagttcttgggcaccccctcaatgctctagctccgcccctactcatatactagtgattgtaatggtataagtgatattatgtagaggatcctcaaccccattcaccacgtttttaaacaaaaaaa

SEQ ID NO: 4461 - DNA, 1501 bp, Oryza sativa
ttcgttagggtggtgagtgcaccggagccaataaacaggtttaggtggaggactcgtgtttttttttaaagctcagccatacgcccatacgataattatttcatttgttcttttagatgtgcctactagttcgtgctagtaatctatagagcacttcaggactagatagcgagaaatctgttttaagagatcaacacgacacccctttgcatgcgaccttgggcgagtggctagctaagcttggactggttcctaagattgccactaaaaacatgtgtcaaatggttgactgaatatatatgtaaggtgtcagacttgtctcaagatataatggtgatgagatccttttgggacgcacctgatcgattctatgaatggactacaactcttttgaagtagcagatcatactagtgagcaaacgcttaataatgtcactcattccctccgtctcagaaaatacaatctaagataggaactgttatatatcctcggacaaccaatcaagacaagcacttaatccagattcgttgttcttgaatgcgtcacattctattctaagttaggttttttttatggagaaagtactttagattataaacaaaacgtatataatgattgagacagctatgtaatatcatttatgtacacagccacatcaactaagaacaaataaaaatggcatgtacaagagacaatatgatatctaatgtcactcctctcaactgtttccttgtaccctatattatctgagatgcctctttgcaaagatacatctcctttctcttctttctttatccatcgacacttcattaattaattgcaatgagtcatatggggtggggggtgggggggggatggaggaactaagaccaattaaggactaaaaatatctagcagtagctggtctagagctgattactggttaccaaacgatgaattcagattttaaaaattcgactattatggataacctattcgatttttatattactgcaatgttttccctccaactcgtaattcataaatagtagggctggccagccagttggcaattgggagtccaactcagaagacaatattgtgcataattcagttggcaattgtccggttaattttattagtaggacaaattcgttatgccagtggcacctagttcggtaacaaattttggtgttattgtagaggttggatatagcgttttcatatcaaacactcaaaagtagtttagaggttttcccctgtgtggatattatgggtaccccatacccatacggcatggttatccgaccagtcataggggataacttatatctatagaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 4462 - DNA, 1501 bp, Oryza sativa
gatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctctttttcccccacaccagagctgaagatcttccttgttggagctgttttgccaaagtttgtttcgtcgctgccgtcaaggtttgcctgtggagtggagtcgctcgctgctgaagtcaagcttcccggtttagctcgcttttatctttcccggtgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaacacctaacagccttctgaaccccttttcatatgcatatgccctttttcacttggatttgttttgggaaaatttggagttttgcctctttggtttgcgggaaaaatcttggtcatttattcggatcggatttttttttaaaaaaaattagctcagtctagggctttagaaaaattttagttggagtttattcgacagtcagtcgggaatttattggggtatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcatgctcgggtatttatttgagtcttcttttgctttgtttaacttggatttgagcatgaattggttcctatcccttgtctactttagatgtcagtcctatccctcgtttgcaagcgccgccccgagcttcaaagtcgccgcccttagctttatcggcttcttagtctgtttgcttgctaggtttcgtgttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttttgagccccctgtttttcttccttttctcatatttctacctatccccttcaga

SEQ ID NO: 4463 - DNA, 1501 bp, Oryza sativa
aaatccaaactttgagctgaacacagccttctttgattactcaatagtgacaacctttttgtcgtcgttgacagcatttaaattcccgcactactgttcgtacgtacgaaggcatgcatatcaatcgatccatccatcattctggaagaatcaatgcatatatatcatcattcgatcgatcgatcccatgcatacatcacaaatctttatatatgatcatgcatatgcatgtctatctaggctaacggctgcagtagtagtacgattgttgattgatcatcacaaggggaccaatctatacatatgtacatttatcggaacaattatcaaagagctagttactataggatgtgtgccacgatttgagttggcagctgatatatactgatagtactcctacttaaaatgccacgcatgcagctacagcccatccttttgttcaagatacaatgtgcttaattactctgtctcaaaatataaggatttttaggttgacagggttattaagaaaatacgtgtgaatgattaaagaatgattaaagaaagtttatcattggttgagaaaagaaaacatgtgaagtagaatggttgtgattagttaagagaaggtatgtagagaaatactagctttattttagcacaaggtactatgttagaaataactatatattttgagacaatataatgtacttaaaaatagctatattttgatacagacgtagtagtatgcatggcaaattgttctaattaatcacttaggggatgatgtacactcacttttgcacccatcaaatggttaaaaaaatgaaataataaaaaatgacatatcactataagatatatatgtcacatcacaaacaaataagtttaaatttgaccattctagtttaaataaaaagaacaaactaaacctctaaaaatattaatttttagtaatttgtgtaagttgaatttaaacttgcctgtggagtttctaaacttttttttaacttcaaaagttatttagggaatgaaaaaaaatcacaatactggtattattgcacaagtgcagcaagacaacaagaccagttgcagtctagctgccatgcatgattactagatagcttggtccgtcctctcagatgctacaattttgcatgtgtgtcgacggctacgccttcatatatggctatgagcctgacatgactcgctaacgaccacaccaaattcgccaaacttatcacaagacaagagcatatgccttacatatgttatgtcacgtttcagtatcgctccatgtcgcgctgaaatttcagagctatatagcacaacgtttattaattactcctagttgatgtatgatcgaccgacatccatgcgtatgcatactctctccgtactcataaagaaaatcatttaggataatgtttaagtcaaaccttgggaatataaatcatgaataactctcaaattgttaagtttaaaaatgtaaaaattatatgtatagatttgtcttgaaaaa

SEQ ID NO: 4464 - DNA, 1501 bp, Oryza sativa
gtgtttgaccattcatcttatttaaaaaatttaagtaattatttattcttttcatatcatttgattcattgttaaatatacttttatgtacacatatagttttatatatttcacaattttttttaataaaacgaacagtgaaacatgtgttaaaaagtcaacgatgtcaaacattttgaaacggagggagtataataagaacaagataggtgtcatcgttcaccaataatagtgaaacgagttgctatacggctgaaggattatgtacggattatttgtggcactcttccataagtacgattttttttcagaaactttctacatcagcattacttaaatataacttgttttaagctactacatcttttaacaactttgtaatatgttagactgaatttatctctgtaaacaatcatctgtacctgtagcgacggcatgctgcggggctctgaccaactgggtcgccggtgacattctgtgggaggacttgccgccggagaagcagcaagcatcggttgggatagatatctgcacggccctggcttccaacgccatggatgatgataatggcctcgttagtgattcagccgaagctgtgtgtgatggacaaaggtggtgatgcagtttatttatagaagcatgcaatgcaaccaagcaacagaggaaagcctaggattcgacaagtttcctgttgttggcatgggacacatgtacaggagaaaaacctctgtttcgtacagtacggggttgtctacaagatctgggggctactagaagaatgtccatttcacatactttttttagatgctaggagatgtcatgctgtattactaccgcgaagacatcagtatggtatctcacatagaaaaatcatcgtacagttactacttctctggcttaataattttttcaatcgtctttttagcctaaaggatgaaagaaaatcagagtttctactgttataaaaaagatactgaaagatattacattttctagcattaatttgtagttctgtaaaaatgcatatatcaagaaattttatggtacttaagaaaatatcttgagggacataaattttatactaaaaaattttgacacctcgagatacctaatatctgaaggtattaaattttgacgcgctcgttaatacggaagcaattctcagtgtttaattttgacgcgctcgtcaatacagaatcaattctaccatccgttacaaaacgggagagagagtcaaccaatcaacagagactctctactagctccgtttttaaattgagacctcttcacttatattttcaaggtggtattattacccataacacttaatgtgggcaatgaaatttattaggatttaattaggcttagcccattaatctaacatcttttaaccaatcttttcattttagaccagatgatcttacctactccctccatactcataaaggaagtcgtttaggatagcgacacggtctccaaaacacaactttgacttcttgtt

SEQ ID NO: 4465 - DNA, 1501 bp, Oryza sativa
cttccagaagcggttgccacccttgcctggcttcttacccttgccagacttctttgagctaaaatgaagcagaaaaacatcgttaagacatgtgaactgctcacagaatacataaagcattgaaagagcagaagaaccctacctgaggaaaacctttggctgcttcaggaaagccttctcagtctgcacaacagaaatggatgaaaaacatcaacactctacacaacatagctagaaccacttgcatcacttatttggattgaacaaatgggaaacaagaatacaaatctgtatctaattcagtagcagataagctccacatcaaccataaaagaagttaaaacgtgacaaacacacaactgcagcatcacgaatattaagcacagacctatcattcgttaccatgaacacggcagcggtaatgaacccaaacatcgaatacatccacggttgcgttaatctattggaacatctcagcaaaacttcgatccagtaacaatatctcagcaaaacttcgatccagtaacccaaaacttctattgctaatttaacacgagagaattacgagtaccgatataacaaacccaccgttcaacaaatccacatctaacaagaagacctcaacaaattcatgacactatcacacgaactttccatcgctagcgttccagcccaaatcacgagaactgagaaatcgagtctcacatcgcaacacgcgcatcacatggcaacgcgcccccacctagaactgactcctatagcaagcgacggagaagctcgacggaagaacaggaggtgccgggccttacctgctcagccatggctgcggggcgagggtgacgaccggcgagtcggcggcggcggcggcggcgcggggagtggaggcgaggcttgcgaaggaggatgcggcggcgcggaggtaaaccctagtgagccactctttatagcgcagcgccgcgggtgtcaaatatgcagatacacccctccctttacgggccacaaaacctcaagcccaataaggcccaaactccgggccatcacggatctacatgggtcctcggcccgtgtacgcaacctccgcttcatcacgcccgttcgtcgcggacggtgcaatgtggaccgtccgatcgcggcgatcggttgatcctggccgtccgtgtggcgccatagggggcgagagaggggatctctctcccctcggctgcagtttcgcattattccgacttcgccgtcgttctcctcccgtcgcggcgagcccacggcggccgcggcgccgccggagaggagcggagagtggtgatccgtcgcggaattcgggtgatcccttccatttcgtcctagttcgctccgtgctgtatagcctgtgagcagtcgaatcccttattttgctacatttgtggaattgatcgagtttgtgtgttttttgattggataattttgtggtttgggaagaaatggtgatggtggtttcgttggtgttgtgcagttgctgtggggataa

SEQ ID NO: 4466 - DNA, 1501 bp, Oryza sativa
atttgattcagagcactcaactgggagaggtaggtctgggccatcaagagcaacctccaaagaagactttgccaggacaattagtgtacacacagtacagtggcacgctcacctgtgagtgagagtgtaccattcttctagctagcttcagcctcgctgctcgctttcaaagctcggacgatctgcaataccctgtcgctgccatgtgggcccattccagggtgctgctgctggggtcccacatatgagttgtgaaggttatgtacaagatggaaatcatggaatgggggtataaatgtataatacatgtgtgtttatgtcctaaacaagaggtgctcttaataacgaaatggataaatagattataaaatatattttcttcttctttgttgttgttgctgcaggagtcacgaggggtttgacactgtttgctggtgcctgaacccgtgtgaccgacagtctgtatgtccggctagttaacccctcttctcctctaatccggcgatttctgaagtagatggagtaattaatactccctccttccctaaatgtttgacaccgttgacttttttaaacatgtttaactgttcgttttattcaaaaacttttataatatgtgtaaaactatatgtatacataaaagtatatttaccaataaattaaatgatagaaaaagaattaacaattacttaaattttttgaataagacgaacggtcaaacatttttaaaaaagtcaacggcgtcaaatattttaggatggaggtagtagatcacaaagtacctcgagaaaaaaaattaatagacaaaatacgaggcgattgatccttaacacgcatagactgagagcgtttatggttgtcacttgtgatatcattggcagtgtttcttaaaatttctactatctttaaaaaaaaagaagctgctcaaaaaataaaaaaaaaacttgtgctttgatgttttataatcattcatttttcagcattagctttaaatctataaatacaatttaactacaatttttgtttagtggtgttttgactgctgataagctgtagatgaaataattaatagataaagtagtgagatacattttgatagcatcgtgataagtgatacgtagttttaaccctaagatctggtgttcaatccctaacatacttataagtttctttttaaaaaaaaatatttggagcgacgtatctcccaccaattcttttttcttaagtagtagtgattaatccttgacacacatatgaaaaaattattaaaaaaatgttcggagggattcgtatctcccaccaattctttttttaagtaatagtgattaatccttgacacacatatgaaaaaactgctaaaaaagtgtcaaaggaaaaaaaaaacttgtgctttcgatgtcagcgaggagagaagagaagcaaaattagcttggaacaccgcacgcccaatcagaggaggtatataaagggcgcgaacaccgcacacgccggcggcgatcca

SEQ ID NO: 4467 - DNA, 1501 bp, Oryza sativa
ctcgaggagggcgttctcgcgaagctcggggtcgcagaggtcgagcaccagctgctccgccgacgccatcttcatatccttggctggctgccccaccccgccgcccacgccaccgccgccgatcggagaaggcgatggcggcgaggccccggcgaaggagggcggaatggaaagcgagggctgcagattcgccattatccccacagcaactgcacaacaccaacgaaaccaccatcaccatttcttcccaaaccacaaaattatccaatcaaaaaacacacaaactcgatcaattccacaaatgtagcaaaataagggattcgactgctcacaggctatacagcacggagcgaactaggacgaaatggaagggatcacccgaattccgcgacggatcaccactctccgctcctctccggcggcgccgcggccgccgtgggctcgccgcgacgggaggagaacgacggcgaagtcggaataatgcgaaactgcagccgaggggagagagatcccctctctcgccccctatggcgccacacggacggccaggatcaaccgatcgccgcgatcggacggtccacattgcaccgtccgcgacgaacgggcgtgatgaagcggaggttgcgtacacgggccgaggacccatgtagatccgtgatggcccggagtttgggccttattgggcttgaggttttgtggcccgtaaagggaggggtgtatctgcatatttgacacccgcggcgctgcgctataaagagtggctcactagggtttacctccgcgccgccgcatcctccttcgcaagcctcgcctccactccccgcgccgccgccgccgccgccgactcgccggtcgtcaccctcgccccgcagccatggctgagcaggtaaggcccggcacctcctgttcttccgtcgagcttctccgtcgcttgctataggagtcagttctaggtgggggcgcgttgccatgtgatgcgcgtgttgcgatgtgagactcgatttctcagttctcgtgatttgggctggaacgctagcgatggaaagttcgtgtgatagtgtcatgaatttgttgaggtcttcttgttagatgtggatttgttgaacggtgggtttgttatatcggtactcgtaattctctcgtgttaaattagcaatagaagttttgggttactggatcgaagttttgctgagatattgttactggatcgaagttttgctgagatgttccaatagattaacgcaaccgtggatgtattcgatgtttgggttcattaccgctgccgtgttcatggtaacgaatgataggtctgtgcttaatattcgtgatgctgcagttgtgtgtttgtcacgttttaacttcttttatggttgatgtggagcttatctgctactgaattagatacagatttgtattcttgtttcccatttgttcaatccaaataagtgatgcaagtggttctagctatgttgtgtagagtgttgatgtttttcatccattt

SEQ ID NO: 4468 - DNA, 1501 bp, Oryza sativa
ttacgaaaaataggggtaaaaaagtctacttcataccccaattctagcaacctctttttaatcataaataaaccctataacttaggtgttgagttaggttttctataaacgtaggaagatactatgggcttgttcattttataatcgcttttaaccttattaaattttagtaagataacaaactaaatatgatgtcaccaatattatcatactactaaaatttagtagttctagaactttcctatcataaaaacgctagtactaaattttgaaaagacatcaaacgctactaaaattcgataacaccaaagcttgtcaaaagttgatattgccacagtttaataaggttaattttggtaacaaagtgcacagcttatgttgtccctgctattaggttatgatcgattggagtaaacagaaaatggtaggcggtaggctcagccactgcctcacacaagacattattatcagtgacaccgagcttaattaccatccttccaggaaggccttgtcaccgcggctctgtgtctgcgcgggctgcggcgggttcatgcccacgtcgaagttgcccgggtatcccggcggcggaggcggcgcgtagttgccctgcggcggcgccgtgtacggcgcctgccccgtcggctgctgcagtggcgccatcgccggcggtgggtacgctgctcgcaaaagaaatcaaggaagcaaaaaattcgaacaccgaaatcactccatcagtaaaaaaaaaggaagcatgaacgcaaccaagaacagcagaagtctcccaattaattcccaaagtcatctgtagcattaccggtcacgggagccggctgctggccgtagtaactcatgatcgatcagcgagacagtagcacgctagcagtagcagacggtggaaacgcgtgcgcttgggcgagacgagatggagagagcgagtggccggcaacggcaacggcaacggcaacgcgtcgtgtatatatagccaggaggaacaccgaacacacgagtatcgagtactggtcaactggagcagagtctagcggatcaacgtacggtggaatgaagacaacgggggcggcttcggttttgaagctgatcgaaggaagctagatagccaagcgacgacgaagggccggccggacgagtgcctagctaggttggctgcgaattgaacctgtgattgccaattgggcgagagacaaaactgggcggagtcacacaagcagctaggatggagcatgcatggaggaaagaagacgcggtcgtccaagatgtagcgatagtagacactagacacttagagcaagtttatagtatagacactggctctaaatcatctatagttaatgttatagccaatttatacaatagttgctgactataatattaatacctggtctcacctgtcatacacatatttctcttggagtccgcgctgcagctggctacaaatctgtagcccactgctcttctctcttcttttatctctttaaaatatgtt

SEQ ID NO: 4469 - DNA, 1501 bp, Oryza sativa
caattctctgttttacacttacattcctatcaaaatcctacgtttttcctgttcctacattttctcaatcttgcgattcaaaggggccctaaatgaacctagcatttcttaccaaccaaaaaaaaaagatcttaccgatttcaccctactgatccattggaaatgtatttgaatgtgaacagtgcatcttggatccaaatcaatgctcacgatcgcaagaatgaccactcacattgcagcaatcccagctttagcgtacggagaagaggcaacaccagcaggccggaactggatggaaacagtctgtgtggctcacgagttgcccaatcctgtgctgcccccaatcatgtcaaccaacctgatctgcgtcctgaaatatcatgtcatcgcctcggccccagccttttcgtgtccatctgctatgtgtccagagatttatcctcgtgatctgtctaatgcaaccgcctgtatatatagctgtagttaagtattccatcgtcatatcaccaaaaaggaaaaaaaaatccaagagaaacagcgtcccttctgtattgccgcggttcataatttcatacagcaacccaattgccgcggttcataatttcatacagcaacccaattgcatcagtgcccctatgtggcgatctcgtctgtgcccctctgttggtctagtggcggtcggttacgtttagaagcggccgatccggtgctagccctctcctgggcgtgtgtgttggcgatgtcggcgtgtgggtggtattttttttcttttcctggttacgactctctatggttgtaatcttgtaattttttcatactctatcaatagaacctcgcaccgtctcgtgtgattcgttaaaaaaacccaattgcatcagagcacgaaaaacagttacaaaatcctactctctttctgatttagtataaggcattatctttattcagattcgttgtattatataatgttcaatttattttaggttgtttattttgagacggaggaagtacaccgatacgtgcaaacagtcactctcgcaacagctaagctaatagcttctcaaagtcgttgcgttgtaacaagacaactgaatagggcataaaaccgtgaaactgaacagtacctgttgccagtagatttgcgagttttcgatagagccgacgggtaagctgtcactattcagctattcagctatgacaataatattatcaagttaattatcagaatccggccgtgcaagcacctctccttaattattttgtcatttgtcacctcatcacctcacatcatatcctgatccctggctcccctgtccacaattaaatcgatcactagttgacgacctatctaataatccaaaatttcgatgaagcagcagcaggcagatgatgatgcagattgcgactttgcggatatcttgctcacgaaagttcaagttctttttggaggtagaagagttctattttgtaattgaaatggtgttgttcatggcaacctggagag

SEQ ID NO: 4470 - DNA, 1501 bp, Oryza sativa
tgcgtgagaatattcgcaagagaaggggcgcgtgagtgtggcggcaccggcggagcagatcgtggcgatgagcgaggggcaagggcgtaccggcggcggtagcggggatttgggcggagccgcggagcgaggaggagtgaggaggcggagggattcgagcggcggagtcatcgcgcgggcggaaagcgcggtggagaggaatcaggtgggattggtgatgatgatttcctacagcgaggaggataggggatagcgatggacggatgagattagatgagatggcggatggacgaatgagatgagatggatgatttgtccggtaggattgctagaggtgaactcctttttatattagtatagatgtcactggtaatatgctttcctatagctgatcttttccctcttcggtcatgttctgttctgcttaccacacctctcctccacccaaaaaaaaaaggtatggaacatcatcatgtagaaactaaaatttaagttgactcaaattaagtagaaaacatgctagaaagaagtatccctccctcactgctgacaaaaggaatgagggcttcaaaagaattgagagtacaggtagcggtcctagcggaagaaaggaagcatatggagcaatgaattggtctgcctctactactattagaggtaatctgaaaatgatttataatctcatttggatacagttatcataaatatgtaactcataaactcccagtggtgcagtataaatttttttatatgaattttgaatagcaactagatatgacacccatgcacattacatttacagagagcatatgacatgcttgcaatgatcaaacttccgaagaaatgtgcggttgttgttgttatgagctgtgaggcccagcaagcagagcagattagtgtgatttattgattctatatgttaaaattgatatactacatcatgtttctattttttgtagtgcagaatttttctagagataatttgtgtatccattcaataatattttttttctacaactaattcaggcaaacaacaatgctgggatgatttttataagcaggacatgaacgctagaaagctaaattgacaccctggtgcctcccgtttatagatgtcaccaacaagtaagagtgttcctctcgtgtttatattggaatattgttattgcttctatctgtaaaacctgaaaaatctgaaaccattcctatactgaataatagaagatataaaatgaatatgtgttgccattgcatccttatatttatttcttcaatccacaattaactatctaaaccacttttttttattttaattcacataaattattttcgttgctggttttagtatgaatattttgatatatctccgtgcaaaaaaggattttgatatagctatatgcatgtgcattgccattcgattccttttccaatatgtaacagtagtcattgtaaatatactttcatattgtttctctctgttggggcaagaactctgaaaaat

SEQ ID NO: 4471 - DNA, 1501 bp, Oryza sativa
cttctagaagtacgatatttttcgtattggttaatggttattcgttccacacttctagaaagtacaataactctaaaaactccctgcatcagtatccgtatcagtctgtttgattggagggagttgttgatggaaaatgggagtattattttcgagagtataagtttgtagtttggttggaatacttgaaaattcgagagtgtttgggagaattaagggtccaattcccaccaatctcttacctagggaggtctgttaattcgtgagatttgaagggaattcaatgtgaaaccaaacaaaggatggagactatgccaaacatgccctacgagttttttttttctctctctcaatcatccagtttaatttgcccttaatcaaagcagggttttatgagctaatcacaccttaatcgacattgagcaattgtacaacggtgccacaaaaaaattcagtgacagaagaaccaaaccttaggttggttggtcagtcagtcagtcagtcactgcagcggcttgaagacctgagagtgcggcgagacgacggcctcctgcaccatcctcctggggtcgccggggtcgcgcacccacttcacctcgctcatgttgggcgtctcgacgaacagcatcgtgaactcgcccaccttctcggcgcggccgcgccgcccggcccgcagcacgaggctgttgctcctgtggtaggagaagatgccgccggtcagccgcacgatgtcgcccggctcgaacgcgtcgcgctcggcgccccacaggaggaagtgcgccgccgccgtctcgtcggccacgagcgccaggcacgtctcctccctcgcgtcggcgcggccgtgcggcggcggcggcggcgccctggccgccttgtcgagcacgatgaacgtcgtgttcacgttgttggtggccgccggggcgaggtctttgagcttcaccgtgctgccgctgttgatgccactgacaacaggcacgtcgggctgcaatcaatcggttctggtcgttagtcaccgtagaataagcgcatcatggagtggccgcgtgcaatgctaaaacctatattggtagagtggtggaattcgtgtgtttggtgttcgtggtgaagcttgtgttggcgcataggacgaagcagcggcatgttgagtcttctgggcattctatcgaacaccttgaggtcgtcccaatactgacacaacttctcaattaatttttagatacatggaaacagtaggcttacccctttatgcgccatgggtgacgcgattcgtcgaccagcaacggcgacgacgcagacctcccaagtcccgaacccctacgaagagagaccaccaggcgttggattgaaccgtcgaagaagacgagaagatctgcaggattggggagaagctaactagctaagccagtgggcttgcctgggccgtgggtcaatggaattgatgggagcaggtcggtgtctactcgtgccatgcgcgcgcagatcccttgatcggctttcctag

SEQ ID NO: 4472 - DNA, 1501 bp, Oryza sativa
gattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacgttgcacctgcttccggcggagtggaggtaggtatgggccgtcccatcagaagggtcactcgggcagcagctgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagaggcggggctggaaggggggatgatctggagagtagatcccacgagaggaaaaaagggagaagagggtttttagagtaagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcaggcagatattttataagaatatggagaagtttcgtttcttagattatggcttctagttagtttttgaattttataactacaatttatcaggatttggatgaaaagctaaattgtttggaaattttgggagaaactggagctaccatagactccccaaacaaaaccctttgtgcgccacgatcggttcgcagcgtgtgccatcccacgcgctcggttcacacaccacgcagggaggctctggctcttcatgcgattctaacaaacctaacaaaccttatctaaaagagaaaaaacgaaataaagaaagagaaataccgaaaatactggtttgacacgcaccaggattttctaaaaaaaaaatccaacagtatcgatctaagacatcgtcaccgttattataagaggcatttgtaaatttgttatcgattttttcaatattgtaaggatgccactcgaatgatagttttagtagtatttttacaattttttagtggcagtcttataataacgattcaaaatagtggcaaatttgcaattgcccgttcttttatacgcagagactccgagagtcagtgcaagcaagcaggagctcg

SEQ ID NO: 4473 - DNA, 1501 bp, Oryza sativa
aaagttggaatcgccttgagccatgactgcctccaaaatcggtgcttccttaactcggctgcattactccgtttggctgcattgctccgtttgtcacgctcgcactgattgtcttgtcgttgtagatcagtcagttaattaggaccacacgcaggcagcgcaattagagcaagtttaatagtataaccaactactagttacaattcaactatagtcagtctaatagctcgtccatacaatagttacatactgcactattaatacctggttccacctgtcatacacactgtgtcttggagtccgtgctacagctaggtataaatctgtagcccactgctctcttatttatcttcttaaaatatatttacagctgacttatagcctactattgtacctgctctgcctactcatcctcatatcctttccttccttcgactacagggaattagtagaagatgggtcggtctgacacgtaaacacgggtacattaagttttttggcccatgtagtatttgctgacaacgacaagttgccaatcctgccatcgatcggggcattgtacaaagtctcgaatactacaggaaaagtaagttccatgacatcgaggtttaaaagttcaaatttataccatcaacagagcagatcagagtacatttaaaacatttctgagaataaagcagtttaagcggcagcagcgacggcaaggaatcacggcgctgatcccccaacgccggcgaccggtcgattcctgaagccgccggccgccaccgtactcgtatattcctctccacccgtgtgtcgcgtcgatcgccgtcggcggcgggcggcggcaacttctggtttatggagaggaacaactagggtgggccggtgattggtccagtttcgactaaacggcccaattggttcatggcccaggcgcatcttaggggttcggagatttcttctccgtaccccgtcgaaacatacgcattcgccgttgtggtgccctcgtatcgtattaccggacacctacgaggaaccatcttcgctgtgtgatgcttggcaactcgccggtgttctttccctcgagggtcggcgcgactacgatgttgtctaccgttcatatcgacgtcgatcatagctccacaatagattagggcactatgtgaaaaaagaaaagcaaaattatgccaaaattaagattaggccaaggattttgagtaagaggtgtgtacaattctcgagtcatgaattcgtgatcatgggcacttcacctcgtagaagttgagattacacactaggctgcgtttggatcctcggcaataaacatactagcctcgcttagtaaggtgagctgtttggcactgcagctaaaatgttgctaccgtgggcaagattacctcattttagctaaaatgtttattgggctttagctgcaatgggctagcccatgcttatcaggctaggaaagccgatcaagggatctgcgcgcgcatggcacgagtagacaccgacctgc

SEQ ID NO: 4474 - DNA, 1501 bp, Oryza sativa
ttgctggtcgacgaatcgcgtcacccatggcgcataaaggggtaagcctactgtttccatgtatctaaaaattaattgagaagttgtgtcagtattgggacgacctcaaggtgttcgatagaatgcccagaagactcaacatgccgctgcttcgtcctatgcgccaacacaagcttcaccacgaacaccaaacacacgaattccaccactctaccaatataggttttagcattgcacgcggccactccatgatgcgcttattctacggtgactaacgaccagaaccgattgattgcagcccgacgtgcctgttgtcagtggcatcaacagcggcagcacggtgaagctcaaagacctcgccccggcggccaccaacaacgtgaacacgacgttcatcgtgctcgacaaggcggccagggcgccgccgccgccgccgcacggccgcgccgacgcgagggaggagacgtgcctggcgctcgtggccgacgagacggcggcggcgcacttcctcctgtggggcgccgagcgcgacgcgttcgagccgggcgacatcgtgcggctgaccggcggcatcttctcctaccacaggagcaacagcctcgtgctgcgggccgggcggcgcggccgcgccgagaaggtgggcgagttcacgatgctgttcgtcgagacgcccaacatgagcgaggtgaagtgggtgcgcgaccccggcgaccccaggaggatggtgcaggaggccgtcgtctcgccgcactctcaggtcttcaagccgctgcagtgactgactgactgactgaccaaccaacctaaggtttggttcttctgtcactgaatttttttgtggcaccgttgtacaattgctcaatgtcgattaaggtgtgattagctcataaaaccctgctttgattaagggcaaattaaactggatgattgagagagagaaaaaaaaaactcgtagggcatgtttggcatagtctccatcctttgtttggtttcacattgaattcccttcaaatctcacgaattaacagacctccctaggtaagagattggtgggaattggacccttaattctcccaaacactctcgaattttcaagtattccaaccaaactacaaacttatactctcgaaaataatactcccattttccatcaacaactccctccaatcaaacagactgatacggatactgatgcagggagtttttagagttattgtactttctagaagtgtggaacgaataaccattaaccaatacgaaaaatatcgtacttctagaagcgtggaatgaataaccagtatggaaaattgttttcatcattgaagaaatgttatttacatgtcagtcagataatcatcagaaaagtatccccatggtgtccgtagtctagtttaagataattttctccattacctactactcatagagtacaaccttacatagtagtttttagtgtaataacgggcgcacgggcgcgtgtctgcccgcaccgctgctaggg

SEQ ID NO: 4475 - DNA, 1501 bp, Oryza sativa
cagcgacacggtcttcaaaacataactttgactttgtgtttctataaaaatatttattgaaaagtgatatatgtatatttttatgaaattatttttcaagacaaatctattcatataatttttacattttcaaactcaataattttagaggtattcacgatttatatttccaagatttgatttaaacattgtcctaaacgacttcttttacgagtacggagggagtataaccgctacaatttgtaagttctaataatgccctggctttcacttttaacataaataaatccacttccaacttaagactgtgttgttcagtgtttattgggtacctactacctcatttttcgtaagcacatatttcaaaatgctaatgctcaactcaactaatcctatgctaataggtcttattgttttgtgtgctgtgaaaaagcctaaccattaagccatatgaaatgaatcatgattaagtggttatagttcttgttgagcagtgcaaatagtcattcctatatttttttatagaagatctattccctcttaaaaagtcaaatcctaaaaataaatttggatatataagattcatctcgaggattaaggttttttttacagagggagtatgttatacatctctactattataaaaattgaagatgttttgccagtattttggtacgttattcgtgtatgagtcggttttaagtttgtttgcttttggaaatacatatccgtatttcagttggtttttaagatagttcacttttggtaatacaaaaggaatcatataaaaaatctgtttaaaaaactcacatgttaacttgagacaatcggactcctatctgtagctcatgattttctaaaagaatatatatgcacgcaaacttccacagtaaatttcatcttaaataaaccatataacaataataagattaaaatagacttcacccgttacaacgcacgtgcattttttttctagtaccataaaaattctcagtcatccgagtaaacatatctaatttttactactactaaattggttgtactagatggttgaacgtcggggattttattggcttgaattcctgcacgcatacatttcctaagtttccgataattagttgacaacccattttccaggcaaacgttaaatcactagtgctggaatctgaggatacatttttggagaagtcaagggacatgtttgctacacgcgctgagtcaccgaccaatgggacccacccctagcccggcacgtcggaaggccactaccgcagtgtgcgccccaaaatcgccgccgtcccccgtctcactccccgccgttctcctcctcctccgccgccgccgccgtcccgcccgcccgccgccaccgcccacatgtgggagcgcggcaggctaccccgcaagccgcgaccgtcccctatcctcgtgccgccgccgccggcgtccccgccgcccccgccccgcctcctcgccttcctcctccctagatccctcctctcgc

SEQ ID NO: 4476 - DNA, 1501 bp, Oryza sativa
agaggaggttgttatagcagaggccgcgacgacgacgacgaagggaaagaacaacaacaagtgtggattggccatgatctcaaaggcacaggggggggggggggggggcgggagaaaaggtcggcggcagcagcagaaagaggaaaaggtgagctcgatcagtgaagtggcagtggagtggagtggaggtgatgatcttgttcttctctcgcgcggccgatcgatcgatcccccttcgctttgtgcagaaaacgtcgtcgcgcggtttctagtagcttttcagtaccagtactagtgattatctccatcactctctcacttcacttggagagattaattagttggagtgtgtgctgtgctatcagtgtgtctttctttgtgtttctttttggtttggacgttttgcctttaatttcttgttgtttaattttggtatctatgctttcttgccactagagcaaaactgagagagagatagagggatatagatgggagaatgtgtggacgacgacgtgtttgtactttggttagcttctgggttagtagcttgctttaagctcaaggaaagcatgcatgaacaacagatcgatgcagtggtgtggcgacgatcgatgctgtgtcgtgttgtagcatctgcatgctgagatggaaggtcgattaggataacatgagatgcgagctaattaagctagcttagctctgtgaaaagttggtgatggcaacgtgtgtgatcgatcatgccaggggtcagggtggttttcttgtttactgattggcttatcagagacgtagggttcatctgagcttaggttgaccaatgttttggatggatggcttggccacctttgccttttcgtttgtgcattttaatgagacacttgccgtggggtttcaggcttgatcagtattccaatcccctacagtctacagacgctttctgagttttttttttttgagggttgggggggggggatgataagcttaggcattcgtgatcatcctgtgtctgctggttaatttgtcaatagcaattgtaaatcaatcacctgttaaaggcgtacagtttgattaagatgtacctaataggctactgaggaggaaagatcaaccgctgtcagaactacaagcatgtccttacataaaaaaaactccagtttgattaagatgtacctagtagcaaaataaattcttttttgctactagctgctatattatcgcaaacacgtttctcaaggtgtgtgttttttttaaaaaaatagtttgcacacacaagtttttttaagaaaaatcaaacaaatttattttttaagtttataatagttaaaaattaattaattgtgatataattgagcattttgtcgggtagggaaacaagaaacgttctccatgggctgtcgccggagtcccgcttcagtgcaaaaggccgtgcagaacgccgcctgcggcctgctgtgacaacccacaccggccgcgtctacttgggccggcgccatcgccatgc

SEQ ID NO: 4477 - DNA, 1501 bp, Oryza sativa
ccaacctcccggaccgtgcattcgcctcgacaaccatggtgtacagaccaaagcttggacggagccctcccctcctcatctcctcccagagctccatccctgcatccaacttcccagccctcaccagcccctccaccacggctgtgctcaccgccgggcttgcacggtgccccaccgccaccatctccctgtacatccccatagcagcatcgagcctccctgcttttgccagcacgtccaccagcacgccgtacatcccagccgacgcccgcccaatcccctccctcttcctcatttcatcaaacatcttgcgtgcggcatctatcctcccggcgcgcgcaagggctggcaccacgagctcgtaggttccctcgtcgagcgcgcaccccgacgatgacatttcgtcgagcacctcaaaggccttgaaggcgaggcccctggtgagcagcagcgagaggagggcattgtaggcgtgcgtctccaggaccctgaaacccgcgtcgcggaggcgcttgaagcagaagaaggcgggctcgaggaggccatgggtggcgagcgcggagagaacggcgttgagggtcttggggaaggcggcggggtcggggagggcgagggtatcgtcgaagagggagaggagttcggaggagtgggtggccggggcgaggcgggcggcgaggagggaggagaggtcgtcggaggggacgaaccatggctggacgcgcgcccaggcgacgagggcgaggagcggggtggggtcggaggcggggagggaggacgcggcgaggaggaggagagccggatcgggctgggacggcagcgcggagagcgcggcggagagggatggccccgagcggaagcggagcgcgagcgccgccagccgcgccgccgccgcggggcgcgggagcgggtgggccgaggagccggacaggatggtcgcgtcggcgcccggcaccgcggcgcgcgcccccggcgccgacgagaggacctcccccgactcgtccaggtagtccaccgtgtcggtccactccgccgccggcggaggcggcggcggcgaaggccccgtcgagagccgccgcccccgcgcggcgatcgagaggggcagcgccgccgtcgtgaggcggcggcgcgagaggccgacgcggagtagcatcgcgatgacgctgccgccgccgtggggctctctgcgactgcaagtaggggacttcgctagggtgccctttgggccgtgctcggcccatccaattacatgttgttgggccgtggcccattacaaggcccatcgcacaccgttgccgagtcgtcttcttcctcttcttcccctcttcttctgctctgctctactcgcgaagccaaagcctccgccgcgatcccctccgccgctcccacgagcttcgccgcccgcttccgtcgcgcgtcggcgattcgcgctctccccgactccagcgccttcgtcttcttcgacctcctcctccgaaggccccgccgatcgatccccggtgtc

SEQ ID NO: 4478 - DNA, 1501 bp, Oryza sativa
ctccaggaccctgaaacccgcgtcgcggaggcgcttgaagcagaagaaggcgggctcgaggaggccatgggtggcgagcgcggagagaacggcgttgagggtcttggggaaggcggcggggtcggggagggcgagggtatcgtcgaagagggagaggagttcggaggagtgggtggccggggcgaggcgggcggcgaggagggaggagaggtcgtcggaggggacgaaccatggctggacgcgcgcccaggcgacgagggcgaggagcggggtggggtcggaggcggggagggaggacgcggcgaggaggaggagagccggatcgggctgggacggcagcgcggagagcgcggcggagagggatggccccgagcggaagcggagcgcgagcgccgccagccgcgccgccgccgcggggcgcgggagcgggtgggccgaggagccggacaggatggtcgcgtcggcgcccggcaccgcggcgcgcgcccccggcgccgacgagaggacctcccccgactcgtccaggtagtccaccgtgtcggtccactccgccgccggcggaggcggcggcggcgaaggccccgtcgagagccgccgcccccgcgcggcgatcgagaggggcagcgccgccgtcgtgaggcggcggcgcgagaggccgacgcggagtagcatcgcgatgacgctgccgccgccgtggggctctctgcgactgcaagtaggggacttcgctagggtgccctttgggccgtgctcggcccatccaattacatgttgttgggccgtggcccattacaaggcccatcgcacaccgttgccgagtcgtcttcttcctcttcttcccctcttcttctgctctgctctactcgcgaagccaaagcctccgccgcgatcccctccgccgctcccacgagcttcgccgcccgcttccgtcgcgcgtcggcgattcgcgctctccccgactccagcgccttcgtcttcttcgacctcctcctccgaaggccccgccgatcgatccccggtgtccgcgccttctagttcgccttttcgagctctttttcgccggagacgacgggcgtgggcgattcggctggattcctctccggtacgtgcgatctcgctccagctctgctgatttatctaccctagctttgtggttgcggaacagccctgagtagcacccatgttttgagatgtttcgactgtatcgacttgctgtgcgcgcgtccctgttaggtctagcttccactgggtgttgtttactgctcaatctatactttaccactgtagcttctgccaccaatcggttggtcatgtgtatgcctgtgtgaattccactgggtgtgtgtgcacatgtatgaatgtgtgatgcaaaccaatatggtagatccagtggatgcttatactattaactgcttaagtaagatgtatatgccatagttttgcgcaatgtttgggtgtagttcattccatgttgttttccctgcagctggttgtataattc

SEQ ID NO: 4479 - DNA, 1501 bp, Oryza sativa
ttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggcgtagttcaggtggttggttgggcctgttgcaacgtggtgtagcgttggacagtgattggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctctttttcccccacaccagagctgaagatcttccttgttggagctgttttgccaaagtttgtttcgtcgctgccgtcaaggtttgcctgtggagtggagtcgctcgctgctgaagtcaagcttcccggtttagctcgcttttatctttcccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaacacctaacagccttctgaaccccttttcatatgcatatgccctttttcacttggatttgttttgggaaaatttggagttttgcctctttggtttgcgggaaaaatcttggtcatttattcggatcggatttttttttaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcatgctcggttatttatttgagtcttcttttgctttgtttaacttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 4480 - DNA, 1501 bp, Oryza sativa
catctatcccccatattataccgtcaatccaattgttacagccaatattcacgcaacagtagcaacagccaccacaaacataccattgcagcatgcgacttgcgagcacacatgacgcactcgacccctccggcgtcgaggtgaacaaatgcatggaccgacacaatgcacccacagtgcagcctctgcaggataagaacagagatacaagggagggatcagccaggaagcacaaatcacgaacaccaccacaaggctcgaaagattagagaaacgagcatgcatggggcaccgtaccttcccgcaggattcgcagttcctccacccggcaacctccaaatggaaagtctcgcaaaagcccccatgctcgaacgagtgactgaaacagaacacaccatgcatggcatcaggagagctctctcggagtcgcacgcgagtcaaaccaccacgaggaaccccaaaaaaattttacagaaaacccccgcgtattccgcggaaattacaacgacgtggcgatcactccacgtagatccggtgggcgccataggcgaatccgcccgcgcgtggaggaggagaagagccggcctccccgcacgaatcgagcacgcgggggggcgccgccgattgcgcgcgggagggggaagggggagggaggcgattaagggggttacccgtacgtactagcatcggtcgcagagctcggcgaagtcgccgttgcggagtcgccatccgcggcggcgcgggccgtcggatttggggtccttgcagtgcgcgttgaagcagatcctgggccgctgctgcggcggcgcgtgaccgggggggccctgctgctgctgctgatgctgcggcgtcggcggcggcggcccaaccccaaccgagacgaccgcctgaggcggctgctgcggatgcggcggcggtttcggctggagcgggggcggctgcaccgagatgggggccgccgccgcgagggatgggggcggggcggccaccggcggccgcgtcgggggcggctgcgccggcgacgacatgggcctcgaaaccctaaggccggccgcgacgagtccccccggggcgcgcggcgccgcgcggcgagagaggagaggagggggggttttggggtgtgtgggaatcgtgggggacggacggaataagacgagagagccagaggggaagcgagacggaggaggaggcttttaaagcgagacccagaagaaaagaaaaaaaaattgccgttgttgttgtagtagtactactactattactactcaaaccagcgcctcctcctgctacgtgtacacgacaccccccccccccccaacacactctactactctctcacccaattttattattattcgtaatctcgctcataactactcatttttatatactaatctctcatcgttgtactgtgattgtctacgtgatggacgaataatcatattcttttttttctgtccaacttggaacgagagagagattaattagagatcaatcgatg

SEQ ID NO: 4481 - DNA, 1501 bp, Oryza sativa
cttctagaagtacgatatttttcgtattggttaatggttattcgttccacacttctagaaagtacaataactctaaaaactccctgcatcagtatccgtatcagtctgtttgattggagggagttgttgatggaaaatgggagtattattttcgagagtataagtttgtagtttggttggaatacttgaaaattcgagagtgtttgggagaattaagggtccaattcccaccaatctcttacctagggaggtctgttaattcgtgagatttgaagggaattcaatgtgaaaccaaacaaaggatggagactatgccaaacatgccctacgagttttttttttctctctctcaatcatccagtttaatttgcccttaatcaaagcaaggttttatgagctaatcacaccttaatcgacattgagcaattgtacaacggtgccacaaaaaaattcagtgacagaagaaccaaaccttaggttggttggtcagtcagtcagtcagtcactgcagcggcttgaagacctgagagtgcggcgagacgacggcctcctgcaccatcctcctggggtcgccggggtcgcgcacccacttcacctcgctcatgttgggcgtctcgacgaacagcatcgtgaactcgcccaccttctcggcgcggccgcgccgcccggcccgcagcacgaggctgttgctcctgtggtaggagaagatgccgccggtcagccgcacgatgtcgcccggctcgaacgcgtcgcgctcggcgccccacaggaggaagtgcgccgccgccgtctcgtcggccacgagcgccaggcacgtctcctcccttgcgtcggcgcggccgtgcggcggcggcggcggcgccctggccgccttgtcgagcacgatgaacgtcgtgttcacgttgttggtggccgccggggcgaggtctttgagcttcaccgtgctgccgctgttgatgccactgacaacaggcacgtcgggctgcaatcaatcggttctggtcgttagtcaccgtagaataagcgcatcatggagtggccgcgtgcaatgctaaaacctatattggtagagtggtggaattcgtgtgtttggtgttcgtggtgaagcttgtgttggcgcataggacgaagcagcggcatgttgagtcttctgggcattctatcgaacaccttgaggtcgtcccaatactgacacaacttctcaattaatttttagatacatggaaacagtaggcttacccctttatgcgccatgggtgacgcgattcgtcgaccagcaacggcgacgacgcagacctcccaagtcccgaacccctacgaagagagaccaccaggcgttggattgaaccgtcgaagaagacgagaagatctgcaggattggggagaagctaactagctaagccagtgggcttgcctgggccgtgggtcaatggaattgatgggagcaggtcggtgtctactcgtgccatgcgcgcgcagatcccttgatcggctttcctag

SEQ ID NO: 4482 - DNA, 1501 bp, Oryza sativa
ggattgcgtactaatcatgtaactaaaacgggaaaacactgccaatactcaatagggacatggccggcatgctgcccattccgaacttgatcgagcattaaactagtagcaatttagcatgacatggtactcgtctacacgtgtctggccactgtatttagtacagtattcggtcttctcttcagacactgcactttgcgaaaccgtaagcacgaacagggcacttcgttttgaagaaactgcaccgggtttgtttcgagattagtgcacaagatcaacggcagagggggtctgcttcagttgcggtttaactcacgatctgggctgatgctacggcccactttgcttttgcgtgaggcccatatatccggcccgtgggtccacgcggtgtggatttcggcccaatagcccataaccacctcccttactcctcagcccggttgtccccagatccccctcttgtcaccgaggcggcgagcggagcgaagcgccggtggccggcggcgcagcgacccgcggaggagcgaggcggacgtgcggcggcgcatcgagaggagcaggtggctgcggaggcgcgaccggcatagggagccccgctggagaggggtcagcggcgcgggtgcgtgtcatccgtcggccgcgtctccatctcggatcgccggagagggaggaggggtgggggtggtacaggtgcgttctttgattcccctgcggtgagatgagctagcctgccatggattcgctgtgctgttcctacttagctcggtgatcttcgttgtaagcgtggtcaaatttgactttacaattttacattatgtgtgctgcttctagtctcgcgccgcctctaagcacattctttttccccctttctttatacttctgacccgtcgagtagaacttttttgacatcaatcgtgcttgcattctactactagaatgttagttcttgaagagagataacagattgtgcatttgttcattccatttcttttgttttttcattccatttctttttttgacaaggaggagagagacgggcacctaggagaagcttcaccggtttctatcaagtaagcttgttgtatgagtgaggttacagaacacaatgtccagcaatagcgggggtagcgcgaaggagaaagatcctgaaaatgctccggagcttgtggcactgccgttggtccggaccctgaggcctgttcatgcagtgattgatcctgccgctgacccgagatcagcacagctgtcttggccgggccatgtagtcctcctgcctccatatgcaacatggcctcatcatgtgccgaccctgccaccagcggtgaatcctgcaaatccacaacaaaacgtggtactgcgattttatagttgcctatgtgactttcttgatctaggtgttgagggatatgttcatatatcgcctccttcttattgattgtgctgtgctgcaatttgtgattggcaggatgtggcggcggctgatgttagtcctgacgttggt

SEQ ID NO: 4483 - DNA, 1501 bp, Oryza sativa
agccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacgttgcacctgcttccggcggagtggaggtaggtatgggccgtcccatcagaagggtcactcgggcagcagctgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagaggcggggctggaaggggggatgatctggagagtagatcccacgagaggaaaaaagggagaagagggtttttagagtaagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcaggcagatattttataagaatatggagaagtttcgtttcttagattatggcttctagttagtttttgaattttataactacaatttatcaggatttggatgaaaagctaaattgtttggaaattttgggagaaactggagctaccatagactccccaaacaaaaccctttgtgcgccacgatcggttcgcagcgtgtgccatcccacgcgctcggttcacacaccacgcagggaggctctggctcttcatgcgattctaacaaacctaacaaaccttatctaaaagagaaaaaacgaaataaagaaagagaaataccgaaaatactggtttgacacgcaccaggattttctaaaaaaaaaatccaacagtatcgatctaagacatcgtcaccgttattataagaggcatttgtaaatttgttatcgattttttcaatattgtaaggatgccactcgaatgatagttttagtagtatttttacaattttttagtggcagtcttataataacgattcaaaatagtggcaaatttgcaattgcccgttcttttatacgcagagactccgagagtcagtgcaagcaagcaggagctcgtcactgtcaattgacaaaattcagtagcaaatcctactctgtctgcatcaatggctggcccaaccatcgtcctcctcccggcctggggat

SEQ ID NO: 4484 - DNA, 1501 bp, Oryza sativa
ttaagttttttggcccatgtagtatttgctgacaacgacaagttgccaatcctgccatcgatcggggcattgtacaaagtctcgaatactacaggaaaagtaagttccatgacatcgaggtttaaaagttcaaatttataccatcaacagagcagatcagagtacatttaaaacatttctgagaataaagcagtttaagcggcagcagcgacggcaaggaatcacggcgctgatcccccaacgccggcgaccggtcgattcctgaagccgccggccgccaccgtactcgtatattcctctccacccgtgtgtcgcgtcgatcgccgtcggcggcgggcggcggcaacttctggtttatggagaggaacaactagggtgggccggtgattggtccagtttcgactaaacggcccaattggttcatggcccaggcgcatcttaggggttcggagatttcttctccgtaccccgtcgaaacatacgcattcgccgttgtggtgccctcgtatcgtattaccggacacctacgaggaatcatcttcgctgtgtgatgcttggcaactcgccggtgttctttccctcgagggtcggcgcgactacgatgttgtctaccgttcatatcgacgtcgatcatagctccacaatagattagggcactatgtgaaaaaagaaaagcaaaattatgccaaaattaagattaggccaaggattttgagtaagaggtgtgtacaattctcgagtcatgaattcgtgatcatgggcacttcacctcgtagaagttgagattacacactaggctgcgtttggatcctcggcaataaacatactagcctcgcttagtaaggtgagctgtttggcactgcagctaaaatgttgctaccgtgggcaagattacctcattttagctaaaatgtttattgggctttagctgcaatgggctagcccatgcttatcaggctaggaaagccgatcaagggatctgcgcgcgcatggcacgagtagacaccgacctgctcccatcaattccattgacccacggcccaggcaagcccactggcttagctagttagcttctccccaatcctgcagatcttctcgtcttcttcgacggttcaatccaacgcctggtggtctctcttcgtaggggttcgggacttgggaggtctgcgtcgtcgccgttgctggtcgacgaatcgcgtcacccatggcgcataaaggggtaagcctactgtttccatgtatctaaaaattaattgagaagttgtgtcagtattgggacgacctcaaggtgttcgatagaatgcccagaagactcaacatgccgctgcttcgtcctatgcgccaacacaagcttcaccacgaacaccaaacacacgaattccaccactctaccaatataggttttagcattgcacgcggccactccatgatgcgcttattctacggtgactaacgaccagaaccgattgattgcagcccgacgtgcctgttgtcagtggca

SEQ ID NO: 4485 - DNA, 1501 bp, Oryza sativa
tggcacgaacacattttttgtttttataagcggtacaatttttacataatctttctatacataaattacttacttcctccgtcccaaaatatagcattttttatgttggcacgggtattaagaaagtatgtgagaatgattggagaagttgtgtaattggatgaaaagaaaaggtaggtgaaggagaatatttgtaattggttgagaggaggaggtaggtggaaaaatagcttcatttcaagacaaggtactgtgctagaaatagctacattttgggacagaggaagtagaatatatttttaagtaagaaaaagttactttttcttgattgaatttttattgataatcgaaatttctagaatcctgaattatctgaagaaatttaatatatttctgaaatcgaaagaagacatggactctaaattaaaaatctagagtaagattgggactaaaccggaaaagggcccccaaagcacccgattccatctaaccgctttctggtttctccccccgctttcgccggcgcctcctcctccaccaccaccaccaccaccatccccccaccaattggactcaggggagacctacccgcggagacgcgaactcgccgcggattccttgccctccacgccgcaaaccgcagccgcgcctccgcctccgcggcgggatcccttgctcctcctcctccacccccgcgcggcgtgcggaactcgccgatggcgcttctggcccccgccatctccggcgaggtacgatccctttggctggctcgtacggaaaccctagatcgcttgagacgttgctgtcggcggcgcgttcggtttgaggatcggggggacgatcggggtggattgggggagggcgcgcctcggattacgctttcttcttcattgtacgggaagagcacggtagattgtgggttagcatgggggtttcttcgttcggtggattttgtgttccggagccatgcgattttgctcccattgccttgggatggtattgggggtggagctgattgagttgtaatttctcgtgggttccgatttgtgctgaacgctttctagttcatccaccaaaccacccgttgacgtgaggattcatctcacgggaatttggcagacacgactcaaccttatcgtttttcagcgcgttcaaatttatttgggcttgcttttagggaaaaattaactttgagttaacttattttcgttttgcaatgagcatcactcttgatcaaatctatatatccagtctgccaacagaaacagatagataccctttttatcagtacattaacgttttcctgatagcccattttttatggccttttgtaattttttgcactttgcaacgcctctaaatatggcacttcaaatttctttcttttttatttggggcagttcggctaatcaatctgtttgtatgaggtagagattacatttatattacgcatattatctcataatgtgttttctgatggattcctggaagttccatgacc

SEQ ID NO: 4486 - DNA, 1501 bp, Oryza sativa
caagcggcccgggcagccagcccagaaagccgaaagaatcctttcttttcccctcgccgcccaagcctccacatgcgctctcgtgccggcctgaaccctgtcggaccacgtccatgccgcattatttagcccccacatggccgccgctgcgtgcctcctcctctcgtctcgctcgctgaagacgtgatacgggcaagcgcgcgccgagtcggacagggagcacctttggcttgtgcgcgctccagcgtgacagcgtttcagttcaggggatcggacagagacgtcgcgtgcatgggtggcggtgtggtgggccgcggcttgtgcgagtacgtggcgcggcgacggtggctctcgctgctgctgtgtccgtcctcctgctactagtacgttttttcacgggctggtggagtgatggacctggtcagctactcagtttgcattcatgcatgcaccaccgcctgcgacagtgcgagcgacgtgacgacgtctccttgattgtctctcgtgggcctgtgctatatgtgatcgatctaatccctgcgacacgataatgcaatgcatatctctacgaaatcgaacagtagaacatgcacttcgaccttttctcatccgaaataattagtgcgggatactcattatatgcgaattcaatcagagggggctgcaatttgcaaactgcgtataattgtttcatgtggatttaaataacctcctcattgctagtactcctatcatgttgacttacacggaaaacgagctgtcttcccgtccatttgcggccctttgccgatcataaccgagacaagcgtatccagaacaggtgctagcttagctacgcgacgcccccgtcttgaggctccgggagatccgagcgcacatgtccgcgagttaatacgagtgcgtgccgtgccgcccggccggccgggcgggcggagcgagcggcttctgctttctgcttctgcacccagcaatgtgggcgctggccggagcacggagcgggcgaaagccccagttcgttcccatcccacatgccattgctaatcatgcacgcaccaatcacgcgccggccgtggccgaacccacggcgatgcttcccggttatcaccaccacggcaccacctatctctgtgcctgtgcgtgtgtgtgcgtttggcatgttgcggtgtcagggattgattcgttttcactcatcattcaccgcgaatccttctcgtgtccgctcgtagtaccaccgcaccgctggccgtctcggtgtccgaggccccgagcccaagcatgtcccggttcgatgggtggtcaaaaaaaggatatgagagggagagagaaaaaaaatgggaggaaaatgtatcgtttatcccatcatgcatgcacactgatcctgacgcctccacgcgcggctctttttataccaccctcgagagctcatcactcccgcactcactcacacacactcaagccagctccagccacacgagcctagttcaggtagatacaatggcgt

SEQ ID NO: 4487 - DNA, 1501 bp, Oryza sativa
aggtcattgcggccgcctgataacaatccggcccaggtggggtcggccgaggcccaataacttaaggttgtccggaccccaacagttctttagcacacccactcagggaaaggcccaatctccctaaaagactagtccggtaggggaagggtggctctcctttttaaggtggcttcctccttctaagctaagtaaggtgggattagctaagcaaggtgggattattcagaggctcacacggtcgccgcccgactttagcgtctctgccagcggataatagtggaggatgtcctcatcaccgcctgacccaaaccactatagcatgtagcaattggtttgaggctggttcttttcctcaataaattatagattatcgtagacacgttttacaagtttagaaacatggtattttaaaaactttctatatataaactgtttagaataatattttagaacaacttatctattttttcacaattaattcattcgtttgtatagtcgattatcatcacaaaattagataatctatcgtatgtcccgcccctaaatggagtattatattaattaatctatttagaacatcaatctagtccattaaaaaacaactaatccctccgtctcgataaaaagtaacttagcgtcctaataaaaatcaacatagattgatttcctgatttttattgggacggagtgagtaatatttatcgatccattttaaaatattttacggcgacgcatgatcgtacagtggaagtacgtaactaaacatgtaggaagagagaaggctagaaccttcacgctctttgccctaaaaaatgggtgacgtatccaatccaaacctgtactactaatcaaagggaaaaaataatcatacggcgcttgttaatgttaaaactatatgattgtgtgagtcagcgcactttgcacactctaacctctaaaccttaccccccaaaaataaacacacacacacagacccctccaaaatcagaaagcgagacgaagccgcccaaaaggcacacgaaatggggatcgaaacggaaatacccaaactgcccctccaatggcgggcactggctcagcgacactgacacgcccgggcccacctccccctcttctcccgcctatttaaccaagctaggcatccgatcctactcaccactcaccaccacagctcagctcggagaagcgaagaggaggaagaagagcaagacgccgatggttacgcgtgtgtgctagtggctgagcactagcggcggcggcggcggcgacggcgacgacgacctcacccacggcggcgacacatgttgagtgaacaaacggcggctagtggtagcagcagcagcagccgcggcgccgacgaccgggagattgtcatcagcaccggccgggagatcgtcgtcagaagcagcgggggtgaggagagggaggaggaggtggtggtggaggaggagctcgaggagccggagttcagggacatccacgcgctgagcccgccgcc

SEQ ID NO: 4488 - DNA, 1501 bp, Oryza sativa
gaaaatactaattataaaaaaattccgtataagacggacatttaatcgttggcacaaaaacctatggtttgtcttttttttttggaaggagggagtagaacacgagggagggtgccgtcatgcaatgcgtggaagccaccgaagtacgactagtgtggttcagtcatgttctgactcccgacggttttatcgagtactagtacagaaggaagcaaaccaagcgagttgatgaaaactcaaaacagaggacgcaaaccacagaatgtttccgtcgctgtctttgctggctgctgccacggcttccattcctcccgtcccttcctcccactgacacgcgggccccacgtcccccaccccacgacgtctcactgacatcctgtgccccacccccaccagcgcctcggcgcgtccgcctccgcccgccgccgccgcgggggccatcctccgtggaccgcgcccacggcgtgtcccctgcgtgcgtggcgcacccgcacgttttgtcacattccgcggcggcggcgtgcgtgcgggcgcagtggaccgagcccacgggctcgccaccgacgacctttctcgcccccgcccgcgcgccgaccttccgtacggcgtagcggagatacaaccgaggctttcggcgccgaatctcccgtccaccacctgcccccgtcccgatcccccgccgtccatccacctcaccgacggccggatgcgcccccgcgtggcgagatcgcggtcgcgggggcaaaaacccaaccccccaacccaaccccaccgcgacgcgagcggtcggtcaccaccgtcgcgcacctgtttgaatcccactcgtgggccccacccgcgcgcagtaaattccctccccccacccccccgagagcaaaaaaatcccccgaccgcctgagcctccgcgcccactgacaggtgggtcccacgtaatgccccgggccctcgtgtcagcgacagcggagggaggcgggtcggtttgcggtgggggatgcgagggacgtggcgcccgaggaattagaccatttaactcgtcgccaccaccaccagtaaactgcgagtcctcctcctcttctcgtcgccgtgctactctcgctttctctctctctctctctcacttgttccccaaggcgagaagcagccgccgccggcgagcgtcgcgggggaggggagggaagggagggaggagcggtggatccgggcttgattggattgggtcggattcgattttggatcaaccccggagggcgggaggtaaaaacgctactactcatttattgctttcctttcctttctccggtcgatccggccgaaatcggcgattgctcgccgcggaatcccgattgggtgtggggggatgggctgatctccttccgagaaccgggagctcggatgcgtcgagttggttttgtgctccttttgctttccctttttctggattcgggtttccatattggaaggtttcttgatctcgatttcgtggcgagagctggttgctgaa

SEQ ID NO: 4489 - DNA, 1501 bp, Oryza sativa
tggatcagaaattctttccctgtagtattgtagtagcagttagtactacttaaaactgatatagcacatgtctggatcgttgattgcctctcgatctaatgatggaaaacggtcccaactgcctttgcagtctctactacgactgcaccggatccttatgcgtctcaaatctattatttagaacgtgttaaaggtatagtcgcatattacgatacattctccatgatgggttgatggtacactcaccggcatgtctatatggcctgcatgtgtaacggtgataagctcgtgtgtaacggtatatagtagtcatttagtgtgtgtacgcgcgttccgcatgtgcagtgaggatcaagattatatgactttgtcactgatatgtggacccgatgttctctatgcccacatgtaagtgacaaaggcagcgtgcatctgactgcagaggatctcaatccgtgcagtggtgtgtctcgcgtaaatacgaaattagaagaaaaagaaactactccctccgtccaaaaaaaactcaacctagaagggacgtgacccctcctaggacaatgaatctggactggtgccacatcccctccccttccaaattgagttttttttaggacggagggagtatgtactagaaaatgtagcaaaagttactgctccctccgtttcacaatgtaagtaagtactattttttttttctcttacaaaaggacaaggaacacgaatgatgaaaccccagatcacctccacctccacctccaccgccacctcccacggctggctggctccacgtcggaccccatctctctcccacacacacgccttcgcattcgctgcacccatgactcgcgccgcgcggtgatttgccgtgatggcgacgggtgcgagccgcctcggcggcttttttttctccttttctttctttttttttgggctagccgctggcgaccgggttttccgcacggtttgtttgttggctggctcctcctcgggctcgctgcttttgggccggcccgccgcggcccatcataacgacataccggcccaataacatcatcaatcaaagcaccggttccctccctcctaaaataaacaggaatgaggagccatttagattgtagccaaaataaaccttaccaaatttttaacaatattgtcaaaattttaacattatttcttatgtatttattaaaaattgacaagaaattaaatggatccacatatttaacaacttaaaaaatatagtatggtttaaaatggcatcaatcctaaacacgccttgagtaagtattgactgtcgtctatacagatgcagatcatgcagttactggagactgacaggtactatacagatcatgattcttgagcaatgacaagccactgtacattgtactgaatatatacccctaataagttcaaaatttgcaggtaaactttctgcgttagtatcatagcatgcatttgatcaagaaaccatcagcattgcacaaagcaagagata

SEQ ID NO: 4490 - DNA, 1501 bp, Oryza sativa
gttgccacccttgcctggcttcttacccttgccagacttctttgagctaaaatgaagcagaaaaacatcgttaagacatgtgaactgctcacagaatacataaagcattgaaagagcagaagaaccctacctgaggaaaacctttggctgcttcaggaaagccttctcagtctgcacaacagaaatggatgaaaaacatcaacactctacacaacatagctagaaccacttgcatcacttatttggattgaacaaatgggaaacaagaatacaaatctgtatctaattcagtagcagataagctccacatcaaccataaaagaggttaaaacgtgacaaacacacaactgcagcatcacgaatattaagcacagacctatcattcgttaccatgaacacggcagcggtaatgaacccaaacatcgaatacatccacggttgcgttaatctattggaacatctcagcaaaacttcgatccagtaactatatctcagcaaaacttcgatccagtaacccaaaacttctattgctaatttaacacgagagaattacgagtgcggatataacaaacccaccgttcaacaaatccacatctaacaagaagacctcaacaaattcatgacactatcacactaactttccatcgctagcgttccagcccaaatcacgagaactgagaaatcgagtctcacatcgcaacacgcgcatcacatggcaacgtgcccccacctagaactgactcctatagcaagcgacggagaagctcgacggaagaacaggaggtgccgggccttacctgctcagccatggctgcggggcgagggtgacgaccggcgagtcggcggcggcggcggcggcgcggggagtggaggcgaggcttgcgaaggaggatgcggcggcgcggaggtaaaccctagtgagccactctttatagcgcagcgccgcgggtgtcaaatatgcagatacacccctccctttacgggccacaaaacctcaagcccaataaggcccaaactccgggccatcacggatctacatgggtcctcggcccgtgtacgcaacctccgcttcatcacgcccgttcgtcgcggacggtgcaatgtggaccgtccgatctcggcgatcggttgatcctggccgtccgtgtggcgccatagggggcgacagaggggatctctctcccctcggctttcgcctcggctgcagtttcgcattattccgacttcgccgtcgttctcctcccgtcgcggcgagcccacggcggccgcggcgccgccggagaggagcggagagtggtgatccgtcgcggaattcgggtgatcccttccatttcgtcctagttcgctccgtgctgtatagcctgtgagcagtcgaatcccttattttgctacatgtgtggaattgatcgagtttgtgtgttttttgattggataattttgtggtttgggaagaaatggtgatggtggtttcgttggtgttgtgcagttgctgtggggataa

SEQ ID NO: 4491 - DNA, 1501 bp, Oryza sativa
gaaggcgtgtgtgtgggagagagatggggtccgacgtggagccagccagccgtgggaggtggcggtggaggtggaggtggaggtgatctggggtttcatcattcgtgttccttgtccttttgtaagagaaaaaaaaaatagtacttacttacattgtgaaacggagggagcagtaacttttgctacattttctagtacatactccctccgtcctaaaaaaaactcaatttggaaggggaggggatgtggcaccagtccagattcattgtcctaggaggggtcacgtcccttctaggttgagttttttttggacggagggagtagtttctttttcttctaatttcgtatttacgcgagacacaccactgcacggattgagatcctctgcagtcagatgcacgctgcctttgtcacttacatgtgggcatagagaacatcgggtccacatatcagtgacaaagtcatataatcttgatcctcactgcacatgcggaacgcgcgtacacacactaaatgactactatataccgttacacacgagcttatcaccgttacacatgcaggccatatagacatgccggtgagtgtaccatcaacccatcatggagaatgtatcgtaatatgcgactatacctttaacacgttctaaataatagatttgagacgcataaggatccggtgcagtcgtagtagagactgcaaaggcagttgggaccgttttccatcattagatcgagaggcaatcaacgatccagacatgtgctatatcagttttaagtagtactaactgctactacaatactacagggaaagaatttctgatccaatagtagctctaggacagctatagctactgcaggggatcccaatcctgtttgagatcaacaacaaattcatgacctcttttctatagtgaaataattagttgatgtcttacatcttgctagaaaaatacacggatgaatgtatacatattgtagaaatgatggataaatatgtattgaaataaagtggaaatgatatgggacatgcttatatattaagctctaggatgtattaaatagtaaatgatatgctatatttgtatgtgatttaaaatattttgatagatttgtatgttaagctttaaaagctagcgggattcaaatatataaatatattccattgtgagcgcacttctatctatcatgctctaggtgttgactagatgtagcacggtcatttgataaagtaccatactctacatcttattaaattttagcagaatatgtacacttgtttttgtttttgagaggatacctaggagggtgtaggtacacatgagttatatacaaagacaaagcctacgacaaggctggcctgtacaaacattacttgtaaacggttgcacatcacaccacaattaaacatcatcacccaaaggcagcatacaacatagtcttctttcgggtatgctcctcatggaataaattatcaaacctaagctcttcctctttttttc

SEQ ID NO: 4492 - DNA, 1501 bp, Oryza sativa
gttctcgcgaagctcggggtcgcagaggtcgagcaccagctgctccgccgacgccatcttcatatccttggctggctgccccaccccgccgcccacgccaccgccgccgatcggagaaggcgatggcggcgaggccccggcgaaggagggcggaatggaaagcgagggctgcagattcgccattatccccacagcaactgcacaacaccaacgaaaccaccatcaccatttcttcccaaaccacaaaattatccaatcaaaaaacacacaaactcgatcaattccacacatgtagcaaaataagggattcgactgctcacaggctatacagcacggagcgaactaggacgaaatggaagggatcacccgaattccgcgacggatcaccactctccgctcctctccggcggcgccgcggccgccgtgggctcgccgcgacgggaggagaacgacggcgaagtcggaataatgcgaaactgcagccgaggcgaaagccgaggggagagagatcccctctgtcgccccctatggcgccacacggacggccaggatcaaccgatcgccgagatcggacggtccacattgcaccgtccgcgacgaacgggcgtgatgaagcggaggttgcgtacacgggccgaggacccatgtagatccgtgatggcccggagtttgggccttattgggcttgaggttttgtggcccgtaaagggaggggtgtatctgcatatttgacacccgcggcgctgcgctataaagagtggctcactagggtttacctccgcgccgccgcatcctccttcgcaagcctcgcctccactccccgcgccgccgccgccgccgccgactcgccggtcgtcaccctcgccccgcagccatggctgagcaggtaaggcccggcacctcctgttcttccgtcgagcttctccgtcgcttgctataggagtcagttctaggtgggggcacgttgccatgtgatgcgcgtgttgcgatgtgagactcgatttctcagttctcgtgatttgggctggaacgctagcgatggaaagttagtgtgatagtgtcatgaatttgttgaggtcttcttgttagatgtggatttgttgaacggtgggtttgttatatccgcactcgtaattctctcgtgttaaattagcaatagaagttttgggttactggatcgaagttttgctgagatatagttactggatcgaagttttgctgagatgttccaatagattaacgcaaccgtggatgtattcgatgtttgggttcattaccgctgccgtgttcatggtaacgaatgataggtctgtgcttaatattcgtgatgctgcagttgtgtgtttgtcacgttttaacctcttttatggttgatgtggagcttatctgctactgaattagatacagatttgtattcttgtttcccatttgttcaatccaaataagtgatgcaagtggttctagctatgttgtgtagagtgttgatgtttttcatccattt

SEQ ID NO: 4493 - DNA, 1111 bp, Oryza sativa
cccccttacacagtactacagcattgcttatttctattattgtacagtacgagtacgttctaacagatatgggctatttcctcgatcttgtgctcatttacaccgaaaatggttacctacatctagaaatggagagagtagtaaacagaaagtatagatacggccgttcctaccgagaagtactcttcctcgttgctcctgaatactgtagtttaaaagagactagaatatatatggggttgtttggttcactaccacaatttgcctcatcatgccacaactcaagttagccatgtttgaattagtcattcatttggttggtgccatacgtttagcaagattcattcaccatgatgtgggtcccacatatcattggcatataaaagtgtggcaagtttattctcctatgactgaagtgtggctttaattttattggccacatgttagacatattagctaaatgaagtatagcaagttttagtaatgtgagtatgccaaccaatcaaccccatagtcccaacaaacacatgccttgttcggagtactcgcaagtcgtaacagctggagctcggacggaggcagggctcgaggaagctaggtagcatatcagctaagagcttttgtccgtttctgcttgttaccgtcacgacatagcacggttccggatgatcgaggtcaacaaagcaatcaatgatgggccacctattcgttgtcaagacaaatgttagtgccctttgcattggccgtcctcgttcaccgaacgcaatcacagcgtactaatcttgctactaaactattcacatacgagctaccactacattagtacttatccaaaacaattattgaaacagtaagtactactacagtcactactagtacgctagcttcgtgccatcttaaacgtatctttgcgtgcaagctaacttccctcgagtggtacggtgccaccaccattcttatagcgctgcgcggccaaaacaataatcaggtcgcgttgatctaacttaacctatcaacgagaagaaactgaagtcgtcgtcatcatccgaatgaaaaaaaccgctcgtgccgatcgagcagtagtagtactagtagtttaagggaggcggca

SEQ ID NO: 4494 - DNA, 1501 bp, Oryza sativa
gcgctgatcactttcgcggcgagtgttgctgacttgcagcaacgcgcgccacttgccgccgttcggttggcctccgcggcgggggatgataataatggataatgctttatgcgagatacggctctgttggttttgcatttctttttcgttagggtggtgagtgcaccggagccaataaacaggtttaggtggaggactcgtgtttttttttaaagctcagccatacgcccatacgataattatttcatttgttcttttagatgtgcctactagttcgtgctagtaatctatagagcacttcaggactagatagcgagaaatctgttttaagagatcaacacgacacccctttgcatgcgaccttgggcgagtggctagctaagcttggactggttcctaagattgccactaaaaacatgtgtcaaatggttgactgaatatatatgtaaggtgtcagacttgtctcaagatataatggtgatgagatccttttgggacgcacctgatcgattctatgaatggactacaactcttttgaagtagcagatcatactagtgagcaaacgcttaataatgtcactcattccctccgtctcagaaaatacaatctaagataggaactgttatatatcctcggacaaccaatcaagacaagcacttaatccagattcgttgttcttgaatgcgtcacattctattctaagttaggttttttttatggagaaagtactttagattataaacaaaacgtatataatgattgagacagctatgtaatatcatttatgtacacagccacatcaactaagaacaaataaaaatggcatgtacaagagacaatatgatatctaatgtcactcctctcaactgtttccttgtaccctatattatctgagatgcctctttgcaaagatacatctcctttctcttctttctttatccatcgacacttcattaattaattgcaatgagtcatatggggtggggggtgggggggggatggaggaactaagaccaattaaggactaaaaatatctagcagtagctggtctagagctgattactggttaccaaacgatgaattcagattttaaaaattcgactattatggataacctattcgatttttatattactgcaatgttttccctccaactcgtaattcataaatagtagggctggccagccagttggcaattgggagtccaactcagaagacaatattgtgcataattcagttggcaattgtccggttaattttattagtaggacaaattcgttatgccagtggcacctagttcggtaacaaattttggtgttattgtagaggttggatatagcgttttcatatcaaacactcaaaagtagtttagaggttttcccctgtgtggatattatgggtaccccatacccatacggcatggttatccgaccagtcataggggataacttatatctatagaatatgtaatagatcatgactcgggtattacgtttcctt

SEQ ID NO: 4495 - DNA, 1501 bp, Oryza sativa
gtaatatcatttatgtacacagccacatcaactaagaacaaataaaaatggcatgtacaagagacaatatgatatctaatgtcactcctctcaactgtttccttgtaccctatattatctgagatgcctctttgcaaagatacatctcctttctcttctttctttatccatcgacacttcattaattaattgcaatgagtcatatggggtggggggtgggggggggatggaggaactaagaccaattaaggactaaaaatatctagcagtagctggtctagagctgattactggttaccaaacgatgaattcagattttaaaaattcgactattatggataacctattcgatttttatattactgcaatgttttccctccaactcgtaattcataaatagtagggctggccagccagttggcaattgggagtccaactcagaagacaatattgtgcataattcagttggcaattgtccggttaattttattagtaggacaaattcgttatgccagtggcacctagttcggtaacaaattttggtgttattgtagaggttggatatagcgttttcatatcaaacactcaaaagtagtttagaggttttcccctgtgtggatattatgggtaccccatacccatacggcatggttatccgaccagtcataggggataacttatatctatagaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctataatacacccggcggattcaaatccccaaacaggagtagggtattacctctcattgagagggcccgaacctgtctaaatcctttgtctccacatccatccacttttaggtctcgtgcgctaccccgttttattattgccgaaatcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtca

SEQ ID NO: 4496 - DNA, 1501 bp, Oryza sativa
ctcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattagatacaatatcattgcttttcgccacgtaagtgtgcatttttattgaccaatgttatggcttaggctgattatatattgtggtcattttctaggcggttggtaaatcctttatgagtttatttactcagattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgaccagtcataggggataacttatatctatagaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 4497 - DNA, 736 bp, Oryza sativa
gggcggatatgatggctggatcgatggcgtggcgatcgcccgcccattagcccccccccctcccaaaaaaaaagtcctctcaaatgctttatctacttaaattatgagctactactaatattaacatgggactgtaatgtaaaataataaaactaatttattttttaccaaaagagaaagggtgtaccgaccagggcagcattggcccacgtttgtctctacaagcccaatgatatagcgaggaggatgacatttgaaccttttttggctttagttgtctattttaaatcataaaaataaagaataaaaacgacatcatcataaagtaaaagtagaagacatcaacatcaggaggcgaatgtaaaaaagatactagtttcggtgtaacttacatacatttattttgcatacttttctgctctttcagttctctctctatctctgtcttttgtcctctccaaataaacaggacctaaagcgacatgagccgtgcaataagcaaaaggagtagattacacatcacgccaccccggatttcccttcgaaaccaaccaaaacctcaccaaattaacttgataaaccggcagaaaaaaatgagaggaataggcatcggctggtcaagtaatgtttaatttgagccaccaaaaggtgcacttcctctctcagcaagagtcccgtgctgtctgatggctcgagaacctaagatcgtgaacctacgtactgcaaagagatgata

SEQ ID NO: 4498 - DNA, 1501 bp, Oryza sativa
gaacacaatattgacggtgttaccaaaatggacaaagcagaaaatgatgcatctgacagcaattttctaccaaccaaattagatatcttacaaacacttaatattagcaggctgttagctaaagtgcatgctcaggaatgaaaaataaatgcccaagacagtgacccgcacaaataacaagatataatcattttttgggtgtattcttagtgaaaagacgtaaacatgggtgacaaggacgaacacaattatactacaagtgcagttggttaccagataacccctgaaggcagtctgaatcttgatagcggcaagctcatcctttgaactaacaggcgatttcggcacagccgtggtggctgttgtgaggcggaccacctcagcagcggcctgggcagcgacggcagcagcttctgcagcaacagcagaggcaagtgcaacagagtacgcatgcttgttctgttcactgtcagtttcaacagccttgacatctttgatctcctcaggctgtggctggatagggtgtgttggcggtggcggtggcggctgtggaggcggtgctgtagaggtaggcactgccactgttgaggtccaaggatcagacttcttagactttccaaatggccatttcctcctggatctcgacttgtccgccttctcgatcttcatggtaatcaaaagatatatattgaagcaaggagaatttttatgacaagtatagcgatttattgaggaagcagataagttttggcataccttagcttccctcccatctggatcggatgagctgaagactttcttgacagcactgaaccaatttcctttcttacccatttttttggtgttcctttattgtgtcttcagctaaagcctgaaagcatcagagcagacaccaaaggttcaggacacgaatggctgtaaaagatcagctgaaatcatataaccaccagtaaaatctatggttttctgcagaattaaaaagttcgacatggtcgcgcacagaaaagagggtttttagtaagatgtgttaaagatcagaagttctgccagtattatgatactgcctcaaacccaaccggtcaagtatccccactcgtaaaatcaaagatttaattttaccagaaaatcagcatggccaccaaaaattgacaaaaaaggagcacgcaaaagccttaaaccgatcagagtaaaaaaagaagcaaggaaccgaactccatggtttggagctagacgattaacgtcagtcgccaaactccaccacaacttactacctttctcacaaaaaagggcaaaactttgaccactaaattatcctagttccgcgtgttctccttcctcgctcgatcaatctggcagcggcaaaacctctcaaaccaaaaggatcaaacaccaacccagactgacaaaatcccccacccccgaaacaaaccctcgccacctgcggccaaatcccatcacaaatgcgcagcgaaattaaccctggattcacctggagcggagc

SEQ ID NO: 4499 - DNA, 774 bp, Oryza sativa
ccctccccctatactcgatacattcctccctcctctcccccctttcttctccccttcttctcttcctactacagtataccacacaatttttttttaaaaaaacaaagagttacaaaaatttatgtatagaaatactatatacaaaaaatttgaatcgggtatgtaaacttttgacttataaactttgggtctataaattttagatgtataaactttagatgtatataaatactatatatagaaaatatttgaatttaaattcaaatttgaatcggatataattcaaatttaaatttgaatcgggtatgtaaacttttgacttataaactttaggtctataaactttaggtgtataaactttagatgcataaaaatactatatatagaaaatatttgaattcaaattcaaatttgaatcagatataattcaaattcaaatttgaatcgggtatgtaaacttttaacttataaactttggatctataaactttaggtctataaactttagatgtacagaaatactatatataaaaaatattgaattcaaattcaaatttgaatcggatatataaacttttggtctctaactttatatgtgcaaactttgggtctctaaactttagatgtgtaaacttgaggtgtataaactttaggtacataaatttactaaaataggaaagtaatgcggtgccaaaaaaggaaaccagtagagggagggaggggggaggggaattgatcgctacccccgtcccaggcgatcgatcgccgattagg

SEQ ID NO: 4500 - DNA, 1501 bp, Oryza sativa
caatcttctaatggccaaacgggtaatgatatgtggatctgttgagtgtaaagaactactgtaaagggacaagagcataaaatcttggccgtcggattttacatcagcggctgatatcacctaaccgttgtagtagtagtagcaagtaaatttatcaacagcatcaggaaatctgactttgtacaaggaagaaaagtcagatgccctgtacacgcatactttcaaccctcctacagtcctaccagttgctctacttatagcttaggtacaataacttactataaatcagctataaatacatatcggtagttgttctacttatagtgtaggtataataaccgactataaatcagctataaagctataaatacatatcgataagataaataaaaaaagagaaaagtagtgggctacatatttgtagctagccacaacacagactacaagtatgacagatgggacaaaatattacttctatattatatatttatatgtaattattatatgaattggctattaaattaactatagataatttaaagataatagtgctataatattaaacttgttcttaccttgtaatataggagtagtggagatgtgaccactctcggtcttgcagtgcataatgttttttgtttttttttcttttagcaagacacaccatctaaattcgatttgacttgtgaaatgagttccgatatagtatatatcggtatagttcgcgtgggacatgataagatttttttgtactgcatggacgagtgagcggtgaccctaccacctctcacagtgcatggcaccataagccagcgcacataacgcgccatgcccttccccagttccccttcttataccgtgccccctccacttgagcttccccccaagcacacaattcgcccgaagtcccaaggctttttttacgtccaaattaaaaagaagccatgttccgccattcctcctctgcctcgtcggcggcctcctacggcagcgacgtcagcttcatgaaccactcgccggcggccgccttgcccgccgtcccgacgcagatccctcgcgtcgccggcggctacctcgacggcaatgttagcggcgggttacctcacttcggaggggcggtgtcgtcgtcgtcgtcgtcgccgccgtcctactcctcgtcgctcccttcgtcctactacaacaacatccagaggagcatcagctcgcactccctcccgcatcacctccagctcaccgaccacttcggcggcgcattcttctcgtcgtcgtcctcctcctcccaccagctgcctctgccgccgccgctctcctcctcgccgtcctcctcctctggcgacctcttcgagttcacctcgccatgccccgtccgccgcgtcttcagcaccggcgacctccaggtaatataagctgcatgcaacagcttgaactgcacggtgcacacttccaatcgagctgcgttcatggaagctcgactgacgaattgtgtcctgacgaaaacagg

SEQ ID NO: 4501 - DNA, 1501 bp, Oryza sativa
tccttacaaaaatttcgactaaactcgaaaccctaactcaaaactcaactcaattgctctcaaaagcgataccgggaagcctcacactccccctctatttatacccgagataggcagtctaaagccacgaaccaaactcatactagaagtcctaaacaccttaggaaaccctctagaacaagaaacaaactttacataaccaatcataccaaatttggactccttccaaattcaactccgcatcccatacgcacacaatacctccatcgtatgccatatggaatctccatcaaccacgtgcgtcaactctagcctaagtatcccgcatgatctctgaccaccacggatgacagagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctattcctgtgttctggtggatctgtgcgtgaaggaatacagagagctcgaaagcgagagagagttcaggctccagaacccctccgccagagtccccctctcctcctaggcctgggcctcctttttatctggtcaggggtcaccacaggggcctctagctgcctaagaaaggaaacatgctttttacaatgagggctagtctacagccggaagtgacctctgacaagcagagcacacgcctcctgccccgctcgccagctttcccggtggacgcccattttaaccttcattcaatggccagcgacttccttgccatgctcgcgctgaagcctggaatggatctgaccgggactgacgtaccaactccaggagttagcacgccggctccggctagggacgagagccgggaagctctcatcattctgacgggacggggcgaggcgtgtgacaggccgcctgttgccacccaacccgcgatctgaccggtctgtgaccggtcacacactatgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccgcagggggtcggggcgccccagccctcggggccgaaacgggagcggcccaacccctcggggagacagagggaggggcggccacatcaccctcgggcccgacccccccgagggggtcaggccacgtgggtgaccgcagctgccccaaacctctagtcaagatacccccggtcccatgtcaccgacagtagcccccggcgttatgccagggcgatcgccctcctcgaggaaagcgctcgggcgtgacgccactccttaggcctggtgacaggcggggccggtctctacaggcgggcaggaatccagtggtgcgcgcatcggcaagggaaaaccgaccgacaataa

SEQ ID NO: 4502 - DNA, 1501 bp, Oryza sativa
ggctggttcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccatcggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcaaaggaaaggaagaatacggaccgccccgggtagtgtggcgccgggcgtccctcacccagcgcgaccacctcccggccggtggcagattccggcatgaatcggcgcggcagcccggcctgcctctcgctcacgatgcgagaaggcggcagcatgctaccgtcgagcggtgcggagccccgtgccatgacgccagcggaggaggggcttgagagcgagtgagtgtggcgagggtagggcacaggaaacgagaagttagagcgcaagcggcgaaggcaaggggaataatggcgagaggaaggaaacgagtctcttcctcggcgtctttatacccttgccaacgctatgcccggctcctcgcttcccgggcccactatctcgccccctcgtttctcacgcccactcctccactaatcccgctcgcccgtttgcggtgcacgaggcggatgtgcggccgtggcagtcgagatgggacatatcgtgcgcgccgaccgatgcaccatcatcacatctccaggcgaaacgaaccggctcgtcccgattcgcgcgctgctcaagtaatgtagcggtcttgaagaaagccgctcattattgtcggtcggttttcccttgccgatgcgcgcaccactggattcctgcccgcctgtagagaccggccccgcctgtcaccaggcctaaggagtggcgtcacgcccgagcgctttcctcgaggagggcgatcgccctggcataacgccgggggctactgtcggtgacatgggaccgggggtatcttgactagaggtttggggcagctgcggtcacccacgtggcctgaccccctcgggggggtcgggcccgagggtgatgtggccgcccctccctctgtctccccgaggggttgggccgctcccgtttcggccccgagggctggggcgccccgaccccctgcgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcatagtgtgtgaccggtcacagaccggtcagatcgcgggttgggtggcaacaggcggcctgtcacacgcctcgccccgtcccgtcagaa

SEQ ID NO: 4503 - DNA, 1501 bp, Oryza sativa
tggggccgaggctgaagagcgacagggagcggttctcgccgaacaacatcctcctcatgatcgccggcggcgggctgctgtggctgggctgggccgggttcaacggcggcgcgccgtacgccccaaacatcaccgcgtccatcgccgtgctcaacaccaacgtcagcgccgcggcgagcctcctcacctggacctgcctcgacgtcatcttcttcggcaagccctccgtcatcggcgccgtgcagggcatgatgaccggtctcgtctgcatcacccccggcgcaggtatcagctgcttcctgctagctttgatcaattctagaatccaactagattagcaatttagtactactacactgtgattagccagttgccattcacatagtttcattaatgaggtcgttgaattggccattcgttaattaattcagttggattaacgaactagttgtgtgatggcatgcaggtctggtgcacacgtgggcggccatactgatgggcatctgtggcggcagcttgccgtggttctccatgatgatcctccacaagagatcggcgctgctccagaaggtggacgacaccctcgccgtcttccacacccacgccgtcgcgggcctcctcggcggcttcctcacgggcctgttcgccttgccggacctcaccgccgtccacacccacatccctggcgcgcgcggcgcgttctacggcggcggcatcgcccaggtggggaagcagatcgccggcgcgctcttcgtcgtcgtgtggaacgtcgtggccaccaccgtcatcctgctcggcgtcggcctcgtcgtcccgctccgcatgcccgacgagcagctcaagatcggcgacgacgcggcgcacggggaggaggcctacgcgctatggggagacggcgagaggttcgacgtgacgcgccatgagggggcgaggggcggcgcgtggggcgccgcggtcgtggacgaggcgatggatcaccggctggccggaatgggagcgagaggagtcacgattcagctgtagtggtggtagagtgggcattttgtcgcaggctttgccgcactgcagctaaactggacgttgaccatacgataattctcatctcgtacaggtagatcttgcaactagcaagatggagtagcagatattactaaacacatatgcttcattattttatttctggagtaaatcaagattcgttttggggtagtggtagatatttgcaatctgatgcagtcagtatgcaatgtgtcctaccctgggagtcccaatagataaacaaacttttgccagcattgcacacaagcaaacctcacggtaccatggtttcagtggaatctactgtaaattggttttgcttagttagcttggacaggtctgagaatatctcaaaactgtagagtacgcgaccgcacgtggacgcctgatctgagtctgaagaactgcagaagcaagcctgaagacaggccagtgcaaactgaaatatgacagcctaacagat

SEQ ID NO: 4504 - DNA, 1501 bp, Oryza sativa
atactacactattaatatatggttccacctgtcatacagacactgcgtcttagagtccgtactgcagctggctataaatctgtagcccaccgcccttctttctcctcatttatctacttaaaatatgtttgcagctggcttatagcctgctattgtacctgctctaaaacgcagatctgaaagctcagtgtgtgtatagttcacgttaaatttgaaagtttaattgaaattgaaatgatgtggttgaaaatattaaaaatttatgtgtgtagaaaaattttgatgtgatataaaatttgaaaatttgaagaaaaagttagtaactaacccagccctcacatcacagctgcaccccacctatcgctgacacttttatatatccgcgctcccacagatctgtgtcagaagaaacgggctttgatttcggacggtgcgattcacgtacgttcaggtggcgattggtgaatggggatggcgaataacgcacgattcaacgtacagaacatcgctacaggtgtatacccatcagggagctgttttggtactgcatagtggggcgccggcgcgatgctaacggaatgtattcattggattgcaaagaaggctactgacggaaaattgagtccgtgactatactgactgcagaaaaaaaggctcggttaggattaatttatttctctttttttttgaaaagttaggattagtttattttctgttgtacagtttgttaagcaatatagaatcatctgatgcacaatctgatgcacaagtatttggacaggtttcccttttaggctgaaactccaatagtttctcgaaaatttgttttaaatatgaagccacatgtatttagggaactctggttattcgcaataaaattatatattaatatacgtgtatcaattcatacgaaggttgtgtttgtcggagcatttcagttgaagttgttcgttgttcgaaacatagaatgaatcactaccgcgtgattaattacatattaactattattgtcggtgacatgggaccgggggtatcttgactagaggtttggggcagccgcggtcacccacgtggcctgaccccctcgggggggtcgggcccgagggtgatgtggccgcccctccctctgtctccccgaggggttgggccgctcccgtttcggccctgagggctagggcgccccgaccccctgcgggtttggcgccacgtgtgtgggttaggtgagcacagcggcgctcacctaaccgcgtttattgcgggttggacgagcgccccacgccgcatttaatgcagcgcagcacactcgttcggtccgtgagaggtcacagtgtgaccggtcacagaccggtcagatcgcgggttaggtggcaacaggcggcctttcgcacgcctcgccccgtcccgtcggaataatgagagcctctaggcactcgtccctagccggagccagcatgctaactcctggagttagcacgtcagtcccggctagattcataccagg

SEQ ID NO: 4505 - DNA, 1501 bp, Oryza sativa
acttgccttgggagatgggagaatgaatacggccgcagtgggcgcggggacgaacctgcgaggaggtcggctaaacgaccaccttggggggggagatgaggtttccccggcatggttcggtcccccccatcttgcggagccgcttcttttttcgctcctcctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagaagcacgaccccctctcggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccatcttgaagtcttcagggacccagtcccatttgaccccctggtgggtcctcatgtagtcctcggacccggtgtactcccaggcgccccgggcgcgccgctggagtggcgcgatccggcgatgaaggtaatcgccgtacaccatggtccccgtgagcccctgggatcgcagaccagccaggcggtcaagaacggcgtcgtagccgtctcccagatctaccggcgcccgccagctggaggcctgcgccgggggctggttcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccatcggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcaaaggaaaggaagaatacggaccgccccgggtagtgtggcgccgggcgtccctcacccagcgcgaccacctcccggccggtggcagattccggcatgaatcggcgcggcagcccggcctgcctctcgctcacgatgcgagaaggcggcagcatgctaccgtcgagcggtgcggagccccgtgccatgacgccagcggaggaggggcttgagagcgagtgagtgtggcgagggtagggcacaggaaacgagaagttagagcgcaagcggcgaaggcaaggggaataatggcgagaggaaggaaacgagtctcttcctcggcgtctttatacccttgccaacgctatgcccggctcctcgcttcccgggcc

SEQ ID NO: 4506 - DNA, 1501 bp, Oryza sativa
tttataaatagtatgttttgtaaacaaaaattatatataaaagttttttatgttcaaaatcaaataaactctcttttgaatttataattgacggagcgtggggctcctcaccgggagaccgcgcgggcccccctttgccggttcggccaggggcgctaggtgaggttctaagccctcgatctgtggaatgtttcgcgagagagcaaatgcgcaagacacgggcgatgtagacaggttcgggccgctgagaagcgtaataccctactcctgtgttctggtggatctgtgtatgaaggagttacaaatagctggagagcaagagagttcaaactctaaagaccctcttcctctttctctcctctccgagctccggtgtttttccccccctcttctctcttttttctcttaagtgggcaaggtcctccttttatatctcaaggggataccacatgcaccacttctacctactcttcttttgggtggggactcaccctatcttccaaaaaaaagtggcttgcgccttcgcctagaagctaaatcacagcttgtctttgagtgaggcccagcgtcatcactcgcctgacaccggggatctccctgttactccctcattaatgggcggagatttgccatggctgctgtccgaatgaccctccgatgggatgagccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagttagcatgccggctccggctagggacgagtgcctagaggctctcattattccgacgggacggggcgaggcgtgcgaaaggccgcctgttgccacctaacccgcgatctgaccggtctgtgaccggtcacacactatgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccgcagggggtcggggcgccccagccctcggggccgaaacgggagcggcccaacccctcggggagacagagggaggggcggccacatcaccctcgggcccgacccccccgagggggtcaggccacgtgggtgaccgcagctgccccaaacctctagtcaagatacccccggtcccatgtcaccgacagtagcccccggcgttatgccagggcgatcgccctcctcgaggaaagcgctcgggcgtgacgccactccttaggcctggtgacaggcggggccggtctctacaggcgggcaggaatccagtggtgcgcgcatcggcaagggaaaaccgaccgacaataa

SEQ ID NO: 4507 - DNA, 1501 bp, Oryza sativa
aaatatagcaacctagtactctactagataggttgctacattttgggccggatggagtactaaacaataaatacagtatcacatagaatctgacgaaccatagatgaattcgtgaatatacgcaagttcagcagcgttctctagctattttccccattattattggtctaactttcttctccttcgatgtgaccaaaaggcagctcaccaactactcaatcaactacttaagagacacgcagcacatgctgtggatggatcacgatgcagatgagtaaagtcaagattcctccagcaaagcccagaaatccgattcactcctctcccctattcaaaaaggtcaaaagtatcgattctgcacgaggaaaaatagaaaggatcgagcttcgatcattcccacattttgatcactcctccaagaatgttggaaacaggcattccccacgcaggcacgtctgtaaaaccagtggccatttggccgcacacaccaacccagagctgctatgggggtctcaccgtgtgagcgtcggggtcgacggcggtgcagcgggcgaggaggaagtaggagccgggggacttggacacggcgggctggatgcgcgcgagaggctcggcgacggagcggaactcgagcgtgccgacgcaggtggaggcgaggagcggcgtgaacaccatgtggttgcgcggggagacgcacaccacctcgtacccggtcgtgtcgatgtccttcatcagccgcgaccccgcccacccggtccccagcaccaccacccgcgccttctcccccttcgccgtcggccccagccccgcgaaccccctcctctccaccgcatccgccgccgcggtggagaacggcgagtacgggaggcggctgtggtggaacgggctcggccccgcgcctcccacgcagccgcggcgcgagatgcgggagagcgaccggagcaaggacgacgccgccatggccggcgacgatgagacgagattgcgattgctgaacctgaacgagaagtgagcgactctcgttaaacgaactgcgtttttgctagaaagtcgccgcgtgtggagaaaatgttgggtgacccgacgacctcacgctccgtccgatccgagaggctgagatctggacggcgaggggctcccccaccgtcggatcgcgggtgaacgggcaccgttgaaggtctaaagcccccagccagaggcggtttcgtcgtcgcgtgtgcggtggaattttttgcggtggcggagtggcgaggccaagaaacggggagaaatcgcacaaaaccacggcgttttccgcatggcccgccacgcggcgcgaaccacatccactgccgcgccacgcctctcggccgccacacgaccgtgcccccatcgcgccgggcttcccgtggaccgcgcccacccgcgccggcctcacgcgcggctgaggctcacgtagcacgggtccacaccaccgaacaacaacccacccctcctgcgctctccatcccatccgcatccc

SEQ ID NO: 4508 - DNA, 1501 bp, Oryza sativa
acggagactgaccggatggtgatggtaaatcgtagaagttaagcaaaagtcgatggtatattgtagaacgtgacaaagtcaatagctaatcatagaaatgagacaaactcaatggcatataatggattctgtatattgaccctaaactaggcccaacacgtaagctgttcagcctgttgtgttttttttttacccaactggtagaagcgtgatggtggggcattggagggatcgatgcagcttaggatgtaaataggtcaacccgtgaatctatttataaataaaattattggataacctataaattaactcacggttacctactaatttgatctataaattggtttacgggtatatccacttacatctatttcggctctatttgcaatgcccatcgcctcagattgggcctggcccatgggggttagggtgttgttattaggtcagtgccatgccgatcgtggtgctcctgtgactgtgggagaaaatgggaacgagttcacttcatgcagtggtgcacgtatgttcacagaactagctagtggagtctgtgaagacgtggctcctgtgcaaactttcaagagtccaatatggtctacacggacaactggagaagtgaatatatcaccaaattttggacctcttcactttgatgccattttcaaccatacctttttttttatattgttaaaaaaatatctacgtttagtttgctaaatttggttaacacataagaaatactaccaaaattttagtaatattgtcatcttgctaaaattttagcattattaaaacttgataagatttattttggctacaatctgaattggtcatttgtgtatctagacaaacccgtcataacgatgaaactgacccgcacaaaccaatcaaataggactactactctgcctagatggttctttcagctgctagcataatcccgacatgtgacagtagctcagcaagcagtaccatgcatgtcagcacgaaccaacgacagccacacaaaactcagcgaagaataataacaccgattaagatgcttccagaaattcaaagtaaccgcaggaggcctctgtttttccacaaatctgcatattgagaacaaccaatcggtacgtgaaacattcctgggaatctctgtggtaactgtcgtgtcccactctacatgaacagcgtcgagccaacagtcgctgcctcatttcttggcccatgaacgactagccttcgtcaaacgtaaaagggaaacaagctaggaaccaccatatcacacactcaccggcacaccgcgcattttgagcaccggctggggacagggatcgccgagcccgcgttagccacgtaacgcagcgtcgcagcgtgcagcgaaccgcacgcgcgcgcgccttaaattttgttccgccgaggcgcgacgaacgacacaaaccgacactacgtgaatacgtgacgtgtgcgtgcggctgctgcgtttggactttggctcagccgcgtaggagtacgt

SEQ ID NO: 4509 - DNA, 1501 bp, Oryza sativa
gtacacgtacttgtagccactgtgtcacagcgacttccatttccaagaactgtactcgcgcacgctcggttggaagcttgtaggcgtacggtatcgggcgccttcgattcaacgatttcctcaaagtgctataacatccttccaatgatgatgatcagagatttggatgactcgagtcttgtgcaaccatgcatgcgcatatatgcatgtgtcgttaagttataagctcgacagtgaaatcccatcttgtttggaagccgaaggttttccaaaattcgttgaactttcttaggataattatggaagtgataattcagtgtgttcaactctttcgcgtttattatattaaaaaatagttttttttaaaaaaaatatgtgtttcaaatcccgctaactctatttgaattaatttctctcaacgtatatatgtgtggttacctattatcctagtgatcacagagccagaaattctaaaatttataagtagggaggtgtttgctgcggtcatatataacttgtctcatactcctatttgcttaaactataataagctagcatttgcttaagcaaaaataatttgagtacgatggtaattcccgatagaaatgaatggagggatcgtccaaagtaatgcttccaagagtagaccacgctaataagtcccataagcgctcatggagcttatatgacccaatgactgaaatatttttttcaatgacagcatcggctacgtacagggcttcaaatatccaccaaacacaagtctgtacaaggtaaaacaactggagtagacagaagactagaggtgaagctagctagaaacgaataaagagccattattctatgctgtctctttgccaccatctccggggatgtgttacctcccgggtggtcatgtgtacaaaggggtgaatgtgacacaggtaccaatcatgtgatcatgtatttcacaaaggcactcaataaaaagggattgtacggcttccgaagaccctagctggctaggcttcttttcaccaaaaatatagcgggctttcgatcactggtactgtatgagtgctagtaaaaattaaagtcgagatctctagagactagagctatcccatccatgtacgtacctcttcatgaattaaagcatgtattgtgaactaacaatgtcaacattattcatgaccgaatctgtttatttcatctctcgctgtatagtacaaattaggactttaattttgcaaagttgtagatatatgtattaattaattgtttaaatgttgtgatatttttcttaaaaaatataaccattcagttgatatttaagaacaaaaaacatgaatctaaacgagtgcacgtgcacttgagtaggtacggagcacaatttttctgcccactgcactgatcatcagaaataactaggccaattacgaaaacattgcctacgtttttttattaatagaagaagccttgcgttgatcctttttcaaacgtaattaaactcatcaattta

SEQ ID NO: 4510 - DNA, 1501 bp, Oryza sativa
ttcagtgttgattaatatcgatgattaattactttattgctttacaattctcaaatgtttgctaaatgctccttctgcaaatgagccctatattatgccattctttggtatccttgtgcacttgtgtacatgttgtgtggcttgcggagtattccatgtactcaccttggaataatcaatcaaacctcagttgaagacaagttacaaaggagaaaacatttgacttataccccagttgagctgtctgtgggagtggagctgaaacttcgctagattttatttttctgctacagttttcttcgtggtgaggactaggtacctcttatgtaagtatttattgctttagttcttatgatgaatttgtatattaaattgtcagtttgtatacctcggctgatttctggacaatgattttattcacaaattagttcggaaattactagtgattttctggtcgtgacagaccgccaccgcgccgcaagccgccgcgagccacggtcggtcgcgccccgtacggtgccgctgcacgctgccgcgggccgattgtgcccccgcacggcgccgtcgcaccgctcgccggccgcgcccccgcacggcgtcatcgcacgccgctcatgcgtgccgcgcccgcatagccgccgcgcagcgccgagccgtcccctgccgcgccatcaccgcacacgcacgcctggccgccacaccgcagctgcgctgcccgcacggccgcagcgtgccgccgcgtctcgccggcgtccgcgcctcgccccgcatgtccaccgcatgccgccggccgagccgtgctcgcgcaccgcccgtgccccgcatggacaccgctgccacgcatggctgccgaccgggcgcaccattcacgggaagaagaatagaaagagaagaaagatggaaagagattggcgattttgcaaaagggcccctgaattgtctgaaaattatgcgcatatctctcggcatggaaattccttgcgcgtagactctggaatttcagaaatttccattttcatccctccaccgcatggaaacttagtaaagggccccctgtacttgcatatttcgcctgcatttcttatttaagcattttgtttatgtcatataaatttttaatttgaatttcacgaggcattaattaatgttaattggtattttgaattttcattttcagtatttatatgaatacatgcaacttttgccccccttttatgaatatttgtatgaatttgtatgaactctagtatttctttattgaaaattgcatttactttgaattacctgcgtttctttgtataattagcatttcctttgcataagaaatattggaaaaatcatgaaatatttgtattcatatttgcaaccatgataatagcaagtaacacttgaatgctttgtcgtctttgtaacagaatgttagtaatcacgaacaaggagttcgctgaactggccccgtatgaccagaactacctgacctgggcatccaatgtccagattg

SEQ ID NO: 4511 - DNA, 1501 bp, Oryza sativa; identical to SEQ ID NO: 4510

SEQ ID NO: 4512 - DNA, 1501 bp, Oryza sativa
ttgaatcccgactggcgcaagtattcggttgtaacccttatggggaataataaatagtccagtctttaaacatagaaaatagacccatgatcatgaattcatattgcatgtatccagagcaagtccaaattgaaggtatgatacttgtgtttgaactagtaagcccctgagcacgtagtcacaattgttcattgatggtagctgacgcaactggcatagagacaagacgaccaatacagagataatattgcccagcagaggtggcaaaaatattggtggtagtgaagatagtgataccaatcaaaagtgatgaagttgcacagccgtggaggcgaagaaaccagtcggcagcagtcagccagcaatgaatatgaaggcgctcagcaataaagttgtgtagctatggcagcgaaataatcagtcggtgacagacgaggcaaatcaaaggcgatgacgaaatccaccaatcatgaagatgaagaaaatacttgacgacgacaaacgcaaccgacatgatgaagatgacgatgtcggtgatccagccaacagcagtgtagcaaccaatgataatgacaaagacgctcatcagcatttgcatagtaggtcaaccgtgaaggtgaaataataagtcggcaaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgttgaagtagaatgtctgctccgaagcaaagatgaagataatgacttctggagttgactcgtgggttgatgaattgatttcttcagcttgacataaaatttgtcaaattttgagccttgtatttgtgtagcccccgactctttgattagttgggaaacaactgaacatagagtcgagaactgtagcatcttgtcgtcgaatagttattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtaacaaaacttgtgaagtagcagcaatagagtttgctggtaccgaagataataaagatgaagtcgctccaccatgttgacaaagttgtgttgccgtgatgaagtgaacacgagtcggcggcaacagaagcaaactggtagcgaagacgcgcagttgtgaagataaaagcactagttggcggcggcataaccagtcggcaacggaagacgatgatgtccatcagtagtggtagctgtataaaccagacgtagaggtgagggcactagtcagcagcagacgagacgaccagcgatgaagatggtaaggccaatcaacactggcagaatcatgcagccatggaagtgaagaa

SEQ ID NO: 4513 - DNA, 1501 bp, Oryza sativa
ttcagtgttgattaatatcgatgattaattactttattgctttacaattctcaaatgtttgctaaatgctccttctgcaaatgagccctatattatgccattctttggtatccttgtgcacttgtgtacatgttgtgtggcttgcggagtattccatgtactcaccttggaataatcaatcaaacctcagttgaagacaagttacaaaggagaaaacatttgacttataccccagttgagctgtctgtgggagtggagctgaaacttcgctagattttatttttctgctacagttttcttcgtggtgaggactaggtacctcttatgtaagtatttattgctttagttcttatgatgaatttgtatattaaattgtcagtttgtatacctcggctgatttctggacaatgattttattcacaaattagttcggaaattactagtgattttctggtcgtgacagaccgccaccgcgccgcaagccgccgcgagccacggtcggtcgcgccccgtacggtgccgctgcacgctgccgcgggccgattgtgcccccgcacggcgccgtcgcaccgctcgccggccgcgcccccgcacggcgtcatcgcacgccgctcatgcgtgccgcgcccgcatagccgccgcgcaacgccgagccgtcccctgccgcgccatcaccgcacacgcacgcctggccggcacaccgcagctgcgctgcccgcacggccgcagcgtgccgccgcgtctcgccggcgtccgcgcctcgccccgcatgtccaccgcatgccgccggccgagccgtgctcgcgcaccgcccgtgccccgcatggacaccgctgccacgcatggctgccgaccgggcgcaccattcacgggaagaagaatagaaagagaagaaagatggaaagagattggcgattttgcaaaagggcccctgaattgtctgaaaattatgcgcatatctctcggcatggaaattccttgcgcgtagactctggaatttcagaaatttccattttcatccctccaccgcatggaaacttagtaaagggccccctgtacttgcatatttcgcctgcatttcttatttaagcattttgtttatgtcatataaatttttaatttgaatttcacgaggcattaattaatgttaattggtattttgaattttcattttcagtatttatatgaatacatgcaacttttgccccccttttatgaatatttgtatgaatttgtatgaactctagtatttctttattgaaaattgcatttactttgaattacctgcgtttctttgtataattagcatttcctttgcataagaaatattggaaaaatcatgaaatatttgtattcatatttgcaaccatgataatagcaagtaacacttgaatgctttgtcgtctttgtaacagaatgttagtaatcacgaacaaggagttcgctgaactggccccgtatgaccagaactacctgacctgggcatccaatgtccagattg

SEQ ID NO: 4514 - DNA, 1501 bp, Oryza sativa
gtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctattatgccgccgttgttgggcgtctacgtcttcaccgaccggcttgccttcgccgctgccgactggtgtttccgcctgcacggctggcctttatgtcgccgttgttgggcgtctacgtcttcaccgaccggccgcctcgtccgccgccgactggtgcttccgcctgcacggctggcctattatgccaccgttgatgggcgtctgcgtcttcaccgaccggccgcctcatccgccgccgactggtgtcaccgcctacacggctggcctattatgccgctgttgttgggcacctacatcttcatcgccggtcgtctcgtctgctgctgactagtgcgcttacctctacgtctggttatacagctaccactactgatggacatcatcgtcttccgtcgccgactggttatgccgccgccgactggtgcttttatcttcacaactgcgcgtcttcaccaccggatttctacttggacatcttcaacacatatcttcaatcaagcaatgactattcgatgacaagaagctacagttctcgactctatgtttagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttggacgagttagacaacaacatcaactctcctccaagtgaagcatctacaatagccataacattaatttgatggattattgtcactgacatcatcaccagcacctctgcttcatcggccctgacatctccgctgttgctaatggatgattatgttttcgccgacttattatttcaccttgacggttgacctactatgcaaatgctgatgagcgtcttcgtcattatcattggttgcgacactgctattgactggatcaccgacatcgtcatcttcatcatgtcagttgcatttgtcgtcgccaactattttcttcatctccatgattggtggattttgtcatcgcctttgatttgcctcgtctgtcaccgactgattatttcgctgccatggctacacaactttatcgctgggcgctttcatcttcattgatggctgacctgactactgccgactggtttcttcgcctccacggctgtgcaacttcatcacttttgattggtatcattatcttcactaccaccaatatttttgccacctctggtgggcaatattatctctatgttggtcgtcttgtctttatgccaactgcgtcagctaccatcaatggacaattt

SEQ ID NO: 4515 - DNA, 1501 bp, Oryza sativa
tctggactcaaaaattgtaccagcatgcatgtcgggtactccagagtttactattaagaatctataacccacactgtggatagcataaccaagaaacacacaatcaacagtttttggtccaagtttccgctttttgactataggtacatttaccttggccaaacagccccatgttcgtaggtatgagagatttaatttcttcctttcccattcctcgaatggtgttacttccttgtgcttcattggaattttattcaggacatgacacgcagtcagaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttacgaggctgtttcgattgaacacaagtatggcacttggaacctttgaccaaagtgaattttggaattaaactcatgttagctaagcgcatcatacaaccgaaattcacatgacagagtcgcgaatgccacacattagactcatcattctcgctaatatggttcacagcgttatgattattacacatgtcattcaaagaaaagcggaacaagcctccgctgtcataaccttttccaacaaaagtctcatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacaactgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcctttcttcttaaaattggttgcagccttgggtttgacatcaggcttgactttcttgttgttgtgggatgcatgaggg

SEQ ID NO: 4516 - DNA, 1501 bp, Oryza sativa
attttcaactgttttatcccaaaaaatgttttcatctattgtcctctttagtttgctgcctacaaaaatggtatttttgctagcggctgtcttagcatgcctgcttgcgaaacacgatgccagcgaacaaaaatggtttagatgttttattagttagatcgaagtgttttagtgggtatttttatagtgtttcattctcttcgattttcacttggatcttgttgatgtttgaatggttttaaaaaatttgttttatatgttgaaacaaattgtttcatatgactatccaattgtgttctacttctttttaagaactaaaacattttttcactaaatgctacaacattagtttatgagaggcgaaacaccgccaaatttttttaaagaaaaataataaaatgggacgttctatttgtagttgtttcctaaagattagctaggtacttcctctgtttcacaatgtaagtcattctaatatttcccacatttgtattgatgttaataaatctagatagatatatatgtctagattcattaatatgaatatgaatgtgggaaatgttagaatgacttacattgtgaaacggagggagtagttggctaccatgcattaaatgaaggtctctttatttattcgtaggagaaaaacattaacacgtgcgtagggtaaaaccaacattattcagatgggggatggatcgatcgaaacatgcacagtacatatcacttgcgtgcatgtgattatttaattaagataagcaggatgctgaaggcaggcagatgaggctagtagctagctctagccgatggtgggggtgccggcgacggtgtcgacgaagatgcggacgcggttggggcggaagtccatggtcaccggcgtccccaccggaaccacgacgatgtcggcgtcgggcatgtccttgaggatcaccttcttcgcctcctccgcccgcagccccaccacctccggccacgacgtcttcccctcctcgccgccggagctcatctcgccgacgacctcacacctccggacacgatcaaactgatgatgagctatcagcaattaatgtaaacttttgagagagtatatatgtagctagcttaattagcttgcgtatttatcatgcatatggcgtatatatataggcatagctagctagatggatcgatgatgggtcaatttaatttgccggtgttgcatgtgatcgatcattgatatataatttatgcgtgatacacgagcgagcgactactattcatatatataaattaatgcattatgcattatgcatgtgttttgctctcgatcagtcgttcagctgctgatcgaatcaaactatatccatttagcataattaattaattggcccatgcatgtatgcttactaccaaattagtcatcgttgattgtatatatttcccatttcacgtgaagcacatacccgtacctaacactagctgtttctgtttgggataacattattgatccatccctagcacg

SEQ ID NO: 4517 - DNA, 1501 bp, Oryza sativa; identical to SEQ ID NO: 2567

SEQ ID NO: 4518 - DNA, 1501 bp, Oryza sativa
cgaaaaaccagaaagggcagctacgctggatgggctctccaatttatcttaatttaataattccctcaataagaagaaaaattatcctcagtcaatttcttgaccattgttctacaattttacttataaccaaattttacttataaccaaatattacttatgactttatagtaataaaatcccgtaggctgcagcaacgtgctggatatcacccaacaaacataaaaaaaaaacatgccatgttctagtgagcatcttgatcgtggtaggatagctagctaaataaagggtcggatgcgatatggatgctagcgaatagagcttttctgaatcgtcattaatacaaggaaagagggaggaggaaccagaaggagaggagcaatagtttgggggatgatcccctccattaatttctcattctggatctttgctagggatggataaataatcttatcccaaacagaaaaggctagagtacgggtatgtgcttcacgtgaaatgggaaatatatatactatcaatgacgactaatttggcagcatacatgcgtgcatgggccagttaattaattatatatgctaaatggattgtttgcctcgatcagctgccggacgactgagagcaaaacataatgcatttatatactcgctcgtgtatcacgcataataatactatactactcctatgtatcaatgatcgatcacatgcaacaccgacaaattaaattacccaccatcgatccatctatctagctatgcctatatatatacgccatatgtatgacatatacgcaagctacatatacactctctccaaagtttacattcctgatatatagctcatcatcagttgatcgtgtccggaggtgtgagaggtcggcgatgagctccggcggcaagcaggacggtgcggcggcggcgggcgaggaggagcggaagacgtcgtggccggaggtggtggggctgccggtggaggaggcgaagaaggtgatcctcaaggacatgcccgacgccgacatcgtcgtgcttccggcggggtcgccggccggtgaccaaggacttccgccccaaccgcgtccgcatcttcgtcgacaccgtcgccggcacccccaccatcggctagcctgcctcatctgcctgccttcagcatcctgcttatcttaattaaataatgatcacatgcactcaagtgatatgtactgtgcatgttccgatcgatccatcctcatctgaatcatgttttacctacgtgttaatgttttttttcctacgaataaataaagagaccttcatttaatgcatggtagccaactacctagctaaaaacaactacaaatcgcacatcccattttattatttttctcttaaaaaaaatcggacggtgtttcgcctctcataaactaatgttgcagcatttagtgaaaaaaatatttcagttcttaaaaagaagtggaatacaatcggatagtcatatgaaacaatttgcttcaacatataaacaa

SEQ ID NO: 4519 - DNA, 1501 bp, Oryza sativa
aaatgtagcattggatatattttgatactatgtttttgtgttaaaaatattgctatattttactacaaacttggtcatacttaaagaaagtttaactaggaaaaaaataaacctacttcatatataaaatcacataccttttatccaaaaattgaaactttcaactaaaagatcaaaaaaaatattcttggctcaaactttcaatataatatcccaaaacttttaatccaaaaactgaaacttcccaaaaaaaaaaatcaaaaactttgtgctcatggctctcaatcttttgatacgaagttacaaaatttgggaaaacttccaaactcctcacgtgtcaagttgggatgaaaacggtcggaaacgatcataaaacaggctcaaccattaccataaccatatttttctcagaaacaaaaacgatatcggaaatatcgaaaaaccagaaagggcagctacgttggatgggctctccaatttatcttaatttaataattccctcaataacaagaaaaatgatctccagtcaatttcttgaccattgttctataattttacttataacaaaattttacttatgactttataaaatcccgcagctaggggtgaaaacggtcacggaaattcccaatcgaccgggcgctgtttctgtttaaggggtaccgtttccgaccataacgtttttggctattttaaaattttgttttttctaatttctttctgtgtcgtattaatgtcgatattgagtagtttaaatgataaatatgttcaattaccgaccgatcgagcatcgtttctgaagagatgctactgattccgactgttttcacccctacccgcagcaacttgctggataccacccaacaaacatataaaaaaaacacaccatgttctagtgagcatcttgatcgtggtaggatagctagctaaataaagggacggatgcgacaatgggtgctagcgaatagagcttttctgccttgctgaatcgtcattgatacaaggaaagatgggaggaggaacaagctagagggagaggagcaatagtttgggggatgatcccctccattaaataatttctcattctggatgtgtgctagggatggataaataatgttatcccaaacagaaaaagttacgtacggccgggtatgtgcttcacgtgaaatgggaaatatatgtacaatcaatgacgactaatttggcagcatgcatacgcgcatgggccagtttgattcgatcagcaaccggaccactgagagcaaaacacatgctgcatgcataatgcgtttatatactcgctcgtgtatcacgcatatcaatgatcgatcacatgcaacaccgacatattaaattgacccatgcatcgatcaatccatctctctagctatgcctataaatatacgccatattaagcaagctaattaagctagctacatatatatatatatatatatatatatatactctctccaaagtttacattgctgatatatagctc

SEQ ID NO: 4520 - DNA, 1501 bp, Oryza sativa
ctagctgttgtgcatgagctagtccaaagtaaaagagaaagatttgagactcggtaaaagataaaataatttttaaagaaagcattgagaaatattgttgtatatgtatatggctttcaaatttaggtgattattctttagagccaacaaaaggtcatcttattggctgttgccaatttgaaagtgagtttagcttttgcaactcgttcgtttactatgagtatgtttcctaaattattagacggtgtatttttaaaataaatttttatataaaagcttattttaaaaaaaatcaaacaaatctagcttatcgatttaatacttaattaataatatgttaaatgtttttatttcacgtgcagaaaaaagctaagtcaaattgttgccactgcttcctccacactgcccacttgtccagtggttgccgaggtgcttattcctacacctaatttatggaggtcaataacaaaattattattgtaatatacttttttttatatagtactagctcatttcacccgttgttatgtaaactctttagcccatattgtatatgtggcatctgacgaccgtccagtataaaaagcatgaggcctactggcctacttaccgtaaaaagtcaaatgatacactttgtattcaaaacacatgttaccggtgtacacatgcatagaccaaacggaacacctcattttagtaaacctagtctgacgctttctatacagcaacgcggtacctcaaggtttacgccttcaggcggatcacgcacggtggagacggacgagcgcgagaaaggaacaaaccgaacaagtggacccacccacccgtgggcccatccacttcgtccaccacaccgcatcgcacaaaccacacaacaccggttccgaccaatcacatccgtccacgtaccccccaaacatcccccggccccacacaccgaatccccccgcacagcgcgtaagccgccaccgacgcgctggcactcccacgttcaagccctcctcaccaccctcacacctcacagacaggtgggaccaacaaaaaccagacccacctgtcagtgacgcggttcggacgaatcccccgtagccgtaacacgatctccaactttcctcgtgggctccacgtggcagtggggaaagcacgggtcccgatgatatcgcccacacaccacctctctctcttctctctctccccatctctctctctcctcctcgactcaccgtctctctctctcccctcccgtctccggcgatctctccggcggcgtctccggcgaccgggccaccgccgccgccgccaaggagcgctccccctcattccccagatcggtagctgtctcgtcgccgtccccgatcctcctcctcttcctttcccccagatccacaccccccccctcgcgtactcgctcttagcctccgcggcgggaggtggtggtggtgtgggcggggggtgagctcgtgagtcagatccggtgatctgtgcgctgttgcggttgcca

SEQ ID NO: 4521 - DNA, 1501 bp, Oryza sativa
ttcaaccatctctagaacacatgaaatattaatctctctagaattaatatcttttcatttagagcttactacactaccaccaaatccacttttatcttccaccaaatacttcccctttgatctctacccaaacacatgaattatcaattcttattttctccagaaccaatacctttcctttggatctccacctaaatattcccatagtccataaaatatcattgtcaatctccctaagttaatatacctatcccttagaatttattaatcaaccaccaattccgtccgtagaaaaattcccatccacatatactggaggttaaaatcccaaaatttatccaaagttagtagataaattaattatattttctttccatttgactattttaaattttaaaatattagagaaaatattttgtgatgagttctatatttggttcttattgaattcttttaaaattggagcatctttatttttatccttttcaaatttatatctcaaaaataaatatcttgattttattttaaacagtatttcaaactccttttacttcaaaaaccttatattcgaatttattttataaagtttaaaagaccctcaaacattcctcttttaaattttatctcctttaagatatatttaaaaccttccattcaaaaattcccctagttttcaatttcttttgaattctatttaaattcattgtccaagttcaaaaagtccacatactcccttaggttccattacctttgaatcccatctaaattccttgaccatatccttggcacaaagaataatatattcctaaaataattgctcttgtgctaaggaaattccaacttatattcttcactcaatttccccttttagccaaaaatatacataataccaattttagaattcaaatcctatttattgccttcaactaattcccttctatattcccaaaaatattttgaggaatattattaatttcccttcctatttgagtgcttccaaataaattccctcaaactccacctctaaatattgcactcaaataaattaagaaatctcttttatgaactctttccaaattcaaattctttgtaaaacctagctatccaaatcaagtattcaaattagacttctttctttttgtcatcgggccgaaactccgttctttcttccttttggcccaatcttttatcttttatttttttcctcctccctcttgggctgccggcccagctaagccgagccggtccaattcggaccatagcccagccgcctctctcctcctccttccaggtgtgcgtgttgtacacgcgcacggcgcacgccgcctcaaactcccttccgtcgtcacgaagtaatcggcgccgtcttttcttccttcacgccagcgtcgccgtggtcaagccgtcgaccgcctccagaaccgcctctccccaccgcccctctcccctataaatagccggccatccctccccttctttacatacaaacagagctccatct

SEQ ID NO: 4522 - DNA, 1501 bp, Oryza sativa
ccaattcacaagctgatcaagaactctatcccctggcacaaataaggttccctcagtagtgagggaaaggttcatgccaagaaagtccccatcaaaatcaaaaagtggcccgccttcataaacctggcaccaaacagaacaggattacaggccacactggttgaactggacaaaataaagtgaaatggaataagagttatgtaggaaaaatcatcatcttatctcctcagatatgtataaaacaaacagattaaacatttttattgtaatcatgcaagtgtgtacttcaagtgataaaagaacaggtgtacctcagagaatttacaagtcgacgacataagcttaggattgtatgatccgcttgaaccaccaatcaacaacccacctgtggccattaattttccagagatatcacggcctagagctactaccatgctatgtggtacaaatttctgaacattgttgaaaggcacagggcgaagatcaggtaagttctcgacgacgacagcagccatgttatgatctaaatgatattctctcaaagaccctatgacaacagcgtctttatggtgcacttcgacctacaatgaagaatcaggtgaagagtaagcaatgaacacaactagtcaactgaatgattaccagcaccaaccttcaagttatcatggtcttgactttcatcattaaaagctttaagcaagcttgctgaggtcagcaactttataacatgtccatcacgttgtacaaccatgcctgagcatacaaataacactgtgtcccctacacaggactgtaattgttaatcattaacaaatagcggtgtttatatatatatgcctggaaaagtaagaagggtataacagcacatataatcaccatcaagcagagcaagtgaaacaacacttttagacatattagatgcgacttctccactgaactcactcctgaagacaccttcattagacttgaagtgcaagttacctagttaaacaaacatgatacaacacaactgtgaatgctcggcgagagctataagatacatgcagaaaaaggaagcaccggcaaacctgaaatcaaggactcagatgtctctccttcattgcaaactcttcctccttttttcttgcaagagaagcatttctttgcttctttgaatccattccgacaaaatcagttttttcatccctcttcaagtttcttctgagatcataaccacccatccacatcttcccagcactgaagcataattttttgtcaagaaaaggcgcaaaatgtggatcagaacagcaaagcagcaccataaaactaacacagatatactagtaataattaaaaggtcacaaatacaggttttatgtccacgatgatgacccatgaccttataagctttcctgtaagctccaaaatcaactttatacagaagtaaaagagtaaatactcttcactcaatgagtttgttggacaggactcaaaacagttattaccaaaaaatatatataca

SEQ ID NO: 4523 - DNA, 1501 bp, Oryza sativa
ttttcaattctatgtggccatcttgtggctaaattctaaccatagcattatgggtatggctataacaatggctcactatttatagggcccaccttaagattacactacaccacaaacattgatgatgccctaatgtaaacttcagtttgcgttgagtttgtccaagtaggcaacagctttctccaaagcgatccggtggagtaggaggaaggatctcaactctcaagtgggcaagtgatgatgtggaatggaatgctagggcattctttttcaggatagctttaccttctatcgacagaaaatctatacctaaatattatagattttggatcatcaaatgtgcttcacgattcgtgtttcaaacctttctcccctagctctaacgacctcccttcttctttaacactggggacacacaaaactcccatcaatgacctacaaactagggtcccacgttaaaatacgggtgagagggcagtgggaggaggggagggaggagatcgtgggaggcagtagacgccgagacgacggcggtggcaacgaagccgcacggtcgacaacgaatagtgggttggtgttggtggcgagggcaaaacagatagaggcacctcgtcgccattggcttgcggaggagtagagattgtagggggcttgttggattcattgacattttccgtccaatcggcgaagccaagcaacgtcatcatggggcagcgatggtgtaggaggttgtgtattgtgtggcgtagtgagagaaaaagtgaaggagaaggagttatgtttgttgggatttacacgggtttcaaagtattagggattgttttgtgtgaaatatatagtacaatcccttctctttcactaaatggcagttgggaggtttgttcttttgcgctaaatgattaaataatttataatccctattcaacggcacaaatagcgtattccctcctttttcagaaggaaaaaattaatcttgcaaataaacctaacatgcactatgggccgttttggattagtgccaaaacgtgccctaccaatattttggtagtttgaacagtgtatatgacagttttggtttgaaaccaaatcatgggcattgccaatatccaatttgatattttctatattctactcaaagcttggttctaaattggcctcgaaccatatacaactctaccctaccaataaattggtagtgcaaaaactatattttggtagggtattgaaccaaacaagccctatgttcagattcatccccatgattgaattctttttgacagagggagtattcgttattataaacttaatattcccttcgtcccaagatttagcaacttctagcattaaatatttgccctaaaatataacaatttcttcaccaacattatctttccaatcaatcacaacactctaacattcaatttcctcacctaccttcaccactaaaccaatcacaaccttcgcccatttgattatacctattttcttaatatttgtgttc

SEQ ID NO: 4524 - DNA, 1501 bp, Oryza sativa
atccttcctcctactccaccggatcgctttggagaaagctgttgcctacttggacaaactcaacgcaaactgaagtttacattagggcatcatcaatgtttgtggtgtagtgtaatcttaaggtgggccctataaatagtgagccattgttatagccatacccataatgctatggttagaatttagccacaagatggccacatagaattgaaaaataattgtttcatctcttgttcatgaagtgaatgagagagaaaaaatattttctttttgcttgtggtagaacttaagcataaggtgcaccctaagctaatgctactttccacaatgtatatagctcactttacaagtgcaatcattatcttaaagttatctttttcatacattgtggttgcccttagtagaaaagaaaggggaattaaacggctgcttgttcgaagctggtacaatcatcgtggcgaggggcctctagtagtttaatggaggcgtgattaatgatggtaatctacggcacggcatgtttttggttccaattggggacagcggattaatctaatccgagggagggatgattgctgctgctgatgctgctggtcccaacagtggagcacccctgatacggagcagagcgtgaggttcctgcgcgaaatccagtggggatggatccaccattcacgacaactaacatcgaatctcaagcatcgagtgtgcggcaaataccatgccaattaaacaaaaaaaaacttgtactgctatctctgtagccctctaaataatgacggtactaagatccgtttaggtgaagaaaaatgtggtcaggacagtggtatgatactgtatttactattccaaggcttaattagcagcagtacactagcagtactgcatactgtagaaaagttcagacaattgtttctctgatcgagtctgaatgctactgcatacgatattttttttctcactttttaccgcggtagtagttgggggtggaatcaatcgttgtgagggagagggaccaggcagtgctatgaacaggcaggcagaagcagtggtgcttactgtggtcataggattgaaatgtgcaattctggtgtaagccaacctgaatgcagctgctgctgataggggacagcgctatcttaccccatcaataatgtaagtgcagggtgcaggaaaaaggttgcaaccatggccaaaactgcagcagtatgactctctcttcctccccctcctcacacatggaccaccaccaccacaaccatcatcatgatcaatccatcccctctcctccatctccattgcattgctcccacaattatcattgttatcaccttcctcaccttgggatggagtattatagtctttcttctctcataaccaaggaagaaagaatagcatggcattgagtagacaacattccactactagtggcatgtaaaaagagctctgtagctaggcaaccctccactgtcacagtcacaaaggcacaaacaaacatttg

SEQ ID NO: 4525 - DNA, 1501 bp, Oryza sativa
atcattgcaaatgacatttaaaatggggcatttagtataaaattgtgggtcagttgaatcttcactgctcaaatatgtgcaaagagccatttttggttatgctcactaattacatgcattctgactgcaggttgcttctattccaatgctcttggaggcttgaagtgctatgagaacccaaagaacaaggtgactgctgttcctgcaaatgaagaagagatctgtggtgcaaccttcaaggtaaaaaggaaattgatttcttgccaagaatataatgttgagggaaactattttgatccctcgaggggatcctaattaacttgactcaataaaacagaactccttttttcatcatttgcatttgatctgaactcattcgacctttctggatgcattgctaggttgagagcgccactgcaatcctcacagctctgcactaggatgatgtttcggtgtccggtcgttgtacatggtggtggtgtaacatagttgcaactgatctgtatcatcttttcataaaagagaagtactgcctgcatggcaagtgcttcagtgttctgggtgtgtagtatgatctctgtacctttgttgttcaagcaggaatgaactccaggccggctgtgatcagttgaatgtagttctgttgcaaataacctgtccttgtcagttgttactatggatgtctgtttgatgtagtgatgttgtagatcactgcatttcatgaactttggtcaactagtagcaagaacagagtgcagaaataagcaatgttcagagtagaggtggccaaacgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcggcacggcacggcccgcggcacggcacggcccgtttcgccggcggcccgtcaggccgaaagcgggccagcggcgcacgcgccaggccgaaagcagggacagggcgggcggcggtcgaatgggaaggcgccacgtggcactaacggctatttgaccgttcaaatttgaaaataaccgttgggaggctaaaaaattcataaaaatttcgaaaaaattccaaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcataa

SEQ ID NO: 4526 - DNA, 1501 bp, Oryza sativa
aattggttgcggcaagttattagcattgggttcttatataatcctcctattgccttagggcagttacaaattaaggtgaagataggctcttagctaaaacaattgagacaacactatctttaactattaatacaccaaaaaaatttgttactaatttttttcccttttctccaacccatataacaaatattcttttaataaatgctaagagtcgactctaaccatatgtcatgcatagcaacgatgttttgtttttctcatctctctctcgtttacgtcaccaaatttacttatgtgacaacggaaagagcccgctaataaagattgttgtgcattgcccttttcttttcttttctggtttcatatattttctgaaatgcatgagcaaatttcaaagcgggtataacttacaaaattacaagccgtgttgtgcttaggtctcctcaaatctgaccaatctactcagattaaaattcatatcccggtcgccgcataaagcccccagaaattcaccaattttgttgctttccaacacaaattagatttgtttgacgacatttatccacggatgaattgacagccggcggcactgtcggtaattaatcacttgacgaaatttcatggcgatgcggctacactgaaaaccaaccaaatggaagtatgcaaacaactacctacgacttggttcgcttaaaaactttacaaaattcgccaagctgatgcaacaaggtctatagttaattcaacaaatcggcagaactaacaatcgatagacgactgcaatttggcaacacacatggcatgcaaatcacattaccatgcaatccccggcccataagtcatctcatgaaaccatgatagattattctattaacatccctcaataaattatctttgaattttgagcatatcttcatttcgaatcaatacatgaaacaggagatatatgttggagtaacttgatatacaagctcacaaagtctccaaaaaagatattcataaattactaaattagtagataacattgtgtgcatatactcctatatatagagggaaactattttaacagctcgagtggatgtccacccgtttattgcatgtcaactaaatagttatgaaaaaaattaaaaaaaaaatatgaataagatagatcaatatgtaatgtatcaatccacaaacatgcaagttaaaattcaactggtacaaattgtaacaaaaataacaaacaaaactcaaattactatatgtatatttatagttaaatttgttatttttgttacaacttgtagaagttgaattttaacttgcatgtttgtggagtgttacatattgatctatcttgccaatttttttgaaaatttttcgtagccatttagttgacatgcaataaacgggtggacgtccactcgagctattagaatacatctcctatatatagagactagagagacgcaattgacagcattttgtaagcatttgaagcaagcaagaaagctaagca

SEQ ID NO: 4527 - DNA, 768 bp, Oryza sativa
gtagtctatggtaatttaaatttaaatagtatatatagaatgatgattcaaatgtaaaagatgatgtggcttcgtgagagaagaaaaggagagagataatttggaccatagattaatcatctaagggcaaaaacaattgatatgatatagctaaatgagaggagagaaataatattaactaagtgaggatgaactatataggtgtatgggatgatgatttaacattcgttcattttaaagctctaaagttcaataattataaaataaaattatagataatatagcatgcttgtacgatgtttatatgtaataattattagtgaaagatgatgtgtcatcattgcatgtagagttttagaatttagtgggttatagctttatagtaagataagaattatgcgggatgatgatttaacattcttgcattttaaagaactaaaattcaataattataaaattatagataatatagcatgcttgcatgatgtttaaatgtaataattattagtgaaggatgatgtggcatatataagatcttgctacgccatcaaaacttttgcctgaatcaatacattacttcttctatcaacagacctatcccaactatttgtcatatttctgggctaacagcaacaacacacgggaaaatcttggaataaaaaaggtatttaaattaatattatttttccatatcgactggtagtgtttcacttttgcagtttacatcacacttttcttgtttctcctgatgttcataacatatatagg

SEQ ID NO: 4528 - DNA, 617 bp, Oryza sativa
cccttacaaatataaaattaatcagaagcggtagatgaagcttcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagacaatgcctgcgggcttatgatgtaataattagcactagactctcatgtatgtgcttttggtatttcagctatgaactcgtgtgtaccagactacttgatccagggaaatggtactgtttacacgaatgattcctgttataaaaacgggggtccacagagctggtatcagagccatacgactgtaggaaaagaccaaaaggcgccccaccccttttctaagttggccaagggagaaattcccatttagtaatactttcaaaaataaaaacgctatgtttacaaaactcggtacaattttcatcttactcttaactattttctttacaaaacaagttttactctcaactgactttgggtttttcttaaaattagatggcagatccggattcacccgctacctgggagt

SEQ ID NO: 4529 - DNA, 1501 bp, Oryza sativa
ggatgtaaaatagacttattttagctatatatatatgtatatatatatatatatatgtatatatatatatagacacacacttctacttctactactacttaaaaagtataagatgtttccttcgtccgttaattaaaaaaagcgataaaaaaaagttcgattgtaattaaaaagtccggcgcgaaaaaaaacggcgcgggaaaaaaaaacctgaccgattcctgtccgtataaaaaagcggacaaaaaaagtgccgcaaaaaaaacgattgtaaaaaaaacccggcacggcagaaaaaacatataaaagagccaaaaaaacaaaattttcgtccctttctttttttcctttttccttttcattttcttttcgccatttttttcaccatttttccagtttcaacgaaatccaacacgctatttttttggcggtttttttttgtggggccgaaccctagccgccgtatcgatttgcctctccatgtgtttcctcatccaattgattgaaaaacggattccccactactctctcatcattttccccttaaattccctttagttcgtcattttttatcccaaattttgcggattgcttcgatttttatgaaaaaaatagaaaaaggagatcaagtggattaaaatatgtcaataattttggaggtcgagaaagattcggccgcatttgacggagaggatcgactccatcattgtacgtgcacggtattatgcgagctcgactagattaccggatttggtgggaagatcggctccgtcatggtacggggcatgagactgttcgagatgggactacagctccacttgcgggctgagccgaagagaggtaggccactaggccaggcacaagactattcgagctgggcctacagctccacttatgggctgagccaaagagagataggccaggcaaaggactgttcgagctgggcctacagctccacttgtgggctgagccagagagagataggccgagcaaatagagacagcggactgcactgggactgagctgaaaaggaaggaaagaatgaacgttcggtccaaaaacaaaaacaagggagtatattgtatagtataaaaaatgtttttacctgttgcaacgcacgggcattttttctatatatatatgtgtgttcaactcctcttaaagttcaaccaaggacacggggaacgtgtgtgttcaactcctcttaaagttcaaccaaggacacaaagcaaaatgggcaaagcgtagagatgatttcctagtgaggaacagtgtgtacagaaaacttaaatttaatcctatcgcaatacttcaggcattggcttgctcgctgctaccagatctcgctttactccatacccggacagggaggaccggtgatctcgagggctatcaccacctctacaccaacctctaacgaaatgttagatacgcagcaatcactggtaattaaatacctagacattgcgtctatgcaattaattactattgtagcgttagt

SEQ ID NO: 4530 - DNA, 1501 bp, Oryza sativa
aaaagatacataaagaaggaggtaaattaaacttccatatttaagcctatggagtttttgtgtcacaaacctaatcaaacacaagcaaatgggcccattcaccatatatatatgcaccgaggagtccttcaccagagcccaggagaaaattcggggcaaaatgggccagcaagggtttggccgaacacaaaaggatcccaatcggctccatttttcacgggcagatacttaccgatattctaagacccttgagaccgtttctcaagaggacacatggcaagaggagagtgaagatgccatttagatgcttagcatctccacattttcccaaagcatctccctacctataaatacctctctcttcctcacttctaaacacgctcaagcatgagctgaattataagaggctctattgtatcttttatatacattagaataggcagacagtaaggaagaaagagtcggaggaattccgaagttgtcagtattttcctctttaccttttgtaccttgtcaattactttgctttaattgataatatctttatcgagtaagtgagttttactttgtgaggattatctcttagttagttcctattagcatattggattattgttcactattgttcaataatagatagtgattactttagtgtttaactaacgctacaatagtaattaattgcatagacgcaatgtctaggtatttaattaccagtgattgctgcgtatctaacatttcgttagaggttggtgtagaggtggtgatagccctcgagatcaccggtcctccctgtccgggtatggagtaaagcgagatctggtagcagcgagcaagccaatgcctgaagtattgcgataggattaaatttaagttttctgtacacactgttcctcactaggaaatcatctctacgctttgcccattttgctttgtgtccttggttgaactttaagaggagttgaacacacacgttccccgtgtccttggttgaactttaagaggagttgaacacacatatatatatagaaaaaatgcccgtgcgttgcaacaggtaaaaacattttttatactatacaatatactcccttgtttttgtttttggaccgaacgttcattctttccttccttttcagctcagtcccagtgcagtccgctgtctctatttgctcggcctatctctctctggctcagcccacaagtggagctgtaggcccagctcgaacagtcctttgcctggcctatctctctttggctcagcccataagtggagctgtaggcccagctcgaatagtcttgtgcctggcctagtggcctacctctcttcggctcagcccgcaagtggagctgtagtcccatctcgaacagtctcatgccccgtaccatgacggagccgatcttcccaccaaatccggtaatctagtcgagctcgcataataccgtgcacgtacaatgatggagtcgatcctctccgtcaaatgcggccgaatctttctcgacc

SEQ ID NO: 4531 - DNA, 1501 bp, Oryza sativa
taaccacatatatagtcgggggctacacctattaggtgcatatagtcgatgtacttgactttatttttcagccctccacagtcttcatatttggtaaaagtactcgggagaccatggcaaagatgattgaagcacttggctttggagtaatctgggtcgagagaagattatcttttcgacagtgaaggtctcaggggctactgtggagattatgggtaccacatacccacacggcatggttatccgactggttataggggataacttatatctatggaatatgtaacagatcatgacttgggtattatgtttccttttatattatggagcggcctaaagtcctaatttgataatattgtaaaatagatttagaaaaccgataccgtattggttaaggtttctatcttgtaatcctgccccccatcctatataaggtgggctggaggccctctagggggcatgagcacaactagatcgtcagatcaatacacacccgacggattcaaatccccaaacaggagtagggtattacctctcattgagaaggcctgaatctgtctaaatcctttgtctccgcatccatccacatttaggtctcgtgtgctaccctcttttattattgccgaattcatgtttcgacagagggtgaggccacaccgccacaaatctcttcaacgagcatggagcgactacgtgaggaaggccgcattggcagggagcatgaggaggggagttaggaggcaggacaccaacaaagcatcgactgccggtagcggcgctcggactacgacagcgcgatggatgtcgtcggcggcaccgaatctaacagttgtggaagcagtggtatgactgatgtatatgggcgaagggcaaagttggaaagagagtttttgggtgtataccagcgtcaaatattaaaactgcttttgagttgaatacggacgtcaaacataacgaaatggagggagtacaaactaaagctacatcatagttaaactgtaactgtaccttagctacgctgttaccagtttaactgcacccttgttacaacgtaaatacactatggtcacagtgaatgtattttcccttaaaactgtcgaatatgtcataggttgaaccaaaaagttgattgactgatcatccagcgctagcccgttaatcgcgctcgtaggaataaaaggcggcggagacatcggatgttcgtcgcctagggcacttctcccctgcgagttccgatgaagtagaggggaccgccgactcatcaccgggcgaatcagactatttcttggccatttcttgcttccttcatcttctgcacaacaagctctttgcttggctggccatacacaaatattactccagaattttggatagttttcacattggtgcactttcttcatcaattcatgccatctttagctctggttgtgtttagttcagcgcaaagtttagattttggttgaaattggagatgatgtgactgaaaagttgtatgtatgac

SEQ ID NO: 4532 - DNA, 1501 bp, Oryza sativa
ttgtatgcgaagctccccccgatggcgcaccttggtatgcgtgtgcacgtgcggcagccgacctcgacgaccacgcctctccctcttcaccagcggacctgcggcggcgacggccggctgctcacccttctcgttagcctccgcctccgtagaagcatccgctccctgcttgtacatctccgcaacagcaacagtaggaggcggcgacgggaagccttcgcggcggggctgcggtggaggggcggccgtgcaagcagcccatggcgtcaccggcggcgggtcagcatgaggttgcggcggggcgaggcatgcggcggcggagggatggtagccaaattcatcctatatagattcaacatttagtagccaagaaaacaaattcacctctatttttttttcttttggaattccctcctctctctgtttgaatgctaattgcaccctgttctggctttgctcctaatggtcaacctcattgcacaaatgcaaagacacagaattgttcattcttattcaaaattcacaagatatccagaaaaaatcggcatcctttattgcaccataattttacccttgttaactttacaagaagtcacagttcacaagaaaccatattgttaactttacaagagtattgtcaaaattgcacaagcttttcgtgctgttgagttgaagtgacattactcaagatattcagatcaatactacaatgaagaaatgtttcatcaggatctttgggttgtatgaatgtagcagaatgcggtctgctgctgcatacaggtgttatggacaattcggttcagtttcagttcaccattgaacacccagtgatctacccagtgatctttttcttgttctggttctgaattgaatgagctggtgaagcagcagaattgcatctttctctgaagattgcagatgattcagcggtgcaaattgttgcactgaactgttgttagaaatcaagaacatcttctgtggacagaaaaagagaaaaatatcgccttcatccgaaaaggatttgggggaagttgacaacttgtgatgaagaagaacaaggaaacgaagccacacctgagcatcaacaggagcatcttctcctctcccttcatctcctcgccagttgtccctaccccattggtgagcagggcgattctgccatgaggataactagcggattggagctgatcgacgcaggggcgttcacgcaagacgtcggggcatcaacgagggaggaccagaggaggcattgagggtaccacctacccacacgacatggttatccgactggttatagggaataacttatatctatgaaatatgtaacagatcatgacttgggtattacgtttccttttatattatggagcggtctaaagtcctgatttgataatattgtaaaatagatttaggaaaccgataccgtattggttaaggtttctatcttctaatcctgccccccatcctatataaggtgggcaggaggctctctagggggcat

SEQ ID NO: 4533 - DNA, 1501 bp, Oryza sativa
tagagagcctcctgcccaccttatataggatggggggcaggattagaagatagaaaccttaaccaatacggtatcggtttcctaaatctattttacaatattatcaaatcaggactttagaccgctccataatataaaaggaaacgtaatacccaagtcatgatctgttacatatttcatagatataagttattccctataaccagtcggataaccatgtcgtgtgggtaggtggtaccctcaatgcctcctctggtcctccctcgttgatgccccgacgtcttgcgtgaacgcccctgcgtcgatcagctccaatccgctagttatcctcatggcagaatcgccctgctcaccaatggggtagggacaactggcgaggagatgaagggagaggagaagatgctcctgttgatgctcaggtgtggcttcgtttccttgttcttcttcatcacaagttgtcaacttcccccaaatccttttcggatgaaggcgatatttttctctttttctgtccacagaagatgttcttgatttctaacaacagttcagtgcaacaatttgcaccgctgaatcatctgcaatcttcagagaaagatgcaattctgctgcttcaccagctcattcaattcagaaccagaacaagaaaaagatcactgggtagatcactgggtgttcaatggtgaactgaaactgaaccgaattgtccataacacctgtatgcagcagcagaccgcattctgctacattcatacaacccaaagatcctgatgaaacatttcttcattgtagtattgatctgaatatcttgagtaatgtcacttcaactcaacagcacgaaaagcttgtgcaattttgacaatactcttgtaaagttaacaatatggtttcttgtgaactgtgacttcttgtaaagttaacaagggtaaaattatggtgcaataaaggatgccgattttttctggatatcttgtgaattttgaataagaatgaacaattctgtgtctttgcatttgtgcaatgaggttgaccattaggagcaaagccagaacagggtgcaattagcattcaaacagagagaggagggaattccaaaagaaaaaaaaatagaggtgaatttgttttcttggctactaaatgttgaatctatataggatgaatttggctaccatccctccgccgccgcatgcctcgccccgccgcaacctcatgctgacccgccgccggtgacgccatgggctgcttgcacggccgcccctccaccgcagccccgccgcgaaggcttcccgtcgccgcctcctactgttgctgttgcggagatgtacaagcagggagcggatgcttctacggaggcggaggctaacgagaagggtgagcagccggccgtcgccgccgcaggtccgctggtgaagagggagaggcgtggtcgtcgaggtcggctgccgcacgtgcacacgcataccaaggtgcgccatcggggggagcttcgcatacaagacgcgcg

SEQ ID NO: 4534 - DNA, 1501 bp, Oryza sativa
tgaggtatcagaaaaagagatggtaccagaaaatagcacagaaaaagagatggtaccagaaaatagcacataattttttcccttttaaccataagtatatgtctttagtttttctttgatttgtagcatcccattacatttgaggggctaagttctcaatttaaaaatgttgcatatatctggttggatgtagatatttgccatttattgggatggaaaaaagactaatttatccttcttctactcatctttccccttttcttcctcccgtcgatcttgccagtgcgtcagtgggcagccatggtgcggcaatgcagcgtagcagccagcatgcaatgcagttgtgtgcagtgctgctgccgggactaaggctgacgctgcggccagcgcatgcggcgcaacgatggcgaggtgcacagcgcaacggtggcgaggcacgtggtggctgacatggcttatggcgcaacatttgatgtggttactcgccgtggtggtcgcacagcttcccggtagcttgcgtcgtacaacctcattggctgcacctcgtcctcatccgccgcaatcgctgtcggtcaccccgccaccgtcgccacggtctccgcttcttcgctcgctgagctaaatagatcagaattccaaattcatgtttggttacaataaaggataaatttgtcttttcacatctctaatcatggctaaccaatcgattcagatagaaaatgtgacggaagtgctacaaattgaagcaaaacttgtgacatgtgcttctggttgaaaggggaattttcttttaccggtgttttttctacatcgaattttctctttatttttttcactggtaaatagagtagtataatggtcctgccacattccttgttgagtaaatcttaaagatcgcttttcatccaattaaaaaaaagaggaaagtgcgagaccagctagcacttacagaatcacaagtacatatataggacaagtacgtgcttaattcgtactactcccggttgaatgaaatttgattctcataaaaaacaacgtaatacagtatatgatagattctagtagtataaatttggacagattgtgattagatttatagtcctacaagatcttttcatatttgtagtaataggatatgccaaatctaatgcagattcgttttctttttaagagacggagtacatgtaggacaatgaagtctgatagaaagcagttccaggcgtcactactcgtctgtacgaaatctgacgacgcagggtccagactccaccagtccaccctgtaattcatggcgaaggacgaggaaggtgagcacaggacgaacagcaacagcaagctcgaaactaatccggtgataaatgcatgcgccccaacttccaactcacagttcctcctcgtcattcaaaggaaagtggcaggcaggctagctgctcggttgacacacgagcacacacaagacaaatgccgccacgccggccggcggcgcagtgcgtccgatata

SEQ ID NO: 4535 - DNA, 1501 bp, Oryza sativa
ttatatatatatgtgaagggatatatctattaatttattttattattttaaaatattcttatttagatgatattccctcagtttttcataatatttcttatagaaaatttaataacatctaaaatattaaattagtttcattaaatctaatattcgatatattttgataatatgtttgttttatgttgaaaataatattatgtttttctataaatttgatcaaacctaaagaaatttgatgaggataaaagtcaaacgatttttaatatgaaacggataaagtatataaaatttattatttaaaaaaattcttatttagatgatatataaaaaagtggtgacgtccaatcgacgatgaaaatacatgtccgtcatttattcgttgcgctaccactaccaaactaggcgtgcgtttgcactgtgtgcacatgaacgatgctcatcttttcagaagctatcttctttggcccggttttgttacagggttgaaaagtttcggtatgttcttctttaaacagaatatcttcttttaatataaatcatcggcaacagtctgactgttaaaaaaaaaagttttagcgtgtaacatcggactacagacacatatttgaagtattaaacgtagtctaataaccaaaaaaattgcatattccgactgtaaacagcgagatgaatttattaaacctaattaatccatcattagtaaatatttactgtaacaccacattgtcaaatcatggagcaattagacttaaaagattcgtctcgtaatttacacgtaatctgtgtaattagttttttttctatatttaatactctatgtatgtgtccaaataattcgatgtgatatgatgaaaagtttttgcgtgagaactgaaaatggcctttgtttgctttttatttttcatgatattttcagaagctagcagcctagcacagcgccgaacaacgcgaggccccagaacttggattggagtcaccccaggacttggattcgagagtcaagggggatatatgctgtgcatgcgtgccaccgcgccgcggcgtactctatgcaatgcatgcatatatgcggccaccgcttgggcacttgggtggtgggtgtggacgagagggatgcgtggctgcgacggctttagcaactgtgcatggacaaagacatggcaggagcgatggacggacgtactcgacgttggcacgctcacatcaggcattgttacaaggcgatggggttgtgtcgttgtgatatcgtcgaagcctgacggcgatcgacaaggacaaggccagggcggcgcgcggtggcgagatgaccatacacagggggtggaggtagaggatattagagggtaaaaaaattttagctatattttatttattttcatcatatatatatatatttttcaatacaaacttagatactcgcatcagcttaaacttgattaaagtagagtaaattaatcaagtggcaccaccctccatttcgttttagctccgcccctga

SEQ ID NO: 4536 - DNA, 1501 bp, Oryza sativa
gcttgttttggtcggtttgtttgttaggtaggtacaataacacactataagccagctataaacacatatcgagtagatgaaataaaacagataagcagcgggatacaaatttgtagccagctgcagcacgggctataagacataatgtgtgaatgataggtgggaccggatattaatagtgtagtacatatttataggtaactattgtatgaattagctactaaattggctataaacgatttggaactagtaattgactatactactaaacttgctcttatatttgaaaatttcggttcgcaactaccaaaaaggagaccatgactacgaggagagtgcgcgctcgattgtcataacaagtgacctcactctccaaagtctagattgactcatgtttttacccctagaacggatttacttctaatatcgtgacaacttaattccatttgtgctaaattacttttatgacttatgtaaattacttttatgttttattgaattttctttcataaatgtctaaaaagtaattttaaaatgcatacatattttttattagaatataatcatttgagatcttgttataaagattttgttgcaatgaatacaacagtccaaccagataggaaatcggataagtattttaacagaaaattctataagaagtaaaaaagacatgtatgacctgatagcaaattatagatgtatagtactagttctctcacatatgatcggtgttactcgataggaaaaaaaaacgagagcgctatcgatttagattttacgtatcgaaaaccgacctttttcaaacaaaaaacaccgaactaagaaaactataaaaaccgaacgcccactggtactactttgccatagattctttttattcctaattggacatatgactatttttgttcaaactatatttctctcatgctgcataagaacattggtgaacatacactccttttctcctttttctttttattttcttctcataatgtttgagaatattttatatttctttttttatatcacagccatctcttttactaaatattaggagagacattttgactgacgtgaatggtgtatttagttgtggatataatgtagagacaaaacattaaccgtaagtacgaacacacgtaccaacatcaaacttttatttgaacaataaaacacaaactttcttcctaagatgacgaaacattcaatggtgtgtggacggctgcacgcagcacgcggatgatacagaccatgcagagaatgatcctaccaagaaaaatgagagacgagaaaaacgtcgcggaaaaagattaaaaaaaaagagaagaatactttaatattattcgtggctctcctcggcattgcgagcgcccatggattggacacgcgtctctctcgcctccttcccactcccaccaccaccactgcctcttcctcttctccgggagtcccaaactgcagcagcgcgcggcacaggagagcgaggaggaggaggaga

SEQ ID NO: 4537 - DNA, 1501 bp, Oryza sativa
ccaattgcataatattgagtatgtcctgcagcaacgcacgggtttcctctagtttccaaacgaatatttctcggcaaggcaaacactgcagcttgtccatttcttccctttgcgggagtagttttcaatgattgcgatggtaatggaaagagaaccgtttccatcgttgtcattgccgttgccgttgttgttcccattctcgctgccaaccatgatgaagaggaaatagtgattagtgaatgtagtcgttcacgaacaacagccaacagtcgcacaatgtattttctaaaaacttgactcgccttatcttctcggtgcaagatcagggaggtggggggagggggttccgaaccgctgtcccaacatccatggacgcagacgtcgggatgggaaaaccatatagtaatagcgtggaaaatagagagttgtgtgttgtcacgtgctcttatatgggagatatttagtgccttctattggactcaagtaagaggaagagaaaaaaaatagccatgaataataagtaaccgacattggctttccattttgaattaagtagacgttttaataatcaatccgttggagagttatatgtgttgtaggattgaaacaagaactaggcctaccagagaggggtgaatggtaggaacacaaaaatctgaaaacttctaacaaaattaaaagttaccctcaaaccagttggagataggtcttactggtgtagatgcgccggtctgatcacctgactgccatcgatctgaccgattggagttgctctagtccgaccaccctacacatcgttgtcaccaatcgctacacaggttcctccacttctcgtcacaacttttggatctgagtctactatgtacccttgggttcagcttgggcatagctctaccatgtctgaacatgggcctagggaggtgcaggttctgattcactcattggatggctctgatttctccgataacaatactatctatagctccgacgactctaccccactccgtgaggtgttcatggctttgaaaggagccaaggatgaacaagctcgaatctagagagaagcggaagaggaataccttcgtaaggaggtagaagatcgtctgcgtcatgattggcattgtgatctaacaacctgaggatgcacggctcacgacaatatcatccaaatgggccacgacgaccacaatgttcgtcgccccacggcacaatgttgttgcgatagtcatgctgttggaccttgtacttgaagccatacccgaccaccaggtgactccgaccctcaacaaagacaaagccatgatgaccacgacgtcttcctagcaagtaggaggatcaagttgcaattttcgccgtccaagccaattacattccaatccgtcgctgagttacctaaaactctagctggcaatcaccctaaccaagagctgtctgggcgtccctctgcgaaaaaccactcggtggcaggcaacaaaggacataccgcttcatccctaaggtg

SEQ ID NO: 4538 - DNA, 1501 bp, Oryza sativa
tttcagatttggataagaatagttaaaaaaaatagcatcgatccctgatcaacatgtggtctataggtgagatggcacgattgattttcattcgttaagaggtcttgggtttgaatcccacttaagacatgcatgcatatcatttgaaaaatcatgaatttttatctagtgatgtgtgaccatggttggaatatcctaatgatatttttaggggtttctatgcatttaaaattcaaaaaacataaattcttatccgtgaaggtttgtaattatgaactgtcacgaataactctcatccacgacaggtcgtaactaccacccattacggatgagagttatccatgatggtcttttatttacacccgacaaagatgactgttatcggtgacggctgccagcccgacacaaatgagttttcacatcactaaccaatgatctatgaccaagccactcaccgacactgatgtggatttccacctgacgcagatgaccaaatccacactagggcgtgtgggatggagggaatactaagattcatcatcatattttacattgtttatttctcgattacactgaatggaaaagtactaataattccaactcgcacaaaccaataaaaaatagtgctagaggtgcaaacaaaaccactacccaaagttcaaaacaaacactaaatgccattccattatattcagcacataactcatcgaagtatatactactacccaaatcccagattgatgtatatactattttgttcgaatagattaacacacacttcacaaaaccaacatttatggcagtttaactgaatccatgatcgctctcaccaagcagaaccttcatctgatttctcttccggattccaacctggagacgccatagattcagaacagaatctggcagtagagatgcaaagaaccactggatcgagtggcgccagtaggggacacatcttggctcataaccgatgcagcggacagcagccttggcgtactcctcgggtgatggtataaacggcgagttaccctggacaggtgacatctttgtggcgacatataatggtatctgcacaaaaaattggttagggcaccacttgagatgacaatggagaaatatgtgatgtacatatgggtagtggattttttattttacgtgatggggtaatgagaggcacatattttctggtgttaatttgtagtgcatttcgatgtcttctgaagaagagtaaaacactcaatccattatgtaatatatgtttggaaacaagatataagttttctagaagttaaaagaaattaagaatatcggtaggttaattttatactttttataatattgtagcaattttagtattttattttacaatatgttaaaaatgagctatgcaatattttcaaagcctaaataatgtgctcataactgccttttattttcacctcgctctagaaatgatctttataaatgtcgaaaacccatttttgcaaaggcctcccactat

SEQ ID NO: 4539 - DNA, 1501 bp, Oryza sativa
catagatgcaatactaaaggtacatgtaccaaaaagatttataattttcgatgatatttttagtggatgtataacgtgtgtacatgcacaggtttatgtgcatagtatatatcccaagttagatatattaaacattatagtacacttccagaagatataacggtgtgatgattaatcatccgtcttactacacaatataaatgatcaacttttttttgacataaaactttataaaaatgatcagcttactacaagagtaatcgcgtgatcacactggtcctaggtgaagcaaggactagctgtgaatttatagctgagctatagcatatatacgaaaacagtacctacattattttgtggtcctccttaacccagatgtgcactatgaccacaccctccattggttattggagaataaatactggttgtttacggagactaataaaatgacagcgtactaaacggtaatatatagtcttaccataaaaacatatgtagaattaatttgaaaatgcattctttacttcatttttttctttatttaatttggtattcaagtcgaagaagaaatacaagaattctataattacttttttctttttttgcgggttataattacttttttcaatgaaacatcctagcgtttactcaaagagttacacacaattattacataagtcacacagaaaagttcacaatagcagaaacgaagctaagcaaacacaaactaatagacaccaatagaagaaaaagatcccctaactactaaagaattctataattactaaataattttttcattgcaatattttattcagttaatatatagttattttgttatggaaaaatagatagctaatctaatatattaattaatttttttgggaggttgatagttcatttgttggagaagagtcgattattctctttatcatttcatttatcatttcaccattgatcatctagagtactccgttggggatagaaattccataatgaagtacaagtcataagcaaagcaattatatttcattactatgatagaatatgagtttaaataaattgtatctgtgcagaatcttttcaaatagatactaaactccttttattcatatttgttcatggatagcaaagcaatttaaattagtacagaaaaccagactaattgttacggctaaaagtaaacactaccaaggatctcccctggtagatgatgattcttggtagaaaccatcattgctgtaaaatcaacatggaactaattatctgacctaaaattagagtgacatggtcgctcatactatctccatcctataaaaatctggatacacatatgttcagattcattgtaataatttattgtactataatgtgttacatcccgtcccaaattcttttttttgaaacggagggagtacgtggaaatatgtggaatgtaccgacatgccaatgtccaccatgtaagggccaggttgtagttgggttagaggatcttattccg

SEQ ID NO: 4540 - DNA, 1501 bp, Oryza sativa
aaacctccagcggaggcagggagccccagcccgtggggcggcgttcgtaccttgaccatgtcgatgggctggatgacgcaggtggcgagcatcccggaggcgccgccgttggcgaagggcttcaccgtcttccacaccccgctcgccgccgccgccgtcgccgcctgcggctgctgctgctgctgcttcgcctccgccatctcctcctcctcctcgctctcctgtgccgcgcgctgctgcagtttgggactcccggagaagaggaagaggcagtggtggtggtgggagtgggaaggaggcgagagagacgcgtgtccaatccatgggcgctcgcaatgccgaggagagccacgaataatattaaagtattcttctctttttttttaatctttttccgcgacgtttttctcgtctctcatttttcttggtaggatcattctctgcatggtctgtatcatccgcgtgctgcgtgcagccgtccacacaccattgaatgtttcgtcatcttaggaagaaagtttgtgttttattgttcaaataaaagtttgatgttggtacgtgtgttcgtacttacggttaatgttttgtctctacattatatccacaactaaatacaccattcacgtcagtcaaaatgtctctcctaatatttagtaaaagagatggctgtgatataaaaaaagaaatataaaatattctcaaacattatgagaagaaaataaaaagaaaaaggagaaaaggagtgtatgttcaccaatgttcttatgcagcatgagagaaatatagtttgaacaaaaatagtcatatgtccaattaggaataaaaagaatctatggcaaagtagtaccagtgggcgttcggtttttatagttttcttagttcggtgttttttgtttgaaaaaggtcggttttcgatacgtaaaatctaaatcgatagcgctctcgtttttttttcctatcgagtaacaccgatcatatgtgagagaactagtactatacatctataatttgctatcaggtcatacatgtcttttttacttcttatagaattttctgttaaaatacttatccgatttcctatctggttggactgttgtattcattgcaacaaaatctttataacaagatctcaaatgattatattctaataaaaaatatgtatgcattttaaaattactttttagacatttatgaaagaaaattcaataaaacataaaagtaatttacataagtcataaaagtaatttagcacaaatggaattaagttgtcacgatattagaagtaaatccgttctaggggtaaaaacatgagtcaatctagactttggagagtgaggtcacttgttatgacaatcgagcgcgcactctcctcgtagtcatggtctcctttttggtagttgcgaaccgaaattttcaaatataagagcaagtttagtagtatagtcaattactagttccaaatcgtttatagccaatttagtagctaattcatacaatagtt

SEQ ID NO: 4541 - DNA, 1501 bp, Oryza sativa
gtttggctcggctcggttcggtttccaggaaatttgtgctcacgctaaccacataccaccttccaccatatagccacacttgtacatcttaataagtgaaagggtcaattaagcctagaggggggtgaataggctaatttaaaactttatgcggaagctaaaactgagttagggtcggaaagtctgatccacagtcagactatccgaaaatatcagatagtctgatgttggatcagactgtctgatccactaaaggaagactacaagtagatctagtgcacaaacaagagtatggcgcaaacagcgactagatctaaagtggcacaaaagcaaagctaaataataggagaagagatatcaccaacaataaagttcaccgagttgttcccggagttcaaatccttgaggggattctactctccgttgaggagctcactaagagccgggtctttgctaaccctttccttaagaggtggcactaagcactcctccttccactaaggggtatctctttccttgtggagacgagatccggccttcacaaacttctcccggccaaccacacgtagatcggtggctcgggagtgacacctagccgtctaggagtcctcaacctccaagagtaacaaacaccacacaactcttggtcaaaccctagtgctcaagatcgagtgaaacacacactaggccctcaaacaccaaatccacaaccaccaagatccactacacaaagaacaaagagggatttgagagagggagagagagctcaaagatccaaagcactttagcaccaagctcaacccaaagtgaatgtgaatgaatgagttgggtaaccctagaaaagggttaggtggggggtatttatagaagcccccaaaatgtggccgttgggagagaatcttttcatcccacctcggaaagtccgaggtgacatcggatagtccgatgtttttgactcccaagcaggccagagatagagaatgaaattctggagaatttcggacaatccgatcgatcgggtagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcatttcaaaacagagagtgaagttctgagaaatttcagatagtccgacgtatcagatagtccgaccttatatcggatagtccgatatttttttagccaacactcagaccgaagacagtgagcaaagttctgtgaaatttcggatagtctgagcatcggatagtctgatcaacatcggatagtccgacagacataaaacaggaatacttcaaataaatgattttgagcactagtgttctaccaattatatgcatatgacatccctcttaatagtacggcatcctaatactcaagaacacaagatatacatggattagaagaca

SEQ ID NO: 4542 - DNA, 1501 bp, Oryza sativa
tatattctacttgctttaatatcttaatatagagtagtatcggagtattagccgatacatgctagatctacctgatcggctatgctatgaatgtatatagttccattattaatatatatttcgatctaatgatttatactgtctcggcatggcgtccgatctatcccaatcacttgatttaagtatatatcgatataggaagtatgtatcattaatatctacagccgatcgagtagatttagttccttcttatttgttcatgaatgccgatcgatacatatatgacatcggctcagagataaatgatatgtcatcggcacctagccgatcggctatcgtttataggattaattatggtttctttgtctctatttcttgttgattacaggatcagatcaattggcacgcttacacacccgaaggcaagttttggacctgcactggagttaagcagatctcctaggcctcgtgttttctgtcaacaggcggacacctccctccttcacagatccggtctatggggggagggggcggcggcggccaccgcatgcaaaggagttcgccggtgacgacgatgatgttgtttttttttctaagtttacatgttgattgctgtggatttgaatccaatgttttgtgttgatgaatggatgtttgtgattggattttttttcctggatgagatttgtaagaatttgtgatttcaaacctacggagggggtggggctggcgggaaaattatttttgggcgccatgagtattttcgcaagcgggctactgtagcacctgcagtgcctgagaagatggcaacggctgcctgtgctttggtccgcctataaaaattgaggatttttaccgtcgtttagatgcaggtggaaggtttatccgcctgcaaaaatgtattttgaccacctgcaaaaacgtcttttctagtagtgcatgctatcagtttgctccgtaacttgtgtactttgtagtactatagttctcgctccatggtattggccttgtctacactagtgttcaccatcattagcccatccaaagcccaatcaatccatctttggctcttgctctcttgttctgtccgtatgcttagaaagaactacactaataatattgttttgttgcctagtggaatgagattgcaaattaaacttgcattatttggatggactttaagtttgtggttatcagtgtgttactataatatctacataagtaatagtggcaatcgctattgctgtaccaggttggcgatgggtggtagtagtgatgtggtggtggtggtgattgtaggtaatggtaggttctcgtagtaatggtggcattggtagtattcgtttgtcctcatagtagtcaccactaggaaaatcgttttcccaggcggttccaggcgagggaaaggaccgcctgtacgcaaaggcttgtaaaaatagatgatttttccagcgaaaatcatttttgcaggtggcatctccatcttcaaatgaggtagatc

SEQ ID NO: 4543 - DNA, 1501 bp, Oryza sativa
ttatgccattttatatatttttttcaaacataatttatagtacatgcctacgcatcgcgcgggctaccttcctaattatatctaaatggttatcaaatttttttaaaaaaaaaatatgacgagatagattaacatgaaatacattacttcacaaggtatacaaattcaaatttaactcagttttttttacaagttatagaactcgaatttcaacttgcattttgtagagtggtatatttcctattaatatgtattattaatttttttataaaaaaactttatgactatttaggtggcatgtaagaaatgagaagaccagccccggtcctatgattttgagggcctcagagtgaactcatcgcgataggccctctagactatatataaaattttatgatatatatagacgctaattttacttgcaaagcgaacacaaatccattgaaatatttaatttaacatatttgataattatcaaggaataaagacaaccaaaataacaatatatttgtgcccttggaatcaatatgattaccttaacaaagaatagaactctatcacatccattgcttcccatgaaaagatactcttcgagcatctctagggctgaggacgagacgatcagattgaaggcggcggatgatgaattgagggtgagcggaggaggaattgaggatggcgcctagcggctagcgtgaggaattgaggatggcggcgcctggcagctagatcgatctgatctgatctcctgtctctgactctctatctccgtcgcggcatttccacttccaccacaaagctgcgtccagagctggccctcctgctgcgagcctgcgactatgcatattggctagttatctgctattaggtgtgggccccgggcactggagaagacatttacttgagggatgaaaatccatctccagacaatctccacaattaattaagagataaatcaacagttaattcacatatttgggtaaggagattgaaggataaagggataaggttgaactcctcacctccataaagtgaggcaatctccttatgatcttcatcatacataaggttgaaatctatatcatgtttatccttcaagtgaagtgattgcctcaaaaaaatgaatcaattgataaggctgaactcttatcttatggtgaaataagatatttgacaaatatttattctacttaacataagagtagatgtcatccataacatgtttatccttcaaatcaagaaatatatgggtctgtgaatcaaggcagaaatctcctcagcaatgggaatcatggggaaatgggagagatgcatcggaggcagaagcaagccaatgtcgaggcagcgcacgcaggaggctctccgtcgagcacctggcgactccgaggtggacaggaaggagaagccatgggcggcgcggtggaaagcttctctgatcgcgacctgcctcgtcgcgctgccggcgctggtgttcctcgccgtcggcggcggcatgccctcc

SEQ ID NO: 4544 - DNA, 1501 bp, Oryza sativa
cctcgcgcgcgcgtcgggggagcaggcaggtctggaggggcgacgccgccgacgacatccttccgtctcggttcggatcggattgaaggtattcgtcctcctccgcccactttgcgcgaggcaggcgggcgcggtgtagattgggaattgggatggatgggcagggagaagggagggagcggggcctctcttcttacccccaaatcgtacaaatttgcgccggaaattggtccaaccaacaaccttgttgttgacatgttagcacgagaggaatggaatgttcttgctttttttagttgttcgatccttggttgattgtagtgaatgccagtgacggtgagtggcaggagtcattttggaattttagattggaaattcggagaccagctgcgaagggatccggaacttaagtagccccacgttttagtttgtctacatttcgtccaattcctttgatggttttggatttatttatttattttgtctggatatgcatcgttggcaaaatcttctgcactattttgctatgttttatgttgcagttaagtgtcagggttttagtgaggatttcagtacctatagattatagttgttttcttgaaaaatctgtgatttttttaatccctcagcacactgtacacttaaaaaaatattttagctggtacatttcctggtataattaactgccgtatctgtatgaaaaagcaggaatgcatgaggaaccactgaagatttattggtggtaatggagaatgatcatggagatctagatgatgtgggatcagggtggcttgaagtgaaaaaagtaaggagttctctctgttcaattataatgcatcgaatgattgtggtgttttccccattatatgtgttataaaaccggccccgaaatcacatcggaaaccaaaccgcggaagaaaacaccataggagatccaaatatgatgatgacaccgagacacgatatttgataacggagttcagccgtagcctacatctccggagcactgattacggacgctcctccccaatccagcatattacagcgtatcagagttacaacgactcacgactggtcgctgccggcagccgctccctctcgctatgctaagtcgtcatgcggttacaataggcacgcccctctatttatgagagagcctaggatagagtctgactcttactctagtcctaacacctattacaattccaagtcctaaactggaactgactttgtacatatattcgacacaaactctaacaatatgttcccacaatcgccttattgttaaatgcaaggttaaggccttaaggggtgtgagtttgatccatgcaacaagacagtcatttctagataaacagatgcaatagcttggccgagagtgataataatcaatttaacacctgtttataaatcaaatgttagaagaatacctagattgaaccaaacagatgttgtggtaggagtttctgtgttatttatgcatagcaaaagggcatgtatt

SEQ ID NO: 4545 - DNA, 1501 bp, Oryza sativa
ctgcaggtaatgctagacctggcacttcatcaaaatcaccaaacctgacagaagtgttcgataaaacacctatactatctgtcattggagggcctttaacatgatcataaaaacctgaagattttgcaagaccacttgaacagttggaggattgatgtggagttggagaatcagcacagtcaatcttaccaacgttgggaggttcacttatttcttcagtcactagcagttttttaggtttttctattgcatgatccgaggctgaaacacttaattcactcttcagattgctagcatctgcatgagcacattcttcaccatgaacaaccattgtgactacgctacccggttcattaacgcaaacattaacctttgtgatctgaggtgagcattgtaacctgtcacaccactttgcactatcactgccaaagttggtctgagattgtgaggacgagtttgaaattttattatcattggaacctcctgaagacctctgcaatgtgaattttgagctggatcggtgtttctgttgaatagatttgtaataagttaggaacagaagcactaagagttcttctggcataatagagcatcaaatgagagcatgatccaagtctctgagcaaaatgcaaacaaaaaatataaaatgtttgatgaaatatggtattaacttgatgatccagaaaaaatgcttctgaaagagccaataatcttcaagcaacttagagctgtttacagggtataccttcgctatgtaagtctatgtgtgtgcaagatagtactggttaatagctatcatcctggacagaatggaatatggccaaaatatatcactgaatacatgcccttttgctatgcataaataacacagaaactcctaccacaacatctgtttggttcaatctaggtattcttctaacatttgatttataaacaggtgttaaattgattattatcactctcggccaagctattgcatctgtttatctagaaatgactgtcttgttgcatggatcaaactcacaccccttaaggccttaaccttgcatttaacaataaggcgattgtgggaacatattgttagagtttgtgtcgaatatatgtacaaagtcagttccagtttaggacttggaattgtaataggtgttaggactagagtaagagtcagactctatcctaggctctctcataaatagaggggcgtgcctattgtaaccgcatgacgacttagcatagcgagagggagcggctgccggcagcgaccagtcgtgagtcgttgtaactctgatacgctgtaatatgctggattggggaggagcgtccgtaatcagtgctccggagatgtaggctacggctgaactccgttatcaaatatcgtgtctcggtgtcatcatcatatttggatctcctatggtgttttcttccgcggtttggtttccgatgtgatttcggggccggttttataacacatataatggggaaaacaccacaatcattcgat

SEQ ID NO: 4546 - DNA, 1501 bp, Oryza sativa
ccaattagccaattgaattgctttttcaatattgcatctacttttcgcttagttctagcctagtttcgtccatctttgttggtttgcaccgtgaaccgttcgccgtcactgcgagagtgcaataccgctttgtaggtttgtcccgtaaaccttctgttcgcccacgagacgggtggttatcctttgttccacctagattagatccgctagccggtctagtttgcaaaacacatcttgatttcgaaaggctaatgggcgatcgattgcccctagcgatcacccccctcctccacgtggtttctttttttggcaccgcattactttcctattttagtaaatttatgcatctatagtttgtacacctcaaatttacacatctaaattttatacacctaaagtttagagacccaaagtttataagtcaaaagtttatatgtctgattcaaatttgaatctgaattcaaatattttatatatatagtatttctatacatctaaagtttatacacctaaagtttggagacccaaagtttataagtcaaaagtttatatacccgattcaaatttgaatttgaattcaaatattttttatatatagtatttctatacatctaaaaattatacacctaaaatttatagacccaaaatttataagtcaaaagtttacatacccgattcaaatttgaatttgaattcaaatattagtttatagacccaaagtttataagtcaaaagtttacatactcgtttcaaatttaaatttgaattcaaatattttttatatatagtatttccatacataattttttctaactttgttttctttttttaaaatttatggtgtaaaagtaggaagagaagaagggggggaggaagccaggaagggggagaggagcgtataggggggatggcgggtgatcgctgtgggagatcacccgcccattagccacgccatcttgatttagccttttggctagatcggagtggttggcgactccatatcaccgtaagacgtttaggtatcccgatcatggttgtcttcttgccaaaaaaaagttgtcaacaattttgttgaagtactttttgagattaatctataaatatggagaccatgattataagtcaaatactacccccttttcaactgtaaatctttttgacttgttttttcaagtaaaactttttttagatttaactaagtttataaaaaaatatagtaatattttcaacacaaaacaaacaaaaaatattaaaatatgttcaacgttagatgaaataaaataaaattggtgctataagtgttactttctccgtttcatattataagtcattttgatttttttagtcaaatttctttacatttgattaagtttatagaataatataataacacttctaacataaaataaaatagattatcaaaatatatattcaatactagatttaatgaaactaatttggtgtttaaaatattactaattttttctataaacttagtcaa

SEQ ID NO: 4547 - DNA, 1501 bp, Oryza sativa
ttaactatttataattaatatagtgcccatttgtctctctcacagaattttttggttcttgcgtccaagccggctgtaaatttacagcccgcttctcctctctctcctctcttctctccatcacctcagcatttagccgacttacagcctcctattatacttgctcttaaggttagccatagccatatattctcttgtgagtttacttcccaatacataaagttatactacaaatattattttagtgcttaaggttaactttacatgcacattggagatgcccttatgcctttaatttttaaggtcacggtaaattttttgcagaaaaggagagcgcctggccggccaccagctcactgttgcaaatagtagaaactcaacaattttatgaaaaactatactagaaacttgataactgcaccacacctgcacttctcatcttttgcaaattaaataaattatcaccttcagcagttcagttagttttagtactatagcacattgctaagctggatcttaatcaatcagtgtataatcatccatcatcagagataatacctgccaaaggcaaacaccacaatgatacaatctacaaagccccaaactgaacagattacgcaaagatatctctcccatgataatatgatattatgcacagatccatcaaaaccacagtgtcatcacactatctcaatatatcaacaatcattgcctgctttaacactgaccaagattaggttatctttacgcaaagagctttgttttttcatagctagattagtgcagggattaaacgacacctcagcttcagtagcagctggggcaatgcatttgtctgggaaaggagtcgatctcatcgattgttcagatcatcttttaaataaatacatgtgtgtcacgaagctgggcttggctggctgcaggcagcagttcgaaatgcgcatcgagctggtgagcaaatgatctttgccactgtgacgacgacgacgctgctttacataaaggcaggacaaataatctggtaagaatttggggcctctctctgctgcttgccctgaagatagcaactggttgtcgtgttgccataggcaaaatttaagtagcacagtggtttaggtctaactaacacacgcatgcaactataaatatgtaatatgaagtgtcctgaatcttttcaagttcataggatggatggtctcctgaaaaaagaaaattcagagtcctatagttattttgtttacttaaaatgtactctgaataatgaaatgatcgacttacctttatggtgatctcaaacgagtacccctatctactactatttagtattatcatcgatataagtgatcttaaccgttaatttatcttgttagtacttcctccgtgtcaaaatgtaagtactttttaggttggtacgagtattaagaaagtaggtggaaatgattagagaaagtgtgtgattggttgagaagagaaaaagagatgaaacagaatgtttgtgatt

SEQ ID NO: 4548 - DNA, 1501 bp, Oryza sativa
tctaatcatttccacctactttcttaatactcgtaccaacctaaaaagtacttacattttgacacggaggaagtactaacaagataaattaacggttaagatcacttatatcgatgataatactaaatagtagtagataggggtactcgtttgagatcaccataaaggtaagtcgatcatttcattattcagagtacattttaagtaaacaaaataactataggactctgaattttcttttttcaggagaccatccatcctatgaacttgaaaagattcaggacacttcatattacatatttatagttgcatgcgtgtgttagttagacctaaaccactgtgctacttaaattttgcctatggcaacacgacaaccagttgctatcttcagggcaagcagcagagagaggccccaaattcttaccagattatttgtcctgcctttatgtaaagcagcgtcgtcgtcgtcacagtggcaaagatcatttgctcaccagctcgatgcgcatttcgaactgctgcctgcagccagccaagcccagcttcgtgacacacatgtatttatttaaaagatgatctgaacaatcgatgagatcgactcctttcccagacaaatgcattgccccagctgctactgaagctgaggtgtcgtttaatccctgcactaatctagctatgaaaaaacaaagctctttgcgtaaagataacctaatcttggtcagtgttaaagcaggcaatgattgttgatatattgagatagtgtgatgacactgtggttttgatggatctgtgcataatatcatattatcatgggagagatatctttgcgtaatctgttcagtttggggctttgtagattgtatcattgtggtgtttgcctttggcaggtattatctctgatgatggatgattatacactgattgattaagatccagcttagcaatgtgctatagtactaaaactaactgaactgctgaaggtgataatttatttaatttgcaaaagatgagaagtgcaggtgtggtgcagttatcaagtttctagtatagtttttcataaaattgttgagtttctactatttgcaacagtgagctggtggccggccaggcgctctccttttctgcaaaaaatttaccgtgaccttaaaaattaaaggcataagggcatctccaatgtgcatgtaaagttaaccttaagcactaaaataatatttgtagtataactttatgtattgggaagtaaactcacaagagaatatatggctatggctaaccttaagagcaagtataataggaggctgtaagtcggctaaatgctgaggtgatggagagaagagaggagagagaggagaagcgggctgtaaatttacagccggcttggacgcaagaaccaaaaaattctgtgagagagacaaatgggcactatattaattataaatagttaactattatatttgtaggctaagaaaaaattgcaaagaaccttataaccaacaagtcg

SEQ ID NO: 4549 - DNA, 1501 bp, Oryza sativa
tttaaaaaaacacagccttagggcgaaggatcttgttccgacttaatgatgtggtagcgccaaaagattaccttagaggctagtagtatatagatgtgtcgatcttgccttacaaaagatcactgcaaagcagatcgccgtgcgcctgtgtgtgctttgcttgcctggattctttgcctgtaacctgatcctgtcgcaaagacacagcttaagtagttaagtgtaagcatactttgcagttttgagccatcactccactcgcaaaaagtggccaaaaggagatcgagaaatttaaaaaaggcaaagctagtttaaaatcgaagggaattgtttgaccgattttgtttggatcatatggattctttgatgcttttctcccaggacgtgccttccatgccataagctcagcctcagctgtcgctaaattctatcgctatcaaagagctcgtgcacaacaattcgtttacggacagaagcaactgctagtttttatttctattttttaatttttgcccagctgctagtagaatatatatggaataatggaggttttcagtttccagttatgaaaaaaaaaactttacgtcataatacgaacaaggcctagctgttgcattatgttactggaaggtatttttggaagttgcaacaagtcacgatatcacataaatttgcatgttcccttatcttagatgaaatttaccatttgctagtgaaccaaaattctgtctaaaacaaagtgaacgtaacttgattggttagcctcgttatggtgtgcaacttagggcctgtatagatccactggcaaaatttttcaccctgtcacatcgaatgtttgatacatgtatggagtattaaatataaacgaaaaataactaattacacagcctgcgtgtaaattgtgagacgaatcttttaagcctaattgctacatgatttgacagtataatactaccgtaaccatttgctaatgatggattaattatgcttaataaattcgtctcgcagttcataggcgaaatctgtaatttattttattattagtctacgcttaatactttaaatatgtgtccgtctattcgatacgacaagctaaattttttttacccctaatctaaacaccgccttattatccccctttgagttttcaacccatcataatcgtatgggtgatttgcgcgtgcgaatatgagcgtaatttttttgggactgtatttaaaaaggattttttttgttaaaaagcatttttgtaagaattttttttgttactagaagtattccagctaaaaaagtcatcgtctcccaaatggcgcgtcttgaaacgctgtagcgattggcgttggcgaccaccacaagtagccgtcgctacaaaccacggtgcgcagcgcatccaagcaaacaaaccaatcacacgagacgcagccgacgaacgcgtccatggccaccgcctggccacggtggcggccgtcctcgccgccgatgccgtcctcgtcgtcgtcgt

SEQ ID NO: 4550 - DNA, 1501 bp, Oryza sativa
actttaataaatacataagaaatcatgttaaaacttggcaatattactaagttgccaatgacaaaatttgataaggtttaatttgattacaatctgaactgccttttaactttttagaatccccaatattttacaatattttgaatgtgacttgaaaagggacatatactcggttgtactgagctgttttcttgcacatgaaactgagacatgttattagctactttcgtttcgtattataagttgatttgtcttttgtataattaaacttttttaggttcaaaaaaaattaacaatatctataactttaaatttactttcaataaatgtaacattgaatgtaaatatattgtgatcatataaaacttttgggttgaaaatattactatatttttctataaacttggttaaacttacgaaatgagaaaataaatcaaaagcgacttataatatgaaacagagggagtagtgattaattaagttttaactattacaaaattaaaaaaatggttttatttgaattatttaaaaaaacttatatataaaataattctgtaaaaaaaagcaccattcaattgatgtttagaaagcatgctcacggtgaatggagttgcaaaagttaataaaaaacgaacgaagcattagtgatgaaagcaatgaaaaataattttaatataaatgttagtatatactttcattctcaggctttcatcggttggccaattacggataatgcgccaaacaacatattatcgattaaaaataatttacggttaaaactaataacaacttaaacgttaatgtttaaaaaatacgatgaaaaatctttaaattaactctaaaattaagttttattattcaaattttgacaaaaaaaaatgtgccttttagaattctaaaggtgcagggccgagtggtaagaccaaggaaaatcccactaaattggttatgatatctattttggaaaacaaaaaggagaaaaaatcaatcttactcgctcgaagtatttcatttggatcacttaaccactaaaatatttttctaatttacccctaagtactttttggttcattttgtctctaaactattgaaaatgattcactgtactcactaatagcatttttttcttctttttctttctctttatacctgaaattttttaaaccatagagacaccactatcaaagttcaaataatatttgcaacttttttcatgatcgtttacttgaactttaaaatctcaaagttcaaaattaatcttaggtatttccaacctatgtaaacacctataaaaaatattctaaaaggataataagacataagttgtaaattgttacccatctatcatccaatcaaatttcagtgtgaaatacaacttacatatggagagaaaataccgtgatggagtaaattgaaccccttttttatagttgttgtaatagcaaatcaattttattagggtttaattaaaatgcaccattttttttgcagatgagcataa

SEQ ID NO: 4551 - DNA, 1501 bp, Oryza sativa
tggagctgctatgtcgctaggcgacaagctcggcaatgataacacttgtctcgtgaagtcgaagactttgtgcggccttacgataagctcttcttcgatgattgttttgggctccgtttttgtcttttttttcttagtcttggtagcttagatagttagaatgtgcttgtgatatgcatgatgtgattgtggaaagagagatggatagtgttggggcaccctaggtaatatactatccaatatccaacgtgatcaccaaatgtatttttatcctacttatccaaatacatgtgatggtcacgttggacactggacggtatattacctagggtgcccgcagatagaatattttttgagggcagatagaatattcatatagcaataaacgagcatacaacgctgaaaagatatctatcagtactttatggctcagtgcagtctatatgaagtgggatccacctttgtcgatttcaatacaaatagaccctttaggggataaatgctactagtgtaattatactaggtcggggggagtgatttgtgaacacacttggtatacattgagggggaaagaaaactctaactctaacctattatactctctccgtccctaaatataaggaattttggtgggatgtgacacatttctagtacaacgaatctagacaagatttattgtactaggatatgtcacatcccaccaaaatccattatatttagggacagaggttttatccagattcgttgtactagaatgcgtcacatccaccaaaatccattatatttagagacagagggagtattagggtctgtttcgcacagctccagctccagctccacccctcctggagctggagctcagccaaacagtttcagctccaccaaaactgggagtggagctgggtggagctctctcataaaatgaactagagttgtggaactgggtttaggtagctccacatctccactccagaccaaactcctggagctaaatttaggagttggagctataccaaataggcccttagtttaagagaagtgatctcatcatctcatcaggattgttggtggctatcttctaggattcttccaaatgtcaactcatggtttatgttggatgacttttgcttcgagaggaaagagtggttaatacaaagagtgccctccatacgcaaaatttgtaaatctatagattaaattggttcctctcaaataaatatcgttttaacgaatcaaaaatcaagataaaaaaaggttgaattggccagccaggctaaaaactggataaaccaaaatactaaaaaaaaaaccaaaaaaacctgacatgatccacaaccttaccttcccccctctccgactctccccttcctcgtctccatctcgacaccacccctcccgcctcccatggagtcctccctcctcctcaagcccttcgtcctcctcccctccgccccgcgccgccgccaccatcaccacctctccctccccacgccgccgcatc

SEQ ID NO: 4552 - DNA, 1501 bp, Oryza sativa
gcctgaaaatgatgcatctgtcgaggatgagaagccaccggaaatcgaaagtgatgatgtgcatgataaaccatcagaaagcaccccagatactgaaaccctgcctcataacactccaaagagtagcataagcattagcgaagctgcagacggcaacgtttctgaggaggcaccacctcagagcagtgcatccatagaaacgccatcagaaagtgccatagctgtcgaggaaccaaaacacgacgacgaggccagcataaagccatccgaagacagcagtgctcttgaggagccgccgcaggacgatagcgccagcgtggagccatcagagaacactataactcttgagaaggcatcagaggaagatgagggaagtgtaaagccatcagaaggcaatgatgctcttgagaaaacattggaggaggatgaggcgagtgccaagctaccagaagacagtacgacctttgagaagccatcggagaaagatgatgctggcaccaagcagacagaggaccctgtaactcttgagaaggaaccagaggaagacaagggaagtgtggagccaacacaggacaatgctggtcttgagaaaccgttggaggaagacgaggcgagtgcgaagccatcagaggacagtgtggttcttgataagccatcagtggaagatgatgacagcgccaagccatcagaggatagcatggaccttgaaaagccagaggctcacaaaccatcagaggaagaagatggcgcgaccaagtcatcaccggaggatgctgccgttgaggaggcgccattgcaaggtgacacagaaacagccactgacaaaccctcactagaagcagacaccacagaaactgcctgagctggttacagttagttagcaacagtacacagtttttaacccagatgggtggatactactgttgatactttggtttgccattttgcttgttttcttgttttgtacaatgcttgagttgtaaaatttgagggaaaacagaaaaggaactataggtattgatttgatttgctcacaagcaataagcccctcccaatattaggaggagagcagcattgaggatttgagctttacatacttacaatatagattttgcgtgtggcttgattaatttgttgtacatcggatgatgtaaatgatatttatgcaaattactgtgtgcttttgctcatttgtctctgataatctgtggagctgttcttgattgtgccttgtggcttgtggtttgaatttcaattcatccacaaatttcagaaataatttcttggacaacctgtcaggccttctttgaaatgggaaaaatttaaaaggtttttaaaataactgaactagtagattctacgaaaatccagtaaattctaaattttagggttttaaaggaaccctgatgaagaagaaattctaaaacctccccaaaacccctgtggctctgaactctgaagtcagcgaggaagggagaaggcgggagttctccatggctcc

SEQ ID NO: 4553 - DNA, 520 bp, Oryza sativa
atgggcggcgagggggcatggaattttgcaggcggcccccttgccgccctgggggagggcgatttttgcctccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 4554 - DNA, 1501 bp, Oryza sativa
cctagttattattattttgtttacgtagacaaggctgctaagcgagcacacatgcacgaaacgggccaacggacgtacggtgctttgcatatatatatatatatatatatgcatgcactggatatatatattgctgaatcatatctggcctgcagccggccgcacgcatgcatatatgtggatagaaaacagtaaatatcgttcagcactaataaatcaactatactaaattgcacagtactaattaattaactcgcctctatctcaccaggctaggtggctaccgtgacactgacgaatattcaaaacttgcgtataaaatttaccgggataataacgtgcattggaatgttggggttgggccggcagcttccttcacgcgggccatatcaaggctcgctctggatgtgtttccccgtaacatacagtttgatcaagtaatcaaggtgtcgccgatcaatccagaggaaaaacgagtgggaggaggaagcagcttcgtcatgagattggaggcgcagctggtcgccgcggtggcacaggagctggggctgctcgaccaagaataccacaggctcaagcaaaggatggaggagacaaactatttctcctggggtgtgtcgggggataatgaaatgcgtgagtacttgttttgggaaatggctcctcggatcaacgccacactggacagtaagaggtacctgctggtggttgagaacctgtacaagcccatcacgaccagtgctttcacaaccgagttgcggcttcctcctgctaatgcatggtcgggctctgaatgggtggtatccgccacctcccgagaagtctgtagcaagagcaagtccgaaggtgatgacgtgtatgagtcattctctggtgctgatatcatggttcttatcctctttgcgctgcaccaatcagccaaggacatctccaaggcagtggggcaggaggatgacgtggagcactggcaccgcgttgccctccggtgttttcactatgccctgcttctctttccacaatgtcatgcgccacctaatgcagataacaacaatggtattaatgttaccaaagaagagcttattcgtcactgggctgcccaaggcttccttactgctagcaaaccaccaagagcagttcaagacaacatccacaatgtgggcatcaggcaccatgatgatgtatatcaagttgggaacatcatcctccaaacgtttctggagtattcattactaaagctaccatttgctccagcaactaaagttgatgagcctactgacactgctgcacacttcttagcatatcacggtctcgttataaaccatctcactgaagacgaaatgtttcatgaggagcagtgtttgcagaacatgggatggatcaagttggtttgtgagcagacaacggaggatcagaaatggcacataagtggaaaatgcataaccaacaaggaagtatctagtggcacaaccgcacttcttctaagtcatttctcacacaaacc

SEQ ID NO: 4555 - DNA, 156 bp, Oryza sativa
aaatactgtaagctgccagcgaagaaatatcttcgctgtcggccgtcctaaggctaccacaagccccgctccttcttcgccggcggccggcgcacctccgcccgggcggccgcaccagctcccctggcgcccccccgtcctctgtccgccgccagc

SEQ ID NO: 4556 - DNA, 1501 bp, Oryza sativa
aggctagacagcgagaggaaggggatcgagcgaatgagcaatcccatagtggctgggagtgaggagggaggggtgatatggtttagattgtgttacacgaatcttacaataatcatacggtccaaaactcgcatgttttctgagggggttttatgtcaaatgcttgatggacagtccaaataaaaataaggaatattaaataaccatcctaaatgtcacccaaaatttgagattttccttgtaaagaagttttgttgccaatatcccccctcccacccctcctaattcatggtttgatattccttcccaaattaccgatgttcgcgtgttgagtgtcatgagtagggatgaaaacgatacgaaaatggacgaaaaccacctttattgtttttgttttcatattttttttggaatcaaaaacctcgaatacgaaaacgaaatcaaatattgtcgaaaccgaaaacggaccggcaatgatacagtaacgaaaatttatcgaaatacaaaaacccctcaaactaagttttaaactatgtcaaatccaattctcaagtctcaaatttcaacattacatctcaaaacacaattatgtcaagttcaattctcaagtttgaattgggtgtattgggttgggctaaattgagtgacttaggaattacgatgctgaattgggttgggctggggaggaattatagactatggtaagggccttcataattctggaaattccgagaaaatttctggaaaatttccgaccgattccgagttccgacggaaactgcccttatggtattcgattctatttctaagaaaatatttccgaattcgattccgtttccgaaaaattccgaccgacagattccgtttacatccctagtcatgagtgggaatgccatgaccgtattacgtaggcccggtgatatcaaataaaggtgaattaattaggagggagtatttacatccaatcattttatagggtggaatctcaaccttacagcgatatttacgatggtattttacaattttcccataaattaatgtaaattgcacatatgcacccacttgcatgcctaatcatgcggaagggaaaactaaaattaaacgtccacgtttttcccagtgtggtactctcttcgtccaaaagtcaagacctattttgtttttttgttttttttttcaaaagtctaagactcatttataggactaaactaaaatgattggaatccaagaagctatcttaatccttgttagttacatgcatgtgtatagtttattaattttgtcacatgattaatgatttaattttgtcaaaagaaatactccatatggagggagcgagtactaataaccagtagcgcacacgaggaagctaattaacctgacgccaccacctctctttccctctctctcttccattcaccgacaatctaactaaaaatgaatccgatggccccgatgctgccggcgccggcgcccatggcggcggggccgacggagccgg

SEQ ID NO: 4557 - DNA, 1501 bp, Oryza sativa
tattatattttttttctcatataatagcttaaagaatttcatattttattatagaacatattaaaatggcaatataattttaaattatgtactaacttgactctacacttttttttccaatactcctcatttttttaattcctaatttcagttatttataaattgtattcctatatagactctagactcttctcccaatcttgttttttcaaaaaaaaataaattttagttatttataaattatatttctatatggactctaaactctacttataatttttattattctttaactccaactttcaattaattgtaaattcctatatggactctactcttccaatttttcttatttttaattctaaattctattatttctaattgtatttttatatggatgctaaactcatcttcaatattccttatttttagttccgaactttagttatttataaattatattctatatggagtatagacttatctgtcaacattcttttttttaatttccaattgtaattatttctaaattgtatggactctaatcttctcttcgaatatttctttttttaattccgaattttttctattttaaattgtatttctatattgactctatttttccctttttcttcgattaatgtgagaatttttaggccgtaagagcgaacatggtgacttctttttctaataataataataataataataataataataataataataataataataataatagtggtagtagtagtagtagtagtaataaggagccagctactcaaattctacattctacaaatatacagtagaacctctcatagcattttttatgcccaaaataattatgatgagtccaagataaactgtaatatgtgttttacgtgcatatataaaaaaactaactcgcgcgcttatacggccaaaagacaacactatgtacaagctcggattttcactagcgttgattttgggacaaccaacgaaaaataatccatccgatcttgttctgcatcggcatatttgcaaacgaaaaataatttatgaataaaacttttatatacgtattcttagaggctaaaaaataaacttcgataaaaaaaaaccctaaaaccaactccaaatttaatgtcgaaaatttaaattttgactgataagcataaatataagcgaaaagatgaggccctttgacaaggtatacttatttgaatttgaaacaagaacatatatactcccttcgtcccaaatcgcgtccccttttatgaaaatcaaactcagtagcttttgattaataatcatactaactatattcatgctaagtattatacatgttatattattatatttatattttgaagtactttaatgtgatactaatttcatattagttaaaaacataacatagaataaattatatattgatcaaagtatgttattgaaaatcgtataaaaaattataatttaggacggagggagtgtacttaatgatgagcctata

SEQ ID NO: 4558 - DNA, 1501 bp, Oryza sativa
ggcatatactatagctagctagctagctatatgccaacaacgactatcacatatatatactgttggaacgattttgctagatatttgtcattaaatttctctcctaatatttgtcgtttttctgaccgtaggatttgcgctatgattcgtgcgcatgcgggggtggggatgcagctgcgtcacgtgtaatcagaccgcgcctatagtcaaatgtgggccatccctctcaaatgtcgggctccacgcttttctgtctgtactccgtagccgttgtttttcctcagctctcttctcgctctctttccttctctctttttttcttttctcttcattgttttctccggagagagagagagagagtcatctcgccggtgagtgagagctggcttgccggcgcgggcgagagagagggcttgccggcgcgcgagagagaggtaggtcgccatggtgattcagctcgccggagagttttctgctgatttttctctccttgtctcctatttgtttgcatcattagttgatttttttttcaatcttattccggctaggttttgatgctttaggtagctcttaatgtttggatctgatgcttgtttaactgttttagattttggaatcggtagttttggtttagtcccctgatctgttgatttctatgtcatggaacctgaacacgcggagcacttccgtcctgcccttgttttgattagtcccctgatccgttgatttctatgtcatgccgatgagattgcctagctgttgattttttattttgttaagttccaggtgagtagtgctctgatctgtttatttataggtaaagctacacactatttgaaattttctaggtctgatctgttttttaagtacatctgctttgtgtgatttgggaatagaataaattgtaaccaccgaactagccatcggtggaaacgatggctggattttttttttggtcttgtcactgagctcgattttgtgtctggtagatggggatttttttttgtgtgatttgcatttttcggagtaaattggacatgcttttggcagatttacaggtttgctagcatctttttccccctctgttttgttctgtcctgtactggggattttgttttttccctctgttcttaacatgcacgtctccttctgtgtttgttaacaataaattgtaaatgtgtccaccttagaataacaaaagcttttatcatgttctttgttttatgaaacaaagcagtgtcaattatacacctaaatcttgtttgaatggatcacctggttaagttgcaagcacctttagagctccattcattgtgtcctatacgatagaaccaatgaagatcccttctacaatacaatcttgattgagcaaccctgtgcaggctgcagcaagcttacatctaaactgtgcgttgattaaagatatatgttgtgttcaatttgcaaaacaaggtgatgtatgatttccatgtgcttctgttacaattcccttctgttattg

SEQ ID NO: 4559 - DNA, 772 bp, Oryza sativa
ctggtattaaaaacttgatcagtctatgctaggtcttaggcttgtgaaaagaattacaaaacttgctttgcgcgaaagaaccatagccatcctttgaattcctctgtcatgtgcatcattgctgtgatggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccaatgatttaagactatgcctgcgggcttatgatgtaataattcgtattagatactcgtgtatttgcacttggtatttcagctatgaattcgtgtgtaccagactacttgatacagggaaatggtactgtttacacgattgattcctgttataaaaacgggggtccacagagctggtatcagagccatacgactgtaggaaaagaccaaaaggcgccccaccccttttctaagttggccaagggagaaattcccatttagtaatactttcaaaaataaaaacgctatgtttacaaaaactcggtacaattttcatcttactcttaactattttctttacaaaacaagttttactctcaactgactttgggtttttcttaaaattagatggcagatccggattcacccgctacttgggtgt

SEQ ID NO: 4560 - DNA, 1501 bp, Oryza sativa
cccttggattcgtttagaaaccctcccctaatcccgccggcgccattgatggagcctgagaacgccgcgccggtttccttcccctccggccgccctctcccccttccaaccctatttaaaccctccccgcacctcctccgtccgtttccgcctctcgctgcccttcctcctcgccggattcgagctcgcgacgtcgctctctctctccgccgtcgccgccgagctccggtccgccgccgttgtcgccccggaccacctcccacctcggtgccgcctccttcggcttcgccgcatcctcgccgacctcgtccacctctccatttcggtcgccaaccgccggaacgccgccgaccccgtcgacccgagccgcgctgccgccttcctccgctccagccgcctcctccgtcgccgccgtcgcctcggggtgagccgtggaccgccgcttcgtttccccctctccctcccctctctcgtccgccgctccgccgtacctatggtcgccgccggcgaccataggggcgcaggcgccgcctcccgccggccgtgccggcctggtcgccctcgggcgcgccgagtggctgccgcgtggggcccggccgtcagccgcccgcgccctcgggtgcggctgacgtgtggggcccatggcgccggctggtgcgagcccgggtgcacctggtccaccgtggaccgtgaggctgccgcatgggccccactcccatggacccggtccgcgcgcccctccccctcggctgacgcaataaacccttttaaaattagaatttaaatgaagaaattcacaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgccgcagcttcggaagatccgctcttcgtggaggttgaagccgacgtttgggaaagcgagcaaggcaagtcacatcatccttgaacatattgaatcccattttataaaattgttttgatttaaattattgcattatcgctttatttaaattcccgcgttatcactgttttatttagccatgcctatttacctttgttatgaccttattagtattgctattgttattattaccttgttcaccctagaataaacaaaaccccaactagtggaccctctactcatggtaccactagtatgaatttaggtagatgcttcgctggttaattaggcaacattaggtggttttacaactctagactttgggaatattctcatcacctggacactatggaatggttggattattgtggaattggattcacacctccccctctattcaaaatcttcaaaatggttttaggctgggctcagggtgcatggttttgatagtagcacctcggccatataaggaccggt

SEQ ID NO: 4561 - DNA, 572 bp, Oryza sativa
ttgccgccctccgcgagggcgattttgcactgtccggggggccgcctgcaaatgggcggcgagggggcatggaattttgcaggcggcccccttgccgccctccgcgagggcgatttttgcctcccccttataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcggttattgttttcatcaggcacaa

SEQ ID NO: 4562 - DNA, 1501 bp, Oryza sativa
agctaagattggtttaagattgcatttatatcagtgtttagttttgcaagtaggccatctgcttattgttctaaaagatttcatgtcatctgctccagcatatttagttgctatccacctgcatctatgaaaaaagttgccaatgctaaattaatctagccttaattaaatataaagttgcaaacggcattttcttcccatcttaatacaatctgtcagcttgtattcagccgatacggctaaaagaatttcattttctcagagatccggcgcagcagcatacgaattgaatgcacgcgtctaaacaaatactccatataacagtaaataccggaaatcgtatagtaagaacttatatatacataattataaaccattcatttagtaagaagactgccccagcagctgcttgtttaagtcttttaggaaacatatacaagtcagtaacaagaaatctaaaatgagtaacttattaattacaagtgcagtaatcgcagaaaaaaatagtattttgtactccctccgtcccagtacagtggacgtttttgactttgtactttcaacgtttgaccattcgttttatttgaaaaattagtgtaaatataaaaaaagataagtcatatgtaaagtacttttgataataaagcaattgacaaacaaaataaataataatttcaaaattttttgaataagacgaatgatcaaaaaactataaacaaaaacttaaaaagacaagtatgggacggaggtagtaactctattactctatcaccaccaatagtaacacactgctgatataggtgcatgaacctcggtccttgtgaagcatatccccagtaactcagaatgaggagcattatatatgcatgctgagcccggatgatatataattgcacgcatggcatttcatgatgcctagtggggcacatgcgtgcaggtccaacaaatgtctccctcctatgcagggagagggtgcagacagaagcatctccattgccacaattatacctgtagatcgatgcatcatgatgaatttgacatttttattcgatgggcatgtatttgagatattgacattatgcaacatcagaatctacatttgaaagaaagcacttatatcttgccatcttggaatcgaccgagatacgatatacacccttcccttcttgtgggtcctcaacagagagcatcagaatctcactcacctctcaatcttccaagccaataacaagtgtgtacagtagagctcacacaaccacacacttatgaacacgagtacagccgatgccctataaatagccgccaccggagcacaacagatatcatatcaaaacacagcagagatcgatagatctcttctgaagtccaaaaaaaacttcagtctagctgcacactagttagcaagttacttagcgttcaacttccaaagaagacagtagctagctagtttaatcaaatccaagctgcaggatgtcttctgctgggtcacgtagctcgtccc

SEQ ID NO: 4563 - DNA, 1431 bp, Oryza sativa
tttcaacttctactctcatttttcacgcgctagcttttctgaattgctaaacgatatgtttttttaaaaaaaattatataagaaagttgttttaaaatattatattaatatatttttcaaatcttcttgaactaatatttaattaatcaggtacgaataagttgttttgttttacaagtttcgaggagtagtatttttctttttttttctttttttttgtgagaaggggcttggatgagtatgttgaggtacgcccgatatcacagctgctaaagtaattatatcttcttttttaatagatgacaccatttactttgttatcacatatttgactatttattttattaaaaaaatatgtaattataattaattattaattttgttgtgagtttttctacttataccttattgtcagggttatggataaggtataccttctatcctacgacttatggaatataccgataaggtatactttcacgtacacggatcgtctttatatatgtacgccgttaggaatccgtcctaagttatggaaaatatctctacgaattaagcgataagcgatttccaaagtcttacttggaggggatatgatttctgttatactgtatcagattatcagatcaaatattcttagatctttcttagggggtcaacatgatccacggtattaaagagacccccagggaggagtgtaaggcatcgaatttcaccgccaacacacccatcatagtttacgatgccggagtacgcggagccaagtcgccaggagatctcgtcaagctcatcgactacgatcccatcggtaccatctgtttcgtctacttcctttgtaatctgttctcatcatcatcaatcccatataaactggattaaggctattacctgacaaggggtctgagccagtataatctttatcttttgtctacttgatgtcatactacgtaaactctcgttccaacgtactctaatactcaactcatccggtccgcgagtatcactcgtcgacacttatacatttgcataaactttctaaattagacaaatagttaaacatgtgtttggaagttaacggtgttttttatcagaaaaaaaggagggtgcaatacgaataaaactttttgtcccacaagaaaacatttcgatcagggccgaaacctcgtaagcccaacttaacacggcccggcccatatatggacaagtgtcctgccccccgcatccgccaacggctctttcccctttcccccagacagattccaacggtcaaaatcaacgagagcggagcaaatcacaccacatcacatcacaccggcggaatggcggcggcggcggcggccaatggaaagaggaggccacgcaaggcggcggcagaggccgtggacgggcaggaggaagcctgccgcggaggaggaggggcggcggaggcgg

SEQ ID NO: 4564 - DNA, 1501 bp, Oryza sativa
aaccaaacaatgcttccacacgccactagcccactagctctaggtgtctccctccttactcttaactattacttccctgcgcgtcgctccaaggcaaggggcgacacgggaggcgattcttcccccccccccccaccaccccaccacacctcctcctcccccgcctcaccaccgctagagcagccgccggaaaccgtgcggctgcaaggacggcggctgcggggcctcaccccttctccatggaggccacggaggtcggcacccacgaccagtctggggacgacggcggccgcgaggggggtgagctggagctggcgcgcctcgtcgaggtcgggacgcctgcggcgaggagggatgcagtttggcgaggaggggagaccgcgacggtcgtggtggctggctggtgccggcgtcaagctagagggctgccggcatacctccttggcgtggcagtggctaggcgccgtggccggcgatgggtgacgccagggtggtgtgggaagcagcggatccggagtcccctaggccggatccggccatcctcgcatagatctggcgtagcagcggtgcgacgcggcttgtggcggctcggcggcgtttgcgcggcagcaaggcgtgcggccggcctggaggtgagtggcggcggcgtgcgccgagccgggcggcggcggaggcggctcggaggttggaagcggcggtgacggcgacggctcgggggcgtggcctgccccggcggtgtggcccaccccatggtgctggcggtggtgctgcccgggggcggtgcgctgctgtgctgcctggccgctcggcggtcggtgcagccctttggcgcggctaggcctcggcagccgggaagccgtcacggtgaccttaaagcgggcgccggagccagggcggccgcgtttccggtgtcggcgcaggcccagatggtagtgcaaagggagctggcagcggtgggtcgtctttctcgttgccggtcggcaccctcacccttcctagagctcctccccttctttgcggggagtttctaggctggattgaggggccagcttgtcagcgggggaagctcaggctgccgaagcaatgccacctagtccagtgttctccttcggccagatctagcgaagaggccggcgggtggtggaacggaagggtcctgggccagctctcagcgatggtggtttgatgaagtcgaccgacggcggggcgtcggtgcggtgtggtggcagtcttgttgttggcaggattggatgctggctggcggatgggcgtcggtcgggtgtggcggaagccatgtgtcctcggtcggattgggcgacggaccacggcggtaggggttccgagcgagagcttagcccaatttctttgggacaaaagtgactacaccttcgggtgtggtaactctcctgagggcattgttgaggtacccctcctcccgcggcaaggagctctgggtgaaaacctagtccagttttttggacggatgatgacggcgtctttc

SEQ ID NO: 4565 - DNA, 1501 bp, Oryza sativa
ttctactcgagaataatgggactaagccgtgtcacatcgggacacgaattataaatattaaacgtatactattaataaaatatataatcttggactaattcgcgaaatgaatctattgagcctaattaatccatgattagcctttgtgatgctacagtaaacgttttctaattatagattaattaggcttaaaaaatttgtctcgcaaattagctttcattatgtaattagttttgtaagtagtctataattaatactctaaattagtgtctatatacagagactaaaattaagtccctgatccaaacaccacctttactatttgtcacacttactattaataattaagaatttatcactaaagtgacaaaaaaagttaatacaagtactctcacctttatctcaatatttttactactttaaatctagctatttctttataatctttataatgactaatgactagttgcccacgtataaaaaattaacaaacttggttagcgatcatgtcaacaataaacccttaaggctgtgttctttccttcaagttcccaacccctcccctcgttttccgcactcacgcttttcaaactgttaaattgtgcgttttttgcaaaaaaaaaagtttatatacaaaagttgtttaaaaaatcaaattaatctatttttgaaaaaatatagctaatacttaattaatcatacaattatgtgtgctccgttttgcgtgctacacagcctaactatcactccacgcaccgccaccaccacctagggatgaaactggttcggatagattccgtccgtccggaccaattttcagattcagaaaaattcggtcggaactatccggaatttctcggatttggaaacgaattcgggttttttctcggatacaaaaacgaacagtaagggtggtatccgacggaatcgtaaatcggtcggaaactatctggaatttttcatcggatatccggagatatttttcagcaaaaaaaaaacaaaaaaaatcccgaaaccctagctagatccgcgctgctgcgcccgcccgccgccggccgtcgcggggccgagcgccgaacacctcctagggcagcggatccggcccctcccgagggcgatgccgccggatccgccgccctcgccgcctgccgctgccgcccatccgaagccgtcgccgcccaccgaagccgtcgctgcagccgcttcctaggtcgcggcagtcaagcccgctgccgccgcccgccgccgccgccgccgcctgctataggatcgagatgtcgactagaggggggtgaatagacgatttaaaactaaatgacacctaatcaaaactaacctaagttgctaggcttggtgagggtcaactctaactaagcaactaagttatgttttgcaaacctagggtgatagtggctcaattatatctctaggaaagtaaatcaaactcctatgtcaatgtttagcaatcctagggtgatatgatctcaagtttgtctctaga

SEQ ID NO: 4566 - DNA, 1501 bp, Oryza sativa
cgtgcccctacccacctccggccgatctagggttagggagagggagaggaagggccgatctactgcaggggcgccgctgcccccgccggggtgggggcggatctgggagggaggggaaccgctgccgccctcccccagactccctctagctggatctgggagggaggcgaaccaccgctgccgccacaggtcctcccccctctcccctcggccggatctgggagggagccaagcggccccgagtatcaccgtcgccgtcgccgtttgctgccccgacctgcgtctcgctggtgccgccgccgaccccgcgcctctccgtcgcgtgtggatcccgctgcccctgctcgtcgccagtcgctggttcccccgccgcctgtcgctgtgagggatctgagggagagagaggtgagggagaggagaagtgagggagagaatgctgaggacttagaaaaaaaatcttctccagccttgtctatttatattccacactcatttttgtaggtggaccacataagaggtttgccttcaaaaataaagagtatttttgcaggcggacagcgagatttaacccggtttacatttttgtaggcgatcatttgggcccgaaggttatatccgcctgcgaaaaataaatacgtacccaacgtcggcgcgaaaatgctttttctagtagtggtgatacatctccctagcaggttaggaaggactttaatccattcctaattcctgatcgttgattgctagtaaagttgtatatatatgcatttaatagttaatattacatgtgcatgtaaaatctcatcttcaaactcatcacacgtatgaaaagaaaattatattgttacggttaaaatataatttacccaatttaggctaaaactttacagaggtataataatattagaagtacatgtacattttttaaagtatgcataaataattatattatattttgaaaccgatggagtattttgtatcaaacctttttatccatttaaaatggacacttatcctttcagcaatgttgagatagacaatagtggatttcatgtttgtgatcttatatacagctttcggccttcaccgagaggtgaaaatttctcgtaaacttccacatacaagttttacagtataaattaatttggttcctaatgaagtcttataactttatgcattccaatggtagctaggactttccgggttcgaacagagatgaaaatttcaaataaacttcaaaaagaaaatcatataaattggttgttagattaatgtgctatacccaattaaatcctaataaattccattggcccacattaagtgctatgggtaataacaccaccttgcaaatctgagtgcagaggtctcaacttaaatacggagctagtggagagtctctgttgaccggttgagatggtgcgcggacaaccaggcggggcgaggcgaggcgaggcagacagcagctgctgctgcgctctctcgttttgtaacggacggtaataaa

SEQ ID NO: 4567 - DNA, 1501 bp, Oryza sativa
acaaattttacacacaaatattttttatttattaataaacgatttgaatttaacatatgaataagcgaaacaatagggctgaaaatctaaataggaaatctaaatgcgagccgtcagccaccgagtagcatcgattcctaatttcttcaacatttaaccaaaaactttccaatcaggttccaaagctttctgatgggggaaacaagaggagctttcaagtttcgagcaacaaatggagaaatttgttgggaaacccaatactggaatccctaaactttcatcacggaaaactaaaagttttagaataatctcacctcagatccgaagatgttttcaactcctcattgcacgcccgtactcgagagcagcggcggcctcgccgacggcggcgttggacgcgacgggtagcgtggcgcggctacgattcgccgcacacgggaggagagagaggaaagaggattcgcgctcgcaccgcccttcggagtcgggagttgggccgcgccgccgtgtgctgtggtgggccgttttgctggctcgcggagtaactggcccagttttactgttgaccaccgtagcaatattttagggatagatgtaggacttcacccagcccaatccggcacacgtttcgctcgaattttttttatttacaattttttttattaaaagttttacaaaaataattttccattttgaaaattgacggaagtagtcgcctaccgccctctgggagggcgatttttaaaaatcgccctctccgagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgggggggggcatggaattttgcaggcggcccccttgccgccctccgctagggcgattttgtactgtggggggggccgcctgcaaatgggcggcgagggggcatggaattttgcaggcggcccccttgccgccctgggggagggcgatttttgcctccccctctataaagcccagtccctcctctgtgaaatttcattatattcactaaaaatccaaaaaaaacgaaagagagagaggggagggcagcagaaggggagcggcgaagccctgctggttcgctcaattcatcacaagtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 4568 - DNA, 1501 bp, Oryza sativa
ccaagcctagtttgttgcgagccactgcaagccgcgccatccttccgccgtcctcatggaaaggaagcacgctgacggtgtacttggactggttgcagtcgggctggtacacaaggcatgggagccgccgatgtagatcgcgacgtagcggatcagggtgccggggtcccgaggatggccgcgcacgcccttctcgcccccatgggcaccagttgttgggcggcgcatggccacagagcacgatgaggccgaggacaaagggtgcggagtggcggtggccacggtatagcagtgtgatttcccggaaccactgcatgttgtccacgtcacgcttggggtaggtgacgtcgacgagggcgaggtcatcatcgtcgtagccgatgcagaggacaacctcccttctggtcgccggcgccggatctgtagtcgcacatcgacacacaatgatttcacatcacaagaacacatctcacatcaacaaatgaactctcacatcacaagaacacatctcacagcaacaaatgaactccaagaacgcatctcacaaataacaaagaatcacaaataacaaagagaggagggggagagatagatccgccggtcgccgacgccatcgcctcacctccacaccggccgctgacgcatgccgccgctccgctgggcacccatgcctcccctccgccagatctgcaaggggagggaggggaggggttgcgcgctgccggatccgccgcccccctccgccggatctgcaagggggaggaggggagggggtgcgtgccgccggatccgccgccccctccgccggatccgcaaggggagagaggggaggggccgccgtggtcgcccgctgccgcatgctctcgctgcccttcttcccacccgcagttgagggaggggccgcgcgccgccgcatgctgtcgcaccgccggccggccgggagaggggaaaagaggagagtgggaggagaggagaggagtggagtgggagagggaggtgggaggagaggagcgggcggagggggagatgtgtgcgggcgcggttaaaagcggtgggcccgtgcaggtgaaaattcgggtgcggttggcttaagtcgcccacgggcgacagcccggcgcctgtccccctatttttccatgcggttctacttacggaccgcatgtaaacaaaagtgggtggcgtccaagaaaatatatcatgtagcagtgtcgcggatcgaaaatagttttgcatatttactcatagtctctagtggtcatgcatgctttctcgatctgtcaactcaaaattatacgtggactcacgtggagacaggtcatgtgacatgtggatgatagcgcgaatactctaatttggcttatctcgtggaaactttttttttcaatcgatatttttttgtctcaaacaaatattttgtatttactgaaacttcaagtgattttgatgtcaacaatataagtaataaagaaaaatcatcattagttgtgaagtactcttacgt

SEQ ID NO: 4569 - DNA, 1501 bp, Oryza sativa
cccctgtttgatgaaatgcttatttacacacatcatatatttcaagtagacaggtagcactagaatcacgattcacttttgagtttccatctttttgatcttgagcaaaaaacctttgaaatgggcaacgatggagccgcagaaccacattaaggtgtttgtttcactgtcatgttctttgtatgcaatatgcacatctctatatgcttcatagttatttgacacatagatgctccgcatcaacgcggcggggtatgatctagtaccatgttttccaagtacaactcaaattattgtttaagatgtgtgttttgttttattatgcatgattagatagcatataattattacgtattgttacctaaatcaattttcagaaaaagcttgaatgaagcagagagatgcaaattgtctaaccacaacgatacccatattgcgcatgaaaataatattcatatattataacaagagtaaattgcataggcggtccttgaatttgtaagcaggtttcatctaggtccacgaacttataaattgtgtatcgaggtccctaaacttgatttattgtatcattccggtccaaagtctcatttgcccatggtcttgcctacgtggcatgacatgtagacaatgacatggcacattattattattattattattattattattattattattattattattattattattattattattattattattattattattattattattattattattattattattattatttctttttttctctcttcttcctctttcatttatgtcttcttcggcctcttcgacgcgggggagctcgaggtgactctagtggaggaagaagataaaagaataggaggaaaaagaaaaggggaaaggaaaaaaatgccacgtggcatgccacgtacacaagaccacggtcaaacgacactttggaccggaatgatacaataaaccaagtttagagacctcgatgtgcgctttgcaagttcgtggacctaaatgaaacctcataacaagtttaaggaccgctagtgcattttactcttataacaatatacaacgaatacagaatgacgcttggaaaaataaaatatgaattgtattgtagtaacataaggtatatataaagccacattatcatatattttgtagagatagagttgcatctaaccatttaaaactacgattttgtttgacgataaaactacataacccgtggcaagacgcggggtgccaactagttaataagatgattgggtcatgttgattttgtttcacgatagattttagggctggtttgcatgaactaaataattgttacaccgaagtgttttacatgttgttacacttactaaaaacaccccactgcacattcttacactacatgatgtaatctatactttctatatagtggtacccactaacaattattataagctaaagctcaacatgcaagcatgccacatcatcacccactactaattactattct

SEQ ID NO: 4570 - DNA, 1501 bp, Oryza sativa
tccgctgttgctaatggatgattatgtcttcaccgacttattatttcaccttcacggttgacctactatgcaaatgctgatgagcgtcttcgtcattatcattggttgctacactgctattgactggatcaccgacatcgtcatcttcatcatgtcggttgcgtttgtcgtcgtcgactattttcttcatcttcataattggtggatttcgtcatcgcctttgatctgcctcgtctgtcaccgactaattatttcgctgccatggctacacaactttatcgctgggcgccttcatcttcattgttagttgatctgtctaccgccgactggtttctttgcctccatggctatgcgacttcagtatttttgattggtatcactatcttcactaccaccaatatttttgccacctctagtgggcaatattatctctatattggtcatcttgtctccaactgcgtcaactaccatcaatggaccattgtgactacgacagaaggacaggctatatgatcaggggtttactagttcaaacacaagtatcataccttcaatttggacttgttccggatacatgcaacatgaattcatgatcatgggtctattttctatgctcaaatactagactatttattattccctgtaagggttatcaaccgaataattattccaatcgggattcaattattatatctattttgaagtatcccataagggataatcactcagatcagatgctattcatatgagctacacttggtctatatcaccggaagatttattactcgggagcatgttacatgcgtcatcctttaaagggtgtcgaaggcatattttttggcctagacctaatatgtctgcagcccatattttcaggtgtggcctgtcacgttcttttagggacttaggcactttttgcttaggccaaagtgcgcatgatcaagtgtccaataccttaaaatccttttataccgcagttacttaactttttaggagttggtacaatgcatcttaaaaggtgtcaaacagtaaagctttatatagctgccccgctgacttttttacatagtcatggcgctgtttgggtttataaagcaattgattgaatataatatcattgcttttttgccacgtaagtgtgcatttttattgaccaatattatggcttaggctgattatatatcttggtcattttccaggcggttggtaaatcctttatgagtttatttactcggattttatatcacatatgccatatatttccatgtgtggtgaaaccatgtgtcttctagggatttaagcatatctgttaaagcagtgtgcgcatggtgtgtgcccaatactttggaaatttctttattcacaacatcaagctcttctttatagctgttttgttatgtgaattttcaaagatgttgtcaactttaggttgctcgcatcaatttttataaagcagttggtatatcacttggattatgttatttgggggattcacaccgca

SEQ ID NO: 4571 - DNA, 1501 bp, Oryza sativa
cggggctgcctacgtattagacccccgcccaaaaaaaaaatatagtagtttagttcacaccaaaattagaagtttgattgaaattgaaatatgtgacagaaaagttagaaatttatgtgtgtaagaaagttttgatgtgatggaaaagttgagagtttgaagaaaaaatttgaaagtaaactcagcctaggtgctgaacatttgccaactatagatcacgcaaatctgtcgggacaaaagaacttttcgtttttggtagtgttcttgtcctcggttgtcgcacaacatgatggtgtgcgtggagttgttggagtggtttagcttgtgggctcagcctatttatttcttggcaaaatttgctatagggcatcgaaaaaacgtgtaattagcttgtggacactgcaagaaccagaatttgctaacaggtataaaaaaatgtgtaattagctcctggacactcggagccttattttattattttatgtgaatttggagagagaaacactaaataaagacaactttgcccttgggtctcgacctggatagtgacaaaacattgggttggccagcggcggcgacggagccgaacacgtgcagcgcttgtgttctgtccctgtgatgggtccaagcggcggcggccatcgccgggatgctccgcgttatggccggcgtgcgtggcctcgtcgccgccgacgacccctttggcgtggagctaacggacgtgttgactgacgacaccgacgccgacgacaatgcgcttgtgttgtccctgtgatgggtccgagcggcggcggccatcgctgggatgctccgcgctgtggccggcgtgcgtgggctcgtcgccgccgccgacccctttggcgtggagctaatgcacgtgttgattaacgacactgacatcgatgacaatgtccggcgaccggagaacacggtgcccggcgcgtgggcgacggtggagagttgtgacatcacggagctgctcctcgccagcctcaacgccggtgtcccgttctcctgccgtgtcaatggcagctgcttcgcaattgcaagggagaggatcaaacaacaatttgcatatagagatggagagatcacaaaaaaaaaggaggggacattttgatcgggagggagagagcacatgcatatactcgtgaattccctttcgcatatggcgctgagctaactctttccagccggctcggcggcacgatagcgtggcggtgctcgtcgccagcgaccagagttgtggagattatggtaccccatacccacacggcatggttatccgactagttataggggataacttatatctatggaatatggaacagatcatgacttgggtattacgtttccctgtatattatggaacggcctaaagtcctggtttgataagattgcaaagtagatttaggaaaccgataccgtgttggttaaggtttctatcttgtaatcctgccccccatcctatataaggtgggcaggaggccctctagggggc

SEQ ID NO: 4572 - DNA, 1501 bp, Oryza sativa
atgtcctaattcgaagtaagaactcgtcaaaagtagaaaagtaaaaaagggtggcgatgcgctgagagtgtattgaacgatcgtttttgttctacatgattctaggaatatatttatacccgtagtacaaacttgtccatactagacacgactgaaactttcctaagttataaaacatatgaacaagtcctcgtggtggactcttgccaaaaacatctgaagacataaatatttctaattaatagatacaattgcctgtaatggactttaactacgtatgaaaaaagcgttgaaatcatgattcgagaccaactatatccgattcaaactcaaccgatacaacctgctagccgatgcacactttgtttctggaaagattacatccgctccaaatctgcctcggtgttatctttaactttgagcatatcttaccaaattttgttattaacacaacctcaaataattaattttccccgttgcaacccacgagcactttgctagtggttttaaaagaaacaaaattaaaaataaaccaaaaaaagaaagaaaaaccacttataactgcaaaatgggccgcgctacgatgaggagcccattgggttttatgtaaaagcgaattgcagaagagctagggggttttacgtaggaaaaagtatacttggactccctcaactatggtctgagtatgattcatgaccttcaaccacaaaaccggatatattgactcatccaactatcaaaactcatgcaaactatatccctgggtggttttagaagcggttttggctgatgtggtgcccacgtggcggtgttgacccggtcttcgtcccgcgtgttgtcgacgtgtcgcttatgtggcattagagtaaaaaaaattgtgggaccgacatatcattcacacaaaaagaaaatagtgggacccacggatatgtgggccccacatgtcatcctcacctctcccccctctcgctctcatcttttccactcctctcaccttccaacactagaggcggggcggcagcgatgtcgacggcgcacgggggaggatctcaccggccgtccacgcgcggggaggagccagccggccgtcccacgagctcgccggccatccgtgcgcaaggggaggagctcgcgggcgtccgcgtgcgggggaggagctcgtcgaccgtccgcctgccgtccgcgcgctggggaggagctcgccggcgttcacgcgcgggtgtggactcgcctgccgtccgcgcgccgggggagaagatcgccggcgtccgcgcgcgggggtggaactcgccggccgtccgcgcgcctggggaggagctcgccgatggtggcggtggggacgaggtggtggggagcagcgacggtcggaagcggtggcggtgacggtggggagcggtgaaggcggtcgggagtggcagcggccgtggcggtggggagcagcgcggcgccgttgagacagcttgctgcctcatgtcccgggagctggagctcctgctgtttt

SEQ ID NO: 4573 - DNA, 1501 bp, Oryza sativa
aatattcttcgctcccttcaccagagagatggaatatcatccacaaatgataaaaataacattatcatcgtttcacttatgtttatcatgccattcgcactgcatattagcttaaaaaaatacaaataaaacttcggaatcgctagaattgtgtcaacacaatttctcctccgtcacggtcagtgttcgatttcgttgtcccgtgccagtgtgatcctgttcgtgcatattgccgtggcaactgacgttgcggctgtgataacatgattaattaaatggaattgctaaacatcagtcgacaaaaaacatacctctaaatcttgcaaattttggttcactagatgtgcttcgcgattcgtgctctagctgcttcttctccaactccgacgaactcttccttttcttcttcgacgccggcgacaacccaaactctggcgaaggccgacgaattagggttctggggtggggaggggagggggaagaagggggagttcgccgagcttagagggatggtcgtgggaggcggcggcctggtggtgggcggcggaacgggcggccggcgaggcatcggtggcgccggagctgcggggatggaggaggccggtgggccggtgttggtggcgggggcatagcgagtttgtgtcttgtggtggccgacggtgccagatctggcggcgaggagtcaccggagacgaggaagatgacgaggcgaggggggagggggaggaggccggccagccggcgaggccgggcggcggtacgctggggcggcggcggaggcggcgcgcgctcgcgctagggagagcggcggcgtgaccgcgtgaggaggaaacgggagaggaggcggtgctttagggattggttggttgcacgaatcttaaagcaatcagatggtctaaaatttacaagatttctatgggggttttctgtcaaatgatctctagacagccccttaattaaaacttagcatcttcattgtttcaaacttatgatggttttacacgcatgcattctattctttatacaaatttacgctgtagttacaccctacttctatcccacttacacaccacttacacatgtaattttgagacttacatacacactacttacacatgtaattactatgtaattttgagacttacatacataattttgaatcttacattataaatacactaaatttacatatgtaatttaggtacttacaatgtaaatatatgctgactatttttttaaaaaaaatatgacgtcatgaatatgctactcccataaaactttatataaacgtcgttagctatttaaaatacatattgtaaaataaaatatgaaaaaatactataaaataaactttaaattttgagttttaaaatttaaaatttacagaatgttataagcacgagcatagctgaaacgataaggcactttacagcttagcggctggactgactgacagctatcccaaaccggcaaaaatccccacgtgggccgggctaactcc

SEQ ID NO: 4574 - DNA, 1281 bp, Oryza sativa
ccgccgtcgccggccggctcgccgccggccaagcccggttcgcgttgtacgggatcgcctggtacattttctttttccctttttttttctcttctctgcgtgcgaaatgcaaattgtgctgggcagagcgcaccgagagccaccgcgatatatataggccggtgacgtcacggcggggggtcgtgacgccagccggccggtcggtttcggtgggtcccacgcgcaaaggctggagaggacggcgacccggttcgcgcccaaccgcggcgggtcgggcgtgacgtggcggggcgtcagccgcggtttgggggagggggctgcggggcccacccgacgcgcgcgcgcgcgcccgccgaatccatgacgtggagggtgacgtgcggatggggtctcgtgtggggccctggtgcccacatggacggccgggattaatcgccacgaggacgtcgtggtagatttgatttgaacgtcgtggtagcactgagccgacctgacaatgatatagaagtaagtaatctgcttaagtcttaaaaaaaaaagatatgatctgcttctgctgctaaagtataccaacagtgtcaatttggtgtagtaagcacggcaacattggattatgacactaattaattatcaactgttgatcatcctcacacgttcaaacagctcctgttccaacttccaagccgtgcaagtgcaactagtatagggggtgtttagatgggactaaaactttttagcctatgtcacatcggatgtttggacgctaatttagagtattaaacatagactaataaaaaaaattaatttcataaatgagagctaatccgcgagacgatttttttaagcctaattaatccataattatcaaaagtttactgtagcatcacattgtcaaaatcatggcgtaattagactcaaaagattcgtctcgcgaattagtccaagcttatggaatgagttttgtaattagtatatgtttaatactccaaattagtgtccaaacatccgatatgacaagaattagaaataagtccctgaaaaccaaacaggcccattgtaccatgtcacttcatcggttgccatggccaagttggggaaagaatccaatcatcaattgatcagctctgcatcatcatcagcaccgggtgttcgccgcagcagcaggtatgggatcggatgcggacgtcgatcgatccgcccaaggtttcgattgcaatacggcgtcggcagatcgatgcgctcgttcgagacgatgacgtgatttgattggacttggacatc

SEQ ID NO: 4575 - DNA, 704 bp, Oryza sativa
ccgccgtcgccggccggctcgccgccggccaagcccggttcgcgttgtacgggatcgcctggtacattttctttttccctttttttttctcttctctgcgtgcgaaatgcaaattgtgctgggcagagcgcaccgagagccaccgcgatatatataggccggtgacgtcacggcggggggtcgtgacgccagccggccggtcggtttcggtgggtcccacgcgcaaaggctggagaggacggcgacccggttcgcgcccaaccgcggcgggtcgggcgtgacgtggcggggcgtcagccgcggtttgggggagggggctgcggggcccacccgacgcgcgcgcgcgcgcccgccgaatccatgacgtggagggtgacgtgcggatggggtctcgtgtggggccctggtgcccacatggacggccgggattaatcgccacgaggacgtcgtggtagatttgatttgaacgtcgtggtagcactgagccgacctgacaatgatatagaagtaagtaatctgcttaagtcttaaaaaaaaaagatatgatctgcttctgctgctaaagtataccaacagtgtcaatttggtgtagtaagcacggcaacattggattatgacactaattaattatcaactgttgatcatcctcacacgttcaaacagctcctgttccaacttccaagccgtgcaagtgcaactagtat

SEQ ID NO: 4576 - DNA, 1501 bp, Oryza sativa
attaatccagaaaacaaatgaaaacccagcggccgatcgactgaatggatcaaattaaccatttacagatcgattaagcctctatctagatcccactactaatttgtgagacgaatcttttaaacctaattgctccatgatttgataatttggtgctataaacatttgctagtaacggattaactagacttaataaattcgtctcatggtttactgacggattctataattatatttttgttagtgtccgaacacctcgtacgacattctatataataaccgatgttacatgtcaaaatttaaacacctctaatagatcgaattggatgagatagtactgtagctgcaagaggagatgtccaagtccaatcaaatcacgtcatcgtctcgaacgagcgcatcgatctgccgacgccgtattgcaatcgaaaccttgggcggatcgatcgacgtccgcatccgatcccatacctgctgctgcggcgaacacccggtgctgatgatgatgcagagctgatcaattgatgattggattctttccccaacttggccatggcaaccgatgaagtgacatggtacaatgggcctgtttggttttcagggacttatttctaattcttgtcatatcggatgtttggacactaatttggagtattaaacatatactaattacaaaactcattccataagcttggactaattcgcgagacgaatcttttgagtctaattacgccatgattttgacaatgtgatgctacagtaaacttttgataattatggattaattaggcttaaaaaaatcgtctcgcggattagctctcatttatgaaattaattttttttattagtctatgtttaatactctaaattagcgtccaaacatccgatgtgacataggctaaaaagttttagtcccatctaaacaccccctatactagttgcacttgcacggcttggaagttggaacaggagctgtttgaacgtgtgaggatgatcaacagttgataattaattagtgtcataatccaatgttgccgtgcttactacaccaaattgacactgttggtatactttagcagcagaagcagatcatatcttttttttttaagacttaagcagattacttacttctatatcattgtcaggtcggctcagtgctaccacgacgttcaaatcaaatctaccacgacgtcctcgtggcgattaatcccggccgtccatgtgggcaccagggccccacacgagaccccatccgcacgtcaccctccacgtcatggattcggcgggcgcgcgcgcgcgcgtcgggtgggccccgcagccccctcccccaaaccgcggctgacgccccgccacgtcacgcccgacccgccgcggttgggcgcgaaccgggtcgccgtcctctccagcctttgcgcgtgggacccaccgaaaccgaccggccggctggcgtcacgaccccccgccgtgacgtcaccggcctatatatatcgcggtggctctc

SEQ ID NO: 4577 - DNA, 1501 bp, Oryza sativa
ccatcaaccgatccacacgtacctcgtcctattaattagacgatcaagacgcatacatatacttgttgaccgcgtttgattggcgccccaagatatcacatccgggtaactgtttactcggaaattaaaactagatgttttgccgtgtgtggctcgtgcttgattcgttagtactagctagcttgcaaacattgcattgcatgatgctatactgtttctctaatagggcgatcgcaaattcacatgttgtgcacgtatatttctctatcgatccaacggcacgacatcgatgtaaatatttcctttggtttttaatagatggtccaatttacttttatacatttaattagccatttatcctattaaaaaataaagtaataattatttactttgttgtgttttatcactagaggtattctaagcatggcctatattttttatatttaccaaaaaaaaatgaatggtcacaatatggttgccatcgagtcagattctaactcatatttttgttcaagttcagaaccaaatacggttagtaccggataacatgatactcacccctcctatattttttcctccgtattgaatttgagaacagacatctacatgtatctctaattaataaatattacattaggaagataattagagtattaaaaacataaatcatggagaaatatacaatattacttgtgagctcgtaaaatagtgctaacgaatcttttatcatgtttatagatgcatttataatatatttcatatatatttgataatatgagagatacggacggatacaactctctatatcctcggatagaaggatattcttatttttctctcccatatccttcccgcgagaatcgggtctaatggatgaaaatacccattccattttgccccaagttcaaatataggaagtaatttaaaaaggatatggtacaatttagctgtagcaggtgtgacaaaattgccggcacagcaatttggtgccaccgacgacgcttctgatccaccttggcgtattcaacagtgatatatatatatatatatatatatatatacttatatatactagctagggcactcaactgctcaagaaaagaaaaggagggagagttgccttatatatttatagagcagataaccgctcaaggtatattggtatattgtagtagtggacaaagatataatcaatattaattaacaacttggtcacaattaatatattccatttccaaaatatggtgataaagtacaatatacttttactccctttgttccataattcttgacgttttgaataataatacgttctccaaaatgttaggaaacgatagacaaacaaacgataaaaaacaatagatcaatcacagaagacacgggatttaatgtggaaaaccctcccaaagtaggagagaaaaaccacggtcgtgagccagcaaaatatattcgctatatcgagatgaggttacaacaccgcatggcggcttacaagaggtgt

SEQ ID NO: 4578 - DNA, 1154 bp, Oryza sativa
cataggtttctgtgtttcacatgtttgtttgtttcaagcaagtccacgagggctgtgagtcggatgcttaggatactattagtaatgcttagggtggtatttaccttgatgggtctcacttgacttttgatgacaaatggtgacgcagaaaatctgtttttctttcgtcacccacattcgttgtcaatgtgtagatgaatgcactcgtcaagtaggattagtagtaatccctccagtttcataattcccgacgttttggataaagttaatatcaaacttttataactttgattataaatatcttttaaaatatttagtttaaaggcactaaaacaacatatatagatttgtcttacaaaatactataataaaagtaaaattgtttttatttattgtgtacattgtaattgaaaaacatagtcaaagatatccaaattcatctgcatttaataaaggctagattctgccgaagcgaagtggaggccctgccagaggctgggcaggatcgtaataccttttagggtttcacctcaatatatatatatatatatatatatatatatatatatatatatatatatatatatatatatatatatatatatatacacatatacacctcttgtaagccgccatgcggtgttgtaacctcatctcgatatagcgaatatattttgctggctcacgaccgtggtttttctctcctactttgggagggttttccacattaaatcccgtgtcttctgtgattgatctattgttttttatcgtttgtttgtctatcgtttcctaacattttggagaacgtattattattcaaaacgtcaagaattatggaacaaagggagtaaaagtatattgtactttatcaccatattttggaaatggaatatattaattgtgaccaagttgttaattaatattgattatatctttgtccactactacaatataccaatataccttgagcggttatctgctctataaatatataaggcaactctccctccttttcttttcttgagcagttgagtgccctagctagtatatataagtatatatatatatatatatatatatatatcactgttgaatacgccaaggtggatcagaagcgtcgtcggtggcaccaaattgctgtgccggcaattttg

SEQ ID NO: 4579 - DNA, 1501 bp, Oryza sativa
agcgcgaggaggtccgtgatgggcccgtacagcgcccgcgcgcggcgcagcgcccggcggagggagaggcagagcagcgacgcgtggtgcgtgctgcggaggtagtccgcggcgaggcgggtcagctccgtgtccggcgcgtcccccagcgcgcgctccaccaccgcgtcctccggctggagcacgccggcgagggtgcacctgtcctcgtcctcctcatcttcctccccaccaccaccaccactgacgccgccctcccgctgcccatccccgccgtccacatggatcttcgcccagatctcgtggtaggagctggtgtggatggcgagcgtgtactcctggctcaggttgatggtcgccgtcgacagggagcttctcccccacccctcccccgccgccgcagccgccccattccgcctcgccccgctgctaccactcgcggcggtgctcgagctcgtgctcgcgttcgcgctactggctgtggtgttcgtgttcgtgtccgtgtcctcgcggcccaccgactcgcctccctccgcgcccacgccacgccgctcccacggccgcatcgaatcgatagatcggccgcgatcgccgcgccgcgcaagcaatcgagccacagcgacacaagcaagcgcaggggcaagctactactagtagtataggggtagtgtggtgtgctgtgtaaggcagcaacgggcgcgaggcgaggcgcttttgggttttttgaccagtcgaggcgtggacgacgggtcgggtccatttccgggaagcgaatccgacggcgcgcgcgttcgcttccggtggcatcctacggcgggcagtgtacacttgcctccgcgccgcgccgagccgtcggtcgcggtgcgcgtgatagctctactctcgcggtcgctgtgggcgcggggcgggttggcgaagcggagacggcacgcgcggagtccgtacggccgcagcgaggcgacgtggtggcgtcgagtcggcggcgatgataagggttgtgtctccgccgcctccgtccaccgtgcagctgcgcggcggcggcggcaccccggggccctcctcctcctccgcggtctgccgtttctggggttcccgaagaggaagtagagttgcggcgacgagtagttggggttgggggaagagtaggaggaggaggcgcgccgccatctcatgctgctctgctgaggaaggggaggggccccgggtcgccacgccgtcggctcccccggcgccgtccgagggatcgatacagctctactcgcagatcgagaggtaggcgatggctaattccgtgcctgcgaaatctctctcctagattgataacatcttttgttgttgcggccggcgaacagggtgatcacggaggcggcgaagcagtcccgggagggctggggttcgaccggagattggaccgagatcgaggtgcgcttcggtgattgcgacctcaattgagagtgcaaaattttcctgctactgttgttgatgcagagtgattttactt

SEQ ID NO: 4580 - DNA, 1501 bp, Oryza sativa
taaacgttacaagaaaaactcaaaatcccttttattatgggacggagggagtactaaagcttgttaagttcctcaaaccagaattactctgaaattcagaccaactccctcatgagccgccggtacacctgcaaaatttgacttcaaaacccctcaattcccttatgtgccgccgaaacaccagcaaaatttgacttcaaaaccaccaatataagtgatccaactgatatcaaccttcaacattcaaatttgacttcaaaaccactgatataagtgatccaactgagatcaaccttcttccaacattctcaggcgactgacaaagctggtcaagtaaccaccgaaaatagacacaccctctttttttagaaagaatccgttgctggacgctagcaatggcagcaggactctccatccaatccaattcataaacaaaataaaaaaaaatctagtaaaagaagttgtcaacggcagtctctcctccatccccctctccgatctctctgcccagatcacgactcgctcgcgatgcaagtccgcaaacggttgccggatcaagcatggactctctctctctctccacgaaaccgtcagacccgatcgcctcctctgaccttagacttgcttagacgccgcgcgcatgcagccaagctgcgagctgcgatgctgcgagcttcatccattcccatccatggcgctcgcgtcgcttgtggtgtccacgcatcctcagcttaaccccccctctctctctggtcaatggtcaccaacactgcctagaatgatggactcagctccaatctcatcccgccacgtgtcccccgtctcgtcgttatatatatacacactacgccctcgccttggcctggtcgtctactctccctcccaccgctcgtctgtcaccgccgcgcgcgacgcgacggcgaggtgtgtgtgtgagaatggagtcctacgtgggtgtcaaggggaagaatgtcgtcgggggcggcgacgtcggcagggagatgccggtggcgccaccgtcgtcgtcgtcggcggcggtagggatggtggagttcccggcggcggcggcggggctggggtacgccgggatgacggcgaaggaggccgggggtggttaccaggagaggagggtggtggtcggcgagatggacttcttcaagacggcggagaagcgtggggagaggaaggagccgccgccggcgacggcgacggcggcggcgagtggacacgccggtgcctcgccggatgacctcagcctcaacaaggacgacctcaccatcaatgtaacggatcagttgatgcgtgatggtttgagagatttttttttcttggttgatgcgtggtttaatttcgtgatcttgttgcgtcgcagatgggattgctcgtcggccggaggaggaacagcggcagcgaggaatccatcgtcgacgatggcggcgtctcctccaacgacgaggagcaccgcgaggccaaagctgcggtgagcaaacagcagcaaaat

SEQ ID NO: 4581 - DNA, 1501 bp, Oryza sativa
tgaaattgaggtgtccattttcggcccgcggcccaataggattgtcagaattcagcccattttcctccgactaactccataaggtggtgggctagacgatctgggtttgaaacctcacccattctaattatttgatattagatccttctctaatattggcctttttttaagaggatttttagggtacattgtactgcaagtatatactagcagtatatatgatttaacggtgtagattcatctaatcttccgcccaatgagcctgcagtataaattgaatagggtatattagtttttttcatcttttgcgtggaggaatatttttgtattttcgcatttctttacttcttcgtcagatcccgctcgagcgaattccagttggagagttagagccgttccctttcctttgtcgcatgtttgaccgccgccgccgacaaccaccggaagcacgccgcgccccgcgccgccgcccccgggaatcgattctatttacgtcctcttttcatcctcttctatcattcccactcatccaaaaccttccttaactcctctattgacggctcgggtgtgcggagacggcattcaggcggagctgcatatgggtgccggctgctgggggcccaggccaaggggcgcagctgcggcagtttgcaccggcaaggctacacacaaggactgaacattaatgatgaacaggttcgaaaagggtacatatagagggcttcagatgttcaagatggctacgcaaaaaaatattttgatcctgttttggataagaatctgatactttcagtagtagcatgtaacattgaacgctcgacctcagtctttgtctctccctcaggaggcagaccgcatggaagtaacattttctgcaacaccagcagtccaaggaagcctacagaatcggcgacggccgggcatggagggcagaagatggggaggcagccggctatagcagcgcgccgcctcgccgcgagagggcacggaggctgatgctgggttccagccgccacgagagtagtgtacaaacacttcaccgccacgggttggggagtacaggagcagtgagactggaggtgggaagcggggggaggcagccagctcgtagcggtttgggaaaggctggagctgtgaggacggatgcggaggagaaagccacgcggggaggaatcgcgcagtcgtcaaacgaggagcctacaagcgcgtcgtcgtcagaacatgccccgaccgctcatgcgagatccaggcctccagggtactgtcgatggacggtattataaatctcaacttcaaatgactaataagcactttttaggtttttgacaaattcctattatacccataaatatactgctagtatatacttgcagtataatgtaccgtaaaagtcctcttttttttaagtgtcaccctgaagtctgaattctgtctgcgtagctgttagctctgaattctgatcagaaaagttcagtatatcttgcgcccacatgtattggta

SEQ ID NO: 4582 - DNA, 1501 bp, Oryza sativa
agtgataaaacaacatattacaccgctaactgaacaagcacaaatttaatcttacataaagaatacttcatagcccagaagataaatgaagggtgtgtttagtttacgctaaaattggaagtttggttgaaattggaacgatgtgacggaaaagttggaagtttatgtgtgtaggaaagttttgatgtgatggaaaagttggaagtttgaagaaaaagtttggaactaaacaaggccgaaatatgcacttataatctcgtaccaatgagaaggtggatcacagatcccaaagaatgcccaacaccaaatgtgggaaggtcatttacctggaaaaaaaatgtttgcttagtatattggacaatattggagttaattgttatgtgaaaaataacaacttacaggttcaaccatgtttcttaagcacctgtcaaacttaaattgaacttcatctgcgatgaagaaatgatcaaagccgctagcatatggcgttgcgatcaccaaagctcccctaaatttcaaatagactgataaaatacatgtctgctagagaagtggaatatgtagaaagatagctctataggaaatcataatagcagtgtaaaccgtgtagagctagagctaagaagtactgtatcattttcttgaaatgaagatgcagttcattgcttgtaatattatcaaaggacaaactttaaaaatgattgttgtttcactaactttttgatagattgaacatgcgtgtcttgcttagaaccacataaagaggtgccttgcagttaataatgacaaattacacaccaaagctcttattctctagattcatggtcaagcaatgatgcactagttaaacacacaacaaagggagggctaaattttcaaaggttgcatttcgggtatagaactatagtcaactctccagcgttacgaacaaatcaaatgccgcgctgtttcagtctttgagcagaattagactgttgcacacagataattttgggtcattgggcattgcttgtccacatacttgtctgcaagtcgttcaaggaagaaacgataagtgatctgaggagcagctccaacaaaaatcccaccaacgaagtgaacaacgaacgagggctcctgtgatttaggcttcagcacccacgctccctatcagaacaaccagtagtaagtaaaatcactctgcatcaacaacagtagcaggaaaattttgcactctcaattgaggtcgcaatcaccgaagcgcacctcgatctcggtccaatctccggtcgaaccccagccctcccgggactgcttcgccgcctccgtgatcaccctgttcgccggccgcaacaacaaaagatgttatcaatctaggagagagatttcgcaggcacggaattagccatcgcctacctctcgatctgcgagtagagctgtatcgatccctcggacggcgccgggggagccgacggcgtggcgacccggggcccctccccttcctcagcagagcagcatgaga

SEQ ID NO: 4583 - DNA, 1501 bp, Oryza sativa
tagccaagagatccagtatcatgtttttagttctttctcttttgcaatcatatgttttctcttggtttgtaatcaaacatctcttttgaagtttttatgttagaattgaggattttttgtgtaactcctattcctatgttgtgagtttttcatgattagggtctatttatatacaccaatgctagacaatcttaagctaggggtgtaacaaaaggtacacgtagcacttggggatgaggttcactggctggctgaaggctaaggagatggggggaacaaacaaggtacatcggcggctgacggtgttaacatagtggacgacggcactgatggcaggaagtagtaactcgagcgaaattcaacagaggagtagaaggatactgagggaaattcagccgctcgcttaatttgaatttgaatccaaaacgacctacaatctgtaaaattacttatatacgctaatgtgaatcaatctcaagttggggtgcaataaagggtacgcgtagcaattggcggtgcagggcaacccccggtggcctagtccttatcatagacacgtgtctcgtgacgtggctccagcctttgccgcctcccctttctctcgcctccctccctccctcctctctccgcgcccttctctctctcccctctctcgctgctcattggagatcaatctgctttcacgtctcctctctctctccgcgtgcttcctccgagggtctcctcctccaccgccgtctcgcttcccggcacgcgcgcgcgggcggcggcgagctccctctccttcgccactcctccaacccctgtgcggctactccggtgcggagccggcgagcgagcatgttctaagtggctctcttccttaaatctctctacaagaggcaattgaattgaaggtatttgttctcttcctagccgctgctttcatgagcgataggagatccatgctagcaagttggattgatttgttcactccgtccaaattattagtccgtgtcctcctctttgttccggatttcgatgatgcgttggtggtggagttctaattgcagtttgtatcgattgggtgtgtgactgaatatctagttactgaagcagtttcatgttgatgtatgcgtttgccctgtcctgttcctggaaccaggattaataataaacatatgaaaagttatttgacctcgaaaaaaaaattgtgctctccaatgtaggagaccgacgaaacttttgtttttaatagctgcttttagttctaaaaatcataattcgacttgtatgataggaatttgcatcttatgaaaagattgagaattgtttttacacaagttgatagctttatatcgatactgttgggcagtgtgccaaaacgtccttttggtgaaatcaaacatttctcacatttcaggctcacgcaaatttttatttatttttagttgcttaactgcacaccattataacctgaatttctacttgataagcagacagcaggctttcataaaaggca

SEQ ID NO: 4584 - DNA, 1501 bp, Oryza sativa
atcgacagtaccctggaggcctggatctcgcatgagcggtcggggcatgttctgacgacgacgcgcttgtaggctcctcgtttgacgactgcgcgattcctccccgcgtggctttctcctccgcatccgtcctcacagctccagcctttcccaaaccgctacgagctggctgcctccccccgcttcccacctccagtctcactgctcctgtactccccaacccgtggcggtgaagtgtttgtacactactctcgtggcggctggaacccagcatcagcctccgtgccctctcgcggcgaggcggcgcgctgctatagccggctgcctccccatcttctgccctccatgcccggccgtcgccgattctgtaggcttccttggactgctggtgttgcagaaaatgttacttccatgcggtctgcctcctgagggagagacaaagactgaggtcgagcgttcaatgttacatgctactactgaaagtatcagattcttatccaaaacaggatcaaaatatttttttgcgtagccatcttgaacatctgaagccctctatatgtacccttttcgaacctgttcatcattaatgttcagtccttgtgtgtagccttgccggtgcaaactgccgcagctgcgccccttggcctgggcccccagcagccggcacccatatgcagctccgcctgaatgccgtctccgcacacccgagccgtcaatagaggagttaaggaaggttttggatgagtgggaatgatagaagaggatgaaaagaggacgtaaatagaatcgattcccgggggcggcggcgcggggcgcggcgtgcttccggtggttgtcggcggcggcggtcaaacatgcgacaaaggaaagggaacggctctaactctccaactggaattcgctcgagcgggatctgacgaagaagtaaagaaatgcgaaaatacaaaaatattcctccacgcaaaagatgaaaaaaactaatataccctattcaatttatactgcaggctcattgggcggaagattagatgaatctacaccgttaaatcatatatactgctagtatatacttgcagtacaatgtaccctaaaaatcctcttaaaaaaaggccaatattagagaaggatctaatatcaaataattagaatgggtgaggtttcaaacccagatcgtctagcccaccaccttatggagttagtcggaggaaaatgggctgaattctgacaatcctattgggccgcgggccgaaaatggacacctcaatttcatcgctcttaggcccatatgcttcgtgccgatagttcgagtcgtgggcgctcgtggcagccggcggcagcgaagcatctgtcgcgggagacacgtgcctcctccagaactacacgtgtgcaactgcatgggcgagtcagcgcaccataagaacagctcgctcgcactcgagtctctctctcgttcatccatccagcggcacacacaccaagctagcttctagtagttgagcaa

SEQ ID NO: 4585 - DNA, 1501 bp, Oryza sativa
acggtcacggtgggccgtgcccacggcttcaataacagcagcagctcacctcgccgtccagttcgtcactcacacgcggagacaaaaacaccttcacaattcgcgaaagctcagctgcttctgcttcttcttcttctttcggattcgagaagaggatgtccatctcgctgcgcctcgcggtcccgacggcggcgccgcccgtgctgccgccgctgcggcagtctgcggtgcgggcggcgggctcccccgccgccgccgctctgcggacgggcgcgctcaggtgaggcggctatctgtccgggttaatgcggtggatttgttcgtactgacggtgttgtggtgatggatgatgtgcaggggatgcgcctcgctgccgctgaagccgcagccgctgctgggggcgggacaggcggcgagcggtcgccggggtggcgccgccgtgtgccactcgtcggcgcacctgagcgcgcggacgatgcaatgggtctccgccggggccaccgcgtgagtgcctctgtttctcatactttcgtctaatggtagtggaatagtggataatgcgatgcgattcatccgctgtacagcatggcgattttggggtttggcatctgttcgatcttttgcccgtgagaactgtgaatgattgtgcaagtgttagttcatgtgcttctagctgtcactcgatagggacatgcgcaaacctatcttgattttgttgtctgaccgtgacgatgttgattgttgaaccttgaggaaggacagggcacaaacagagacataatcttgaaatggactatcaaattaacacgtataatctcccatgtaaaaaataagctaaaagaatatagcctcccaaattatgtatatatgtatgcaacttgaggattgataaccattttaaaatcaagttagcacaaatacaatctcattataattgtctactgtttaattttatcatttaatacttgggattgcgtgataactgcactgtaaattcccagtacgctctgattattatttgatcatttaccccctttttgtcttttccagagtgctattgcttgctaaaggcacagccatacacaaatctttccttgtgccactgtttgctctgctagcaccttgcagtgtaatctcatggatcaagtaaggcatcgctattccgtgcaaataattgtttaatacctattatgttccttcattaacaacatctagtaaatgcttgttcggtttaaaacaaggtactctcttgagtcctacttaattctttgatcaacaaatgtaggagtgactatggtcagtggactgcttttcttgctcttttggtgcgtttgttcttctccattccaggtagagtaacaataaaaagttcaatattgtaaggctattcatcattaacattttcctgctgaaaacaacttcagttgaagtgccctcattcagcctgaattcagatgtttatgctttgtcataggtgagctggagcttccattgtcaacta

SEQ ID NO: 4586 - DNA, 1501 bp, Oryza sativa
gcgagcatgtgctagctagtgagaaaccctagcgcatcgagttcacacgtccttgaccgaaaccaaaagaggagccaaaatgcacacatcttgaccaaaccaaagaggaaataaattaaaacgtgaagaaaattaaacatgctcaaatctggatacagtcattcaggaaacagacggaagaaaaatcaacatgaacacaaagagaaaacctgttcctgattattaatctttttttgtcacattaatgtcaccaatagcaccagtcagaacagaaaatcaaagacttcgccaaatcaacctttctaaagctagcaaaatgaatttcaagatacagttcaagatgggatgaatttcaagatccagttcaagatgggatgggatgagatgagatgagatgaaagaactcaccctttcttgttcttgtcttctccatcgccatcccccttggtcgtcgacgatccttccttgccgtcgtcgtcgccgccgtccccctcctcctccttcttgcacttcccggccgactcctcgtcccctccggcgccgccgccgacgccgcacgcctcgctcgacgtcgacgacaccgacatgctgttcggagtcatcggccccgccaccgccgccgccgccgcagcagcagaagcaccacccccagggaacaacccgacgccgtccaccaccagctccctcttcacctcctccagaggcgccacgtcgtcgtcgaactccccggcgaatgcctcgtagtccagcggcggcgtcgtcggcgcgctctcctgcatcaggtggtggtggtagtcgatgaacgaccacggctgctgctgctgcagcatccccggcatggcgccgttcggcggccgctcagcgaacagcgacgccagctcgtcgtggaacgggaagccctcgccgccgccgccgccgcccgacatggagctaattaagcaaactagctagctagctagctcagatcgagctaagctttgctccaaattaaactgatcgaaatcaatcgtgcaagcaagcaagcaagctagccctcttctccttggcgtttgctcacatatagatcgtacttgctagctagctagctagctactggctagtggtgtggtgatgcagtgaagagaaggagatgagaggtagacgacgagagagagatagagaggggaagaagaaagggagaggtgtgtatttgtgtgtaagcgagctagcacaagctgaagctagctagtgtgatcatgtgtggggatagctaggtggttgggtgagaggccaagggcttagttgaaaattcctagttaatcacgggctttgtcgcataattgaaattaacaaaaattaattgatttgatttgctcttgtcatgtgtactatacgccactgtactttgcatgcgcaacactagtttttctacccttagatcgagttagtattcggtcgcaggttttaccttctagtaacatcttgttgtttgctttaccaattctcaatgcttcatgcattt

SEQ ID NO: 4587 - DNA, 1501 bp, Oryza sativa
aaaactactcaacactatttcgtacacgcggataactgctatcactaaatatctaagtatcttattctcttttttttctcttccccttccatctttcctcctctgtgtgactaccaacctcaagagcatagagacgacaatagcggctaactgcgcggggtggcgcgttgagcatagaggacgctcggcccgctcttcttcgctggcgccgcgcggagctactcccgctggctcaggaacgcacagcgcggtgccaaatcaacgtgcgagctctcgcgccaccgctcccctccgtccatccgcctccccatgccggcggtgctgctccgccactcgcatccatttcttcaattcctgcactccattccactctggctgattcctccatcccctcccccagctggcaatgcttcaccgccgcttgcatcccttcctcatgtgtgttttctctttttgattgatgattttctttgctgatttttttttctgacttatatggatagtatcgattcccctgtcccatccttgtgaatctctccaattccataggtaccaggtactacacaccatgcaactagtgccatactggtatcaggtatcagatactaggtatcaggtactagttactaggtatcaggtactagatactagttactagatatcaggtactaggtaccaggtactaggtatcaggtatcaggtatcatgtaccagcctatattgtgctgctccgactgcagaggagcggtgccagcgatgaggtatcgcacgcgcgataccgaggaggaatcggataggtatcgcgcctatggtatgtggtatcaggtactaggagggagcacatgttcaccacgtgaaatcttacctatacagaagaaaggaaaggagttaaaggaatcagataggtatcgcgattatggtacgtggtaccaggtaccggaagggagcacatattcaccatgtggaatctcacctataaaaaaaaagtaagggatgaatcacttaaagtatcctgtagcaacaagatcccgtatagctaccctcttaaaaaaaatggcacacgccgctagcgacgacgtggggcggccagttttggctaaatctaaatctaaacagctcctgcattccgtcaactactaagcaaaatcatatactcgcacagtcagcctccaccacaaggtccaagccggcgccgatgcgccgtgtcatcttccgctgggaatctgtctgttggagatgccgaaccacacaatttgccgtagttgtgtaaactagctgatcagtagccggctctactactataaaagagatcaagtctcaggccaaactaacttactcagagagtcgcagatcgagagagctaacgatttctcatctcgcggtggccatggcgggtagcagctacggcgacgttcatgagtctgcaagaaagtgagatcacaacggtttaattttttttcccgcgtgttgtgtgcgatgcatgagcttgtcggtgatctta

SEQ ID NO: 4588 - DNA, 1501 bp, Oryza sativa
acctaagctgcaaaccattttagatcattaatcttcaatcgaagaaaacaacccaagacaatgaaacagtagaaacctagacataatttgtaatacaccgaccaatcacataactacatatctagcctaagggtctcttccatccactgatgataaaaaatgatttggccggttgaaggaaccacccatgtaacccacaaaacaagctccgcccatctaatccaaccatggcgggctccccactgcaagaagcagcactcagcagcaaccgtgagcagcagtcaccgtagattcaatttcctccaatggaaaatcgcatcaatttgttcaatatttacacccgaacgtaaatctacaggaaatttacagcagcagtagcagcaaagcagcctcgatctgctacggttttcatcagctacggtctatttgcatctctcataccgaaatcaaccaggcacagatcgttcacaccgaaccccgaaaaaaaaatcaaaacctaccgcaacaacatacatagatcgacaaacgagaagaggggagggaacctagggtttgggcgacgaacacgaacctcgagagcggacgaaccggaccttctccttcccgttctgaatccccgctttgctcctgcgaggaagaacaaaaaaaaaaaatcgggcctcgattttcgaaggcgaggaggagggcgagggatttggaagaggaggagaggattgcgagagagatgagacgcaccttgcttcggttgaggcggcgcgacgccgagttggggaaggatcgggagagtccgggctggaggtggagaggaaacctatatgagcacggcctggagggccttgatgccgtcagatttggaaccgacggctaggatgggatgagcgaggtgcgtcggtacgcgtgggccgtttcggtgtggaaggcggagtcccagcccaactgcacggcctgtataccgccacacaaagttgggcctccatttggcccacctaaaaatggatttgcccaccggcctccctcctcccttgcttctgatcgaataacctccctcgaccgtaaaaccaggtataaggcctcccctatcttagagcctatttggcacttcttctgaagctagagctcaaccaaacagttttagctccacccaaaatagaggaataattaactatttacccctcttatgagtgatgataaagatttgccacagaacctacatgttataggcacatgaggacccacatgtaatagacaacaagtggcaaatctttagatgccacatcttaaaagtgacaaatagttaaatgtccctaaaataggagcagaactaagtggaactctctcacaaaatgaactagagatgtgaagtggagtttaggcagttccacaactccattctagacccagctcctagagctaaatggaagagcaggagcggatctatagtataatggcaggtgtcaggcgatactaacgacttttggcaaaacctatagctaaatagctt

SEQ ID NO: 4589 - DNA, 1501 bp, Oryza sativa
ggggctgccatgcctgcgccttcctccatcatcatacctgtcatacctgctgcccccacccctgcgtccaccaccaccaccaccacggtaactatcaccgccgcggtaaccgtcaccaccaccgccaccgccgccgccacggtaaccatcaccaccaccacgataaccatcacgttcacggcggaaatcatcacggtcacgattgcccctcctgtggcgtgggcttgggctgcggcttctcccatggctcctcctggatcgccccccataaagcttcctcctgagctccctgccaatctgctttacatgcataaaattacagtagcccccacggttgcagctgttctcctcaaactgcctacaggtcgcctcacggaaatcagtcacaggggaatactcaacaattattgggcgccctgagtagaagcgaccttgaagggcattatgcgcagcgactgcctgttcttcctccctgaactggacatacacattgcctatcatgtggtcagcaaggttatcacagacattgagggtctcaacctcaccaaacttgctcagctcctcatagatatcctcatagaaatcctcaaagtgctcctgcatcttttcaggatcaataggttggccttgagcatcgactcctggtgtgatcatatcagggcgctgatacatgttagcaagcacaattgtcggcgacacagttggcctgttgtgcagacgggagcaacgatccccatgacggcaagccccaatcttgaagtaaaaggggcagttaaccctatccttctcagtcccaaatattgaagccaaatgctccgccatgactttcaaaacacttcaactgacacttgagctgtacataacaaaaagattaaaaaaaattgtcagaatttattgtccaaatctcaagaagtgcttctatatatatgtatatgaatggcttatctggtaactacagggagaaagaaatacctcgatttagagtcgtcatagcgcattacatacagaaaaagtagacaacaaagggagcatatgctaaataaaaacaagttcatatgttatcatttttaacttttgagatcaccaacaagtatgattcctgtgactttacccctgaaacgatcagtgtgtgattggaacattataaagctctcgcaagaaaaccctaatcccagtaccttttaacctaatctgcacacttattcaaagccgttaatattagaagaacaaagtgaatagaaagaacaaaaacaaacgactgtaatccacttcaagaaatcatgaagctagatgttgctcatgataagttttaacctatatctggacactgttaacaacatagaggtgtctcttccactagaaagtttagtatttctcccccctgcaactgcaaaaaagatcaaacaacatggcacagaggcacttttttttgcctgttgcacaagggcattccttccggagtaggccttgaaatatccgcccgacaaagaatactatttga

SEQ ID NO: 4590 - DNA, 1501 bp, Oryza sativa
ttgcacttgcccctaaacataaccatgtttcccatatatggaattgtttggccggctaacgttgaaacaaaaccctccctctctcccttaaccattttatcataaaattattcctccatatatttctacaagtgaaatctttcaactgatccgaacattaactatgaacaatttatctcaattaccaccaatataatcaagtactggttatgcattgttaggctactcatttattaacctacatgcaggatattatgttcgaaaaggagcatctacaaaatctccaactgaatgacattgatcattaaatgcagtatttacatgttaaccaggaatggaaggcatacccaaaagaggcttggattttaagtgaatataacatagattgatttaggaagaaatgggcaaaaagagatttgattgggtttattcctaacctagttctcaattactcacctttccagtctctcgaataatgtgcagtagcacatggaacctgactaataaaaacacaacaatcaagagatcactccagaaggcagtacccgattgactgcccaggaccaaagaccccctgtgttgctacagctagctaggcttacggaggcacactaactctgatggtcatgcatcgccaccgcctgaattgcttgaatgctgatcccatccatgtaccgaaccccaggtagactggttactgcctcttactgacaaataggtgctgagtctgctaaccggtgaccacctagcgacgtccagttagtaccttcgtttcctaattcctcatgtccgtattgttttcaaacatctgtaatcccgtatattaagtctccagtataaccaacaatcccaacaatgaacctcaaaggcatcaagtatgatgtcctctagcatggtcggaaacttggtatgcgaacaactgctgctataacatgggctatttatactggagttgcttggtatcagtggaatctcaggatttgatcacattttggtgaactgtacagttgataacaacatactacaacataaaatatgccattctgccataagacttcagcctagtaaaaccccacattggtctagtaatacaaggttagtaaggtttcgttgcaaagggctagttgattagttagatcatctgtcctgcaaaacaagcaacatacttgattacctcgtacttcaaatccaggttaaaaaaagttcaatcagatgagtagcatgaaagggtggaagcaaaactaaaatatgcaacattgagtgttggcaatagcaggagattgacactaaatgaaatccagcttcgggatatatctgttgaaaaatctacatatttgtagaaataaagaacactattaacttagacctaaaagctcgaatatgccaaaagcagacacatctaacacatttgatagacaggtctatctcaagtagaaggttcaggattcttaaggcataagatttacaatatactatgatagcatgatttacaaaaccattt

SEQ ID NO: 4591 - DNA, 1501 bp, Oryza sativa
ttcagacgcgtttcgcttgccgtatgtataaccctgcgaaaacgcccgaaaattacccccaaacgagccaattttttttctgtgatttgacacacgcgattaaggtgccgttggtttctaccgaagatagaggtgaggttaggatagaaaaaaccattagcatataattaaataacttttaatttttacaaaactaaaaaaatgtatttatctattatttaaaattaacttctaaacaaaatgtaccgtttattaatttaaacctttcgctatgtagtcactgcataccggctctgttccatatggagttgtggagacatatttttgttgcaagcaaaacgagaaatctcattagcataatattaattaagtattaactattataaattaaaaatgaatttgtttgctttttaaaaacaatttctatatagaatttttttgtcaaaaacataccatttattgaaaaatgtgctaacggaaaacgaggtagttgaagttttgagtagagaaaaagaactagacctaagttctttttctaagtgcttgcgttggactttttttttcatatttgattgaacttttttctttgcatatagcaaaacttttttaaaaaactccatatagcaaaacttagtgcgataatatttaaatccttctcaacatttctatccgtggaatcaagtatttaattttggtaaaacaacattgatggctcacattttctgattcggttaagcacacgtactagagtgatttttgcaataaatttgagtaagttgatgaacatttgtaacaaaataacttgtgatataatatatcattagtaacaaaataatttatgagatcctcccttcttgtccagattcacccaaaatcccttatattatgagatgaatggagtagtttttgcaatttaacttagggtgagtttgaggagaaggtgattgacgagattgggaagatacgcaaaacgaggtgagacattagctcatgattaattgagtattaattattttaaatttcaaaaatagattaatatgatttttaaaagcaacttttctataggatttttttttaaaacgcaccatttagtagcttagaaagcgtgcgcgcgaaaaacaagatgttatctccctcaaatgttacccgaacgaacgcagcctgtttgaaagaaaacgtggcccaacccaaccgcgtccgcatcaggcaggaggcacacgcacacacaaaaaagaccaaaacgagccgtttttgcccgtgaattttcggcgtgcgcgcgactaacccaacccaaccccaaccaactgcattcccttcccgcacaaacaaagccacccaaaaaagttggggagaggagagaccgagatcgatccgcacccaccgcgacaaacgctctcccctcccctcccctccccctccgcccttcgctcccatccgctccgccccctcgccgcgcagcgccggcggcgagaaggttgagttcgtggggggtgtgaccgaa

SEQ ID NO: 4592 - DNA, 1501 bp, Oryza sativa
ttcctctccacctccagcccggactctcccgatccttccccaactcggcgtcgcgccgcctcaaccgaagcaaggtgcgtctcatctctctcgcaatcctctcctcctcttccaaatccctcgccctcctcctcgccttcgaaaatcgaggcccgattttttttttttgttcttcctcgcaggagcaaagcggggattcagaacgggaaggagaaggtccggttcgtccgctctcgaggttcgtgttcgtcgcccaaaccctaggttccctcccctcttctcgtttgtcgatctatgtatgttgttgcggtaggttttgatttttttttcggggttcggtgtgaacgatctgtgcctggttgatttcggtatgagagatgcaaatagaccgtagctgatgaaaaccgtagcagatcgaggctgctttgctgctactgctgctgtaaatttcctgtagatttacgttcgggtgtaaatattgaacaaattgatgcgattttccattggaggaaattgaatctacggtgactgctgctcacggttgctgctgagtgctgcttcttgcagtggggagcccgccatggttggattagatgggcggagcttgttttgtgggttacatgggtggttccttcaaccggccaaatcattttttatcatcagtggatggaagagacccttaggctagatatgtagttatgtgattggtcggtgtattacaaattatgtctaggtttctactgtttcattgtcttgggttgttttcttcgattgaagattaatgatctaaaatggtttgcagcttaggtttttaaaacggatcaaatagtattctttgtcgggcggatatttcaaggcctactccggaaggaatgcccttgtgcaacaggcaaaaaaaagtgcctctgtgccatgttgtttgatcttttttgcagttgcaggggggagaaatactaaactttctagtggaagagacacctctatgttgttaacagtgtccagatataggttaaaacttatcatgagcaacatctagcttcatgatttcttgaagtggattacagtcgtttgtttttgttctttctattcactttgttcttctaatattaacggctttgaataagtgtgcagattaggttaaaaggtactgggattagggttttcttgcgagagctttataatgttccaatcacacactgatcgtttcaggggtaaagtcacaggaatcatacttgttggtgatctcaaaagttaaaaatgataacatatgaacttgtttttatttagcatatgctccctttgttgtctactttttctgtatgtaatgcgctatgacgactctaaatcgaggtatttctttctccctgtagttaccagataagccattcatatacatatatatagaagcacttcttgagatttggacaataaattctgacaattttttttaatctttttgttatgtacagctcaagtgtcagttgaagtgttttgaaagtca

SEQ ID NO: 4593 - DNA, 1501 bp, Oryza sativa
tggcggcgtacgttctccgcatcgatcctagcggagtagatcctccggccgagaccaatgttttgctaatgatatggtcatatcgacctaatcatttgaatgcatttttgctagtcctatagtactaatccatctggtcgactgtgctgtgccacatcggcaggagtccacgagatcgatgcatgtgaatgtgatcgactgtgcttgtttgcttattacccgcatcttaaatttaaattttataacttagttttaagttgatttggagggtttcttagctctcaaattgtcggtaatacaggtataaaagtttattaggtaaattattttgattgcttagggagtgtttgggaggagaggattagaaaatattgagaatatacaccaaacaaggtgaatcattagcataagattaattgagtattaattattttaagcttgaaacatactagtagattaatatgagttttaaataaactttcgtagagatttttttgttatgagaagacatactatttagtggtttgagaagcgtacgtgtaaaaaacattggatttctcctctcaacctgcttctgctgttcatttttctactgtttacgacctgtacataagagaggattacatgcacttaactgcaattttaaggtggtgcactgaactaaacaacaactagtcgtagtgctgatcgagggatgaatggttcaaacttggagaagcgagaaaaggcttgcaaattccaaaagatacctgcctggccggccgcttgcttcctccgtgttctctctcatggatcagtcatcaaaaactaaaggacatgaggccaccaatctctaggcttaactctggccgtgtcgggacaactttttgaacgacgatctcctcggccggattggctgcactcccctcaccacgcaacacacacagaactgcacaccccctcaaagcaaggctaataatacagctaacatgttggttataagtttttttttagccttctcttagtctacctatataatagttagctctttacaattaatataggatccacttgtctctcttagaaagtttattggttcttgtgtccaggctggctataagtttatagcccgcttctcctctctctcctctcttctctcctccatctcagcatttagccggcttatagcctactattatacttgctctcatcttatgcagagaaatgctgctagctagctgcaggcatgtggcacaatttaatcgctttgtttactgaagattcatcagcacggagcacaaggcacacaatccctgaatcccctgtcatacgtgtagagcattacgctgataaataacaggccacacgacaaatcacgccagtacgtgtttgcatgcagtcttgcaccagtaacatataatcaaccaataattaatcatctagtatccggttaacattcacactaccagtttgactgccgatagttaattcatcgctccacttgtttctaataatatattca

SEQ ID NO: 4594 - DNA, 1501 bp, Oryza sativa
ttggttaaaattggaacgatgtgacgaaaaaattgaaagtttatgtataggaaaattttgatgtgatgaaaaagttaatagtttaaagaaaaattttggagctaaactccgcccatatatctccctcttcgtgaccgcgcaacgtcgccgctgtcgcgatcaactgctcatcacatcttctcatcgcacgacgcggccggccgctttttcctctgatctgttcatccgtcactcactcacttgggagaatctccgccgtccactggaccggcgacgaaccagccggagccgtccgctggatccgatggccgacaaaaccgcaggtgcgacgagaagacgcgcgtgggggcccacgtgtcggctacacgctgcgtctcgtggctgtactggcatgtggggccacagcctgggaaccggatgcctagcctagggctttcctttctctctgactcttttgagagtttttgccctttttttttcttttctttttttttttcactctggtcatgcctttcttttcagccacgccctggtgagaacagagatttctgtttgggcatctcgtcctgtctgcaaaattttgagcctgtttcttttggtttcttttgaaaggaatctgaactgactgttttaagatgaaaatatgcgagtatttgtttttcttgtatgagtaaaagttaacaatgcatgtgtgcattaccaaaaataccaattagcggtctatttgaaaatagttggatattaattgtctttcctcgttgttatagtctacttaggactgtatatgaaactatcagctctgtgctactttcaaattatcaacttcgaaaaatgaacagaattaaaaaaaaaactgatgtcagctgttaaacttcacaaaaaattgtataatagtgcagtggaacatccaaaactactggtttagaggattcgagcacataagtgaaaatctaataaacaatgtaggcccaatattattgctaagcaaacaacattattattaaatacaatcacattaacaagggagggaatgggatcgcttgaacaggcagacccggcggcctttaatatcgcaataatactccaacactacgaggggttccagaaaaggaaaaaaaacctgcggtctttaatactccaacacttcgaggggttccctgaaaaaattccttcaaattaactataccacacctcgcctcgcctgtggttaactacttctatttatccacccatccctcacctctcccttctcacaaagccccaaacaaccgcgtccgcgtccgcctccgcctcctcctcctcctccgccgccgccgcatccgcatccgccggcggcggaatcgcctcgcatccgtttcctcctccgctcccactcttctccagctgccccccaatcatcgccgcccccgaacaatccgttcatccaccaggcaggcagtccagtccacgcgcaatctcggacgagcacccacatctttgactcgggtgattgattccgcca

SEQ ID NO: 4595 - DNA, 1293 bp, Oryza sativa
gtgcttcttggtgcagacctgccccacgatgcaggagatcaccagcagcgccgcgatgacgcccagcacgatgaacaccggcgtgtacgacccgcccccgccggtggccccggccgccgccgccgccgacgtgtcctgccgcggcggccgcatggcgtgcgcgccgccggccagaagaggcgtcgccggcgaggacatcgacatcacgcaaacctgtgcttagtgcagagagagctaagaacaatttggaggctacttaatatcacttgggtaaatatgcttggagtgagcttaaaggctggggttagtgtggaaggggaggattggaactttgctactttccaaatttcccctttttggccatgacaaagccaaggatcctagcacttttttctgacacattgtgcacagcaaaagacagagaatggatttttgttcaagccagaggttgaaaagttgttactgaatgctaatctggtccttttctgcatgaatcttgagcagaacaaagaaggatcgcttggcagtgtgtgtcattaggcagtagatagagagtgcaaaagtacgatggaagggagactatttgtccccttgtggttacatgtcactcaaatggttatgaaaaaaattaaaaaaaattaagaagatatattaacatgtgatataccactccacaaacatgtaagttcaaatttaacttctaaatctcataacaaaaaaataaattttactgtgaatatatgttaactagctgtagtttaattttttttttgtgagatgtagaaattcaatttgaactggtatgtttctagagtaatatatcacatgttgatacatcttctaaattttttttatatttttttataaccatttgagcgagatacaaacccctcaagggatcaaaatccactctcaggaggacctgtttagatggatgttattttgaactatataattttagtaaattaataaatatttattttgttatttaatactattggtaatgttggggatgttatcagcgtactaaaatttggccattgctaaattttggaaatgttatttttgacaataatttgaacagctcgaaatgccacgtcaggcataggcaagtttctgagttattcctggccgtccatctcagatccaacggctgtagaacacgggaggtgtggccacatcgcactcgaacccatctacgccttatcttatcgcgcgcgccctcctcccgcgtttttctcctctccccgtcgcagagcagagcgcgccatccaggaacccgcgagctcgcca

SEQ ID NO: 4596 - DNA, 1501 bp, Oryza sativa
ggtgatgctcaagaaagcctttgctttggcacatattcttccgatctttcatgcatgcatgggccatgcctgtagcccagacaaaaacaacttcagctgcacaaaaggttaggctaaattgtttgcaaaccaagctgtcagtgtgcataaaacagaagttaaacactggaattagactagcttggtaggcaagctgctacttagaggggagacaaagcaagatatacaagatcactgaaggcttcataagcttatacttggagagcaaggccagctgcttgctaagcaggaaggaattcatggcaaagacgcatgtatccggatgactgtgcgatctctgcaggatgacaaaacagctacgtgataaaatcttgatggatccatagattcgttggcgctttaccttgatgttactatcctttagatctgatcactttgatgttaccccctttcttttctctgcctctttctgatgctgtttttagcttcaccgttgcttcagtgctccagttcgagcaaacacaggacaaaactggagaatggaagcttgatcagaaaacgaaccaaacatgggaatttatatctcacttttttcactgataggttgtggtaaagtctggccacctttaccttccattgaatgcaaacgcgcctgcgcgtgctcagcacaagatattgctttgtcttcttctcagaaagtgtaaagaacatgaggcaatttcaccatgctaatgcttgggggatactatgacaaaatggcacatccaagtgctgtgttgctgtcgaaagatgcactccatgccatgcgtgcatagtagtgatgaacagttgttagctctgcatgcagcatgatgcctcgatgactggaacgctcggcgcatggatccgagagaagcagctgcatgcaaaaaacaaaaacgatcggcgtttgtcagtataaggattgagacatcgggatgcccagctacatgccaggtcagctccttctcagctgagtgacacatatactgcagctccagaatatttaacttctatcttcagcaccagaaagttcaccacaaaaattttcaatgttcaggcatgccaatgtgcagccatgagccacactaacatcaagatgtaatctttaccagaagctcatcaaagttaccatgttaggcatcatgcaccatagtctcgatcgattaggctgctattttttttgccgggagattaggctgctatagaacacagccaatactatcaactgctgtaattggcattttccatcacacgctgtctgtgtccctttgctccaaaatctgcgaaccttattctcctcggccacctttaatgcacagccattattccatacagcttacagctcatacacacaacagcacccaaggccccaggccctataaatagccgaccttgcaacactgaaagcacaaaccaccagagcttctgaaagagcaagaacattcagagctaagacacagcaagatctttagcattagag

SEQ ID NO: 4597 - DNA, 593 bp, Oryza sativa
gtatgtacgaatacaaacttggtatttatacatcttgaaaaaaaaaggaaaaaaaagctgaacagaagagaaaccgaaaaataacaaaccaaacagaaacaaaaaaaccggaggaaaaaaccaaacagaaacgaaaaaaccgatgaaaaaaccaaccgaatataaacgaaaaaaagggagaaaaaaaccgaaaaactcgctcctccctccggcacatcgccgccccctctccgcgcgcgacacgtgtccagtcgcgcgaggaggaaggcgcgcgactgatcgccgaatagcaatctcgcagattaggttcctcggcggtttttagagcggttttggctgacgtggcgcctacgtggctaatttgacttgatattcatctgatgtgacattgacttggcgcttacgtggcaatttgatatagaaaaaaataataaatctcgtggaacccacatatcagtttcatgtaaaaaaattaaaaaaaaatagtgggacccacgtgagcctgacgtgtcagtccaactcattcctcctgttcttcctcctctctccgactctcccctctgttaatctctctctcctctcctctctccagg

SEQ ID NO: 4598 - DNA, 1501 bp, Oryza sativa
gtcaccctgggtaagttgaccccggtaactcatatggcggaaaactgaaaaaaattacagcaaggaagcaaacggttcaacctgaaaatccacaccacttagacaatggcatgtgggtccggaaaactgagtattgttgtgggtcccagatgtcagtgatgttgtagggtcagagggtaggttattgttgggtaggtgtggaattgggctctgcttagaactgccattaataaaaccaggctgcttccctccgctctcttggtgtctcctcctctactccgcttctctccacctcgccgcgacgagagagagagagagggaggggggagagagagagaagtatcgatccatccgcgtttatctccggtaagcgagaccttcgagtacctgttcgagttctagcaatggtttgattcgtgtgctttgcttcgggattggttgttgggagtagtagattgtattcgtggaggaaatgggttttagattaaaactcggagccctgtcgctcccgactccggggttgctaaatttcgagttctttggtcgtctctgcttggatggtatcgttcgtgatggcgtttgcgcgattcggtgccctcgcgttgtttggggggtggattcgaggattcgaatgggcgccttccgcggggttccgcgctccgtccattttcggcgaagcagggatcgaagaatacgatttgcgcgcggattatcccctttttgctcgcgttttgaatttgtgcggcacgttttgaacttcaaacacgtgattttctcaaaaatttaagtttttgttttcgtgtctatagtgcgggcgattttctgtgggcggcggtggtttaaatcattggtttcttttacttatcataggactaaggatttggctatgccccgtttctcgtagcttagtcgaaatatcggatatgttgcatcgaaattgttgatcctctttttttaaaaataaaatcaataagtgatagttcggggaattttactcttttaccgagttagcaaaaaaaaaaaaactttgctttactgtagcaacttagcattgctagatgtctacccgctgctctcatgattttgcacttgctgtacgtctaaatactgtggttttcttctctctttttttttaaaaaaatgatattgaattgtacttgctgtacgtctaaatactgaatctgagttagtatattttgtgtagaaactaaacatactaattgaaatcagcaccagcaaagtgtaaaaagactgttattaccatttgaaatagatttctatgctgttatggattgtgtgggcgaggatactttgttttttttttccaggaataggaatacatgattgtttgcccttattgtatgattatgatgaaccaagtaatgattaaatcttggcatggtttgtctccgaaagatgtttttaggtttctcctatccatttgtgtttacacatttattttttcattacatgaaaacttgtactggtttgttgcttttaa

SEQ ID NO: 4599 - DNA, 1501 bp, Oryza sativa
ccgaaactacacgcgaaacgggagaactcaacaaacggcgaaaataaagccctattaatgacctctaagcatgccattagatagatctcgagatttgaggaattttggaagttgaacggagtcaaacggatttacggttgggaagatattgaatttctaagattattgaatttttggtctaaaggaaaaggatttcattaaatcctttttgaaaaagaaaagaaaagaaaagagggagggaaaatagacttttcctcgggcggctagtgcgcggcccgagagaaacggagcggttcggccggcccaaggcggcccaagcgcgcgcgcgggagggaggagagagagagccggtggaccgggctcaccacgcgtggtcccgggtgggacccgcttgtcggtgacacggttcaccgtgcggagcgagcacgcggcgcacgcgcgtgggcggggaagggatgcggtgcactcgcgtggttcgcggaggaacggatgcggcgggcccacgcgcagcctcacggctcgcggtggaacgcgcgcacgggaggggctgaccggggtcggcccgacccgatctcggccgagctggcgccgacgtggcgcctacgtggctgccacgcgggctggcgggaggaagacgaaggcgtcggccacgaatggacggcgggcggcggcggcttctccggggcgccttgcgacgatgaggggcgacggggcgtacaccgggatgacgagggagaatgagagggagcgagccaacggcttggattcgccggagggtgtccgtcggcggcggattgcggcggcagcacccggcggagagaaaagggggaaacggcgacgaggtcacgagggaccgattcccggcggcgagagcatctacgcggctacgggaatccgttgctagcgtcggattgggcggagctacgccgagcgaggctggcgacgagcgggtgctacggagctcgggcggcgacggcggcgagcacatggcgagcggcgacaacggtcggggcggcgccggctagctacggggaggctactcgtgctaccaccgaaaactaagggggggagatggagcgaggaggaagaacggagggaggcactaccgagatgaggtggggcgctgtgacgagaggccgacggcgcgggagtaatctctccggccttgggccggggaagaggaggaagacgagcgcccgtagtccccttccgcgtccacgaacgcaccggctctcccggcgcttggcgatgaacggcggaggcgagacagagctcggaaagcagcggcaacgatggagtggaggcgaatgggagaggaagggaaagggggaggcttgggttttaagggcggcaatgtcggtttggaaaccgactttgggcggtcaaggcgcgagctggcgctcggcgctcgcgtccaatcggcgacagggcggagggaggatgatgccggcgggaggaaaaagggaaaaggagggagagaaagggggctcgcccctttctt

SEQ ID NO: 4600 - DNA, 1501 bp, Oryza sativa
cgtgttgctacctcatcgttgccagggaggccccccatcacggaccattgaagcccccatatcgccaacctcccaccacagttgtcacctcccgcggacgagctcgctggctacccccctatcttcgctggccaagggcgactgtgaaggagaagagggaggcgagggagccggcatgcgagctcaactttggtgaccttgggcgctgatgcgggaggccttgtgggcgttggccttggcgtacttttcggcatcctcctctcggctgtgcgtgtcacaggacatggccctcccgtgttggtgccacagtgacacccaaggtcactaaggtcaggcttgcgcgctatgcgcactgcagaggaggagtataagcttgtcggcccctcacctcccttcttttctaggacaggctcaccgaccgtctctgcgtccatagctgccacccttgaactgcgtgtgtagttggggaaaaagatagaagaaagaattgtacactgacatgtggccccacatgctttgtttatctatctttttttactaggatgccacatcaatgaaaaccaactatttatatttccatgagatctaatttagactgttttgccaagattgaacgaacctttctagttttacaattaagtatgtcggttaaacataacgtaaagatgagagatggttagtggacttatcccccacgaaagaccaaagacacattttccatctcggcccaactagttaacatgattaatgatggaccatatcccattatccataattgggccgtaaaggaagcactgaacactcacgtagacatagggttggcaacggggcgggtcaggtacgggttgggccagaacgcccccgcccccgctccccgacttctcctcccggccccgtgtaacatcctcaaattttaaactaaaatttgactgcatcatgctgacttttgattaaattagtgtgtttaaaaatttatttgatttcttaattggttcaagtgttacttccttataaccctactaatttaccctaaatattccctttattccaaaccttagtaaatttgagcaaattctctcaaatttcaaactttagattatttccttaagtttaccttaacattagtgaggattcactacactccaaaccctagtaaaactcttccaaattcatagttcaaattcaatcttttctagaaaaaaatactcaaatttactgaatttcactgttcattgccttcaaggtgttcggcagaatgcctagcccaactaactcagcccaatccctgtccaatcctttgcaaagtctatgttgaatccttggggcccacatcccactcaaaaactgtggtttagttggccttctcctccccttggcgcgccgcccgggcatccgacttagccgcgcgccgtgtcgccgcgcatcggcctcggggccgcttgcgcgtgcccgaccgccttggcgcgtcgtcgcccgtccgacgccctcagaccgccgccgc

SEQ ID NO: 4601 - DNA, 1501 bp, Oryza sativa
aatccaaacattgccaaaacttacctccactaccaaagtttggtaattctataatcttcctcaaaaacatgacaaaagaaacaaaacataggggatgtttagtttattgccaaaataaaccttaccaagttttggctttaccaaaattttacaagttaacaatccaaacattaccaaaaacttgcctccactattaaactttgataattctagaatcttcctttcacaaaaacttagtaaatattgatttaagcatcaaagtgaacaacccccatagcttaacacttgtcaactttaccaaatgttttccctaagtagtattacttttccctccaacaactctcattcaaatttctccacactttaccccaacctacctcccacttttcaaatactcctcatttaattatggacataatagtcttttcctttttttttctttctctaaaacaacctaatccattatgcgatggaggtagtagccaaggactccaaaattctggttggactacctgcatatggcctgtggcccattttcaagcggcccaagtcatattagactcagttcacaatagtaaccagggataaaaacagagcagatatggacgaacaattatcataccatattcgctttcatattttttgccgggtgtaaaaacgaatacgaatggcttggatacagaaacaaatacaaattatctcaaatacgaataaggatcgaatataatcagatatgaatatggcaatatttttttatcaaaacacgaaaaccacctcaacttctaatagaaacgaatatcatcatatataattagctcgttttatataaaatatagtataatttataaacatatttaaaagtttaaataatattaatagtgttgactagtgttaagagatatgttactactaaattctaaaaatgtacattgaaagacatagagttataaagaaatgtggtatatcttatggctttagcggatatctaaatagcactgttcaccggatatccgtacccgtcggaaaccctgatatcatattcgtattcgtatttgggagaaaatatccctattcgaattatcactgttcaccgcatattcgtttttctccaatgcgtagcagtaaccactaatcaagcaaaacgaccactcgaaaaataaaaatcaagcaaaacgaagcagccgcgaagcactcctcacatggcgggtagccgtccagtgcgtcgcccatccgagaggactttgaccaatcagagtatcagttccccctggaatttcttctcaaccaagttccttaccagcaaggtacctcctaggatcgatgctatgctagcaatgctgattggccccgtcaagcaagtgacacctctatttaacctcacccccagcaccgtacataccatatccacctccagtagtcaaagcacacttgcatcaactccttttcactccactcacttgcactcatagactgactccagcaatggttcttggagcctggt

SEQ ID NO: 4602 - DNA, 1501 bp, Oryza sativa
tcgaccgacgggcgattggtgaatcaaagcttcggggttgtggggctatggttgttgatgatcgatgatggacaaggaagggattggggtcctatttatagggctaggaggaacggatgagctcggacaccgtcatcgccatggatgagctcaaggattggatatggctggggcggcagaggctgtgagaggacgggcaagatcaatttgagtggcgggaggccacgtttgaatacttaccagcgaaggattggcttgaccgcgtgcgaaatcggctggcgacgtgttggcgccaatccgggcgcgatgcgcagtggcggcgagggtgaaaacggccgactcgggggtgaatggtttgaattgtgagaggggataccaccgtctatcttcaatccaaccgtgcggcaagaattggcgtgattcaccatgggtagaatcaaaatcggactcggcggcggctttggacgggcgcgcatggcgtcgagcggcgatttcttgcggctgtcgtcgtcctggctttgtcgtcgtcaagatttgtgcggcggcggcggtctgagggcgtcggacgggcgacgacgcgccaaggcggtcgggcacgcgcaagcggccccgaggccgatgcgcggcgacacggcgcgcggctaagtcggatgcccgggcggcgcgccaaggggaggagaaggccaactaaaccacagtttttgagtgggatgtgggccccaaggattcaacatagactttgcaaaggattggacagggattgggctgagttagttgggctaggcattctgccgaacaccttgaaggcaatgaacagtgaaattcagtaaatttgagtatttttttctagaaaagattgaatttgaactatgaatttggaagagttttactagggtttggagtgtagtgaatcctcactaatgttaaggtaaacttaaggaaataatctaaagtttgaaatttgagagaatttgctcaaatttactaaggtttggaataaagggaatatttagggtaaattagtagggttataaggaagtaacacttgaaccaattaagaaatcaaataaatttttaaacacactaatttaatcaaaagtcagcatgatgcagtcaaattttagtttaaaatttgaggatgttacacggggccgggaggagaagtcggggagcgggggcgggggcgttctggcccaacccgtacctgacccgccccgttgccaaccctatgtctacgtgagtgttcagtgcttcctttacggcccaattatggataatgggatatggtccatcattaatcatgttaactagttgggccgagatggaaaatgtgtctttggtctttcgtgggggataagtccactaaccatctctcatctttacgttatgtttaaccgacatacttaattgtaaaactagaaaggttcgttcaatcttggcaaaacagtctaaattagatctcatggaaatataaatagttggttttcattgatgtggcatc

SEQ ID NO: 4603 - DNA, 1501 bp, Oryza sativa
gagacacatagtaaaataaggtatacaaagatgcctgaataacttaataaatttatactaaaaaataaagtgaactgataagtatatgtattatttgattcaggtatgcattagcaaatcatgtaaaaagtcttgaggacaaaacaacaaaatatctatttatggtaatcaaataatcatttatcgataacaccgttcaatttcatgaaaagaaataatgattgatcaatcaaaactttctagcataactcaagaatatcagggtcactgggggagggacagggaagggaagagactgaaaccccacatcattttaaatttcatctgcaatagcactacatggtccaggattacaggttaacaatgagaacatgaccagatcacctatacaatatgcattccaaaacccaactaaattaattagctatgctataatagaaagatctcaaacagttacataggtgtagatagttgatgggtggtacttttcactatacgagattattgtgaaaatcccaaacaaagtaccaagaatgtttccatgaaaaatgacacctgattctcattttttgtttagcaacagctatgaatcattttggaaacaggattctttaggtcaacaaataaatatctcacctggcacacttgcatcaactggtaataagcaaagatcctaacattcattactattgttcccacctccttcacaatgcggaatctcttaagttcaaccttaacatacattctcaatttttacacacccaatgtcgtcaagaacaaagaaccacaaaggaaaaggattctcctgtaaatgtgaccgcctcacctgcaatgcatggaaaattaaaaattcagtgagaattatgagattctattatcatgaatatgaaaggtttcaggagatcaagagacatacacaatcacacggaaaaacacagcaaggtgaacagactttcggctgctgtaataagtcgagtacaaaggggtccaaggcatactgctgctcagtgcttaagttttgttatattcctgcaatcctgctgattgtgaatttgttatcaacacgtaaaaataccaacagaaggatagagaaaatacagtgctaactagtatatacaacttcaagcatgtcatctgtttggtggtagtggtagacccaatccattcgtgctaccttcaactatatatttgttctcgtgggaaaactaattcccagagccggggagcagagttctacacgagattagataagtggatcgtgattagtgtttaagttactgttgaataccaaatcgacttcattaaataccaacagaaaacatccttaataaaactccaacacagttaaaagcaagaaccggcttttagtgtccaatcaagaaaacaacaggcttgcctccaactgcctccttgattggtaagcacacacaaaccatggaaaatttttccaaactttcactgttctaatacgatccccctattcccccaattacaagccaca

SEQ ID NO: 4604 - DNA, 1501 bp, Oryza sativa
gaggaggaggagccctcagcgccgggtcataccaccctcctagacgccggcgacgacggttgggttcttggcccgtggatagcttcgacgaggctctctcctgaccgccggcgtggggtgcccgagatccaaaatcccgtcctggagttcttctacctccccttccaaaactctcttttggcatccttgatacaatttcccttccctttctttctttccatttctttttcttgctttagatttcttcttcttgctaatctcgatccatccatccaaacacctcattcttttttcctttgatttgattcttcgctgtccgtgttcgtgttcacgtaccacagcaacctgtccgtgttcacctccctgccggacatgtgggcaatcgggcagatgttcccaatcatcccaatccagtgccttggtgagcgccctgcaatcgacggcgtcctctccgacctcacctccgacagcgacggcaaggtcgaccacttcatcagcgggaggcacagcctgccgctgcacgagctccccgtccacggcacccgcggctactacctcggcggcacctaccaggaggccctcggcgggctccacaacctgttcggcgggccgagcgtggtgcgcgtgtcgtagagcggcggggccttcctgcgccgacgtggtccgctcgatgcagcacgagcacgaggtgttcaagcagagaaccgacggcgccaccgccgccgcactcgccaaagcgttcggcgcaatgccgtacctgtcgttctacccggaggccgcagcgatggccagaggggagagcagcggcatgagcagcgactcggaggtgtcggccgccggcgtggccgaggatgatgatgagtgggagttcatgcgcgggctcatcgtgtgactgaggcagccatcgccggcttcttcgtctccacgcgaggagcacctgacacgtgggtcccacgctgactcagcagccatgtaggacaaaaccgggatctgagggacctcttgtgaccggttttgtataattaagcgaccccacatatctagttttgcggttcgaagacgattttttatcccgatgacaagttgagggaccttcagtgtactttttccaccagcaaactaccactggaagtgaacaaatttggcccaggttagaaatcccggtctctggcccagttaagttaagagaaagagagacagtgtgaacaaatttggcccaggttagaaatcccggtctctggcccagttgagttgagagaaagagagacagtgtacaagagaggattaagttcatctgaggtcccttaattttacaccgaatccgatattcgtccttaaaccacaaaaccagatataaccggtccccgagctgttaaaatcggtgcaaacgaggtcactcggcggttttaaaggcggttttggctgacgtggtgcatacgtggttggtttgactaaggtctcttaccacgtggcattgacgtggcgcttacgtgacaattat

SEQ ID NO: 4605 - DNA, 1501 bp, Oryza sativa
cccggttgtctaatctcctgaaaaaaatcggacgcgtctcattgtggttttgctgcatgcagcctcgtattctttttgtcagatactttcttttcacacctgttacatatgctcccttacttagcattggcatgcatggaggagagaggatacaagattatttgcatgtacataacacccttttagcaaacttgaaaatgatttttcttccagattactcatccaatctacgatatgtttacaccattgtattcgttacaattaaatttttacagcaagatctcacatgactatattataataaaaaacacacatatgtctcaaccaattaaatttaatgtttcacatgtgagaataagatgtttcaactgaaattctattatgttgcacatatttaattattgtcgcaatgtatatatctttctttaatgcatcacatggtgctatttgtatgtttcagtaagtagtttattatgtttcactagtttatttataaatgttgcatatgtgttgattgagtgtttcaataagtattcattaattaattaaaaatattgcacacggtatcatgtttcagcaaatattatatgatgtttcaattgttaataccttatgattaaattataaaaataatcatgtgagatcttgtcgtaaagatttaattgtgattatcggtgttgcagttagtatttcttgaatgttacatttctctgaaatatttttatagactgagttgaaacatttgagcaagatttttatgtctcactcattgagagtcaatgtttcataccgatattatcggtgttgcatttagtattacttgaatgttgcatttctctgaaacattttttagagtgagttggaacattttgacctagtggtgaaacattttttttataagtggtgaaacaaagttcgatttttctcatcaaaatataaccgtgcgagatcttgttgtgaagatttaattgcaaggagtttaatggtgaaatcgaatcataaatcggataattaatttagaaggaaatttaatttaaagaaataaaaagtggggttgagataagtgctgaaccatgcagtcatgcatgcgcaagcatatagactttttacatgtgctaatcaactagagtagaaacggtagagattgtgcatgcatgcgtaggcgtgcggcagtcaggggttgggcgtccgatatttacgaaaaattggacgtccgacgcgtagcatcctcccaatagtaggggtacaagaagctacaaagctacagccaacggaggcttatgttgggttattagttgatgggtagaaccacacaggggagagtcgtggggcatggccgatgtggtgggagagcagtgggccatgggctagtgcttttggaggggttgggaacccctcccctatgcacgcaaatcggtgcgatagattaacacatgattaattaagtattagctataaaaaacttgaaaaataaattaatatgattttttaaagcaacttt

SEQ ID NO: 4606 - DNA, 1501 bp, Oryza sativa
ggaattcggctgaggaaagtgttttccttttctttaaatcgttattcttttctttcctactataaagttcaagaaatacatggaatacaccaaatttctggaaaatttatactcaaatagactatatgaatatcatactgtttataggattttatttgttttttttcttttttatcaattcaaatttgaattttgataaaacccatcgaaattccagatttcctctacttccgagccatgtcgaaacctcggttttccacggaattcaaccggttttctttggaatcgtgaaccctgatggtgtccatcttaaacctcaatttaatattttataattagattgtaaaaaggaatgagaaaaaaaaaacaagtgcataaggcatacatttatagctagatgccatgctttgtataaaaaaaatactatgaacaagtagagctagagatgggcctaaaaattaaagtaatgagttagagcatctccaacaaactacttatctagcttgccaagtcaaattttagtaaacttggagaaaaaccagtatccaacagatttgccattagccaagccaaatcacttgctaaatcagcttgggtggaggcagcaaggatgggttgcactggcgacttgggctgaggcaacgagaggtaggggtaggggaatggacgaaaacgatgggaagaggaaacaatagagggaggaagaagtatatatagatcgacatgtgagacctactatcatattggatagggtaaatagaaaggccgatggagtgaaagataaattggctatctaaatttttaacaagctgacaaaatggatatctaaggtcaaatttgaagaggttgttggagatgcttttaggtctttgtttccaaaactatcctaataggttaggagttaggaccgtatttgtttacactgtatattagcacttttgtataagtttctgtgaccgaagggaaaaagtccgaattcattttcgaatctaaccctagccggatagttcaaacaaaaaaaaaaacaaccccccacccccacccccaccaaatagctggatccttgtcttggtatcagtatttgctcggttactccaaagttgaagggattcgataatttgctgacctgtgcttgatagacttgtttgcaatatctaataaactgataaaaaagaaagataattgatggaatgttgtctgcaactgcaagcaagtgatcttgactgccgtctctcttcgatcttccattttgtctggtgcttttaggatgccttcaatcttcttcaagccacttgtctcgtgcttttcacggacaaatgtctctctcaaggtcacaccttggattcgactccaaaaaatggagattgggggaaaaagaatcatatcgctcagaattactaatcgttgcatagagaagccatttgcgcctcgtcgggttaggcacccacaccaacatcacagaaacttcaggtacgactactgtataaacttcacacaagta

SEQ ID NO: 4607 - DNA, 1501 bp, Oryza sativa
agcaaactgggtaacaaaagacctcacccattatctcatctctcctatctttcttccaactcacttcctttggttcgcgagctgccttggctccggcaaggtcttacacaccggcgagcttcccgcctacgaactgtacccgttcttctccctccactcctcccccgtcatatcgtcgtcgccaccattcccctttgtggagctgggatgcaaggccggccaccatgttggatcctacgggtggcaaccatcgacagagacagcggcgatggatgactgggtggaagaccttagaggcgacggatggaggtttggattgctagagacttcccgacatccacgcctccttcattgtcatgctcggacgagcgagagagagagagagagagagagagatagagagagctcattagtggactgacagcaacatccacctccccatcccggcggcaccgtgaagccctaccagccgtgtatctaagctcgtcggttatcgtcgcctccatcgacaaggagcttgttgggacggggtgggtggtgaaccaccagcaacaacaacatcctccctatcccggtgggtccgcgaagcccgaccgactatgtctccgagctcacctccatcgccagcttgcaggaccttgctagaattaggccaactcgctgacatgaggaaaggggaaggactgccaaggaagaaggtatgaaaaaggagataaggggctaggaagtcttttgtcacccggtttgctgagctaccaatcaaaagtggcaaaatagcaatagcctagtgggcccggatggtaaataattaaagttgtttggaaggatggcatttgagaacacgttgttagggaggatggctaagagtaaaaaaaaaatcccttattgaacacatataataggagatctcaaatagacatgagaaaaaaagcttagtagagaaaatacctagtccttgcctagtacccttgagaaaatacccgtaaacccctttcatttgaactatgaacatagaaattttgtaggatttttgttctatatttttttttctaaatgatccttagaaacaaaggctggacaatatagaattatgaaatatatatgaaatgattcaatccacgcaggttttgaggaaatttaatattgaggtccaacctcatgggtagtttcattttgatctctcctcaaaatcctgcattttcatgccatctaaccaagcgctatctttgtttttccttttttgtgatttgtagccttttattttacacttatatttctgtcaatcctatgtttctcctatccttgcattcagaggagcccttattgtaactttgaactgcttgattggctttgagcaccaatcgaggatgaacatacaagcaaaatgcgaaaagaataacaatgctaacacatgacgacatgacattagttgtaactttatagcaaattgatagcaggaccaccttgtcagatagcatgtgagccagcaccgtcaatgctc

SEQ ID NO: 4608 - DNA, 1501 bp, Oryza sativa
taggtctcacatgtcgatctatatatacttcttcctccctctattgtttcctcttcccatcgttttcgtccattcccctacccctacctctcgttgcctcagcccaagtcgccagtgcaacccatccttgctgcctccacccaagctgatttagcaagtgatttggcttggctaatggcaaatctgttggatactggtttttctccaagtttactaaaatttgacttggcaagctagataagtagtttgttggagatgctctaactcattactttaatttttaggcccatctctagctctacttgttcatagtattttttttatacaaagcatggcatctagctataaatgtatgccttatgcacttgttttttttttctcattcctttttacaatctaattataaaatattaaattgaggtttaagatggacaccatcagggttcacgattccaaagaaaaccggttgaattccgtggaaaaccgaggtttcgacatggctcggaagtagaggaaatctggaatttcgatgggttttatcaaaattcaaatttgaattgataaaaaagaaaaaaaacaaataaaatcctataaacagtatgatattcatatagtctatttgagtataaattttccagaaatttggtgtattccatgtatttcttgaactttatagtaggaaagaaaagaataacgatttaaagaaaaggaaaacactttcctcagccgaattccaaggagtaggcccacttagtacttagcccagttaatagaatagaaaggtgatgtggtcccgcacctgatttcgctcagaatttcgccaaagtcaaccggttttcgcgagcatattggtaaactcagtgaatttgtagttaaattttggtttatgaaatttgttcaaaatctacctgttttccaccggatttcatgaaaattgtcataccgccagagcctggaacggaaagtcatctcagaattgtaaaccttggacaccattagtttgtacgtgtttatacgatatcgttatacacatatacagttgctatttttttttaaaaaaaagtagtctactcttttatatagaataacaattgatattttcaggcaatttttcataagtccgtcagacaagtattttaaccgtattcgtttcatgtctatattcgataatatttatcttcgtattgaggatattcatcatttatatgtttccaaatccaaatccaaaacgaaaacgagaaacaaatacggtacgcgtagtcgagttttgtttgtgatgagtttgagttgtgactgggcttctctcccgttaacagtgagagagacctttttggtacacaaaaaatcctcatcatcagagggaccctgcccgaaaaaggtctctccctctttttacacacatatattacgcgacactacccctctcctctttcgtttctttccccttctccgctcctcctccccctcgcgagctcggcggcgggcggcggcggcggcgcga

SEQ ID NO: 4609 - DNA, 1501 bp, Oryza sativa
ggaccaactactaactgggcctagtacatgcaatctggcccatgtaagtgttttcctttttttaattctttattcttttctttcctgatgtaagtttaagtaaatacacacaatacatcatttttttttgaatatttatatcccaataggttctatgaatatcatagtatttataggattttatttgtttttttctttttttatcaattcaaatttgaatttggatcaaagtcctcgaaatcttagacggtttctactttcgagcctcgtcggaatgtcgaaattttgtgaaatccgattttatttcgttggaatcgtaaaccctggtgatagtaacaatcttaggttgagatcaacatatccaatccaacaattgtaacctacttggtacatatgctccataacagtaactgcaatgagttaagaaaaaaaggtcactggaacgtgttggttctctaccctaccaattcaatggtagtgccaaaatctaggtaaattttgacactaccaattatttggtagggtagaattcatataatgtgtttggtttggtaccatttgctaccaatatgcttgttatagtgaagaaagttctagaatgctaccaaattagctatgggtattgccaatactttggctctaatccaaaccaatcaaactactatttgaactgccaaacaattggtagggcacattttggcatcgatccaaaatggcccattttggattgaagccaaaacatgaccttaccaatctattggtatcttgaagatattgtatggttggattaaagccaaatcattggtaatgcccattaacaatttggcactaatctagaactttcttctctatatcatcaatatttggctttatattggtagcaattcaaatatgtaccatgcatctctaccctaccaaagaattggtagtgccaaaacatgccaaaaatttggcactagcaaagatttggtagggtaaagaaccaaacagcttttgtttcagtcagaaagttaagtggggcaaaaagattgcccaaaatattatgaaatacctctcgatatacctttgatttcacaatatgttgtattaatttatgttttacaggcatacaacagatccaactttcaatgacatgtttattgtttagtttagctacaataattgttgggtagttgtagagcagcacatggtacttatgccacaagcccgcaaataaaataattcgcatttgctcatcctaattcatgctagcatctctattgcagaacaattttgatactattttttttttaaaattagccttgaaaatgccacttcccctaaggaatgacaaatgcatttttttttacaaatgcaaaaacttgcaggtagacacatatttggcaggtgaattcgtgtcatatggacatatctttcattggaagatatgtccatatgttggagctatttcaccagttctttcattggaataatgttagcatttaatcagtgatataggaga

SEQ ID NO: 4610 - DNA, 1501 bp, Oryza sativa
attgcgtcatgacttgttatacttttacgtagtgattgattattattatataaattatgaataccctgcaaaaaaatataaatacgataaatacattattcagattctctaaggtggattaaggacacgtacttaaaccttctttactttcatggcatgactggtaatattcaacgtgcatgtgctagttatcccaatttacatatcttcgctttataagcaaattagtaatgagtaaggaactggacattgctatttttacttacaaattaattaaagcgaagccctgtgtatatatatactaccttcgtttcagattataaaacattctgactttagacaaagtcaaactgctttaagtttgactaagtttatagaaaaaagtagtaacatttttaacctaagacagatttattatgaaaatatattcaattattgatttgatgaaactaatttagtattataaatattactatatttgtctataaacttagtcaaacttaaaacaatttaactctaaccaaagtcaaaacgtcaaatagcctcaaacggatggagtacgtaataggcccagttctaaagagcaactagcttcaacctgttagtacactccgtgaactattaaatggtgatttttttaaaaaaaaaactttctatatacaagttttctaaccaaataaatctgttttttaatttataacatttaatatttaattaatcatatactaattactttttttttgttttgcatgtaagtatttagcctagccaatatgctcaaacaaactcagcttaagccctataaattaaacacttgctgctgtacctaccagcacagttgtttagaccaatccttccgtcctaggtagcgaaaggaaacacatagtaggttgtttgactaattaaattagcatctcaatttgataacgtttaccttataatttacaagcaatatatactactagcataaatgatccaaatatttatattgatttgtcctctcacttaaattaaatagaatttaatataaaattaaaattgtttttctatttaaattttttgcaaatttttaaagtgtacttattaatactagcaaggcatattatcggtaaattatatcataaaagtcctattaatttagtggcggagccacctcccggacaagtcgggcaaccgtccgagtcgctgccatctccactgtccatagccgttgacacctataaaaattaatcaatcatcgtaaaacactattagtcgccggggcttgacgacgccgctggctctgccactatcttaatttaaatgcatctaaaaaacaagtataatttaaagtaaattgttgttaggtactcaagtctaattgtaacatgtagtacgttttaccatatatgctttttaagggtaaaaaagttcacatcaagaatagaagcatcaaccaagatagaaattgaaccggtacatgaatactaaataagtaaaatgtttttaatttgggacaagc

SEQ ID NO: 4611 - DNA, 1501 bp, Oryza sativa
gtgtcgtcttccgatgacctcccctctttgctgccattgctcagggatgagtgggactcagatgacaagtggtttttttaacgattccccaccgctgaaggactccgatgatggggacaacaaggacgatggcaataatgataaggacaatgacgcgacagcaaaacgaggaggaaggcaaggacatggccgagaacaggtgcgctcagtgggacaaggacaagtaggctcggtgggaggtgcgtgaaggatcgaatacaagaatcaagccaaccagagagggggttgaatgattggaacaccaaaaacctaaaactttttgtgcaattaaaagttaccttcgtatagcaaatggagatcggtctgaccggtgtgattcctctggtctgatcgtgcccttgccactggtctgattgaagtagatgcaccatttcaaccacccttatagctattgtcatctgctgttgccgctgccggtttgaccagattgatgtcaccggtctaaccgtcggtgtctcgccagtctaaccgctgcctcctagccagtctaaaccatcgggatccagaaaaacacgtattgacgaaactcttgtgagtagatcaactttattccatcaatatgtgtctacaagtgcatctaaagcactcctctctcaactgacgaactagggttgaaaccttgaggcaaaccctaacttttctctccgaaaaaatcgatatcttcccatctcaacccctcatctatttataccctcaatgtgattgcccctatccacgaatccaactagaactaggactcctaatcacataggaaacctaccaaacaagggaaacaacatccccatacaactccatactccaatctttccaaacttggactccaatccaaatttgactcatctttccatgtgcacacaataccacgtgtatgccatatggaaacattcatctccacatgcattgttctatagactgagcatcccgtgtgctatccttgaccgtctagaccacaatttatcccaagcctagtggctagtcccgatccatcgctggctatactcccatggcctcaagcaacacctgcacatgaacaacaaagaaactccatatccgagtataagtttgcaccaacttgatcactcacattagcacacaatagtatcacatacaaatagataccatctagaagtcataaacataaagcaatctagacaatccacgaagacaacccgaaaccaacttcctcctggagtctactagtttgactgtcggactatccagtcagaccacccaatcaccaccggtctgaccggtggtacccgtccggtctgaactgcctcccagagtggacaacatcgttctcaaaccaaaaacactattcactatattttcaacaaacactcacctttgacaattgttcatcatgacgattaaatcatcaaatgctactacagtgcggaggtgggagacaagtccgctatgaagaagattagggtagttt

SEQ ID NO: 4612 - DNA, 1501 bp, Oryza sativa
actgaattatgctcttcctagctcaagtacacaacatagtgatagtacatgtaatatggatgcaataactgatagtgataattctaccattgccgtcactactagtctacttcctccatttcataatgtaagtctttctagcattacccacattcatatagatgttaatgaatctagatatagaagttaataaatctagacatatgtatgtgtctagattcattaacatatatatgaatatgagcaaaagtcttacattacgaaacggagggagtactacacttgtacacacgtcttcttgttcttcttaattctatgtgtgcaattgtgtgttgtggtatgaccagatcaatggaaggggcaaaactaaaccttaatccatctgttttttaatatatgacatcattgactttttgagatacgattgatcattcattttattcaaaaaatttatgtaattatcatttatttattgtgacttgatttatcgtcaaatgttttctaaacatgacttaatttttttagatttgctatagtccaataaaaagtacctcgaggtaccggtacctcacggtaccaaatcgttttcgattgttggatctaacaatgtccatactgtccagctagatccaacgatcggaaacgattcagtaccgtaatgtaccggtacctcgaggtactttttgctggaccggagaaaatctctaaacttttttatatttgcaaaaaagttttataagatgaatggttaaacgttgccaaaacgtcgttgacgttagatattaaaaaacagaggtagtaaaagaagagatgagatgcaggcgagagagagagagggggggggggtgttcatggtcacattcacatactagtacacaagtgcaaagtgctaattaagtatacgatatgtaatcagctactagaaatgtatggcagctgctgcagtagagcctgggctggtgctcaagctcaagagagctagtggtagtacgagtagtagtcaagactcaagacgactcagagctgatagatgctctgaaacaagctgagcaaagtgcatggtgtgtgtgtgtgtgtcgctgttccactgtgttcatgtacatttacatcactgtactctattttgtctcttctttcaccagctgctgcttggcctctttattattggccatacccatagctttatgctctctctctcgctctcagatatggcatttgatgaaatggatatggtacattgataaactgttaacaagtgtccagggcgtggtgggcccactggaaaggtgtaggtgctctagtggtgagcgaatgataaagggcatcatggtgaggcactgaggccctattacgtgagggcaggggggcagggtacgggatactgtaagtccacgtggtgagaggcatatgctcctacaaaatctgggagggggctgatagaaaaattcggagtaggacaagttgataatcgatcagtaggtcacccttgtggcttggatat

SEQ ID NO: 4613 - DNA, 1501 bp, Oryza sativa
caccatgatgccctttatcattcgctcaccactagagcacctacacctttccagtgggcccaccacgccctggacacttgttaacagtttatcaatgtaccatatccatttcatcaaatgccatatctgagagcgagagagagagcataaagctatgggtatggccaataataaagaggccaagcagcagctggtgaaagaagagacaaaatagagtacagtgatgtaaatgtacatgaacacagtggaacagcgacacacacacacacaccatgcactttgctcagcttgtttcagagcatctatcagctctgagtcgtcttgagtcttgactactactcgtactaccactagctctcttgagcttgagcaccagcccaggctctactgcagcagctgccatacatttctagtagctgattacatatcgtatacttaattagcactttgcacttgtgtactagtatgtgaatgtgaccatgaacaccccccccccctctctctctctcgcctgcatctcatctcttcttttactacctctgttttttaatatctaacgtcaacgacgttttggcaacgtttaaccattcatcttataaaacttttttgcaaatataaaaaagtttagagattttctccggtccagcaaaaagtacctcgaggtaccggtacattacggtactgaatcgtttccgatcgttggatctagctggacagtatggacattgttagatccaacaatcgaaaacgatttggtaccgtgaggtaccggtacctcgaggtactttttattggactatagcaaatctaaaaaaattaagtcatgtttagaaaacatttgacgataaatcaagtcacaataaataaatgataattacataaattttttgaataaaatgaatgatcaatcgtatctcaaaaagtcaatgatgtcatatattaaaaaacagatggattaaggtttagttttgccccttccattgatctggtcataccacaacacacaattgcacacatagaattaagaagaacaagaagacgtgtgtacaagtgtagtactccctccgtttcgtaatgtaagacttttgctcatattcatatatatgttaatgaatctagacacatacatatgtctagatttattaacttctatatctagattcattaacatctatatgaatgtgggtaatgctagaaagacttacattatgaaatggaggaagtagactagtagtgacggcaatggtagaattatcactatcagttattgcatccatattacatgtactatcactatgttgtgtacttgagctaggaagagcataattcagtttctgcctgatataaagacacacataatctcaagtggagttgttattggttggggttagtgctatcttcagcttcactaatgatacctccttaccctaacaacaaccttcaccatcaccaccaccattgcagctcaaaccaagaaccacacttaccattacatccacca

SEQ ID NO: 4614 - DNA, 1501 bp, Oryza sativa
atttagtgcattaattgtttagaaatcttattgtctctactattgtaggagaatagtctctagtgatattaattaatatagagagctcatattagactctacctttatacatgcccttagttgaattttcgctacctttgaaacggggacattatctggcatgttataacaatattatcatggttaatttcgtgttctagcaaccgatcttcgaaacgacatatttttttccccttttgtaactgcatgcgaaaatgtaattcaatttttgcagacacgactaattatgatccgtctgtagtttatagggtcctcgtacataaagatggttttcgtagtagagactgttcacacgctgacgcatgctgccgttcaactcttcatcgtacatggaacataaagtgacggcctgtcagtcgtcgcaactgcatttcactccatgattccagctagcccctcgcaaatgagaagaggggggattttattcgaaatgattcatgaaattttgagctaggatatgaatatgatcccatcaagctagctgatcgagaaaatggtctttcgatcgatcgcaattcgcaagataaattcattgattacacacgcatcaattcaatttgacataatctgtttctggtacacatgcatgtggcatctggtcgtcgtgaggttgcaaatacgtcgccgccgtttattttgccggcggcggcggcggcagcagggtaggcgcagggcctatcggcggcgaggacaccggcgccggcggtggcggcgtcacctggttctgcgtgctgagtagcctccggccagcaccgtgctgcggcggcggcggcggcgcatcgccgacggcgaggtgatctatgtacgtatacatatatgcatgaacagatcagcatatgtatgtatattcagagattttcagaatgtcaagaacaatgttgtaaacaacaatatgtgcatttacctgataatgcgctagcatccaaggaatattgtgggcgtgagacaacgacaagcagcagagtgattagcagcagcagcagagacgatgaccttggagcaaatgagccacacattgttgccactgaaaaaaaaatggaaaattgatcaaggagctacttgttagtactctacttgattgtgtaggcttaattagatgaagaaaatgtgtaggcctggcgatcaagggaggtagccaaagggagggtatttatacaagtgaaggaactggattcctggaagcctggaggccagcagcccagcaccaagaaagtactaggaaactatacctaggtattattgtcttctctataaactagctaaatgcctgtattttgttacagataaaaaaaattatagtaatatctaaaataaataaaagtttatttctcatgaaacgtgttatatatctttttgctataggaaatatgtggctgccatttaattattgattgtttttatatgaataagaaattcaaaggctaatttgtaaaatttacaa

SEQ ID NO: 4615 - DNA, 1501 bp, Oryza sativa
accatgcaccagcagtatcaggcccctccagttccacagccacaggcacccccagcgccgcctcagcagtaccaaaccccaccccaatttcctcaatattcacaaccgcctcagtctggaatggttaacccttcgaccccactcccacccgctgcaccccagcagccagaagaagccatgtcgtatgcacctccacagagctatccaccaaatgtccgccctccttcaccttatatgccaccgcctagtggacctgcccctcctttctatgggcaaaaccaaagcatgtatgaacctcctgtgggcaggccaaactctggcccaccaccgtcctatggtgctggcgggtacgggccacagggaggaagtggtttctctgaatcatatggttacagcggatccccttcacaccgtggcaatgcagggatgaagtcgtcaccctcaccttttgctccctcagggccatcatctgggggaagtggcaactatggcaggctccccacagcccaaatactaccacaagcagtgcctatcaattccagcccaagtggttcctctggcaacagggtgccggttgatgatgtagttgagaaggttgcaacaatgggattctcaagagagcaagtgagggcaactgtgcggaggctgaccgagaatgggcagaatgtggatctgaacgtggtgctcgacaagctgatgaacgacagcgatgtacagcagccccagaaaggatggttcggtcgataagttgtgatgcgcatcattggtgctcgatgttctcatttctcagtctgtgtataatactattgaatatgcttgcttgcgcacaacctcggaattcttcagatttttatatggcctggaactggaagaactgaacaggcaattataggttggtttgctgcctgccctcagttgcttacccttggtgaaaacatgcaactacagtcaacaggtgttgttaatgagtttggtagtgtctctctggatacccttgttcttttctataaatctattatatacatgtaatgacggtatattaaatcataaccatggctttcctgtgttctgtcaataaaaccatcttgagcatattgctgagccccatttgtgtccttcaaatccgtactgtcaaccaactgttatcaatcaagttgatcagcacgatgtgatttctgttcaccttcaagatgtcgcctgaacatatgaatatatgatctccaaatttgaaggtggcaaaactgtgccaaggtgtcatactagggtgacatgcactaatacacaagttgcaatccatcaaagcctccccacaatgtaggcacaggcccaactaggtccacaatgtaggcacaggcccgtctcccagttgggccgcgaggactggtggcccaactttaccaccatccaagctggccgtccttgtcgtttctggtttctgaccctactgttctgatcaagaaaaagaaaatggtttataagcatttctgccgactcgagctca

SEQ ID NO: 4616 - DNA, 1501 bp, Oryza sativa
gaaggtaacatgttctctactatatactagataatgtttttttatattttttatagactctacattatatttcttttgaaagaaaataggctagtagtaaccatgggagaagggattggtttaatctaatccatcaaattaaagggacggcttggattaagtaaatccacctggtggatttgaaggcaactacaggggatccactcatccacacccttgccgtccttgatgtgatctcctaccaagctgtgtatcatgtcctgcaagcctgcaccagatagatggctcatggctgcataatttcctgcactatgcacacaaaaacaaagagataaagcataaatcgatgctgatgacttgcatgttccattaaaaaaattggcatgcagaaatattaaaatctcttaattgccatgctattggattagtacactaaaataattgaaatttgtctaatcttttttctaaaataatatatcccgtccttttcagaaactaaaaccatgtgccctctcgatcttaagctattttcagtgtcaccttaattaattatgttttcgagggccatccctgcagctaatcaattaatgccaagcatgcatgcatctagatgctgtataccaagttgtaatttggtagtaatggcgccgtaacagtagagatgagcagttgcgatgttggattcagcgataccttgaccaatcatcttgcaagaacaagtacttaatgagaggtttagtaccaaattaggctaattggagccaccacaatcttgtcctgcctacacatgcacacagtataagtcctatattcagaattcagagcagctaatcgcatgtgtacatatctatatatacatgataaaagaaatactcgatcagatacaaacaatttatcacatgctagctcaaagacctagaatgcctttacacaagccaagtactagtacttgcgtgcagtcttgctcatgcacagggtgttcatgatggatatgttcagaatatcatcacaatacatatacctagaactacacacacatggtccatatgtattaatgtaggagtacaacaaattcatgggataccttgaccatacttgggtacaaacacatagaatataataagactatcaggttaacacaatgccaacacaggatttgttttgtctgttcatacatgcatgcaagtacagatactcctgccccccttccctagcttctcctacaggtagggcaatgtgcagtagcctatagctacacatatatttgtatatacaattaattaattatattatttatacacatatatgcatctactatatatatgtgtgtgtgcataggctcacttaagtaagcagtctattcttcagcagatccaatcatcacatactaagtaagctccagctgctaatctttctctctgaattctccatcacacagtagacatcagcaggagtagtactagctagctaagctcaagaatggtgcggaagccgacgagta

SEQ ID NO: 4617 - DNA, 1501 bp, Oryza sativa
cgctaagagcacatatgtaaaagttttacccataaataattcttttctaatacacaaacattggtatttatattaaaaaacataaagggtggcagatggcgcggctgcttgcgcgtgccacgtcggataggaacagtgcgcggcgtggaaattttgcaaaaaaaaaaacccttccattttgtgtttaattcagtgtaggtccctcccgaatagtacatttcagccaatagtttacatggaggcccttataaaagccggatatttcatgcgaagaaaaaaaagtgatgtaaaatgtggaagacgagtgtaggattaggatgaaaacgaagagagaaatactgtgctcctgtcacaccatcctccaccaatctctctcgttgggtaaattgggaacgagcaaaggcggagacgcttctcccgccaaaaagcttgttactggctataatggctactgggtgagtctattgggcttagtgggccggctcatttatatacattcagcacgtgcgtggtaatcccgtgtcggcccattatacaaaccagcccatctgtctgtagcgaggtttgttttgggggttgctaatgggcctattttgcggcctttggtttgagggccacattattatccatttggtaaggttgggcacatacgtggccaccgatggttgagccgtcgaagagcggtggccggagtcgctcttgcgatgcgtggtgagtggtgactgtaatgtaatggaaggttcaggtctaacgctactggcattgctattcagcaggagcaggcaagatccctgacccttgtggcctgcgtcctcctcctggaccttctccccttcccatggcgtcgcgatctcttgaagcaagcaatcaagattgttcatctgaaattgcccttgctatttcagttagtactatttctgcaagccatcctactctatttgaagcaaccagatgttgattgttgctagttttgcattgtcttttgctactgagccgatctgacaatgttgatataaaggataacttgtactccattagggttctttatctgaattttggacagcctgaatgtctgaaccaggtaaccatactactgaacagaactttatgaccattttcttgaactgatctttctacagcatatccaattatccattgccattatagcgaaagcagtatattagttgtgtgactgtgacgcctgtcagtgtggactgtgtcatacattagcagccgctgacccctgcattaataaaccagcaccttatcttgctcatctttatttctagtttgaggcagtctcgcgactcagtctaagctcagtcttcttttttcttcttctttgtttgacggaacaaaaatctcaggcatgatatgatattctgatctgttcatgagttcatctgtatctcagtgtacatgcatttgcaaagcaaaaattccattttgttttgactagtaagcacaaagaattgtttctttttgactacgcaagcaaatt

SEQ ID NO: 4618 - DNA, 1501 bp, Oryza sativa
gccgtctcggcgcttcgatcacgagccgacctcgccgtacacggggcgatcgatcgcctcgcggccgttggattggcgagtcagtcttgtgccgcccccccccccccccccccctcctttcgctttcgcatgcagatcgatgtggtgcgttcgttggacaatcggaggaccgactccgtcacaggatatatggagatggagatgcttttctgtccgcgtccaactcctctgtccgtctgctgtacgggcacgatatttgttcttgtgctctagctgcaactgcttgcattggatcgattctttttgggagaattccccagcctctttgcattggatcgattctttttgggagtgtcttttttcgctactgcaaattgcagcgcgctcaatcatatgaagcatggtagtatactgtattactgtgctacttggcctgcggggccgtggatcaaatcaggttatgaatcgcgagacgcgagatctatcgtgggagggtgtaccacccggccaaaaaatatcggaacagaacacatggcgccgagacgagatccaatgttttgcccatcatagcgatcacgcgccttgatgctttagagctatcgagccctctcttttgggccttttggaggcagatcaatgagaggcccaagtgagggttcttctctataacgcttcatttgtaggcctccgtaagctctttgttggcccggataacgagttcggaataagcctattgtccgtttctcatttattcctccttattgaatcgtctcctgcaacagcaaaactaggtacaatacctccctaatttttaaaaatcagcacaaatcgacttcttcggtgggttgaaaaatagtttgctaacatagcaagttgaccgagattgacttgctgactcaataggtgtgacccacatgtcgggggtggcgtcggttgggcctcatcatgctgcaccgcaccacatgcaaggcatcacggctgttggcttagtgacaagagtatggaagagaggagagtcgctaacatgtgggttcatctgttggctcagcgagttacttgtagtcaatctgccacatcaataaaaaaaacacttcccaaactacccaaagaatcgatttgcactattttttaaagatgtgtgagatattatacctgattttatggttgagagagttgattcaaaccattcaatcaagaaaagagataagagacgcaaaatagacttattctaacgagttttctgctccatgaacaatggattcatggagctttggaaaatgggccttaaatggtgtggtagggttgtgggttatactgctatatcacttatggccggtcatctacttccatttcaattctcaatatctattcggctaagaacaaaaaatccatctcattttattaagtaagaacactactcaactgagattttttttttacaaactcatgtacaaggaggtatacttacctctataaacattcacacgtattgacatatcct

SEQ ID NO: 4619 - DNA, 1501 bp, Oryza sativa
tacctctatcgattccattttcatttttcggggggaattaattggaaccagaaaccttggatgttgagacggaatcaaatattgtcgaaaccgaaaacatagagaatactaactgacacggatactgtaacgaaaatttattgaaatacaacccccccccccccctcacctcaaactgagcttcaaactttatcaagtccaattacaatctcaagtctcaacattcaacggtacatcacaaaacacaattaattagaatgctaacgtgaattgggttgggctattattagggtatatggacatggtatggaccttttctcctatttgggagagtttctagctgctatagcttcttcaagaagttccagctcctaaacagtttaaattctcctagattctaaaaatttggagttataaaatctagaaaataaactagaagccggatttctcagctttatgggtatgatccgactagtcaactcaagtcggaatatgactctgcttcttttttcttatttggagctctttctttatttattcagaacttttgccatatgtataaggcttgattcaatattggacttggtatatagtgggtcgcgttgtacacaagtatagggtatcccatatttagaacactaacctatacaataactgaacatctaattttattatagcactttttaggattagtctatatatattgttttagtgtattcaaactaaatatttttgaaatgattgatagtcaaagttgtaatagtttgatcccaacaacatcaagaattgtgaaattggaaggagtataaaaaataacgaaatgaggaatctgggggtagaattaaatttatccacttgatggattgatggatgcttcttagataatgagcttgatgccaactgtctgaaacatgtgttaagcttctctatttaatttgatggtcaagctggtggcttcaaaggtacaacctctaactctatttatatgtcacggtgtttcttattgtatacctcctccgttccttaatacaagggattttatcattttgcttgtactgtttgatcactcgtcttatttaaaaattttgtgcaactgtagaaaacgaaaagttgtgcttaaagtactttggataataaaataagtcacaaataaaataaataataattctaattttttttgaataagatgaatagttaaacagtgtaagtaaaatgtcaaaatccctcgtattaagggacggagggagtatgttcaagtgattggctaagtctgtcaaagctacggtgtttcttgttgtatatatatagattcatatgtcaacttacaatgtgttccgcttcgagtcgagctaatttctggccagagtacgcaagtgcgcggggtctcgagcagagatcaaagtggtgccatctggaggtcgatcatcgctgtaagcttgctcggtctcgatcggcttaacttcgtattgaggtacgtatacgctctgatcagcctttatac

SEQ ID NO: 4620 - DNA, 1501 bp, Oryza sativa
gcgtccaccgccgccgccaccactactggagctgccccagccgctgccaccacccctgcagctgccaccaccacagcagctaccgccgtcgccgccgccgccgccgccgtcgccttccaccgtaggcagccacgcccgcggcttgccgtcgcaggtcaccatcgccggtcatcgttcggccagatctggcctgccacggtcgccacatcgccgtggtcgctagctgccgccatcaccagacgtcactgccgccatcaccagacgtcactgccgccgtcgccaccaccagcggacggccaccactagaagccgccgccgcctcaccacgctgccccaccgccggccgcctccccaccagatctagccgcggcggcccagatctgggcggtcttcacaccgtcccgtgctgccccccactgccggcgcgacgagagaatgaagccccgccgccgccatccttgcggccgctcgggcggcggcgcggcggaggaggaaggagggggggcgacgcggggttgccgcctcccgtgtcgcccgtgagggaggacgacgcggaagaagttgtgtaacacagtatattttgaagtttctcgtcggttatttggtttcatggtaggcaactagcctctagccattaattggttactcctagtactgcctgcctgttaattctcttcttgcctgtagaagagtctattgtcgcaaggcaacatgccaacatgagacctgaaaaggaataagtcaattgttggcagggttatggataacacatatccaaaagtaatcgactaaactcggcagaacccaccatatattaagtcttatatggaatcatgccttgtatatatagaaggagttccggataaggaagaacaaatagagttcaagctggaaacgataaggactacccatattgtatcatatttatctccctagttttacttggacaaggggacatatatgggtataaatacaataccccagaaggagagacaacacaaaaccaagacaagcctgaacaaaccaatacacaccgctagacatcgacatcggagattagcctagacatacccaatctagtgccatcggaggccgtcaagagggatttagtgttatctctgatctggccgagtatgtattcgaggaggaagactaccctgtcgtcaactacgtgttggtgtttatgtcgccaagttgacgacgactagataggctatcccaattattgtacttgtgagattctgatgaataaaagcaacaccggcttcgaccaacaggagtaaggctattacctgattctgatgaatgaggggcccaaacctatataaaaatcattatctctgtctctttaaccttaatctcacatataccctgataccaacgatccccacaccatgcaaataccgtagtcgtgatctaaaacatcgacaatttggactccctcaactataactccaatatgattcatatccttaaaccgtaataccggatatcttgaccc

SEQ ID NO: 4621 - DNA, 1501 bp, Oryza sativa
aataaaagggcatagtttccataatttcaggcattaaatagataaagaaattaagtctacttatcataccatatcatttactccctccattccatattcattaccatataactttttcaccaagaaaaaaaaggattaactttcctatatttcatttaatgtgagtatgtggtagggaaaaatcaagaaacatgcacactttaactcctcttaggccccatacataagagcaggtccagttattgacacattttgaggagataaaacagaagagagaagagcagtgggctatagatttgtagccagctgtagtacagactcccagatacatgtgtgtatgacaggtgcgaccaagtataaattgtgtagtaatgtttataggagtatatgaatttcctactaaattgactatagatgatttggagtcagtggttgactatcttattaaacttgctctaagaaacgatagctttactacctcgaattcctacatacatgcatgcatactcaattttcatgcttaaatgcaataatattacacgtcaaacgaaggggctatgataacatgatgatcaatttgaaaatttcaatttgtgttaaatgatgatcaatatgaaacggatggagtatttcatcctggctggtctattatgcggcaaagccgcatctagtttaatctctgtggtaggaccactatatacaaccgttaatgaaagaatgtgcggtacagatgcatgcaacggcaatgtttgccgtcagcccgaaaggcagacgatgtgaaccccagtcgggttcgctcgtgtttaacggcatccgccgcggtgagtcccaagtcaaaaaccacacgaatcctgtccacccgttcggtcgtccccccgcccccggtcggtcgtccaccccctcgtcggtcgtccacgcaacgcaaccaaacgtgacaaaaaatttctgaggccctcctcgatcgccacgcctccgagcgccacgcgttgcatataaacggccacggccacggcccccgcgcgcgtctcgtctcgtctccccctccgtttccgtcaccgggcgcgcgacagcgtcacgccgcgaggtccagctctagcggcacagctcgtcagctccaacgtccaggtacgaccagaagaaagaaagacgaggagaaacccaagagagatacgtagagtgtagagagagagggggggccttcgtttctccgcaacccaccaccatcccgcctgatttgcatcctccaccagctgaagccggcagcaaagtcagaaaggtgtttgttgttgttggaggcttggagcgcgcgcgggcagggggagggggaggtgagccgtggccgtcatggcccagctgcatatatacgccagctgcggctgcgcacgcgcccgcgctgcgatcccgcttcccgcgcaggctcaggcatccgctgcggctctaccttgggtgatgtccgtgacttcgccgccgctgctccggcgaggagggtgggcgatgggcg

SEQ ID NO: 4622 - DNA, 1008 bp, Oryza sativa
ccgccccgccgtcatcgccgtcgtcatcgcccggcccccgcccctccgcgcgcaagccgccaagggacggaggcagcgcccctcctccctctgccgcgtcgcccccgctcccctcctcctttttcccgaatcggcaaaagggcaagcccctttctccccctcctttttttcccctttttcccccgccggcgtcatcctcctgccgccgctttggctgcaagcgccgagcgccagctcgcgccttaaccgtccaatgtcggttcccctctcccaaaccgacattgccgtccatttaagcccaagccctccccctccaaactccctcattttcgcctccgcgccattgccgccctctgtttcgccgtcgccgatcgtcgttgcgcgtgtcggaggagccggcacgagcaaggaccagttgcgcctcgatattcgtgcgctctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccaggtgtacggtttcccgctctcgcacttaaggaccgattcccttggaatttcatccaaacataagacaagtacgaccacatgggtggaatgggacacccctggctgagtaactagcttatcaggggagccttgatgccgagagacatgtggattcgccggggtggtgtcggggaggatccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgctcgaacagccgtgcccacggtca

SEQ ID NO: 4623 - DNA, 1057 bp, Oryza sativa
aggtaagattagggttcgtttgatccgtgcggatcttgtgcttttctttctttggatttctttccccgaaacgatctaaacactagggttgctctgataccattgttaaactttgcgctagaatcacccaggttagatctagtcgggtggttctatttggatttgatgtatgacattgtagatgaaagggagagggtttagataccgaccggttgaggagttcgtggaggaagaggcgtgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagcgaggacttggaccaatcatcacaggcgcgacttgggaactagggcgaaaccctaaaactcatcgtagccgacttgctcctggaagaactcctcgtcagcaggatccacttcatcttcttcagcaactgggggggttatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgcatcaatctttagaattgaaacaagattggcacccggccaacagcttttcaaacggccacccgggccaacaacttttcaaacggccacccgggcctagctgatcccgtcagctgctgatttttcaaacatcgaatccccttttcacaacagcaatttcacaagcagtagtcaaacaaaactacgctaggaatcacctcacatccgcccatgaccgtgggcacggctgttcgagcagtttgttaacctctgcagagggggtacactttacccaca

SEQ ID NO: 4624 - DNA, 1501 bp, Oryza sativa
ttgcacttgagtccggctaaccatggactcacgagtcagtggcggatgtatcctttggggtttgttagggctggagctccacctccacagtgacagcaacccctccccccctcccccctcgggcggctcaaatcctggcccattcactactataaaaaaacgtttttccatgcagccaaaacacgttttcgtaggtggccaaaccttccgactgtatctaaaggcctgtcaaaatcctcaatttttactggcggaccaaagcactgctcgcaggcagcagtttcaatcttcccaggcgttgcttgcgaaaatactcttggcgccaaaaaaatttcccgccagccccgccccctccctagggtttcaaatcacaaattctcttaaatctcatccaggaaacaaaatccaatcataaacatccatacatcaacacaagagcattggattcaaatccatagcatcaacttgcaaattaacatcaatcaacatgtaaactaaaaaaaacaacgtcgtcgttaccggcaaactcctccgtgcctcctccgctaccgcacgcaacggcagatccggccggagggaggggacagccgcgccgccgccgctgctgccctccccctctggcgggatctaggagggagaggaaaatgggggagggggggccctccaagcgttgccgttgcatgcggtgaccgccgtcaccgccctccccactccggccggatcagggagggagggaggtgtccgccgccaccaccgccctcctttctcctcgtaggggccggatctgggagagggaggggaggggagccgccacggcgttgttgtcgccctcgtccgcgctgccgtcgccgtctctcctcctcctccggccagatctaggagcgggaagagagaaagggggagctgccactgccgtcgctcctcctcccctggccagatctaggagcggagagggagagagagggagtcgtcgcaccgtcatcgccctcccctcctccggtcggattgggagggagggagggagggaaggggaaagtgaggttgagaggtggagatagaggggcggggagaacggagtgagcgtaccgtgtgagatgagggagggagtaatatgggagtacgtaagtgtgggcgatttttataagttattatttttttaggcggacgtcttaaggtcctgcctgcaaaaataacaataatctcgtcctatgaaaaatccaacaaataagaacaacatgtcaagacacgttttagatcctagtgaaactgtttatttgtgattataattggaattataatgctaaactctatatttaatttgatctgcaggtcattgatgcatttttatgtgtttatgccatcgtatttgattaacaagtaccgacagttgattccttagtttattttttcttttctatatacaaaatttaaattatatttgcatgagaccgacaaatgtatattttttaaatgtttttattgcattgtgggttggacatag

SEQ ID NO: 4625 - DNA, 1501 bp, Oryza sativa
tacgtgtgaatgtttatagaggtaagtatacctccttgtacatgagtttgtaaaaaaaaaatctcagttgagtagtgttcttacttaataaaatgagatggattttttgttcttagccgaatagatattgagaattgaaatggaagtagatgaccggccataagtgatatagcagtataacccacaaccctaccacaccatttaaggcccattttccaaagctccatgaatccattgttcatggagcagaaaactcgttagaataagtctattttgcgtctcttatctcttttcttgattgaatggtttgaatcaactctctcaaccataaaatcaggtataatatctcacacatctttaaaaaatagtgcaaatcgattctttgggtagtttgggaagtgttttttttattgatgtggcagattgactacaagtaactcgctgagccaacagatgaacccacatgttagcgactctcctctcttccatactcttgtcactaagccaacagccgtgatgccttgcatgtggtgcggtgcagcatgatgaggcccaaccgacgccacccccgacatgtgggtcacacctattgagtcagcaagtcaatctcggtcaacttgctatgttagcaaactatttttcaacccaccgaagaagtcgatttgtgctgatttttaaaaattagggaggtattgtacctagttttgctgttgcaggagacgattcaataaggaggaataaatgagaaacggacaataggcttattccgaactcgttatccgggccaacaaagagcttacggaggcctacaaatgaagcgttatagagaagaaccctcacttgggcctctcattgatctgcctccaaaaggcccaaaagagagggctcgatagctctaaagcatcaaggcgcgtgatcgctatgatgggcaaaacattggatctcgtctcggcgccatgtgttctgttccgatattttttggccgggtggtacaccctcccacgatagatctcgcgtctcgcgattcataacctgatttgatccacggccccgcaggccaagtagcacagtaatacagtatactaccatgcttcatatgattgagcgcgctgcaatttgcagtagcgaaaaaagacactcccaaaaagaatcgatccaatgcaaagaggctggggaattctcccaaaaagaatcgatccaatgcaagcagttgcagctagagcacaagaacaaatatcgtgcccgtacagcagacggacagaggagttggacgcggacagaaaagcatctccatctccatatatcctgtgacggagtcggtcctccgattgtccaacgaacgcaccacatcgatctgcatgcgaaagcgaaaggaggggggggggggggggggggcggcacaagactgactcgccaatccaacggccgcgaggcgatcgatcgccccgtgtacggcgaggtcggctcgtgatcgaagcgccgagacggcgtccgagctgtg

SEQ ID NO: 4626 - DNA, 1501 bp, Oryza sativa
tcattctcctcctacggccgaccttctcggacctgctccatcgtgggcggctcgcgcccttccttactctgctccgctgcgctgcgcgcacgccagcctcaccgtctcattcgtcgtctcgagctcgtcgcggcggaggagatggcgaggacggcgaggagagtcgcatcgtcgtcgccaactgcggccactcccacagcggaggacggccaggacggcgggggcggcggagaacgtggagaaggagacggcgaggatggcaagagcggccgccatggcactcgcggcgggagcggcaaaggatggcgaggagaaaagccgcgtcaaagtcgccaactgcggccactcccgcggcggaatgtctccatggtgctcgacaccagcttcacctctgccgccatccgcgatgttgacttgtaccgcgccgagccctgggacctcctaccgccgcgttagtccatcgtcatgcacgctttggcctgagatcgactgcgacgacattgcttgcacgaggagcttcgggtgcccatcgggaatgaggacgaacagggccacgacgacatgaacaggggcacctttccttcatctcccaaggtgtgacatgtgagagaggagagatagcaatgctgacatgtgggcccaaaggcatttttgaaatttcacgcgatttctctcttctcttcaaccggaaattattattctaattggcgcgatgtccatcggcaaattaccacgtttatagagtgttttcccccaaaagtgagctcgggcggtgtccttgggctaaaaccacacaatagcagtatcctgtagcaaaatttgccatcatctaaaatggacaatacatgttctcagcttaaaagtgaacatatcttatgcatacatgtagatggtatataatatgatacatactacatattacatatgaggtttagattttattacatgtaggtgtccaactatttgcaaatgctccctccgttctataaaaaaaaatcaacttttggatatgaatcacgtcatgtctggattcgtaatcagaagtaagtctattatgggactgaggcagtacatgaacaattttcttcatataactctttaatgacatttgctagttgatggacgacaaaatgtgcacgcaaagcttagttgtatgcacgaagtgtgcaacaaaaaagggcatcggttcatttgtgcccaagagtcagaagaaaactagagaatccctttgatagaatatttgaaagatcctagtcttagggttgatcaaaaaattcggcggcaagtattcaaatatactttgcttgatgggagttgtatcgtcgaaatataagttgggtgttgttaaagtgcttagataatgatcaatccaaggttgctatgggagaagtgtgtgaagggatttgtggaacttatcaatcagcccataagatgaattgattacttaggagagcgggattttattggccgaaaatgattgatgattatttcaaatattata

SEQ ID NO: 4627 - DNA, 1501 bp, Oryza sativa
aagacgaacggtcaaacatgtgctaaaaagttaacggtgtcaaacattttgaaacggagggagtatatactaaaagttcattaaacatcctataaacactcctagattgccatgtggcactctacaaacgctcttaaatcgccatgtgtcattctaataaattaaaaggaaattcaagaaaaaacaaaatatctaaccgtagatttttattaaatctggtggacccattatttacaaccgttagatctattttaagaaaataaatatatgcctcccaaacctggccccacccagagcctatacttggacgtacgtacgtacatcacgtacgcccctatccctcaatccctttctcctattttccttcaattatctctcctattttcatgctatattaagttaaaaagcataatttgtgttaaaaattaaacatatctgaaaataaaaatttgtacaatatattgaaattcctacaatatattcatagtagatacttaaaaatatgaataaataatagcttcatgactaacctaataatgttattttgacttatcataatttcagaatggggagtgtaatttttttaaacataattttactttcattatcattacaggactaattaattgttgtgaagctatatatgtaggatgataaaataatatcaattttttatatttttatataattgtttgaatgacacgtaaaaatcaacaaatataacccaaaagtaacacatttctttgaatgttaacatatagtgaatatgggcctttaactataaatttagacatagataatataatttaacaaaataagtggataaaaagtagttgtataatttcattcctattgtttttatgaatttttattatcacaaattttgctttccaattgtataataagaaaataggatagggaatagaacatacagataaacgacatgaataagggggaggggcggacaatgggactaagcatgaccacgcgccatgtatagtcctgtgtagggttttagatgtggattttttttaatctattggttgaaaataatggatttatcatagtattaaattaaaattgatgcctagatgtgttttcatataattcgtagaaatatctcataatatattgaagtatagtatcaggtggtggatgtgaaattaattatgaagtaaattatttttgcaaggttattaatttttatgtggtggctaagtatactaattttgaattatgcagcaaattcttaggttaataataataatacatcaatttttaagttaaaatacatctcaatatgggtcttaaattgcatcgtggacaaagacaaagttaattaggtaattatgcctctctgcggcaagcttgcaattgcaccaatctccagtagtcataattttctatgatgaattacgtcagctatcaatcgattatgtctgctagtaaataataaattaattattgattttttacacgaattggtagaacaattaattac

SEQ ID NO: 4628 - DNA, 1501 bp, Oryza sativa
cccaaggtagagccgcagcggatgcctgagcctgcgcgggaagcgggatcgcagcgcgggcgcgtgcgcagccgcagctggcgtatatatgcagctgggccatgacggccacggctcacctccccctccccctgcccgcgcgcgctccaagcctccaacaacaacaaacacctttctgactttgctgccggcttcagctggtggaggatgcaaatcaggcgggatggtggtgggttgcggagaaacgaaggccccccctctctctctacactctacgtatctctcttgggtttctcctcgtctttctttcttctggtcgtacctggacgttggagctgacgagctgtgccgctagagctggacctcgcggcgtgacgctgtcgcgcgcccggtgacggaaacggagggggagacgagacgagacgcgcgcgggggccgtggccgtggccgtttatatgcaacgcgtggcgctcggaggcgtggcgatcgaggagggcctcagaaattttttgtcacgtttggttgcgttgcgtggacgaccgacgagggggtggacgaccgaccgggggcggggggacgaccgaacgggtggacaggattcgtgtggtttttgacttgggactcaccgcggcggatgccgttaaacacgagcgaacccgactggggttcacatcgtctgcctttcgggctgacggcaaacattgccgttgcatgcatctgtaccgcacattctttcattaacggttgtatatagtggtcctaccacagagattaaactagatgcggctttgccgcataatagaccagccaggatgaaatactccatccgtttcatattgatcatcatttaacacaaattgaaattttcaaattgatcatcatgttatcatagccccttcgtttgacgtgtaatattattgcatttaagcatgaaaattgagtatgcatgcatgtatgtaggaattcgaggtagtaaagctatcgtttcttagagcaagtttaataagatagtcaaccactgactccaaatcatctatagtcaatttagtaggaaattcatatactcctataaacattactacacaatttatacttggtcgcacctgtcatacacacatgtatctgggagtctgtactacagctggctacaaatctatagcccactgctcttctctcttctgttttatctcctcaaaatgtgtcaataactggacctgctcttatgtatggggcctaagaggagttaaagtgtgcatgtttcttgatttttccctaccacatactcacattaaatgaaatataggaaagttaatccttttttttcttggtgaaaaagttatatggtaatgaatatggaatggagggagtaaatgatatggtatgataagtagacttaatttctttatctatttaatgcctgaaattatggaaactatgcccttttattcatatattaatttaaagcagcgagacattgaattcatagacataagttggaagt

SEQ ID NO: 4629 - DNA, 1501 bp, Oryza sativa
gtgttttcattcaaagttctttccttcaaaatacgattctcctcaggacctttccggaaccaggtagactcctttatcttctggattgaaatccttgtgcttgggttggggtccatgatcttgtacaacaacttctgaagtttgcgtgaaaaccaaccggggcacctgaattcaccatgttgtatcttccgatacatttccatcaagtttgggccctggaaaggaaggtaaccagcaacaagaacaaacaggataacaccacaagaccaaatatctgactttgcaccatcatatcctatcttgctgatcacctctggagctacatatgcaggtgttccacaggtggtatggagtaagccatcttgcctcttcgactctgaaagcgcactcagtccaaagtctgagactttcaggttctcattctcatccaacagcaggttttcaggcttcaagtcccggtgatacacacctcgactgtggcagtaatccactgcactaatgagttgctggaagtacttatgtgcaacaacctctgtaagctttccacgctttgcaaccttttcaaatagctcaccacctttcacatactccatcacaaagtagatcttgttccgtgttgccatgacctcatgaagctgaacaatgttcttatgagccaccaaccgcatggttgtgatctcacgtctgatctgctccgaaagcccgaccttcaacacctgctgtttgtccatcatctttatggccacactctggtttgactccagattccttgcatagtgcaccttgccaaatgttcctttccccaacaatctgcccaactcatacctctccattagtatcttccctctactctccatgcccacaaagatataaatctcagcactatgttttgaccaccaatcagatggactgcaattctttagccatcctccccaaggtcatgatcatgaatggagaacaacattcttatatcatcgtcgtttcggagtctaaatggtgtagaattagtgcaggaaagttgatcactcacatcaagacttgagcagatcagtagcactagtgaaccagcaatctgctttatctcacacggaaaatttcttctatgcaagcacatctttcagcattccttgaggctttcactgctttttttttatcaatttccctgcacaaacaaaaccaggcatcagattcagtaattgaatgtcgctaacaaggtacgtataataatctggaagtctgtaagaactttaaccaaacaaaagtcactacgaagaattttgaaagcttattgtagtactaactgcatttttatataattatacctactacttatataatataagtgttccctataatcaatcagaacttacatgagttcaacgtgttgtgtaatagataatatagataattaatataataaggaactttaactaagtacttatcagaaatctggaatggtaaatcagaagcttttttaaaaaagggaaattgagtttcggaa

SEQ ID NO: 4630 - DNA, 1501 bp, Oryza sativa
gcatccactccacatactaccactcaaaaactctctctctctacccaaacaggttttgagaaagaagtggaggacagatccaaaaagttcaccttttgattatccaaacaagtttggagtttgttacctgaatctcctcttcttcctgtcaccggaaggtatgcagttcctctctccatatcatcttctagcgtttctttctacagattcttgattgctcgcttttttccattattctcttttgctccaacgtaggggtagggccacatcagttggacaagtagaaattgatggcacatcaattgagtagatgcggaaatttctggtttttagttaaagtttagaccatgccgatgccaaagtgctgccgtttaatcgaatacaacgatatatactcttgcaatggcatgtgtcatgaggtgtttgggtttggcgaggctcagttttcattgaatttcccctccttcccatgtggccgtatcaagcctaatctttgaaaaatattcacttcatgtggatgcggaatcactagatgcagcttgactccatgcaaatcctaactcctgccatgtgcccatgtgcctgtcccttatcctgatttgcatctgaattcatttgctcagtaatttgcttgttcagtgcctaatccgatagacgtccaaacaaagttttaattaggagcagaagatccagcaatgttattttttctgaatttgtaatgtcttggtttctgaattcgtaattgactatttttattaatcacctttctgaacctgaacgaaagatgcataatgattcacatcggttgcaaatttactgaatatttcctcttatttctagtgtgttattcatagagttccgaaactcaatttcccttttttaaaaaagcttctgatttaccattccagatttctgataagtacttagttaaagttccttattatattaattatctatattatctattacacaacacgttgaactcatgtaagttctgattgattatagggaacacttatattatataagtagtaggtataattatataaaaatgcagttagtactacaataagctttcaaaattcttcgtagtgacttttgtttggttaaagttcttacagacttccagattattatacgtaccttgttagcgacattcaattactgaatctgatgcctggttttgtttgtgcagggaaattgataaaaaaaaagcagtgaaagcctcaaggaatgctgaaagatgtgcttgcatagaagaaattttccgtgtgagataaagcagattgctggttcactagtgctactgatctgctcaagtcttgatgtgagtgatcaactttcctgcactaattctacaccatttagactccgaaacgacgatgatataagaatgttgttctccattcatgatcatgaccttggggaggatggctaaagaattgcagtccatctgattggtggtcaaaacatagtgctgagatttatatctttgtgggca

SEQ ID NO: 4631 - DNA, 1501 bp, Oryza sativa
cgtttccctaaggaaaaaaaaagcaacgctgaaacatgtggggacttggaattaacatctgtgtgcatgagttgtgagttgtgaatgggaaaggtaaccacttgtaattgtgggcgtgtttagatctctaatttttcttttgccaaaaatatcacatcaaatgtctggacacatgtatagagcattaaatgtggacgaaaaaaacaattgcacagtttgcatgtaaattacgagatgaatcttttgagcctaattgcgttatgatttgacgatgtgatgctacattaaatatttattaatgacagattaattaggcttaataaatttatctaacagtttacaggcggaatttgtaatttgttttgtatacttaaaaaaaattgtgtaaagaactagacacggcctgcatggagtaatttcaccagccgtccaagctagctattcgtctgtcctgttgtttctttcaataccaaagcgaagatggagcagtgatgactgacttgcagagtcttttgagatgagcaagaaatggtctttggagtacttggaataggagtagtagagaaggcaggaaaagtggagtaacctgaaggaaggggggttggatggccaatcagggaggtagcggtgaagcgggtagcagtggaggcggaggtagtcgcgccagttgtgcacggtctccttgcggacgttgaagctggtggagaggcggatcttcttggccgggtcgtcggagtagagcttggccttctcctccgccggcagccggaagaagtcgtgcgccaccgccagcaccgacagtgtcagctccactggcaccccatggttgagcacctgatcaactccatcgatcgattgcatgcaacagcaacatccaacatgtgtgagacctgcttatacgagatggacgatgtagtaacgtaggtagtagtgctagtgatttattatacctggaagaagccgtgggagcggcaggcggcgccgacctgggagacgagcttggcgcggtcggggttggcgaggtcgacgacggggatggaggcgtcggagagcacgtcggcgaggcgcgggcgctgcgcctcggggcgcacgtagttgcccggcagcgtgtcgtggtctgccgtggagatgagctggtccgccatgccgcggtacacacacacaacttggcacgcaccacaccacggggggattactactataaataggcgcgacgcggcgccagcggagaagcgtagtcaggcggggagaggaagtcgagtcaggtggcggggggagaggggccggatgggtcgtcagcgatggggctgggcgtaacgtcatcgcggtggtgtagtataaggccctgtttagatgagactaaaacttttaagtccctatcacatcggatgtttgaaaattaattataaatattaaacgtagactattaataaaacccatccataatcttggactaatttgcgagatgaatctaatgagcctaattaatccatgattagcc

SEQ ID NO: 4632 - DNA, 1501 bp, Oryza sativa
ttttggctggagcagcggcggtgacaggcaagtgagggtcgaagcggtgaaggggagcccacaacggtgatcacgaaggaagcggtagagacatggtcgacgaggtcgatgccgacgccatctctccccgctcttatccccctatgctccgtcacatgaagggcctctcgatggacgagtgacaggggtggcgccgtggtgggcaacaacaagatgagggagagggtcggaggggagatctccagctccccgatgacttcgcaaccaggctgcgccaaccttgtcgtgtcatcgccacccatggactccatcgtagggtaaagtagaaggcatggactccgccgagggaatcaaattacactggttttaatagttggggggtggtcgagatattcggtattatggtttagggatacaaaacagattcgattgctagttaaggaagttaaagtggacttattccgtggtatatatgttgcttgtcgctaccattggtagaccttgacgaggatagggttcttagtgagcgggggtggtgtcgttgcagaggatggagaaatgcgtccgagggaccagccaccgtcactgccaatgccgtaggagagtaggggtggggaggatgaggagggagagataagaatggagacatgtgagacccacttttgttttgtcacgtaaacagctagtcagcacgagtaaaccgggtcaacttgccacgtcagcgaaaccacccatcaacagcgcgagtgaaggatctaatttaatcgggtttgcaagctgaaagtttaatatttctggcattacggatagggtttgtaaattaaactcagcgtaaaggtgagggttgccatgtggacttattccgccttacgacataccaacagcatggaacccatcaaggcccactaccatctagcccagctgatagactatgaggcccagtcttacattccacgttttgtcacttttggatcgttgggtcgctcgtcgtgttccgtaaaccccaccccgtctccgcagatccgctctagctgcacgcctgcaccttgctggcttggcgagtggcgacgaaccaaatggactcgcatcgttgtcgccggggccggtcacccgccgtctgtgcaagccgtcgtcgttcgtgccgtccattacctcggtcgatcacgtccaaaacactctacaaccaagggaaaaaaaagaaaagaaaattggggaaaaactttggacgactccgcctcgttgaccggcgggccatggccatcagttaacgaggccgcacaaatcggacccgatccaacggccgaaaccccaccgaaacaccgtcgttttcctcccctcttttcccctcctcccccgcgccccaaaaagagagagagagaaggatagtggcttggtgcaagggggatcccacaccccccccccccacatctcccgcagagtccacggccgatccatcccctcgtgcaggccgccggcggcggggaggaggaggaggaggcga

SEQ ID NO: 4633 - DNA, 1501 bp, Oryza sativa
agtcggcgcttgaggacctaggctgcgtttagtttcaccttaaaattgaaagtttgaagaaattgaaatgattcgatagaaaagttaaaagtttaaatgtataggaaagttcgatgtgacggaaaaagttgaaagtttaaaaaaaaaagttaaaatctaaaccgagccctagtttattttataaatacggagtaggtccttggtgctaatattcttggtaccgatcccatttgcatcattgactatttgactttgcttttacagagggctatggtagggtgccagttattattggcgtcgaggcattgaactttcgtgttaatgaactgatgttgaggaaaaagatctattcttaaaataggatttttttaaatctatttatataaaaaaaatcaacatccagttctgatatccctccctgatgttattggtaatccacaggcgccgggcaaacaccggcaacctgaaatctaccaaccactggaggaaaattctgccgtgaccccatgtccccatcgcaggcaacaacactacgaacgcacagcaaacaacctatcttgcccggaaccggagctgaacggaagagaggtaggagtacacctagtagtcaagttccattcatctacatccaagcgcggtgccgtgcagccgtactactcgtcctccccggctccccgcgcttgtcaccaagggagaaaagaaatgttgtactatctgcagaagtcgtagcctatttttaatccaacattacgcaattgcgagcattatctgactttgtagtttgtaccgaaccgcttgcacgtactggtggctggcaaaaaataattctatctcgctgtcctctctgaccggattaatggaggctgtgtttatgtctagttcaacgtaaagtttagattttggttaaaattaaagatgatgtgactaagaaattgtgtatatgacatattgatgtgatgaaaaaggagtatctaaattttaaatctaaacacgggtgctgtcatgtcatgcctgtctcgtcaaaacgaaatctctcgaattgaaaacaagccatgtgatacgcacgcgagatagggaaccggtcgagcaactgtccttttctagttaaagattactagattttatgtccattttcgttagcacatactctctcctccttgtagctgtcgaattacgtctaacgttcgattgtttgttttattttaaattttttttaattagtatttacattgatattagatgataaaacatgtataatattttacacgtgatttatttttctaatatttttataaattttttaaataagatgaatgatcaaatattggatacagaggtccacagcacacttaaaatgagatgtatggagtaactactaaatgatgtgattggtgcgaaatttttctacggaatttgctttaaaatatcaaatatctatttgtcaaatttataatgattaaatcataattagtcgtatgttgatgatttttttttcatttta

SEQ ID NO: 4634 - DNA, 1501 bp, Oryza sativa
caaaatcctctaaggtccctttgatttgtaggaaaagtgtaggaaatttgaagggtttcaatcctatggaattttttttatgaaagtctttgaaacaaaggattgaatcctatacaatcctttaaaattcctatgaaatggacaatcctatatagattttggagaaaaattagcaagaggtctaacctcttggaaaaattcctttgagtctatttctctcatttgattctcgtgtttttcctgtggtctaatcaaacggtcattcctgtgtttttttctgtattttctattactctattttacacttgcattcttgtcagaatcctgcgttttttctatttctctatttttccattcttgcgattcgaaggtgctctaaaattcttataaattttctttgaatcaactgcggtctaaaggtggagcatactcctagactcctcctagctggtctcgtaggttttgatagctgtgtggaagagccaaaggggagagcactttaagtgaatggtccaataacagtgacagtccttggagcgtgggagtactccagaaaccggggcaggtggtgcgtttaaaggatacctctccatttcctttcagggtctctccagctattcatggccagtcggtagaagtatacacatatatactccactgtagtacatcaatgccaaggagcagagatgttactggatcagaacaaaactgtgtcctgcagtttatagccagaaagagagaacatcgagcgcattcataaacagcgtcatcaatgccagcccagagaggcagaggcagaagagttctgattggtcaccaccaatcagccaataggaggagacgcaattgtactatggtgcagagctgctggtacggcagccactgtgcagcgcagcccacccaacacggcctttttctaacccaccagattttgctgggcctttggatcgctttctgggccagaccaaagttgaagttgatcgaggaggagcatcccattccattcccgggccatttgcaagcctagaaaaggacgcggaaggcgaaccggattctggcccggccccctttggcccctttcggtcgggtcatccatccagctgtaccacactactccaacgttgacccgcgcgacagcgaccgcccatcggacgacggctcacgctacgaatcagatgccccaaacgacgaaagaaaaaaaacaattccgctactactaccaccactaaaagcagctcgctgtgtcactgccgagtgggcccggcgcgcccaaccttacccgcgaaggaagggagcgacccccccgaccccgagccttttgcggtccccaccccgcagtgtgatggcacgtcgtggggcccacggtggctgacaggtgggcccgcaaggcggagttaaagtgagcgaccggccctccctcttcttgacttgcgccaccccaccccacccaaacccccaccgccggaggaaggaggagacgccgccgccgccgccgcagcca

SEQ ID NO: 4635 - DNA, 1501 bp, Oryza sativa
aagtttgatctaaaatattgaaaaaagaaagaaagaaaggaaagaatgatccatgcaaaagctaagatgaaagctcctatgtacgatcgattctaccgcctttggagcacagcatgcatatagtgcaattcggtaggcaccttttcttaggtttggacatgcttaattagattccaaaaccacctcaccctcctcgtccaccttcttcttccacctatcctagctagcttattacaacctactgtttcggttccaatgacatgatctccaaaatacatctttgattaatttcttttatctatattgtatataataaataaatatattttttgcttttattattaatattttgttagacaaaattatatatgttctcttagtgtctttatttttaatatttttaaagttactgataatcgcacttctaaatatttaatcctaatcttgttcaaaacattaagaattatgaaatcggaagagttaagttagagcgagcgagctagctttttcccagctctatcctctcgtggacacaccttctctctcatcgtgctggattaatatattcttctccatgctttagcatccaagctccagtttcaccgagctaaggtagggggaagggaattgaattgaaggttcttgggtgctttcttttccagttacctcccaccttaggaaccctcgaaaagacccctcaccatctcctttgtgtccttgctaaccaactccccattaaatccctctccgcgcgccttctcgctggccattagagctagctagcgagagctctagctacagctatacatacgtgtacccaacggccacggtcacccgcgcgagcgagcacgcgcaccaaccgatcgagcccaacaagctcgctcgctcttggtgcgcgcgcgcgcggcgagttcgatcgatcggtgtatacgcgtatcgtgttgtgtatgcaaggcggtgatcacggaggcatggagatgggcgtggggtcgttcaccggcggcggaggaggcggggagtgctcgtcgtcgtcggcgacggcggcggctgctgcggcggctgcggcggcggcggcggcggcggaggcggaggagcggcagctgctcaagggggagatcgcggtgcacccgctgtgcgagcagctggtggcggcgcacgtgggctgcctgcgcgtggcgacgcccatcgaccacctcccgctgatcgacgcgcagctcgcgcagtccagcggcctcctccactcctacgccgcgcaccaccgccccttcctctccccccacgacaagcaggagctcgactccttcctcgtacgcatctatttaatttcttcctgagttcgatgcgccatgcttgattaatttcactaggttgaatttaatctttgcatttgtgcatgcatgcatacattacatgcaagtatcataccgtacgcactagctacatgattaactagaagctatccagccaagctaactgtatatatgcatactgaaatgatcga

SEQ ID NO: 4636 - DNA, 1501 bp, Oryza sativa
agacagacaaacgttggatacgaatatccatggctacacttatcttggaacgaatgcagtatatactaactccgccccgaacaaatataagtctaggttgtttagcatgtattaagatttgtgaagaaagattattatgcctcgcattaataataggaaataattttaatgataagtaaatgatgggacaattaagaatattttattatgacaaatgttgtaagaaaaattaaatcatagaaatataattattatgagatggaggtagtaatactaggacaataccaaacatgtagcaaaaaaaggtaaaagttgaatggttgttaagggtaaaatagaaaaaaaattaaatgataagtaattgatgagacaattaataatactatattatgacaaatgttgtgggacaaatttaaattaaaaaatactaggacaaaaccatacttaaaaagtagtgggacaaatttaaatataaaaatactaggacaaaaccagacttgtttaaaatataaaaaatactaggacaaaaccatacttaaaaagtagtgggacaaatttaaatataaaaaatactaggacaaaaccatacttaaaaagtagtgggacaaatttaaatataaaaaatactaggacaaaaccagacttgtttaaaaaaatttataagtgtggctgctgggattcgagcccaggtctccacggccacaacgtggaattctcaccactaaactacagccactttattaaacaaggttaattagtcatcatatattgaataaaatatggttaaagcacaagaacaaacttccagagcattttttgcacgcaggggcagccggtagctaaccgtatctgtttgttattgatcgcagggcaaaatttgcagcttggcatgctgaaaccgcgatatacatttgtcgggcagatctcagtgttactctaagtctgaatgataatagacattcgcttcttcagtaattttcctccaccctcccattgtcattgtcgtgttcttcaagttcaatctgaattccaattctcaagcactgatcgttccatgaccccatcggtaggcaaaggagcaacaatttctacagattttcctttccagaaagcgatctatagatttcaccttcaatcaggaaggatactggaaggtagcaataagtgaaccgaacggcccaagacaatccatcacaaggatggcccatgtgaaagaaaacccacccaactgcaaattactaaggcccagcctgggcaaccaatcaccgacctttccagagcccaccgtatagcaactccgggcctatacggcacggcccgttatcgaggctcaccaacccgagcgggaatctccaggcaaaatcatcggctgcctcaaaacccctgagccgtgcatcctagggtttccctctcctcctcccctctctccccgtccggcaacgcagcctcaccgttcaggcggcggcgaaggccgcgtcgaccccgcgcagcgcaggcgcca

SEQ ID NO: 4637 - DNA, 1501 bp, Oryza sativa
tcagtagttagctacactattgaagttgctcttagccttgctctaacccgctttcttttctctcttatcttttcttctcgatacgtggttatagctggtttatagtctgctattgtacctgctgttagaagtattctatccatgttcacgtgtgctggtggtgatcatgtccgatcccagctcagatgggcctaaatgagcgtgcaattcttggtcctcggaataggagctgtgcattgtccataggagtacttcatgattagagagtattgggcgtgatcgaccaaaaaactacacaatctggggcatccttttcttttattagaccgatataattaaccatgcatcatgcaatgccaagtgcccaagtatattgctttcaccacaacgagggttcacgctttagcttttgtcgcgctcattcaagtagcaccatccacaataatcaaagtaactttccttttgactgaacctgtcgagagtagtaaaaaacagagaccgtcacgctgacgaccagcgggacagcaaccgccacgtgggcccccacgatgccggtcggtcagcagatcgggcaggcgagatttgcccgcacgttttgccctcaaacccctgatagtacgtgcctttgacagcaaaagaagccgtggcagatcgacccaacaatgtgtcatcctcctgcccccatcgcacacagaaccccccttgcgtgaattgcatcgcgagaacccgaaacgcctcgtcggtttagctgcaacgtagattcaccgatcgatcgatcccttccaccacgctccactccaccgggggaggtaaatccacgggaaaacgggtgtagtgaagcgagcgaggcgcgcaccaaccgcagtcaccaccaccggcacccaacacccagacgcgcggctccccggttgcgccgcactcgggctgtttggatggtatacgaagtttatcatcattcatcatactttttacgtcacatttgtttaagttgtggcttacaagtgtcacactttagggagttaatgacatgtgaggtcataatagatgagaagaaatcttgtcataagtgtggctataaaccaaacaatagactaacttaatcaatcttgtctactggtgtggtaatctttagtaacctttaggaattaggatcaaaccaaacagcccctctggggagaggccgttacgttatcccacgggggaaaaatacgagaaaccgcaaccgaaaagagaggaggaaaagggagccgcgcgccgtcgacgccgtgccacttaaccaaccagccaactcaagccccgcccgtaataaagcgagccccccgccgcacgcacgcacgcagccgagaccaccctgctgcagctgctgtgctgcgcgggttaaaaagagagagatctattaactggccctcctctcccacagcaaacacactcgtgtcgtactgagcatctgagctcggtggttgccgaggaggattcgccggcggcggcggcgggggggaga

SEQ ID NO: 4638 - DNA, 1501 bp, Oryza sativa
aaaaaactcgcatgctaacttgagacgatcggactcctaactgcagctcatgatttttttcaaaaatataaatatccaaacgaacagtgaatttcattttaactaaaccatataacaataataagattaaaatagacttcacccattgtaacgtaaggatattttttctacaaattgaaaaaataaaatgggacccacctgccaccctctctctatgactctctccctccccctttcttcctctttcttcttctcggccacccttctgcaatgcgttcgccgcggccgtcacacaaagcgattaccgcatccctcagatctcgccgcgcccggccgtcgtgccctgcccttgcctcgctggataccggcggcgcggtgggtcggccgcgcgatccgatgaggcggcggccatcgtcgttcaagcgccggttggtggcagcagcgcccgtggtgattccgcctcgtgccctcctcctcacgcttgcctgcctcttcctcctgcttgcgctccggggctcgcccgaccccgaccatgtagtgttcccctccaccgacttgtccagatccgcggccaccaccttccctctcctccgtcaggtgagcgaatcgcatctttatatctcatgcaagaccggcggcatgtgtgtgcactgttggaattaatagatgggctaaggcccattcgaagattaattctttgtaaaatcacaaaagcccacctcatgggatggcatgcatgtggagtttagtaccactttgcttattctaggagagggggacctccttaaaagggaggatgccctcctagccacttgaagcatgtgtggtggagagaagagggggaacaaacgagcgcgctcgctggcctggcatggcatgttttgttttggaaacattccaaaaaattcggtgcgtgaaaacggcgtggagtccggataagttacgcgcgacttatccggttcggttacgcggagtggagatcgtgcgggcaccctgatcaagcgacctatctctatataaaccgagccgccgccttcacgcaaaacacacgaaatccatctagggtttgcctcctcctctgtgttgcgccgtcgctcgtggactactccatcccgctcgccagcgtggaccggcgatcgggagagcaggtctccggaacctctgccttcgacatcctgcaccgggagaaggcggcaataagatttttgggaagcgctttgcgcaactgctccctgttcgtccgtgacggttcgccttcctctccgctcgcgtgctgcgcgccttcgtcgacgctcgcaaccgcgagtagttcctgccgagcaaccggtctttccgccacctcggtacgtgttcgacatgttgcgcatatttgaactgttcatattttactgcttagtttacatgtgtagatctaatgatgcgttaatgctagtatatatctgtaatgtcatgatttatttatggaatatattaaatcattataggcgctgtgattttacta

SEQ ID NO: 4639 - DNA, 1501 bp, Oryza sativa
tccttatgaactgtgacaatcaaacggtaattgtcaaattgaatagttctaaggataatatgaaatcgtctagacatgtgaaaagacgattgaagtctgtcaggaaattgagaaactccggagttataacgttggattacatccaaacagctagaaacctggcagatcctttcacgaagggactatcacgaaatgtgatagataatgcatcgaaggagatgggtttgagacccatgtgagttatactatggtggtaacccagtctatgtgatcggagatcccgtgaattagaacctgggaagaacaaaccattagtaaactagaggagagtaccaatctataccctctctaagtgaagatgcatgtactcttgtgagctgcaaggcaggttggctatgccttaatgagttctgttggctttaattagcgaagatgctgtcctgcagagcattcttgaaagaactgacctttgtaagcttgactgttggtcgcagtctatgaagattttgggtgaatcttctaggaagcttactaaagacctaggagtatgacttatacgctccacccgaggggtagtctatagacggtctagtaccagataagactctgaatgaaacttgcttgcacaagacttgcaattcaaggcgtagtccattgttcaagttgtgagtaagtgtagcttggagttctaagtggatgttcaaccttgatcggtctccatcgaaccgctggtatataaacagtacattggaaaagacaaatctcagtgggattttgagatttggtgggggattgttggaattaatagatgggctaaggcccattcgaagattaattctttggaaaatcacaaaagcccacctcatgggatggcatgcatgtggagtttagtaccaccttgcttattctaggagagggggacctccttaaaagggaggatgccctcctagccacttgaagcatgtatggtggagagaagagggagaacacacgcgcgcgctcgctcgcctcgccgggccggccgggaccggccgggcaggcggcgcgtgtgcacgacgtactgcagaaaaattcggatttgttttgttttggaaacattccaaaaaatccggtgcgcgacttatccggttcggttacgcggagtggagatcgtgcgggcgccctgatcaagcgacctatctctatataaaccgagttgccgccttcacgcaaaatacacgaaatccatctagagtttgcctcctcctctgtgttgcgccgtcgctcatagactactccatcccgctcgccagcgtgcaccggcgatccaaaaaatccggtgcgcgacttatccggttcggttacgcggagtggagatcgtgcgggcgccctgatcaagcgacctatctctatataaaccgagttgccgccttcacgcaaaatacacgaaatccatctagagtttgcctcctcctctgtgttgcgccgtcgctcatagactactccatcccgctcgccagcg

SEQ ID NO: 4640 - DNA, 1501 bp, Oryza sativa
gtatagaaatttgttgtgtgactataatattcataagtttgttgtacaaaaaatttaatatattaaaatagtatgtgcagcatttttttaaatgataaacatagttttggaaaacattcctatataatatatacaacagaaaaagatatgttgaactaccataaaaaaatgctacatatactcttttaataagtaaataaatattaatttttatgtcatcatgaaaaaaaactttgccgtgaataatacattgtccaataaaatcatgaatataatagtcttacataacaaaattatacacttccaacaatatagctagtttataatttccatgtttccttcatgtctaagggcaaaatggtccttttcttatgaattaaacattcaactaaccgtcaattaacggaataggtatgaaaggaatcaaatccaacagtagacaaaacttgggggcataaaaaggattggttaaacttttaggggcatagaaggatttttatccttagtccttagatggtgggaaatagaactaatgtaatctaattttattattcaatccaatctaagattgaccatttgcaatccaattggaatacacatgtaaatattcatcgatataaatatagatatgtttattttttgttgtatacatatgctagtagttgttataatcatatggaactaaataatcgaaaagtttcaattgaaaaagcattcaaataaccaccgcagcaggtgacttgctaaaagtgctagccacctatggaaattttggttatcctagatggccggtctaacatggccatgtgcaataaaagtttttttttttgcagatggctcggttaggtacaccgcttggaaaaactattttcctagacgaccgtcctaactaactagcctgtttgtgaaaatcacttatagtaggcggccgagttagactagtcggctatacgaacatcacccccctcccccggtttacagtcaggttgagtgaaaacaacccattttcggacacttgaggacgagccgtgtccagctgcctgagaaaactgatttttgtcaccagtgaaaattgattttgtgataataaacgtgtgctcgtttcttctccacatatgctagcttataggctgctattatatactctctctccatccacaaaagttacacatatttcacatttgagtttttccaaataagttgttcatatttatagtctttatgcattcaagacttaaatgaagagataaattaaatgttttattagaacctaaaaagtcatctaaatactcattggttgcatacttgcattcactccttgattttgtaacattcaaagtgatttaatttctccttggtcttgatgtcaaaagtaatatgcgtaacttttgtgtatggagggagtacttgctttactactcctagctagctagggagtaacagttttagttgcctacaattcaatacaatacaacttcgtctggcgccctcaatcgatctc

SEQ ID NO: 4641 - DNA, 1501 bp, Oryza sativa
ctgcgtcttcaccaccagcaagtgcttcgccttcggcgcctaatcgatcaatcgatcacgtcgtcgtctcggctcgtcatcaatcgcgatcgatcggtcgttttcacctaataataatataatcatatgtgtgtgtgcaaagaataacgaattaacctccccaagcttcatgtatgcatacatgcatcgttagtgcatgtgtccctgatcatgggtctctgggggaggatcatgttgtgtcgtgtgtcggctgtgtctcggttatcgtcttatcgatttcgatcatatcggccaattgttgtcgcgctggccacgtatatgtacttgatcgatgaccgagaaactcctaggtcaatctgtgtgttcatatatacatcagtccaataaatcgatcgttaattatattacaaagttttcgcattttaccgatacatgttattatatgtactccctcactgctaaatagcttttgcggtaggcacataatggattttcacagatggacatgtatatgaaccccttattataaccgatcgataacttttatataggaggctgcgcaactacatacataatactttctctgtttcatattataatactttctctgtttcatattataaatcgtttgacttttttcctagttaaactttgctaagtttgattaagtttatagaataatttagtaacatttaaaatatcaaattagtttcattgaatctaacattaaatatattttgataatattttcattttatgttgaaaatacttttttcctataaactttgtcgagtttgaagaagtttaaatagaaaaaagtcaaacgacttataatatgaaacggaggaagtagttgttttgtaggcggcaagttacaccatgcatccacctgtaaaaataatttttggtgctaaagaaaaacctaggtcaaccgctaaattcctcatccaaccctgaaacctggccttgaaaatcatgcatgcaaaactgaccaaaccaaaatagaataaccagctcaatttcacacagattgcaagaaacaaactgtccaacgacatcatctcaatttcatagtaaaaaaccaatcaaatgagctcacctgccaatctgccatagctggttgacgacgagcttgccacagtaattgtcaccgctgccaagtagaatccctcaccgtggttgtcgtccccattgccgagacaacgtgcgccctcgccacggccatcgttgcaatgatttggtggttttgaggcctagctagttgtagctaccgctgagatgaagaccttggcagatccaccacttctaccggcgcatccctaatctgcctatgcagtggcggatctaggccagctagggctcaagccctaggcctgggatccaaagtccatacaaatttcatatatatattttttaaaaaaaatgattgaatttatagaggagaggataggatagcctaggcgtggcttcaagctatttccgccattgtctgcatgggccc

SEQ ID NO: 4642 - DNA, 1501 bp, Oryza sativa
aggaggacttactctttgcgtgcaatcagcacctaaccagaagatgtgaatcatccaagacacattagtatggcgtactcctcctgcttgaatcggagtttgaaaccaaacaaacttctcctcaagaggatagatgggggcgattcaggtgatatcttatgtagatataagtaaagaaagaatggtagatgataatgtgaaagggcgctgcgtttaggcgggtgggccccgaccggctggcccgccccctttctttgcccactggccgcctagctgttattctttgagatttggatagagtcttgcttcgatcctgctcctcaacataagggagtgacaggggaaaggggccggaagttttactttggaccaccctttgttaaatcttttcactttggactaataaatttatctttgttgcacaatagagtaccataaaccacatcttttgcacttcaatgacttcgagcaaatcgttaacagtgtgtcggtgaactttcatatctgtacgtatgccatacctttgttgaaggagacactgacatggttagcaaagagagttaggatgatccattatgcaacaaacgtaaatttacctaattcaaagaaaaaagattaagtatagggtgatccaaagtaaaactttgacaataaaacattggtccaaagtataattcactctttcttttttcatgcatgtttatgtttacggaatggactaattattttgcttgtcagcacgacgtcagaaaagggaacaaatgctttcttcagcctctcaacactaaggaaatgtcctggttttcactactccctccataaaaaaaaaacccctggatttctatatccaacgtttgacctcttatttaaaaaaattatgaaaaaaattaaaaagataagccacgcataaagtattaactatattttatcatctaacaacaatgaaaatactaattataaaaaaattttatataagacggacagtcaaatgttggacgcggaaatccagggtttgtcttttttttttttacgtggggagtagaaatcaacagcaggaaaacgtcactgaattcttctgatcaggacagagaggaacgtcatatgacgttcggttcaatgaacatgtttgagtcactacacgtgtctcgatcagagccgtgggatctccatcgggcggtttatctgcgacgagtgtgttttatccacgaaatcacgatccatatcttttgggtgggggcttaaggcgttaagcgtaatactaaattcttaagaggattctcgtgcacaagtttcagactaatgaagtcgatctggaccgtccgatctcgatcggacggcccagagagagccccaagtaacacgggaacgacacgcgccgtggggcccacacggcagcgggatggtcgccttcactgaggcgactcttcttctcctcctcctcctccgctcgcgccgccgccgacgaggtcgccggactccgccgccgccgccgcaccaccgc

SEQ ID NO: 4643 - DNA, 1501 bp, Oryza sativa
gagtcgttttccgttccaacatcaaccaacaagcaacgcgagacgcgacgcgggcgggagcatgtagccacaggcaaacaccggtagttctctctgcctcgcctataaatgtgggagcccacgcagacgccgtggcatgcacagacgacggtgcagttggcgcgcctgcctagcttagcttacaacatctctcgcgcgctcgctgcacctctctctctttccctctcgcttgtgcgaaacatcgtgggtttttttcttgccggaggaggggcaggggagggagccgggcgggattcagccatgaggaggagggcaagcgctgtgttcttgttggcgtggctcgtcgccggcgtggtgaagggtacgtagcagattcatggtcatggagctcgatctctccttctttgcatgttcttgcaatcttgttcttaggatagttaagttaaagaagctcgcgtttctttcatttcaccagctgctgaggcggcttctggcatggcgcgaccgcttgcttacgactactcgtcaagctctgaggtatgcagcctctctctctcgttctctctcaccattatcatcgtcaaatccatgcttcatggtaccaatgtgagcatggtcgttctttgcgtcgcactctcccacagctcatgcgtcatgcagaacctctgttggtcacatagttattggaccccactggaacatggtaccaccagctgctgttgactgctgcttgcacacaacctcgatctgctcagaccagtgcaacaaattaatactatgattaagattgcttagttgcttccctagttggctgagccagcagagatcagattgcactaattcgatcgacctgccttttgatcatgcaagcgtagtatgtgcagctaacaccggccgtcgttagttgggcgagccgatttgttactgacaggtgacacaagtgtgggcgcgctatgcgggccatgcatacatatgccggaatatttttttccttcttgttgttgcagttgcctttgtgtgatctttgccggcctcaccccactcaccagtcaccatcgagaccttctgcatgttgggtttgcgtaggcagggcctccctgacatgtttagtgctaatgtgaacgaagctacaattaggagcaagaatatgactgaagtttaattaaccattgatcatctggtagatggtggaaacagaccaaacaagcatgagggagatgaaatcttgcatgtttcagctgcaagatacctcacttaacaaaagaaaaaaaaaatctgtgaggagcacaccaagaaccgaaagcctcttcaaaagcctcccaaaaccgagccagttgccacagaaaaaaaccaaaagttagttcctcgtacaccgaacttggagaacctcaccacacacgtccatctatcggtctggctcgatcgtttcaacccttcaccatccaatccaaacttccaaatcggtcttctttaccacttcaattcgagcctaacaaaactc

SEQ ID NO: 4644 - DNA, 1501 bp, Oryza sativa
gtagtccgctactcttatcttttatcttttttattttatctcttatcaactatcaacagctgttcagttggcagcccatattattactgggcagcatttcatttcgaagcatttccaactgcaagaaacccccaaaacccacgctgctggaggcagcgcatcgtccgccccagccttccaagttccaacccccccgccgcatcccctccccccactccactcctcccgaatcccaatggcgtcgtcgtcgtcgtcttcttcgtcgtcgccgccgccgcctccgccgcgccgctccgtgttcgacgccgcctacatccgcgcggagttcgcggcggccggcatctcccctcacttcatccctctcatctggaagtacgcgcccttccgccgcccccctcgaaccctacgcgctcgccgtctctgtgcctctcgatttttttttgtcatccgagagatagaaacctcgtcttggtctgaaggggtgatttcctcttcgcgtgcaggtatgtgttgcagaaccccaggtgcggcgacctggacgccgtcccgtcgctcccggcggccgcgtacgcgctccttcggcagaagttccagccgaccacgtcgacgctcaccaccgccgcggagtccaaggaccgcaccactaccaagctccttatccgactcaaggtgaattgaattagattgtgccactttcgtgctgtatgctcaaacttgggggattttgtagattgcacatttcggtggtttgaacatgcagtactaatggtgattatgggatcaggagaagtctgcaagatgttttagggtttgtaatttttttaccgctgttaacctgctagcacttatcacctaatagcatcgatgtatgtgggcagtttgctctgggtatttccgaaacgtccgctctattgattttaaatccatttgaatgcatgtggatatgaacagaaggcctcacgcatacttgcacaattggcacgccactcttttagggactgaatttaaatgagtatctcaagtaagctgtacattagaaacgaaggatttggtctagcatgtgttttcacttttatctctcccttgggaagccatttatagtttcctaggttatcattgcgctctcgatgcaaagcttggaagattcaatgtaagggttatgacctaatgagttcgtgtcctgtattaggtaggttattttcaaattttaatccaaccataaattaaactctgagtatattttgcagctccagtttgacttgaacttggttactcttttgtctgataacaaacatgtaaatgcatgtcaagttgtcaactgtcagttgcccttccgtttggttgttgtcttgttactgctgttgtctgatttttttttcgttgatccttttctgctaatatcaacttattcctcttcaatttcatgacctagaatggggaatctgtagaagcagtgatcatgcggtatgacacgcgattggggaagtatgacgggaagcct

SEQ ID NO: 4645 - DNA, 1501 bp, Oryza sativa
tatccaaaatttcatctaagcccgagtttagttctaaattttttcttcacacttccaacttttccgtcacatcaaaactttcctacacacacaaacttccaacttttccgtcacatcgttccaatttcaaccaaacttccaattttaacgtgaactaagcacaccctaactcttgttggagtatccaagacagcctaactctgatgagttgggatcctctcctgtaatgcatgtgcggtaagtgccaatgacatatgggcccggaataggtgggacccacatgccagtgacacgtactgcaggtgcagtacagcggtggatttgcatccaactctgattccccatcaccaccacaccatcaacatcggctttggcccttccctttacctagagcttaagctctaccattgctccacaaggacactttcagctactacttctccttagctcgatcggggctaccttgctcctctcttaatgcctttgcttgatctactggcattaaacgggacatgaacaacacattacctgtgccggaaaagatgagctcagcccccatctctcccaagcttcttccttctaatccttgctgacatgcggacaaccggtccaaaatacaaacggtaggtaaatattcctaactttaattaaaaacatgaaatagagagtgatcatactccactataaaaacttcgataaaaataattagctcaacttacaatttactcgtcgaaattaaatcctctctaccacagctccagacaaccagccagccacacagactttgcattgggcgtggacctccatggctccgtatcatctactcaaaatcagagccagtttaatagtatagctaactactagctccaaatcatgaacaatcaatttaatagccccacactgcgacgcaactcttgtctctactgttttatctcctcgacatatgtttatatctggcttataatttgttattatagctgctctcaggggacagtactgcatataggggttaaaacggggtggcgcctgccagtccagcctaggggtgaaaacagtatggaaatttcccgaccgtatcgataccgttttcgcaaaactaatataataatattatttttaccgatgttaccgttttcaaaattttgttttttttatttctgtcagcatggtatcgaagttggcactaaatagatgaattcatcgtaaatatggaaattccccgaccgtttctgctcgttttcgaaaaaaataataaaataatataccgattctaacccgttttcatccctagtccggccacattatttggagacaaactcagtgccgatgtcagcgggatactccagtgggccccaccccctcacctgacacgtgcggctccactgttcgctggcgccaatgttttatactccagttttaacaccccccaccaacctccaacaaagagaaaacaaggacccatcgtcgcctcgcctaatcatcatcctttccgatgcctcgc

SEQ ID NO: 4646 - DNA, 1501 bp, Oryza sativa
tttatctttgtaaagagtaaaaggtactaaaaattagcacaaagaccacaaaggtgcacacctaatcccccggggattacggagaagaggtttcagaaacagagattaaggagcagagcagtgcagagctatcaccttggaccagctgtaggggttgagctccagatttgggaggccacccggatcgctgccacgctcgaaattgaaggggcctgcgctgaatatgcaaattaatccaatggattggatggaatggaatggagcacttgaatcctaatcaatggcgattaaatcgatggtgaacaaggagattggagcgcaccgttctcgtagacgaagccgtcgaggctggagcatcccgggccgccgttgagccagagcacgacggggtcggccgccgcgtcgcgctccgacgtcaccaggtagtagaacagccgcctcccgctcccctcgtccaccgtcacgtacctgcgacgaacaccacggcgcgtcgtcggtcagatgataagagaagagaagagcggcggcgcgcgacacgagacgcacccggagtagtgcttggaggggaaggcgccatggaagcccgggaggctggcgactaggtggccgtcgggggccgcgacggcgacggcgatggcgatggcgatggcggctgcggcggagagcagcagcagcggcggcggcgcggcggcggcggcggcggcggtgcgaggcatcggaaaggatgatgattaggcgaggcgacgatgggtccttgttttctctttgttggaggttggtggggggtgttaaaactggagtataaaacattggcgccagcgaacagtggagccgcacgtgtcaggtgagggggtggggcccactggagtatcccgctgacatcggcactgagtttgtctccaaataatgtggccggactagggatgaaaacgggttagaatcggtatattattttattatttttttcgaaaacgagcagaaacggtcggggaatttccatatttacgatgaattcatctatttagtgccaacttcgataccatgctgacagaaataaaaaaaacaaaattttgaaaacggtaacatcggtaaaaataatattattatattagttttgcgaaaacggtatcgatacggtcgggaaatttccatactgttttcacccctaggctggactggcaggcgccaccccgttttaacccctatatgcagtactgtcccctgagagcagctataataacaaattataagccagatataaacatatgtcgaggagataaaacagtagagacaagagttgcgtcgcagtgtggggctattaaattgattgttcatgatttggagctagtagttagctatactattaaactggctctgattttgagtagatgatacggagccatggaggtccacgcccaatgcaaagtctgtgtggctggctggttgtctggagctgtggtagagaggatttaatttcgacgagtaaattgtaagttgagct

SEQ ID NO: 4647 - DNA, 1501 bp, Oryza sativa
tgaaacaacatacaaactgtcaaagataaatttcttttacccctttctactttgagtacgcttatacgcaacctcaaaatcgtgggccctcccctgcatgacgtgatttttttgctgcttgcattgtaatgattttccctgggaaaactaattaagaggcagataaacaaacacacacttctctaattaaacaacactgatacactcttttcccttcattttatcacaagtgtgcttcaatggggcaaaaagttataagacaacaacttgtgttaccacatgtgtactctagtacgttttaagtggatggtttctagctacgaaaagaattggctatagttttaaggcagccagagattattaatggctgagatatgctatgcatgttgctagcttctactcagtccgtttcaaaatgtttgacaaagttaacttttgagtacgtatttaacgatttgtcttattcaaaaaatttaaataattatttattctttttatatcatttaattcattgttaaatatattttcatgtacacatatagttttatatatttcacaattttttttaaataaaacgaacggtcaaatatatgctaaaaagttaacagtgtcaaatattttgaaacggagggagtatatatttgttggaagtgaagcatttccacttatgattcactcggtcattgcatccatcctaccatacattctatatatctatgtttggactgggaggtcccaggaattgttgtgctgcagtgacgccacgaaatctgtcagttttcttctgatagtttacaaagttccgtggtttcaccactccgccaatgagaatgtcgacttaagggcagggtttgcaatttcgttttgaaatttcggtaattttgtcccctaccggaaagctcacatctcgcccgaaattttcggtttttttttttttgtaaatttttctgattttggtcaaatttaattaaaattcattaagacagaaaatttcaaataatttcagctaaaaaaaattcaacatttccaaaattttggtaatttcggtcccccgggaaagaatttcgaaatttaaagctccaacggcaccggcgggaaagaagtcgcagtctactccagctgctttgtgcaactctgccgtgtactagctagttgcacattttgttgctgcgctgcatagttgctttttacaacaaagatagacctcaaattaattgacatgattcagtgtacatactcgaagtaagaactgatgaatttatattttcggaagagtatttttttacccagcatatacatgtaaccggatatatacagccatatgcagccatttaagttagaacttactacttcaaataacccaatctaaaattcactcctacgtagatttgaactcaatatgttggggtgctacgcaggtcattacgactactcaaaattaatatacatgtatgtatatattgtactatatctgtgcctgtttggagcaatgaactagggt

SEQ ID NO: 4648 - DNA, 1501 bp, Oryza sativa
gacatagctagtttaaaccacaaccctatttgtatatggtatctgacgaccgagggcaaactgtatatacaacgatctttcgacctagccaattaatcttttcttagacactgatcgatctcgtccttttcttttattttttgcgggacgtccttttcttttattgaactcataatgtgcaaattattttcccgtacattttaccttttcagaaaatattttttttccaagctagttagtcacaaagctagaaattgaactcataatgtgcaaatgattttcccgtacattttagcttttctattgttaaactcaatattgtgcaaatgatttgagtagaattgagtagaatctgggtgtggttttgccaggcacaaccgagagcagacaaccagtctgcaactcggttttacccctctctttcatggacttacgttttgtgacctatatatagttgtgcctgtgttacatacgtgccatgccatctgatgcttgtactccctccatgtcaaaatatagtaaccttgtataaaatgggacacatcctaatataacgaatttagacatacccctgtccagattcgttgtactgggatgtgtcccatccaatacaaggttgttatattttgggacggaaggagtaactttttgtccgaagggttttcatgctataaatatgtacattcagcattctattttagtcatctagtctctgaagtacatgtgtgacagtgagcagagatgaaaactgatgacaaacaatcaaaagctaatggatgtttctgtccgtacaaatttcactgtgcaacgtcgatccctaactggccaaataggttgattaattaacaccagtacagatccttccatctgtgacggcccataacaagactggaatttgcgagccgtcacaaggaagtaatctcaatcgggccgaagtttcgcccaattgagatatggtcgcacagccatggtatatcggcataaaacttaagcccgtcacggatcacacttatatgtgacgggccatagttgaggcccgattaagatgagggttccatatctcaatcggaccctaaacgaagcccgtcatagatgagggtcatctgtgacgggctccaactagaggcccgattgagataagtttaatgcccatcacagatgacactcttttttgacgggcttttattaagacccgatagagattacttgtatgcccgtcacggttgattgttttagggccattacagatatttattgcacagtataaatacccctaccacctagtgtaactgtatcccactgttcactattttggtgggaggctgtagggggcgattttttgtctttttttccaagaaaaacagaaaattcctaaaagtgatcaaaatggatcaatcaagtgagtaatattaaacattaattgagaaatttcatcacgtattacttttgcaatactgatcttataagatgtgcatgcaatttgttttttttattttgtagc

SEQ ID NO: 4649 - DNA, 1501 bp, Oryza sativa
agtccgatgcgcccgggtcgccggcctcgtcgtcacgatcgtctgcaccgctggcatcgccctcctcgtcggagttgggggcgaacgcgagccgaggggccgacccctcgaaactgtggacgatgtggtcggcggcatcccggacccgcgcacgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttgaagagcccaggccatcctcgtgaggtgcgaagcgaggccttccaggttggtggagtgcgtccttgtctggcctttccagaggcccgcttgccgtccggcgcgatccaggcgggagaccgcatcccaaagcatgccgggccctatttcgcccgccaagcggagggcctcggcttccccggcggatgagtctagcgcgcactgcatgtcggcgatggtgagttcggcagctgcgaggcgggcggctaagtcgctttcgcccgcagccgccccgccgatgcacgccctcgcgtccagctctttttcccgcgcctcgagatcggcagcccgctgctccagtgcggctctctcggcgcggacggattccaaattgcggcgggcctgctccgtcagcgctgcctcacggagggacagggagtccgccaaccgttgcgcttcggcctcggcctcttcgagagctcgctcccactcggcaagcgcgtcttcgcggaggcggagtgcggactcctcttcggcgcaggcagactcgtgcgccgccagcgttgcctcccgggaggtgacggcggcctcgcggtccgccaggactttctccgcgacgcagacgcgctcctccagcgccatggcgcgcgcctcgagggcctcttcacgccgctgggacgccgcttcaatctccgttgcctgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcggcctcccgctcctcctccacctctcgggcgatctctgccagcgccgctttgcgggcttcaagctcagagacgtgacggcggtgagccttacggcccacctccaccatgacatccaccgagcgccgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcggggcgacagaagacgaggggaagagccgccttggagagaatgcgacgcggctcggcccgccggaggacgcgctgggctcggggatgtcccccagacccgtttggtcctg

SEQ ID NO: 4650 - DNA, 1501 bp, Oryza sativa
attccacacctatggcaacagttaaatattttgtccctaaacttcaaattttcctcctctctctataccagacacattccatcattccactcatttgaatgaacttttagccatggatacatgactcaacatgttgacgaggcctggcacatttgttgagcacttgagctctctactatggttttgctctttctatctctctcccctgcacacgagagatgttaatagttgtgcattgtcttgtcagcatgctaactcatctgttcatacagtgaagagtttcatgtttagagatatgagtattaatgttttgacccattgttgtagttgagcgacagaaaatagctagttcattgtaatagttgggaggtacgaaggctacacttttcttcattataaaacaattataaaaacatgtgatgtgcttccttcatgtgaataaaggagtcacgcattaaacatgtataatgcatccaaacaggtgtgcacaaaaactaggtatataattattgaggtttctcttacctccttggaaaggtacctcctcactattcaaggggaaaaagaaagaaaatcggtggaactgattgaaagaacagtatacaattggtaaggttggactttttttttccatgggacttgggaggtatatagaggcatatatacctcacaatgttagtcatgaggtatatgcctccatatatataccattgaaataatacatttacctatgactctaaaaaacttctcaaccctattccaacctctaagattagttttggtacctctcttcatgaagggcatatctatatatataaggaggaatacaactcttcaagggtggtagatttttaggtcatgttatgatatgccatatgtgctatgatttgtactttgaggcaagccatacagtacttcttcccaattgatcatacggtaggtagttattaagagatgttcactttgaagtgtacaagacacagccgtgcatacaagtataaaccatacatgtgtcttgctaccaaaatagaaacaattcagacaacatcgccatttctgattcactcattatatatattgtcatattgcagtctgcttctacataatctacatatacatttggactgggaggtcttgaaaattgtctctctccatctaggaaaagcgaaagcttttgctgtcatgcagcctcttattaagagatcttccgaaggttggcaatattgtgaaagctaatctcttcagaggagcgatcgacgttttaatgggatgacacaatttggaaaagtataaatgttagttagtgcttgtgtgtttttttaaaccaaatgcatgtaactcccacataatttattaatgaataagtcctacataatttattaatgaataagcccgtctggcctcctgaactgtcaagagactagtgcactgtttactatattgactatgttaaacaaatttctttgctatccgtagttgtttgtgttcatgcaaaaaatta

SEQ ID NO: 4651 - DNA, 1501 bp, Oryza sativa
ctctctctctctccaaaccgccgccgcgtgcctagctatagcttgttgccgacgccactacgccacgccacggtcaaccgccactgccgacgaacgacttcggcgtggccgccaccgccggcgacgctgacgccactgccacgccgccgcccctgtctcgagatcatgccgccgccgcgcccccacgccgcgggcccccacgccgccggaccgcgcccccaccgttgcgagatgccaccgccgcgagacgccgccgccgccgccacgctgccgctgcgcccccacgccgccgggccggccctcggcaccggaccgcgcccccaccgccgtgagacgccgccgccgcgaacgaacgcttaacgaacgtgaacgaacgcgaacgaacgcttaacgaacgtgaccgaacgcgaacgaacgcgaacgaacacttaacgaacgcgaacgaacgtgaacgaacgtgaacaaacgcgaacgaatgcttaaagaacgtgaacgaacgtgaacaaacgcgaacgaacgcaaacaaacgcttaacgaacgtgaacgaacgcgaacgaacgtgaacgaaatgttaaagaaatgttaacgaacgtgaacgaaacgttaacgaacgcgaacgaacgtgaacgaaacattaaggaacgcaaacgaacgtgaacgaaacgcttacgaaagtgaatgcacttgtactaaaagtgtgagaacgaacgcgagcaaaacgtgtacgaacgagataattaaacgattattaaacttagcatacatatatgattatatatataggttaaaacgtgaaatacaataaatgtaacttggccctgtttagactaatatattttcctagtaatgttgtagagaagacgtcgttgtcgtccctcaagccgaagtggtagctagccatcgaaggaattcgcgcaggcaagtgttgtaaagaagtgattgttagagatttaatataagattattagagttttaatataagattattagattattagaattttaatataagattattatattattagagatttaatataagattgttagacttagcatatatgattattacaattttgatataagattattagagtttgaatataagattgttagacttagcatatatgattattacaattttaatctaagattattagagtttgaatataagattgttagacttagcatatatgattattacaattttaatataagattagtagcgatttaatataagactgttagacttagcatatatgattattacaattttaatataagattattagagatttaatataagattgttagaggtttaatatacggaacttaattagacttagcatatgtgagtgtcagagattgttagagatttaatataagattattagaggtttaatatacggaacttaattagacttagcatatttgattgttagagattgttagagatttaatataagattattagagatgtaatattcgaaacttaattaga

SEQ ID NO: 4652 - DNA, 1501 bp, Oryza sativa
gggcaaaaaaaaggaaaaaaaggaaacgaataggtaaaaaaagagcgaaacaaattaaaaaaactgtctgattccaaagaaaaggaaattaaatgtgacacggtaaaaaaatcgacaaggcgaaaaaagccaagcgaaaaaactgggccaaaaaatcaaaaaagtcggataaaaaaaggggcgaaaaaaaaatctgtccgataaaaaatagggaaaaaaaaggaaaaatcgaaatgaatccgactccgtcgccgcggtaaaaaaagggcgaaaaaaattgaaaaaaaaatatctcattccaaataaaaaggagttatatgtgacacggtaaaaaaatcgaatcctattatatctagaaaggtccgacactaataaagtggcgaaaaaaaccgttcgtaaaaaaatacacgagaaaaaaaataaagaagggcagaaaaaaacgcggtggaaaaaagtctaatttctattcattgttttagtagtccttttatatctcttctttatctctaatctaatctaatgtaactattaaaaaaagtttctaccatatattaaaaaggaaaaaaatgcgcgagaaaataaaaacggtttaaaaaacgcgtgaggaaaaaaatgtcagaaaaaagcgcaaaagaaaaacgcgttagaaaaaagttccgtagtcagtaaaaaaacgcgcgagaaaaaaatatttccatcttctgtaaaaaaaaaaagcatatgagaaaaaactgttagaaaaaaggttaagttgatgaacatttggtcggatagactccatcaatttttttccatctcctacacgacttttgtttcatcatctattctcctatgttggagaccctgcacatctttgtagacaattatcatattatttttgtgaagtatagctattattcttgataacatattatatggaaataatcttagaaaataaacatattttaattgttatttagagaaaagtgcacagtgactctattttgtgtggacttgatcatacgagtcagtgtaggatttgattggttgcaataatgagattaaaagaatattttagattatatgtatttcattggttgcaataataagattaaaataatattttagattatatgtatgttgtcacatgaataatccaattattttaaaacaaacatcgtaagcttgccatcatcgagattgggctattgcatttaagatattccaattttttgattttttgattgtcatatatggttatgcatgaaaaacgtatattatcattaagtttttttatccgttgcaacgcaagtaacagaaaagaaaagaaaaaatctcccgattcgtccctggtccacagccgcgaggccacacgaaattcgcggatatcaactccccgccccgccaccaccgcttccttttccaacgacttcttcttcttcctgctctaccttcttggcttttgcctctgttcctcttccaagatttgcgagatggtggcggtgacgccgggcaggcgccg

SEQ ID NO: 4653 - DNA, 1501 bp, Oryza sativa
tggtgggtatgggtgggtaaagaacggacccatacccacgtacctaatgggtaagagttttgcccattagtagacccatgggtataagagttagaacacaattagctcctaatagagtaaaaacccgtcgggtcacaggttttgggtccccattgccatctctagtagcaccgtggagaagtacggcccattacaggtgatgggccatcgagacgaggactgtgctgggccgtactaaatggatcaagcccatgaacaaaagcaccgtgtggagtatgtaataatgggccgtatagatgacggaagcggacttcgtttcgttttgtttgggccgggctcgcgaatcgaggacgaaaccgcgtcagaacgagctactttgcgctcgcgtcggcgtcggcttctgtctccgacgcggcggagcgagggtcccggccgtcgcgcgccgccgccgccgtcgtggctccaatagaagcgctgcagcatccgcggcggccagagctcggtcccccacctagcctgggttttgcccaggcggcggcgctttgaggaatgtctcggtctcgccggcgtgctgcgcgcatgatgtgctcgaggaaatgcctgggaggaggaggagggactcggggcgggaggaagacggcgaggaggggacaggagcgcggcgggcgacgtcgctcgcgcgggagcgccatcatcgggcgagcctctcatgatcaaggtaccattcgtctctgacaactccaccgtgtgttctgaaattttgactgcaaaacgcactgctcgccattggctccatccttgactctggctggatactgtgccattgtgcctttctcgggtcatcagtccaagtcatctcacatggtggagccggctggtccatcgctgtcgctgtgccgtgtgaaacatgcgccgaccgcgacacggcgagcgctccaaattcctaatccgcagcacccccacccgacgacccccatggtcacggtcaacctcgccccctgtccatagccataccaagaaagagagaaagaaatactcctgcagctttacaagtggagttcaatacttcagttccacaagctcctttgcactctaccaaatccagccatggcagccaaggcccctctcgtgctgcgcctctgtctcttcctctgcatctccctctccctcttgctgttatcatctcctcaacgggtgacgagcttgagcctcgatgccgatgtggacgatcactactaccattacgatggggacgaagacgatgacaactactaccatgatgacgacgacgacgtcttctccggcaggccggtacggagaatatacgacggcgacgacgacgaaaactactaccgcaatgatgaagtagacttctccagcaggccggctcggaggctatacgacggcggcgcagtcatgccggagaagtacaacgtcctgaacggcaactcctccaacagcagctccggctcggccttttgcaggttgctttctctccaga

SEQ ID NO: 4654 - DNA, 1435 bp, Oryza sativa
atcgtttctgttcggttggttttttttctttggttttttctttctatttggttttttctccggttttttcgttcggtttgtttttttctggtttctcttctgtttggtttttttcttttttaatgtataaatacaaaatttgtattcgtatgtataccaagtttgtattcgtacgtatagaactttctatacgcgcgtacaaacttttcatacgcgtatacaaactttctatacacgtatacaaagtttgtatacacatatacaaagtttatatgtgcgtatacaaactttctatatgtgatgtttttttttatttttttattttttagtgcgtatacaaactttgtgtctgtgtgaatatatttttatgcattgaaatatattcataaaaatatatatgtgtgttagggttatggataccacatacctaatagtagttgactaaatcttggcaggatccaccacataccatatctaatacggaaactgacttcagatatggagggagttctggataaggaaagacaaccagagttctacatggaaacgacaaggactactcggattgtatccatactagtttccctagttctacttggacaaggggacacctgtgggtataaatacaagcccccctaggaggacagggggacacccatgatatgagacgatcaacatgatcaacaaccaccatgggggacaagacaatcaacacccaacgggattaacacctgacaggatcaacacccaacgcaatcaacacagaagcctacatacgccaagacacgccgccggatatcgacttcaaggataagcacggctagtaccctacggtgtcttcggatattgtcaggagagacgaaagtgctatctttgatctcgccgagcacgaattcgaggtggaaggctatcctgttgtcgactacgagtcagatcgtcagaccgccatgtcgacaacagttagataggttaccccaaacattgtactggtgtgattatcatgaataagagcaataccggcttcggccaacaggatgtagggttattacctgaccgctcagggacccaaacctgtataaaaatcctcgtctccatctcttttacctcagtctcgcgtataccctagtaccgacgatccccatactatgcaaataccagaattgcgacatcaaacgtagataatatgtatgtatattatgtatatatgcacacgtatatacatatgatgcatatagtatatatgagagactagagggggggcgattgaccgcgcgcctcctcgcgcgcgcagctgatcgcgtatcagcaccccggggggaggggggacaagtcgacttgttcgcagctaacttttcgttaaagtgattgatatcacttattctcaacaccatatatcttttcactcctaaattataaaaaaaccatgtaacttagg

SEQ ID NO: 4655 - DNA, 1501 bp, Oryza sativa
atagatatattgcgtgtgtagaatatgctgcgagttgtactcggattagcgagctcataactgcaagcgtggtatgatagcaggaaaagctccaattatatcaatttttttcttcagctgaatcatgcgtgtccagcagaacgggagacatgcctgagctgtcacacatgtacttagagcaggtacagtaagacggtagatgctggcgataggatgaccatgtcagcgttgatgcttagctggaggtgaaaaaggtggtgagagagattaaacaggcgactaattagtcgctagctgctcactctatccaaggcaaagcatttaagtgctgttggctgcacgctatggcaacgcaagaagctgggtggggtcacctcattctaccgaatgcatttgttcatggttgatgggaactgtgtagcaatagaagatagtagatctctattgtatgcactagctattagcactaactataatttgctgatgtggttatttttatagcttttagctggctatactataaaccttgctctaacaattagtcaatcatcagtctaactatgggctataatgaagtagtccatccgttccaaaatataacaacttttagctctcagaatttatcctaaaatataacaacttctctaccaatattctcttctcaaccaatcacaactctccatcgttcatttttcccacctacctttactactaatccaattacaaccctccaccattcacttctacctagtaaccgtgtctaactttaaaacttattatattataggatggagggagtagtaattaactactgttgcaaaagctagcagaaggtgacaggatggttcaacatcgatctgtctctcagataattcatccgtcattctgaataacttagcagtttagcatagattaaagtttaagagacggttatactatccttaaatgatactcgttctctcccactcactaagacccggtcagacctgatgcactaaaaaaaaaaaatcgttgactttaaatttctcatatattataatgtttgtaacagcaaaatcatatcatataaaagtaaatatagatgacaatccaataatataattttcatcaaataaatttaatttataataaagtcttgcagatcaaatattaaagagttacaatttaaaatatgtgtgcgccttagtgagtggccgaaggaagtaatggttagagtgtagtggtaggggggggggggtagaatagagagaaatttaaatgaaatgtgatgggataaatcatacttaagagtgacatgtactttgatatggaggtaataattaatctctttgcatgcatgtgactactagatgggtttgtcaaaattaatgcaacaaatggccaaactaaagtcatctgtgccacttgctgagtgccggttgggatatccggtacctatgatcggttcccaagcggcacataagtgcttttatgtaatagtgaataccaaggagatggactg

SEQ ID NO: 4656 - DNA, 1501 bp, Oryza sativa; identical to SEQ ID NO: 4653

SEQ ID NO: 4657 - DNA, 1501 bp, Oryza sativa
gagattaattattacctccatatcaaagtacatgtcactcttaagtatgatttatcccatcacatttcatttaaatttctctctattctacccccccccccctaccactacactctaaccattacttccttcggccactcactaaggcgcacacatattttaaattgtaactctttaatatttgatctgcaagactttattataaattaaatttatttgatgaaaattatattattggattgtcatctatatttacttttatatgatatgattttgctgttacaaacattataatatatgagaaatttaaagtcaacgattttttttttttagtgcatcaggtctgaccgggtcttagtgagtgggagagaacgagtatcatttaaggatagtataaccgtctcttaaactttaatctatgctaaactgctaagttattcagaatgacggatgaattatctgagagacagatcgatgttgaaccatcctgtcaccttctgctagcttttgcaacagtagttaattactactccctccatcctataatataataagttttaaagttagacacggttactaggtagaagtgaatggtggagggttgtaattggattagtagtaaaggtaggtgggaaaaatgaacgatggagagttgtgattggttgagaagagaatattggtagagaagttgttatattttaggataaattctgagagctaaaagttgttatattttggaacggatggactacttcattatagcccatagttagactgatgattgactaattgttagagcaaggtttatagtatagccagctaaaagctataaaaataaccacatcagcaaattatagttagtgctaatagctagtgcatacaatagagatctactatcttctattgctacacagttcccatcaaccatgaacaaatgcattcggtagaatgaggtgaccccacccagcttcttgcgttgccatagcgtgcagccaacagcacttaaatgctttgccttggatagagtgagcagctagcgactaattagtcgcctgtttaatctctctcaccacctttttcacctccagctaagcatcaacgctgacatggtcatcctatcgccagcatctaccgtcttactgtacctgctctaagtacatgtgtgacagctcaggcatgtctcccgttctgctggacacgcatgattcagctgaagaaaaaaattgatataattggagcttttcctgctatcataccacgcttgcagttatgagctcgctaatccgagtacaactcgcagcatattctacacacgcaatatatctatctattatattattaaagaaatagaaaaagaagcttccacgttcactctcatggcttagaaattctcacattaatcggagaaaaaaaaaagcagagtccatatagaaatacaatttagaaaatagctgaaattcgaaattaaaaaaataaggaatattagaacataatagagtct

SEQ ID NO: 4658 - DNA, 1501 bp, Oryza sativa
gcaccagcgcagcagctgaggacagccagtggcggccatgagcagaggtggaccctcgtcgtcgtctgctcgtggtgtatggctcatggcagcaggtttgaggaggacggttggccatctcctttgatgctggccaggcaaccccctctctgtggacatccttccctcctcagtggggagctccataggtggatggaggtagtggcttgacgacatgggatggcttaggtcaccgaagcggcgtggcccaactccgggctctccttggccggattcgacaaggaggctggtgggtagcagagtggaggagacctaagacaacacatagggaagttggtggcggggtagagaatgctggcggcgggcagggacgtctcccttgatgtcggtcgggtgtcgtctcgacttgtggagcatctcccgttctctatgggatgttctataggtaggtgggggtaacggtatgtcaataggggaaggcttgggctgccgaagctacatcgtccattaccgggctttttgccggattcggagctgaggtcggtggatggcagagcgaaggaagctagctcagcgttgcgggggagtgacaactggtaaaaggcgctggcggtgaggcgaagtggccagtcttgatgtcggtcggcggtgaggagccggaccggtacggcggaggacacacgctaccgaataccaatgttgggctggtggtattagatctggcaggcgacagaccacagaaacggggtgaagaggatcccaggcgaaagcctagcctagcgcttgattgggctggcagtagctacgcctttggacgcggtaaccctcttgagggtgttgccgaggtaccctccttcctcgacgggggtctctaggtgaaaaccgtgtccaatttctttggacggatgatgactgcgtcttttggcatcgcaaccttcatgggggcgttgtttttttggactatcattctatggtgttgctgtaagcctggcggcgaccggcatgcatagcggtggtcggtccgtcgttcggccctcctctctatagcttgtgtttgtgcggttggcgtgtggtgtcggggcgtgtgctttggtgcactttctttctcgagagctagctgttgatgaaaaactttgttgagactttttttcttctatctttataacatttggatgacttccttcactcaccccgacaaaaaaaacatggatatgtatatcctatagaatttctggcttcaggttttttttaacgaatttcaggcttcagccgtgctccaagtcatcgtatgaagtatgaaacttcagccatcatttaacagttaacatttttgtgccaaatattaactatatctctatctctactattataaaaattaaagatgtttttgccataattttgatacgttatctgtatttgaatcggttttaattttgtgtttcgactttaatctatatatagaaaaaaaataagtccgactcaaaaaaggttaaaaaaaaga

SEQ ID NO: 4659 - DNA, 1501 bp, Oryza sativa
gatatattgcgtgtgtagaatatgctgcgagttgtactcggattagcgagctcataactgcaagcgtggtatgatagcaggaaaagctccaattatatcaatttttttcttcagctgaatcatgcgtgtccagcagaacgggagacatgcctgagctgtcacacatgtacttagagcaggtacagtaagacggtagatgctggcgataggatgaccatgtcagcgttgatgcttagctggaggtgaaaaaggtggtgagagagattaaacaggcgactaattagtcgctagctgctcactctatccaaggcaaagcatttaagtgctgttggctgcacgctatggcaacgcaagaagctgggtggggtcacctcattctaccgaatgcatttgttcatggttgatgggaactgtgtagcaatagaagatagtagatctctattgtatgcactagctattagcactaactataatttgctgatgtggttatttttatagcttttagctggctatactattgaccttgctctaacaattagtcaatcatcagtctaactatgggctataatgaagtagtccatccgttccaaaatataacaacttttagctctcaggatttatcctaaaatataacaacttctctaccaatattctcttctcaaccaatcacaactctccatcgttcatttttcccacctacctttactactaatccaattacaaccctccaccattcacttctacctagtaaccgtgtctaactttaaaacttattatattataggatggagggagtagtaattaactactgttgcaaaagctagcagaaggtgacaggatggttcaacatcgatctgtctctcagataattcatccgtcattctgaataacttagcagtttagcatagattaaagtttaagaaaaaattatactatccttaaatgatactccttctctcccactcactaagacacggtcaaacctgatgcactcttcaaaactaatctttgactttaaatttctcatatattataatgtttgtaacaacaaaatcataatcatataaaagtaaatatagatgacaatccaataatataattttcatcaaataaaatttaatttataataaagtatttgcagatcaaatatttaaagagttaaaatttaaaatatgtgtgcgccttagtgagtgggacggaggaagtacatggttaggagtgtagtggtagttgggggtagaatagagagaaatttaaatgaaatgtgatgggataaatcatacttaagagtgacatgtactttgatatggaggtaataattaatctctttgcatgcatgtgactactagatgggtttgtcaaaattaatgcaacaaatggccaaactaaagtcatctgtgccacttgctgagtgccggttgggatatccggtacctatgatcggttcccaagcggcacataagtgcttttatgtaatagtgaataccaaggagatggactg

SEQ ID NO: 4660 - DNA, 1501 bp, Oryza sativa
atcgattggccgtcggcattctgcgtttctttctcttctcgtgttccgacttccggctgtgaaccaagagtagccgacggctccgcgcgtggtcgcagctgcctcctttcgacgattggctcgattgcgccatgtgactggtcataaggccgtaatatcaaattttagttatttataaattatatatatttttatatggactctagactcgtcttttaatatatttttttattctgaattttttgtaaattgtatttctatataaactctatgctcttcttccactattatttatttttatttctgaatttttattatttctaattgtatttctatatagactctaaactcatctttcaatattctttaattattaatgaattttagttacttctaaattgtatccctatattgactttaaacttttcttcccatgtttttcttaattttaaattttagttatttgtaaattatatttttatacggactctaaactttacttttaattttattatgcttattccaaattttagttagttttaaattcctatatggactctacactctacttctaatattccttatttttttaattccgaatttctattgttttcttaattgtatttctatatagaatatatactctacttctaatattccttatttttaattccaagtttctattattttctaattgtatttctatatggactctatactctacttctaatattccttatttttaattccgaatttcagttattttctaattgtatttctatatggactctagtctcctcttcgaatattccttattttttaattccgaatttcaattatttctaaattgtatttctatatggactctagtctcctattataatattccttattttttaattccgaatttcagctatttctaaattgtatttctatatggactctgctttttctttttctccgattaatgtgagaatgtctaggccatgagagcgaacgtggaggctcctttttctattcctttaataatataatagatagattgcacataatctgagttctcaattttttgatccaatggtccaaatcaattgccactaggggtgagcaaaataagaccgggccgaagaaccgaactgaaaagaccgataccgagactgaaaagaccgagaccgaaacgaccaagaccgagaaattcggttagtaattcggtcttggccgttgaaagaccgaaatttatttgggcaattcggttattggtctcggttaaccgaattaaccgagaaaaccgaattgtggcctaatagatctaggaggcacgataagcccaataaactactaaaccctaaagggaaccactgacactccctcctctcccaccagcctcacgcagcgccgccaccaatcccctcgcgctcggcgctcgcgccgtgcggtcacgctgcctccgcctccaccctccatctccatcacgccggcgccgtctccgccttccgcctca

SEQ ID NO: 4661 - DNA, 1432 bp, Oryza sativa
cgcggcgcggggggaggaagaacctgaggcgcaccgggaagaatttcccggtcagtcacccatcccaaaattgctctaggccatgcacacttaaccttagagttttttcgagatcggcttccggaaaagaagttgcaacttgttgatgagtattctattaatcctattaagccctgagccgggatatcacattctcacccccttaagataccgacgtcctcgtcggtcaacccaggccaggaatgtctcctattagcaccacgtatatgcagacatttttcggcgcacatacgtcataccatacgaccacatcgtggatcatcccgtatacactgtatgcccgcgtgcatattcatatatacgtatagctacaagagtcggctctgataccatatgtgacgcccccacactctccgaggccgggccctttctacatctggcagctttcctaggatatagactgccctcacaaaccaacactagtcttttctgcacactttgttctcactcatgcacactcgggaagaatttcccggtcggtcacccatcccaaaattgctctaggttaagaagaatttctcggtcggtcacccatcccaaaattgctctaggccaagcacgcttaatctcagagttttttcgagaccggcttccggaaaagaagttgcaagatatgagtattctattaatcctattaagccttgagctgggatatcacatcctcctcccgccgcccgcgtgccgctcctttccccaccgcccacgcgccgctccttcccctaccgcccgcaactcctccccctgtcgcctgcgcgccgctcccccagcgttgccgccttgcactgttgatctcgctgagaagagagagagatgaggaaggcagagaagaggggaaaagagagaggaggctgacatggccacgctgacatgtgggtcccacgctgactcagccgccacgtcggataaaaccgaggtcaaaaccaccgaaggacctaaaacgaatggttttgttagttaagggatacccgatatctggttttgcggttgggagacgattttgtaactcgatgacaagttgagggaccttcggtgcacatgaggcccattttatttgtgtcgggaatgggtttcgtttcacgtgaggcccatctatatgggccacaaggagactgcgatgtacttgcgtcccgttataaacgggccggaccgggcctctagtggcatcgtggggtcgtagcccaggtgaaaacgcagcacatctccctcgccaacgcggccatatccagaagccgaaaccttcttccccttctccttctctttcccctcggcggcggcggcggcttctcccttctcttctctctctcgcatcgcctactcgttcgttttccctcgaggaggagcagaggcggcggcggcggcggcggagcggaca

SEQ ID NO: 4662 - DNA, 1443 bp, Oryza sativa
tagtgcctatgaatggggctatacctaagacgggtgccttctttgtcgctgctctccgcctcctcgtcggagtctacatttggtaaccttgacgtcctccatcacctctcgtccctaagccagtgtaacactctaaaaattcaactaataaactgtggaccatagttgacgactgtcgaaaacttttattaaattgcatcataccgatggtacacctctcatttattgtagttattattggtgccaaccaaattaattcatggagtcctcaaaaccaaatcaaactatataaaataattaaaggaattaagttttgatttgattaataaaattaaatagatataagggagaagtgtaaacttataaaataaatatggtagaaccaaagcatctagaataaagttcatgaaagatattcctaattacttaattaaatcaactttgaaattaccattttaccctcctatttttttcctttttcctttccccgtttcttttaggcaaaatttgatacaggacaatcaaaaatcgtgtaattggctgagagacaccaaaaaatgtgacactgccgatggacactacaaaagttgtgtaattagttataggacaccgaagggattattttataattttcgggctaaaagaggggagagaaatttcgaattgacgggaatgtcccctctactccttcctcatggccgccatcaagcgctcccaggccaccttccacttctaccactaggccaccaccgcccagactcccgccgccgtcaaggtcgtcagccgcgtctttgccgaggccggattccgtagcggggacatcaagctcaccatcctccgcccggctccatccatgccgctcctcggccgcctccccacgcgcacccgcccacagcctcgccgacgagtatgcctccttggcacccttcaccgccacctccgccaccacatcaccgccgccgccgtcgtccttcttcactgtctgaaagccctgcacggcgccgccgacgttcagcatgttggcgaggccgatgggcacgaagctgatccgccgctccaacaagagctcgtaggtgaacggctcgagggtgagctcgaaggactcgttgcggcggagcagctgaagcttctgtgcctccacgaagtagacggtgaagcagtcgacaccgtcgccgttgccgccaccgcttccgtgcctccacgaagtaggcggtgaagcagtcgacgccgtcgcctttgccgccgccgccatgcctccactcggacttgtgcctgtatagctcgttaattcatcttctcctctctccttcacatttgtttctaggtagcttacttgctctaagcgatgataaattagtaatattcaattatccaccaaatgagcaattaattaccacatgactactgatatacaaacacagtccatctccttggtattcacta

SEQ ID NO: 4663 - DNA, 1501 bp, Oryza sativa
  unsure (1)..(1501): unsure at all n locations
ccacaccatcctacaagccaaccttccanncagcagcgcgtcggcctccgtcgccgcatccgccgcggcgaccaccaccaccagcagcagcaggcggagggcgtcgtgtctccgcggcattggcgagatctagcggcggcgggtcagtggcttgggtttggctgctttggaggcagcctggttggtcgccggagttcgcgtggagggaacgttttttttttaagagcttgcggcgcggggggcggtcaacggggcggggttgaccaaaacacgtggggtgggggttgggtggggtcgacggcgggtgggggccacgtacgtttgtgttgacgtggaatgattatagccgtgcgatgtacggccagcccagtgtcaatttgtggtggccagatggcgtgggtcggtcgaaagtccaaaacccaaaccggagtgtgtcgtgtggtacgtggggtgggatgccatattcgcccccaaatataataatttttttttgtcatatcctttattttattggtgaaataagccaaacgatatatttgtaaattaaataaattttttatatatgtgtttttagcaatctagaagtaaaggctgaaaaataaactttgattgaaaaaacctcaaaatcaactttaaattttttatgttaaaaatttaaattttggtagataagtataagcataagcgaaaagatgagtcccttagtatcggataacattctagtactggatgtgacatattctagtataatgaatctagacagatgtatgtccagactcgtaatattaggatatgtcacatctagtattagattgttttttatgggatggagagattatgtgattctaaatttttatattttgagatgggcagtaatcataatcatggtcctatgtgtcctaggaatttaggaaccacgggcgtactggatgtgtgtgaacatttgtatgtttgactttggtgatgttaatattatctaaaatttggatccaaacttcagtcctttttcatcacatcaacctgtcatacacacacaacttttcagtcacattatcttcaatttcaaccaaaatccaaactttccctcaactaaacacagccattgtctctgatcctacagccccatttccactatcagaaacatattacgtcaatcattaatatagaggtatccacattaaaaaaaaggaaatcaaaggtgctcaactgtctaattgtcagtgtcagtaaaactagatccacaaattcccaatgtcgtctcatcacaggaagatgctcatctagagttgaaaatgagccgatcttggtacggtgctattggagtgggaacgtgggataaacttgctttctctcaaacattagaaaacacgctccacttggaacttgattgttttgattgtttgatctactactgataaagccgtagaaaaacaaactcaagcaatagaaaatgattattaatgaaaatttaaaatatttgtccttagcgttttaaaaacca

SEQ ID NO: 4664 - DNA, 1501 bp, Oryza sativa
acgtgtggggtagtcatcatggtcctctgtgtttcctgggaatttagaaaccacggacgtgttggatgtatgtgagtcaagtggtctctttgaacatacatttgcgtgttcgctgccaggactttctgctcctatatcctcgttccattatcagaaactgattacgtgacagtgtagaatcatggatataaaggtgttcaactgtgggttaaattagaaaccacaatgcttacaaattccctatatcgtctcaccataagtagcagctcgtctagagttaaaaatgacccatttgttacctttttttttttcaggagacactctcaatcataaaatatggcaatctaatattggattgcatataaacatatactacgaatatagataatgccatatcttgggatggagtgagtagaacttgactgactgctatgaatgtttgatctacagtacaataatgaattaagcaatccaaataatttataaatacaagttttatatgtgtgttttttacggtttaaattatcttggaagataaaatataatgtaaaagtaaaatttgctataggacatctaaagtttataattcttggtgttgaacacctaaaaatgtgacatggttgtagaaaaaaaactggtaattcactaagagacactatagtcattattttatcattttcaggaaaatgaggaaagaaacttttagagaagatgagtttgccccctaggccaattgcttgtaatggcctctgtcatgggccctgtctttcaccgcctccaatcttaaggtcttggagaggggattggtagaggaaatgtggcttggatctggttccagatatgttaaatgataaaataataacagcagtctcccctaataaatcatcggttttttatgtcctaaaattgagtttatgttttttagtgtccaagagtaaaaaatcataaattttgaatatcccatagcatacttttaccaatgaaagaaaaaccttagtgttaacttaaaagtaagttttgaaatttaaattttgattgcagcatataataaaaaaaggagaatgatggttcatggatagacctatgatatgctaatctcactcgacgattatctttgacacaagaagtttagtaatatatttggcttgttggtatcagccgcaatcaaaattcaaattaattttagagcacatatgtgacataaccggtaacgccatccgatccacgagaaaggagatcgtgtggtttcatcgtccccgcacaatctcctccctcaggatctccactccaataaaaacgacctccatttggccattctctatctccacaagcaccaccatttttctccccacctgtggaaaccatggacggtgatggccatattcagcaattccctcccagcttcttctttgtgaaaaccgtgtctgtgcatctcctcctccgattacacattgacaaagaaatcaactttgacccttcactcctcttttccactaaagaa

SEQ ID NO: 4665 - DNA, 1501 bp, Oryza sativa
ctagagtttttttttctttttttttcattgtttttttcattcattagttcactaaagtcatatattgatttcaagcaccaacgtcgtcatccctaaatccccacaaatcatgcacaacgaatcattcacaattcataggcccatccacaaaatcatccacaatccacaaaccatttataaaatcatccacaaaatcgtcaccaaatctaaaaaaatctacaacaatatttacgaatcattcacaaaatctaaaaaataaatccacagccacagtcgccgccggctgcccaaccgtgcgccgcctcccagcctcctctctcgtcggatctggcgaaggggaggccaccaccagccgccgcggccgcttccgccaggctgtcgcttgccctccccttccgtaggatctggcggaggggaggccgccgcccggcgtcgccgtcgtcggaggaggggggagggggagggggagggggaggagaggggaaggagagggtgagaaaatgagaggggaggaggagataaggacgaggcgcacggttcaaggcagcaattcacgatttttttttaattttggtgggactaaagataaaaagaacctatggacttttgaaccgttcctacttgaacagggactaatatgatttttgcatgtcccagtaaagatcacttctccactagtgcacgtatcatggccgcaccaacgggaggcggcgatcaagcctagaacagataatgaattaaaccggcctctacctccaaaacgaatgtacacacagctatcatactccaattaacacaagatgaaattcagagttcaaacttcaaataccaaaaaaaaaaggcacatcatcgatcgatcaaacatcgcgtactggataattattaattcaaactcacgcccttttcttcaagcgcacgtacacaccacgcgtatatatgccacgtacgcatcatggccggcggcggcgggagatcgagcctagcagctgggaatggggatgccgcaggcggcgatggtcttgcgtgcgttggtgttgttgacgtaggacgcgtacgtcgggtctttcgcgtactggcagaggcacccctccttctgctgtgcgcgtaggttggagcagcacgactctgatggcgccgtcccgtagaagatcgggctcacgcacgccgatagctgctcagggtcacactgcgccgccaccaccgctaccgccgtcgctgctgccgtcagcagaagcatctccatcacagctgcccacttcaccattgctcgagctagctctagcgtaagaactgcttggttactagccgaatgtgatcgaatgttatcgatgtggtggtgtagggaaaggatgcacatcagggtatttatagacgagatgtcagaaagcaggccatgcatttcgtgtatactcctttcgtaccaaaaaacaaattcaggctttgtcgtagtagtagtagtactagtgccagagctgttcttcttctctagcaaaacggagga

SEQ ID NO: 4666 - DNA, 1501 bp, Oryza sativa
tagaaccctctgtagttcggtttttctatgaattcgggattaaaaatcgctatgtttagttctggttcaaatacccatgactaaatatcgatctttaatcctgattagtaacaccaaccgggagtaaagaggggaatcttttagtcccggttggtgagggtagcgccacgtctctggtcccattcttctctttttttttccatattgatttcacaccaatctcaccaaaatcatcacaattccaaatagagatgctccctacatctccagatcaaagtaacaataacacaaatcataatattcacatcacaacttgtcgaaaagaaacatcacaaattctaaaaaaaaattacatcacaaatacatcatagatcaaataacacagatccaataaatcataaattcttaaaaaaaagaaaaaaaaagaaatccggccgcagcgagctcctgtcgcgccgccgcctcctcctgcttcccgccgcgggccgccgcccccatccggccgccgccaaccataccccgccgccagcctcgctggccaccgctcgctcctcgtcggtagcaactgtgagaggatgaggaatagaaagagaaggatagaggacaagagtgagagagaggatgaataggagatagaaaattttgaggataagagagcaagagattatacacggtatattgatttttggtcctgattgggaacaactactaggactaaagttaggattttagtcccggttaatgttaccaaccgggactaaaaatatctgggacctgacagcctctgacacgaggtgaaccgggactaaagatcatcttaattttactcccggttggtgttactaaccgggactaaagatcacacagtccctttatatttataaactgctttttagtcccggtttttaatggaattgtaactattgtggatttggattgaccgactaaagatggtttctcttactggcgtccaaacacaaacaacaaattaagcttgatacatgcatgttgatgtaaaaagttttgaattggtttcgagtgtccacaaaaaacaaataagatgccccatggatgcctgcctgcaaacttatactgtctgcttggatgatttccttggtgcgatcctgttcttgttgtgatccaattaatttggcagacaccaattttctgcacgcgtacatatatatcgatccattgttactagtcaaagaaacccaaatgcatatgtatacgagtatccaaaatgcacgaaactgaggatagatccatgtctctttcttcttcatccattcttcctccgttttgctagagaagaagaacagctctggcactagtactactactactacgacaaagcctgaatttgttttttggtacgaaaggagtatacacgaaatgcatggcctgctttctgacatctcgtctataaataccctgatgtgcatcctttccctacaccaccacatcgataacattcgatcacattcggctagtaaccaag

SEQ ID NO: 4667 - DNA, 1501 bp, Oryza sativa
aaatcatgccaaaattttagcaatattatcatcttaccaaaatattggtattgccaaaacttggtaaggtttattttggctacaatctcaatctgaacaggccctgaaattctgaaaaggaatcattggtgagacctatccctgtaattctacagtacaaaaattgttgcgatccagaaagcagtatatatagacagagaaactaaatcactaagtctggtgatcaagtgacagtgctactacaagctctgtaatatctattgttagtccaaactctgaaattctgaatgaagtagtacaggcaaggactgaacaagaagggaaggaggaggagcagaaaagcacgaggcactttggatgtggttctcatgcttattaaagctcagtaataagttcaatggaattgattagttctgcatgagtacgaattaaattgactaaatattcaaaatcctaaatcactggacagatactctcctaggtcagagatgacatagaatgtacatcaactcatgaaatcagcaagttataatcctcaaatcccagagcaatcaattaaccggctcctctcttggattttcgatcatgttcatgacattctttatgcatcgtgaacagtggtcagtggtctccggtcgtcgccgtcgtcgtcttcttctctgatctttctcatcggatatggccatatggatggtgaaacgtgaccatggcacgaagacgacgaaagtgtgaaacagtgaggcagccgcgagacagatcgtcaatccggcgtgacgacgatggcggggctacttgcaccaagatcatgcgcatggtgatttgatggttgatgctattattaaataaaatcgatggagaaaagcaaattaaatgccaattcaatcataattactcaattcgtttcatattataaattgtcctttttcattaaacttctttaaatttaaccaaaaaatatatcaatattttgaacacaaaataagcatattattaaaatatattaaatactaattttaatgaaactaattttggtgttatagacgttaccaattttttctataaatttaatcaaactaaaaaaagtttaacaaggaaaataattagaacaacttataacacgaaacatgcaaagtacctcacaaaattttttttaaaaaatattgaatgctactttctccattttatattataggggcaattgcttatttgaccctgttttgaaacttaactaccaatatgaccctactttttctagtttgcttatttgactctacttttttaaaatgaacactccgtttggccctgttttttaacacagttaagttttcattttttaaaaaagaaagaaatgcaattatttttcgtaatgaccaaaatacccttgaccaaaccctatccatatctacgtctctccccgtattccgtctctctctctctctgtgctggcggcggcggcgactcgtggagggagagcggcggagaccgcgaggtgcagcggcga

SEQ ID NO: 4668 - DNA, 1501 bp, Oryza sativa
ccactcgctcgctgctgagagacggcgaggaggagttcctcctctccctgactgccgaggaggccgctatgttcctccactcgctcccctcctccattcgccgcgcgctgcctgtcgcggcgcatggcctgctcgagctcggcacgcgcacatcgagctcgtggcaccggtgcgccgtggccgcgaccaagcgctgcatcgtgcacaccttccggtccccatctcctcagctgagtaccgcagcccgacggtgagagcgagggcggcgaggaggacgagcacgacggcgagagcgagggcggcgcgggggacaagaatgacggcgatggcggcggccagacgaggagtacgagcacggctgggcgatggcggcggccaaacggggacggggcttgttgggccggccttggcccagactcatgacgcggccgtgcgctttttgggcggacggttcgatcgaacgtggacggctggatgacctcgactgctctctgccgtcgtgagggctgaagtcagaggagctgattccctctctcccacctgggcagagcaaggttgactggttgagcggggtggaggcgacaggcggggcggagctggacgggcggtggccggagcaggccagtggagctaagcggcggtggccggagcaggggcaaggggccacggcaccgcgatgccgaggggtgactggcggagagaggggcggcgggtggagcagtggagagtggcggcgagctcctgggagatggcgacgggatgaggccgagaggacgccaacggcgaggtggagcacgcacctcaagaagcgggtgtcgccggagcagaagaagggtgggggcaagagcaagaagaagatgacctggaccgacgtgctcgtcccgtccccctcgccatcgtcatcctccaccgcgacgaccaactgctccaggctccagcggcgactcggccgatgcgcagagcaacacaagcaaggaggaggaggcggacaagatcgagatccccatgctcgacccctgtagcttgtcatcacggacgcaaccactgctgccgttacggccatggcgccgcctatcagcgccagaacttggtatttccctgaagaatctcgcatattgtttgctgctactgctaccagggtggcggcgagcggtgccaagcaagacggcagcgaccgagatggcttgcgatgaagttgagtaaccagtacagtatcaagcattcaagctctaccgcttttgctcaagctaaaatcatcgcatctacaaagaatcaagaattaattggccagtatcaagaataatgacgcgggctgtcgtcctcgtgagcggcctcctctccatcatctttagcgcccagcgccgccccgccagcccctgggcagcccaccgccgctcgtggttccggttgcgctccacctcccgaagcacttcctcgtcctgttcgcaatccaggaccgcgaagttgcgtgacgggctgacggcgacgacatgtcgcctgt

SEQ ID NO: 4669 - DNA, 1501 bp, Oryza sativa
ttttctccctttactttggaattttttcgccctgttttcaccacgtcgacggagtcggattcgttttgatttttcccctttttggctttttttgataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcgtacaaatttttttttcgcccatttttttttctcctgtttttttcggatcagactatttttttcttttttcgcctggtcgatttttttaccacgatatatataattcctttttctttggaataggacagttttctttttatttttttaaactctttttaccgcgtcgatgtagtcggattcgtttcgatttttttcctttttttgctttcttttttgtcagacagatttgttttttttccacccggtttttttccgcccaggtttttttatcggacttttcttttttttttttgctccacgatacatataattcatttttctttggaataggacagttttctttttatttttttaaactctttttaccgcgtcgatgtagtcggattcgtttcggtattttttccttttttttttgtcggacatatttgttttttttccgcccggttttttttcgccaggtttttttatcggacttttctttttttttcgctcggtttttttctctcgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggactttttttttccctttttaagggatcgggtgtttttttgccagggacgggtgtttttttcgcccggtttttttttttcactttttttttggatcggactttttttttcgtccggtttttttatcaaacaaacttggttttttctgcccggtttttttcacccggtttttttgacggacgatggaagcacctcttattttttaagtagtagtagatagtagagtagtagattcgtgtccgaaaaacccttctcacacaaaaatatccaatgtgacacccaaatttttttttcgggaacagtaagcgagtaacacgtgcgctcgtgcagggcgtgtaccagaaccaggaaggccaaagccaaacacaacccctcccattcaaaaatatcagcccctctctctcccgattccgacttcctcctgatccacctccaaagcccacgccacccgcaccgcaccacccaaagcggggggaaacccaaaccggcgaaaccctagatctctctccgctccgcctcgtcgctcccccaaaccctagatccccgccatgc

SEQ ID NO: 4670 - DNA, 1501 bp, Oryza sativa
cgccgtcccgaagaagatcggggccgcgcatggcgacagcagcccggggtcacactgcggcggcggcggcgattgcgccaccaccaccgccaccgccaccgtcgccaccaccaccagcagaagcatctccattgcagccgcccacttcgccattgctcgagctagctagcgcaagaacagccgcttggttactagccgaatgtgatcgaatgtgatcgatgtggtgtaggggaaggatgcacgtcccgagtatttatagacaagatcgaggtgttgtagaaagcagaccgtttcgtgcactctcttcataccaaaataaattgatgtgtagagtttagactttgccatagtggtagtagtactataactgttcttctttagctgaacggaggaagaatgaatgaagaagaaagagacatggatcctctcagtttcgtgcattttggatactcgtatttttacatatatgggtctctttgactagtaacagtgggtcgatatgtacacgtgcagcaaattggtgtctgccaaattaattgaatcacaacacaagaacaggatagcacccaagaaaatcgtccaagcagatgtacaagactgcacgcaggcatccattggagttcatttggtcatcttatttgttttttcgtggacacaggaaatcaattcaacactttttacacattaatatttgtcaagcttaatttaaatgttgttcggtttgaacgtcatagtcactccacctgtttttaaaatatagttgttatagactatcaccgtgcaaaatgtatcaagcgtatatgtttatagctccattttctctctcggtactagtgacttcgtcatatttccacggacgccggttgcttgagcttgaggagcatcgcctcctagaggaaaaaaaaaacagaaataaaaaaccaaacagaaaaaaaagaaaaaaaaaaccacgcgggcctcacactgtgcacgcgctgccaccacggccctctccatgcgcgccatgtgcctcgccgcgggggagggcgcgcgcactgttagtcacacattaacaatttgattgaaatgctatttcagaataccaatctctcaactgaaatttctcatagacaaaatcatcaacaaatttaaaacatttgaatagtatgaactataatggacggatccagaataattaagaacataggatgactcatctatttcttcctccttgagctgccactaatcttcctccttttctcccttcattctttccttctatcaatggtgatctagcgggttcgaatcccccagcactcacgctagatccacccctcactatatatataaatcaatcatctgatcaaaccacgataatgatacgcttaactgtaaaatactccttttctgttgtaatgacgtgcttaaccataatttgctcctatcaagcactagtattccgttgtttcagttagatgacctggtatatggtttatcattttcttattatcaagtttttttt

SEQ ID NO: 4671 - DNA, 1501 bp, Oryza sativa
cttcgtaaatctctccaggaggatttgccggtccagtcttcgaagatgttcataggggtagggttggtgtgcatgtgtttatagggggtgagtgcgtgtgcgttgtgagtgtctgcactgtactgtgtaatttaaaaaaaaacttgataataagaaaatgataaaccatataccaggtcatctaactgaaacaacggaatactagtgcttgataggagcaaattatggttaagcacgtcattacaacagaaaaggagtattttacagttaagcgtatcattatcgtggtttgatcagatgattgatttatatatatagtgaggggtggatctagcgtgagtgctgggggattcgaacccgctagatcaccattgatagaaggaaagaatgaagggagaaaaggaggaagattagtggcagctcaaggaggaagaaatagatgagtcatcctatgttcttaattattctggatccgtccattatagttcatactattcaaatgttttaaatttgttgatgattttgtctatgagaaatttcagttgagagattggtattctgaaatagcatttcaatcaaattgttaatgtgtgactaacagtgcgcgcgccctcccccgcggcgaggcacatggcgcgcatggagagggccgtggtggcagcgcgtgcacagtgtgaggcccgcgtggttttttttttcttttttttctgtttggttttttatttctgttttttttttcctctaggaggcgatgctcctcaagctcaagcaaccggcgtccgtggaaatatgacgaagtcactagtaccgagagagaaaatggagctataaacatatacgcttgatacattttgcacggtgatagtctataacaactatattttaaaaacaggtggagtgactatgacgttcaaaccgaacaacatttaaattaagcttgacaaatattaatgtgtaaaaagtgttgaattgatttcctgtgtccacgaaaaaacaaataagatgaccaaatgaactccaatggatgcctgcgtgcagtcttgtacatctgcttggacgattttcttgggtgctatcctgttcttgtgttgtgattcaattaatttggcagacaccaatttgctgcacgtgtacatatcgacccactgttactagtcaaagagacccatatatgtaaaaatacgagtatccaaaatgcacgaaactgagaggatccatgtctctttcttcttcattcattcttcctccgttcagctaaagaagaacagttatagtactactaccactatggcaaagtctaaactctacacatcaatttattttggtatgaagagagtgcacgaaacggtctgctttctacaacacctcgatcttgtctataaatactcgggacgtgcatccttcccctacaccacatcgatcacattcgatcacattcggctagtaaccaagcggctgttcttgcgctagctagctcgagcaatggcgaagtgggcggctg

SEQ ID NO: 4672 - DNA, 1501 bp, Oryza sativa
  unsure (1)..(1501): unsure at all n locations
gggattaaaaatcgctatgtttagttctggttcaaatacccatgactaaatatcgatctttaatcctgattagtaacaccaaccgggagtaaagaggggaatcttttagtcccggttggtgagggtagcgccacgtctctggtcccattcttctctttttttttccatattgatttcacaccaatctcaccaaaatcatcacaattccaaatagagatgctccctacatctcagatcaaagtaacaataacacaaatcataatattcacatcacaacttgtcgaaaagaaacatcacaaattctaaaaaaaaattacatcacaaatacatcatagatcaaataacacagatccaataaatcataattccccttttttttaagnaanaaanaanaanaaaaaaaaaggggnaaaaaaaaaaaaagnnaaatccggccgcagcgagctcctgtcgcgccgccgcctcctcctgcttcccgccgcgggccgccgcccccatccggccgccgccaaccataccccgccgccagcctcgctggccaccgctcgctcctcgtcggtagcaactgtgagaggatgaggaatagaaagagaaggatagaggacaagagtgagagagaggatgaataggagatagaaaattttgaggataagagagcaagagattatacacggtatattgatttttggtcctgattgggaacaactactaggactaaagttaggattttagtcccggttaatgttaccaaccgggactaaaaatatctgggacctgacagcctctgacacgaggtgaaccgggactaaagatcatcttaattttactcccggttggtgttactaaccgggactaaagatcacacagtccctttatatttataaactgctttttagtcccggtttttaatggaattgtaactattgtggatttggattgaccgactaaagatggtttctcttactggcgtccaaacacaaacaacaaattaagcttgatacatgcatgttgatgtaaaaagttttgaattggtttcgagtgtccacaaaaaacaaataagatgccccatggatgcctgcctgcaaacttatactgtctgcttggatgatttccttggtgcgatcctgttcttgttgtgatccaattaatttggcagacaccaattttctgcacgcgtacatatatatcgatccattgttactagtcaaagaaacccaaatgcatatgtatacgagtatccaaaatgcacgaaactgaggatagatccatgtctctttcttcttcatccattcttcctccgttttgctagagaagaagaacagctctggcactagtactactactactacgacaaagcctgaatttgttttttggtacgaaaggagtatacacgaaatgcatggcctgctttctgacatctcgtctataaataccctgatgtgcatccttttcctacaccaccacatcgataacattcgatcacattcggctagtaaccaag

SEQ ID NO: 4673 - DNA, 1501 bp, Oryza sativa
ctagagtttttttttctttttttttcattgtttttttcattcattagttcactaaagtcatatattgatttcaagcaccaacgtcgtcatccctaaatccccacaaatcatgcacaacgaatcattcacaattcataggcccatccacaaaatcatccacaatccacaaaccatttataaaatcatccacaaaatcgtcaccaaatctaaaaaaatctacaacaatatttacgaatcattcacaaaatctaaaaaataaatccacagccacagtcgccgccggctgcccaaccgtgcgccgcctcccagcctcctctctcgtcggatctggcgaaggggaggccaccaccagccgccgcggccgcttccgccaggctgtcgcttgccctccccttccgtaggatctggcggaggggaggccgccgcccggcgtcgccgtcgtcggaggaggggggagggggagggggagggggaggagaggggaaggagagggtgagaaaatgagaggggaggaggagataaggacgaggcgcacggttcaaggcagcaattcacgatttttttttaattttggtgggactaaagataaaaagaacctatggacttttgaaccgttcctacttgaacagggactaatatgatttttgcatgtcccagtaaagatcacttctccactagtgcacgtatcatggccgcaccaacgggaggcggcgatcaagcctagaacagataatgaattaaaccggcctctacctccaaaacgaatgtacacacagctatcatactccaattaacacaagatgaaattcagagttcaaacttcaaataccaaaaaaaaaaggcacatcatcgatcgatcaaacatcgcgtactggataattattaattcaaactcacgcccttttcttcaagcgcacgtacacaccacgcgtatatatgccacgtacgcatcatggccggcggcggcgggagatcgagcctagcagctgggaatggggatgccgcaggcggcgatggtcttgcgtgcgttggtgttgttgacgtaggacgcgtacgtcgggtctttcgcgtactggcagaggcacccctccttctgctgtgcgcgtaggttggagcagcacgactctgatggcgccgtcccgtagaagatcgggctcacgcacgccgatagctgctcagggtcacactgcgccgccaccaccgctaccgccgtcgctgctgccgtcagcagaagcatctccatcacagctgcccacttcaccattgctcgagctagctctagcgtaagaactgcttggttactagccgaatgtgatcgaatgttatcgatgtggtggtgtaggaaaaggatgcacatcagggtatttatagacgagatgtcagaaagcaggccatgcatttcgtgtatactcctttcgtaccaaaaaacaaattcaggctttgtcgtagtagtagtagtactagtgccagagctgttcttcttctctagcaaaacggagga

SEQ ID NO: 4674 - DNA, 1501 bp, Oryza sativa
attcaaacacacatcctttattttattcaagtacgcagtacaccatatatatatgcttctagacatcgtcctttattttttacaaggacatagggcagcatatatttatatatgctgccacacatcatggccagcaccggcaaacggcggcgatggagcctagccgcagttgggcaaggggatgccgcaggcggcgatcatcttgcgtgcattggtgctgttgatgtaggacgcgtacgtcgggtctttcgcgtactggcagaagcacccctgttgtgctttcaggctagagcagcacgacgccgacggcgccgtcccgaagaagatcggggccgcgcatggcgacagcagcccggggtcgcactgtggcggcggcggcgcctgcgccaccaccaccgccacagctgccgccgccaccgccaccagcagaagcatctccatcgcagccgtccacttggccattgctcgagctagctagcttaagaaccgcttggttactagccgaatgtgatcgaatgtggtataggggaaggatgcacgcctcgggtttttatagatgagaagtgttgcagaaagcagaccgtttcgtgtactctcttgataccaaaataaattaatatatgtatagtttagactttaccataacggtactaatgctacaactgttctagctgaacggaggaagaatgaatgaagaagaaagagacatggatcctcagattcgtgcattttggatactcgtatttttacatatatatatgggtctttttgactagtaacagtggatcgagacgtacacgtgcagcaaattggtctctgccaaattaattggatcacaacacaagaacaggatcgaacccaagaaaatcgtccaagcagatacaagattgcacgcaggcatccgtgggagctagttcatttagtcatcttttttgttttctcgtggacactcaacactttttacacatcaacatttgtcaagcttaacttaatttaaatgttgtttcgtttgaacgtcacagtcactccgcctgtttttaaatagtcgttatcgactatcactgcgcaacttatatcaagcgtatatatatttccagctccattttctctcttggtgccagcaacattgtcatatccactgatgccggttgctcgagcttgaggagcatcgcctcctagaggacgccctctcaatgcatatcttcttcttcttaggccccgttcgatgcttcaaaaaaatgaggaaaattttgtgcgcatgcaaaatgagtaagctcgataacacataattaattaaattttaactattatatatttaaaaataaattaatttgattttttaaaacagcttctataacgcacatcaagcatacgacggagccaccgggagctgtagcaaagctttacctttctataattcagtaccacatggtccattgctgacagactttgctggtggcaattatcaatcaatgtagaatgcagctcatgatcagtcggt

SEQ ID NO: 4675 - DNA, 1501 bp, Oryza sativa
gcggtgggcttgccggtgcgcgacgtagcgacctctgctcgggatcgaccgggcctctgcgggtggtgaggcacggcgcggcgaggccgacggccggcaggggggatggtcgtgcggcggctgcgcgttcccccctttttcctttttttcattttgttttgtttcttgtttcctcgcggtgcagagcgcagatcgacgcagctcacggcggcgcgttgcggacgcggccgtcgtggtgtgaggcgtggtggccggtgcgcggccagaatggcgctgcttgtcgcctgggtgttctccccttttcttttctgttcttctttttctctttcctccatggccggtgccaagagtagcgcaagcggcggagcgacaaccgacggcttcgcagttcgtcgcttggcagccctgcggtgtgatgctcggtgttcaacggtgtgttcgaccatggcagccaacggcgagtccacgcgatggcatgctctgttgcctgtccccgtctggcactgtgtggcagaggcgcatctcgtgcggatagaacaccccaatcggcttgtgccggtgactccaagtcggcaatggcggtgttcatcgggagtcaaagaaaaccagaacgagaacacagagaggaattcgttttcgcgattgaatcagcgggatgcaatgcaaatcttcgagttattacccttcttctttctcggtctccggtagaacatcgtgctgataacgtattacgcaacccctcctgctaccgaggtagtctaagagggattgagtaattctacaaaagtggagatacaagatatgaggttgtggcatcctttctcattcatccattgtattctcaagtgtacaatcctcctctctactcctctatttatagccattccctcttccaccttccatgtttagtgatgggcccaattagtgagtaaccgggccgggccttcatgggccaacggtttcctaacaagtatttgtgcatttaatgtctactttatttacatattactatgtccggtttttaataatttatacatatatccatgccttgcaacgagagattcaattttctattagctaatgattgctcataacattatttagggtgtgttcggcacccctttttcccaaaccatctctctcgttttccgcgcgcacgctttttaaactattaaacggtgtatttttttcaaaaagtttatatacaaaagttacttaaaataatcatactaatctatttttttaaagaaaatagcaaatacttaaataatcatgtgttaatggactgctccgttttcatgttactgttccgggttgggaaccagcgtatgcgaacacacccttagttttgttgggtctgctttctccagtttttttttggtttttttataaggggcacggtatgcgcatgaagtaggtgagaagggtggatgatcaactctgtttttatgtagtagagataagtaggcaagcaaagcataatggcgtgattcttaaacag

SEQ ID NO: 4676 - DNA, 1501 bp, Oryza sativa
gtcacaccatattttcttatctcacttttctttcttcacaacaaaagccaagcatcaggaattatacaacacaacacactctagatgagaagctaattcatgttacagttacacacaccaatggaagaggaagaggaagaggaagaagaaagaaatattattgtggggggagatctacaatgctgtgtattgtgactgaccacacccttgctaacctgggtacctgtgtcctctgcagagcacctagatattgtcctcatttcatacaactcatccagctcaacagccatcaccagctgttctctgtgtatttcttcagggcacgtaccgtcatcaccagctgctgcctctcgccttcgacttccgcgaatttcaggcttatctctgagtacggcccgtgcagttctttcagctcttcctctagtgcagtgttccgcgcctttaccgactgatcatgagctgcattctacattgattgataattgccaccagcaaagtctgtcagcaatggaccatgtggtactgaattatagaaaggtaaagctttgctacagctcccggtggctccgtcgtatgcttgatgtgcgttatagaagctgttttaaaaaatcaaattaatttatttttaaatatataatagttaaaatttaattaattatgtgttatcgagcttactcattttgcatgcgcacaaaattttcctcatttttttgaagcatcgaacggggcctaagaagaagaagatatgcattgagagggcgtcctctaggaggcgatgctcctcaagctcgagcaaccggcatcagtggatatgacaatgttgctggcaccaagagagaaaatggagctggaaatatatatacgcttgatataagttgcgcagtgatagtcgataacgactatttaaaaacaggcggagtgactgtgacgttcaaacgaaacaacatttaaattaagttaagcttgacaaatgttgatgtgtaaaaagtgttgagtgtccacgagaaaacaaaaaagatgactaaatgaactagctcccacggatgcctgcgtgcaatcttgtatctgcttggacgattttcttgggttcgatcctgttcttgtgttgtgatccaattaatttggcagagaccaatttgctgcacgtgtacgtctcgatccactgttactagtcaaaaagacccatatatatatgtaaaaatacgagtatccaaaatgcacgaatctgaggatccatgtctctttcttcttcattcattcttcctccgttcagctagaacagttgtagcattagtaccgttatggtaaagtctaaactatacatatattaatttattttggtatcaagagagtacacgaaacggtctgctttctgcaacacttctcatctataaaaacccgaggcgtgcatccttcccctataccacattcgatcacattcggctagtaaccaagcggttcttaagctagctagctcgagcaatggccaagtggacggctg

SEQ ID NO: 4677 - DNA, 1501 bp, Oryza sativa
tgctaattatataaaggcaaattttgctacaggacactccttatatgtggttttagccctaggacactgcccaaactcacttttgggggaaaatactccataaacgtggtaatttgccagtggacaccgcgccgattaaaataataatttccgattgaagaggaaagagaaattgcgtgaaatgtcaaaaatgcccttgggcccacatgtcagctctatctcctatctctcttctcctcttcctgcccacatgtcgctccccgccggtcgtcgaccgtgcacgcgcagacagcggcggaggcaacggcgagcagcagcagcaccccggccctctggcggcccaccagccgcagcgcgcggtggagcagctgcagccgctccttctccccgctgcctcgccaccctcaccctctgcccccacccttcctcccgccgccggccgacgcgagcaagtcgtagctcccgcaccgcatctccagcgccaacgccgagccactcatcgccaccgccgccgcctttctctcatcccaatcgccgaatcacgacactgctgccgacgacgatggtgacgagttcgaggaggaagaggacgtgcgtagctcgtcccccgcccgccaccacccgtgcccgccgcatccagctcatctccgtcggctgtcgcccgtcttcaccggcggcgcggagcggggcggtggctggcacagcacgcaggccggcgaggaggtggttcgcggatccggcggtgcagagcggggcagtggcggacgacgacgacgatggtgacgagttcgaggaggagcaggatgcgcgcagctcctcccccgctgccgcccgccgctcgtgcgcagctcctccccctgcgcgggcatggccgaaggccggcttggagagcgaaatgtgggcaagaagaggagaagagagatagaagatagagatgacatgtaggcccaagggcatttttgatatttcacgcgatttcactctcctcttcaaccgaaaattattattttaatcggcgtggtgtccactggcaaattaccacgtttatggagtgttttcccccaaaagtgagtttgggcagggctctagggctaaaaccacatataaggagtgtcctgtagcaaaatttcccttatataaatcttgtggtgcctatcagcaatgtcacgtatttgcgatgtctcttaaccaattacaatacttataatgttatgcaacaaattttatcaagaagaacacagtcgtagcactagtactactatgataaagtctgagctatagaaaccaatttcttttggtactaaaggagtacatgaaatggtctgccttctgcaacacctctcatcatctataaatacccgggacgtgcgtgctttcccctacaccaccactagccaaagcagcagtcaactgccgcatcgatcacatcacatcaaccagtaatcaattgaccaagcggttcttgcgcctagctaggtagctcgagcaatggcgaagtggg

SEQ ID NO: 4678 - DNA, 1501 bp, Oryza sativa
ccgtcggctgtcgcccgtcttcaccggcggcgcggagcggggcggtggctggcacagcacgcaggccggcgaggaggtggttcgcggatccggcggtgcagagcggggcagtggcggacgacgacgacgatggtgacgagttcgaggaggagcaggatgcgcgcagctcctcccccgctgccgcccgccgctcgtgcgcagctcctccccctgcgcgggcatggccgaaggccggcttggagagcgaaatgtgggcaagaagaggagaagagagatagaagatagagatgacatgtaggcccaagggcatttttgatatttcacgcgatttcactctcctcttcaaccgaaaattattattttaatcggcgtggtgtccactggcaaattaccacgtttatggagtgttttcccccaaaagtgagtttgggcagggctctagggctaaaaccacatataaggagtgtcctgtagcaaaatttcccttatataaatcttgtggtgcctatcagcaatgtcacgtatttgcgatgtctcttaaccaattacaatacttataatgttatgcaacaaattttatcaagaagaacacagtcgtagcactagtactactatgataaagtctgagctatagaaaccaatttcttttggtactaaaggagtacatgaaatggtctgccttctgcaacacctctcatcatctataaatacccgggacgtgcgtgctttcccctacaccaccactagccaaagcagcagtcaactgccgcatcgatcacatcacatcaaccagtaatcaattgaccaagcggttcttgcgcctagctaggtagctcgagcaatggcgaagtgggcggcggaagcgacggtgatggtggttctggcggtgacggtggcggtggcggtggtggcggcgcaggcgccaccgccggtgcagtgcgatcccgggaagctgtcggcgtgcgcggtcccgatcttctttgggactgcgccgtcgaagtcgtgctgctccaacctgcgcgcgcaggagaaggacgggtgcttctgccagtacgcgagagacccgatgtacgcgtcctacatcaatagcaccaacgcccgcaataccatcgccgcctgcggcatcgcctttcccagctgctaggctagcttcgatcgccatgatgcatggcgtatattaaatatatggtgtgtgcttgaataaaggatgtgagtttgaatcagtaagaactatcgatcgattaatgcacccccgtacgtacgtgtttgatcgatcgatcagctggtgtctcctgactatttaagtttgagctaatttccgatcttgtgtggtactatcagtagtagtactactacactactactagtactactactataaacaaacatatattttttatgtataaaaaaatatacacatatacaaattttgtatatgatgtgtgtcaggattacggataaggtataccttctacccttggatttatgctgtataccgata

SEQ ID NO: 4679 - DNA, 1501 bp, Oryza sativa
ggcggcggacgcgaggggggaatagagcagcggagcgagtgccacactgccaccattagttcattaccaaggactagaatgaaaatttttttggatcgcaaccaatatagcgatctaatctaatgtagggactaaaatggaaaaacgatacaggtgtcgctgccagccaaactgtcaatacaacgaaaaaaacatttgatcgctatacgcgattcaaattcaaccagtggcggtctaaatttctagatgtaagagccaacataaataagacaaatcgtgattggtaccattgttaatagtgacagaaagtttactagtacttcctccgtcctaggataaactgattgggacggaacggttgtaaaaaaaaaaatgacttgtgctcaaaacactagaagcattgaatgtcagctatatttaggtgaactagaaggaccaagtcatctctgtttcctcacgttcacatggttgaatcttatctcctcccagtctctcatccttctcgcatctctctatctcgttcaccctctgcctcctccctctctcattatcgacgcagggtagcagcgctccaccgatctctatctccatccctgctccacctctcctagcacctctcttcttgctccacccctctcccactccctcctgctcctaggggcggagctacatgtccaaagggagtgctccggtcaagaaaattttttagctatagttacatcttttttcaccatatgtacaccccctcagtgcaaacttaagcacctacatcagcttaaatttggtctaaaacagagtaaagcaagcatgtgacacccctctccatttcgctctaactcctcccctgcctactccacctctcctagcacctctcttcttgctccacccctctcccactccctcctgctccacccgtcactctcctctgccggctattttttgcacccgatgcggcagctgggatgtggtggctgaggtagaggcttgcaaggaggcaaatctgatgaaggcgatggtgtcgtcggatggatgcagcgctcagctgatgtgatgcaggagaaggtggaggcgacgggtggatgctacaccgttggctgatctgatgcagatttctctttttctctactcttggtacttgctagttcatgttggtgaattcaaagcatttgtttttttcttgcccatctttactatgagaaaaattgataatgcttcccttcgtcatccatatttttcatccatggtccgcataatgccacaagatgcttctccataaccgatcttctccagtttaagcatatctcatattagtcctatatttcggaaggaaaaagtacgaattacccccctgaactatcgcggtcgtccgaattacccccaaccacaaaaccgggtattcttcacccccaactatgcaaactggacaaattaccctcctcgatctaatctgtggtgattttggtccacgtggtgttcgcgtggtagtccagtcagcactcta

SEQ ID NO: 4680 - DNA, 1501 bp, Oryza sativa
cgtatagtccatgagctttaatctagttattcgatttatcagataggcaagtggtttaaaagacatagttattcaatggtgagtcgaccgaaactaaactcgatttatcatgacataatagacacggttgccacttgccacagaaagaataagagcgctgctacacgtacttaaaagtgaaatacttgcaaaatccttacaaacaataatctgaactgtttgatttaactagacgagagttacagaaaatctatatatactcacagtttgataagagtttagtagaaagaatttcatatttatagcctttttccagaagaaatgatcaaatcaagaagtgaaaccggccggagaaagtctacaccggcaggcccggctcatgcagcccacgttaggaagcctggctgcactgggtggcccaacggtggggtgggccacctcgggccagccgcagcagaatgcatgggccggcccataaatgggccactccaaagcagaccggcgctcagaggtccatcctgatgaatgaacattcatgcaggtgaccggcccaaaataattacagaaacccaaaaattacagaaaaactacgggttgttcatgttataccatttcagaacataccatttttttaaagttgataaatatacgtatccattaagttttttactaataaatacgtaagaaatcctgtcaaaacttggcaatattgctaaattgttgccaaaactttataaggtttattttagctacaatctaaacagaccttatgtatttgctaaaaacttaaaaaaaagtgcagaaaattaggaatttgctcaaaaatatggtaacagtttggaccattagataagcttaatgatttattctagcgagagattcttgctggatgtatgcatgtaaatatattgtaattacaccgtaattatgctatagttatatttgaaatatttttatcttaaagaactgatatgttatatagctacttccgaaaactagcacggaaatgcttttttgaaaaaagaaacatatgttctcctttctgtgtgaataaagcacgagcagttccagttgtatatatatgcgtccaaatatactgtcccgtggtttattcatccaaacgacaaatccttttttctaaaaaaaaattccaacgcattactttcttcccttttctctagcgaaaaaaagaaagcaccgaccaaagtggctcaaaaatggacgcgtccaaagatcgcgctgccacatgacaacggacttcgatgaaattatcgtcaatttttatcaaattccgatcaaatcattcctcgtcggcgtccatcccggatactataggtggacaccttcgagtcgcttctctcttctccggcgacactgccactgccacgcgtccctcccttcctccccgcccaacccccacgtgtgcgtccacgtggcacccgcccatctcacctcctcctcctatatcctcctctcctccgccattgccgcacctcatcac

SEQ ID NO: 4681 - DNA, 1501 bp, Oryza sativa
tgtaattatctggtagttcgttagatttgtttgttttctgtctcttgtcacgttctatgcctagtacacctctagcttgcgtgcaagatactccctttgttttcttacgtatcacataggagttaaaaaaaaggaaagagggagcatgtgtttaaatttcactgaaaaaaatcgtgtttaactagctagcttgaaaaaccatatcagtataagataagattgttagcactttcacgaaatgaacacactagtatgttgtactttatgaaaataaaatttaaattatggatgttacacgtgtgtatggaaatcaaaatgattcatgacactgtgttggctggcagaagaacagtagtcgcaggtgaagaagtaattaacacaagtattgcacagtagattaactgcagggcatgggagaacccaccactcattaactcattggtcgtaagctgtcgtcctcgtggagtccgttaaactgatcgatcgtcgctaaaatactccaaaaacaactcaaaatttaaattcgagattacttgcgctgtccaaattaacaacactgagtatttggaggagtgtttatatattataatgcgccgtccacgcaaactgagtacaaactgctggtactgacaggaacaacattaactggaagcactgttcattctcgatcggcaaattaatcccaaattgattagtagtcgctaactcgtggggatttgatccaaccaactgcgtatacgcgtacgccgtgcatacgtgtcggcgtgtatatatctttactcactcccaaaatttaaatttcatatatctgtatccgtacatcgtaaggacccagagattttcaaaatgttgttgtactgcaaaattatttaatgcatcctactatccctctctttaattttcatgtgatgctgttgactctatattcaccgtatgggaaggtactactcctactgtaataaataaataaattaaaagagacagtgtaattattcacattatgaattaaaaacaatttttaacagcaaccatgtatatacagagaccagatgagaccatggtgttaatataatcattcgttgaccagaattgaggggctagcttaatattaaattcccacagggggaatcaagattagggattaataaatcaaatcaaatcaaatcaaagctgtggttaagtagtaaaactaaactgccacctgtacattaatctggccatgcatacttattatgaacccattttctgctctgctcttgctttgctttgcatttctttcccaaactgaagaagctaagcttagcgcggcgccatggacgtggccatggcgctcgccgtcctcttcttctgcctcctcctcctctcctccgccgccatcaccttcctcctcctccgtcactgcctctccgggctccggcgccgccaccgtgctgccgccgccgccgacgtcgacgccgaggccgcagaaggcggggcgggagcacgacagctgatgccgccg

SEQ ID NO: 4682 - DNA, 1501 bp, Oryza sativa
tcgccaacaccaaaattgacaaagtgacccataatggtgactccatgcttggaaacagcgaatgctgacacaccatctctcttgtaaatcccttaatccataaactgttttggctgcccatgattttgtgttttggtaattgtttcacattgaagttcatattctacggtcaatgcacgattaaaaacactgttaactttaccacagatgggaacgctaaatttatgtgatttgtatgtgctaacagcgcttgcctaaaattgcagagaacaataatgtattatgtcagtagtcagtagattccgtggctctaattgcagagagctagtaacatgctgaaaatgaacagtccacagctcagaccatatcaatgcttctgtggctctatttagtggcattagaatcgtgttcagagtcttgtccaaagtttgaatgtttcacaggtttttttatgtagtgccatcagaatttgtgttcctctatctttgtgtttgaagggttccatgcagaacacccagtgatatagagaaacatcaatagaaatcatttggtctgattggacatgagagttgtaactcatcagtatgatctgtgttcttacaacctctggttggtctttaatccatagaactaacatagaagaattggcagcttgtaaaccctttacctgttggttgaaaagtcaggagtgtgtgataaccattttgttccccattttttagacaatggaattttgttttggacatactgttgtacctattgggaatacattctgcatttatgagcttgcatattggcaatatcttccatgctgtggtccagcaagaaacctttgcaagtttgcagacctgccaatcatcagtgcttgagacaaagcaaaaggcaacggagctcgctactgtgtatcactctgattgcggtagcctctgttctagtacctcaaattctttcaactactgtgtctaatcatatgcaatccatccaatgacatgcaccatcatgattgaatcattgagcccatctcatctctgtatgattagtttttgtttgtcagttccacacctgaaacccaagatcatagcatccaaatgcacaagctgcactcttaatttagaaatcaatatttacattccagtatttcatcactctaatcaattgattccagttctttcctaagcagtgttcatcgtttcctacaattaattaattaccttgccaataataaaacacacagacacaaaaataactaagtaaatcatctacaaaataaaaataaactgcaatccgatatccatcatgtggaatcggaggcatcgtgcaggtcgtgatgagcaatggagatggacgtcgccgccttctccgcgatggccgcgcgcacctgcgccatcgtcggccggaggcccggctgcgccgccaggcactcgacggcgatcctcgccacgtcgccggcctccgccgcgtcgtagtcgtcgcccagccggcggtcggcgagcccgtccac

SEQ ID NO: 4683 - DNA, 1501 bp, Oryza sativa
gcttggtggtgccggcggcggaggccttggactcccacttccacttgcggtcgaagccatcgtcgttgggggtgtcgatctgggcctcccacttgaaggtccggtcgccgtcgggcttgtcgtgggtggtccacttgatcttcctgccggcggattcggcctcgtaggtgtacttgctgcgtggggcggcgagctcaagcgcggagacgcggtgggcgagggagtggtggagaaggaagggatcgcggagggcggggcaggaggtggttacaggtggggtcggggttgggaggaagaggtcaaggtcgaggtcgaggtcgagatggtggtggaaggcggcgtcgaggtcgtaggaggaggtgaagccgagtgggcaagacgatgaaggaggagaggtgaaaccgagtgggcatgaggaggagggagggaagaaaaatgggtgggtgtcgtcgaggaggaaggaggaggaggaggttgggaaggtggggaagaaagggtggtcgtcggcggcgaggaagcggaagaggtggtggctgccccccatggctgatggcagtgtggactgtgaatgaggaggagcgcaactatcgccgcatctccatcgatcgatcgatcgtgtgaagctgaagcatggaagggagtggggagggcccacatgtctgtctgccacgtgtagcacgtaatcagtcaatggtcgtttccaaccagcacgccacgagcactcacgcagagtactgatccctccgttctaaaataagtactgttttagctttattcatgtttaacgtttcaccgttcgtcttatttgaaaaaagtttatgattagtatttttgttgttattagatgataaaatataaatagtactttatgtatgactaatttttttaatattttttaaataagacggatggttaaactgctaaacacggatatttatggctacacttattttggaacggagatagtatacatgagggaaaggatggaatcccgatgcggcgcggatgtcttgcgatccgccgtctcctgtcctgtggactgcacgatgccatgcgcacacgcagacgcagagagcgcaccacgatttgttccttccatgccgcggtttcttctcttgggcgtgtattgttgcacgattcttctcctatgaagagttgctagccattgggaggcccagcccgctctatatcatcgctgccttttccggcccagcccatcataaataatcctaccggcctggcccaactcctttccttccaccgcactgcacttgtcatgaaattttgggccaaaagattgacgtccgccccaccaagttcgttcgcccactgacagcccattaattaagcaaggaatgcgcggctcgttcgtccggatcaacagcccattcagcttgcttgcttgctcatccgccccaacaaactatgtaaattatttacagctaccaaaaattggtaagattgatcaaggcaatcaatcacagtgttgtccacgagtgct

SEQ ID NO: 4684 - DNA, 1501 bp, Oryza sativa
aggtaatccgaatgttgttaagatataagataaaatgtttataaaaaagtttttcatcaaaagtccgatgtcaacactggtggagaaaggggctttactcccggttgggaacccccatatagtctcggttatacaaccgggactacgaatacgggactaaaaatacccatctttagtcccgggtgaaataactgggactaaaaatctatctttagtcctagttggtgttaccaaccgggactaaagatggttgagccacgtgactgacgcaggcatctttagtcccggttgatcttaccaaccgggactaaagactttttttcctccttcggttctttctcttttatttttttttcagttttttccttcattcatatcgattcattcacagtaaacatattcattcacaacatcacaaatacattcacacagattcattcacaacatatacattcacaaaaccattcacataaacattcgcaaacacattcacaaatcaacattcagaaatcaacatccacaaatcatcaaaaaagaaaagaaaaaatcatccacagatctgggcccgggaggggagtgcgaggccggcctccatcctactgccccttgcccggccggcctcccatcccgccgccaccggccggactccattccaccgccccgcgcccggccggtgccggccagcctctcatcccgccacctcacgccgggccgccaccggtcggccttcatctcgctgctgcttccgtcgccacccgccggaggggaggggaggggaggaggagaggatgagtgggggagaggagagaaggagaggatcctcggcgcgtaagatggcgaggagaaggggatcggaggagaggagaagaatagatagagtgtgaggagaggaggagatatttatctcgatccgagtcacgcgtacgcctcgatctctccgtgcatgccgatcttttttcccggttggtgttaccaaccgggactaaagatattagaggggtctgatatcacctatccttttttgaaccggcactaaaaatgatctttagtcaaccaaccgggactaaagatcaaaaagtagctctaaccttttcaaccgggactaaagataatctttagtcttggtttttattgcaatcgggactattgtggaatttggtcgaccgaccaaagatggtttctccaccagtgcaaagaaaggatgtgcatcagagtgcacatctcaaaaccacacgccaaccatacacacacaagcactaaaccagccaatcatcgtcgagcctactacaacaacaccacatagagaagactcaaaaaaacgatgcctccgtgaaggatgcgatgccaaaagatgacattgttatccattaaagaaactggaggccaaggatagcttggacttagctgtaagatcaatgtgtgttttgattcttattctatgatgaacaattggtatatgtgattattggttttgatatttggaatttattcacgaagtagt

SEQ ID NO: 4685 - DNA, 1501 bp, Oryza sativa
ctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgcatggtatatatatatatatataaaccatgcagcaacaggggcatgcaaaaaaaaaaaaggtcagctctatctttagtcccggttggtaacaccaaccgggactaaagattgatctttactcccggttatttcatccgggactaaagatagcgatctttagtcccggattggtactcccggtttggaaaccgggactaaaggggggttacgaaccgggactacaaagggtttctccaccagtgggtagagttcgatattttgagttacatcggacgtccgggcggtaatctcctccagaaaatcggtttaaataaaccatgcatgcatgaatgttggttaattccgtcgtactgaaataaacaacgttggtggtcgtcggcggcagagcagaggctgctagctggtggcggtggccttcacacggactcgccgccgacggccgggatgacacgaaatattggattgatcagtttccagctaactatattaatttcatctgaccttatattattcaacacaaaattggttttggagctatgcatggtcgaatcgatctactgctaacagcaaggtgtgtgtttaattgcgtcagtgggacacatccgtgcaaaccgttgcagcagtgctatatagctcaaatcaaattaaatctatgaaatggtcgtggtcggattcatctagtaatttaacacacgggacggcacttccttcccctgttcaaaattcacaattaaattcagaccacattaatccgaacattatgcaagatactttgtagctacaaacaaagtacgtacagacaaataaaattaacaatgcattttgtgtgtacatgaaacgctcaagcagtgtcttgtatgatgccttcgctgctcactgatataatactccctccgtccctaaatatttcacgccgttaactttttttaaatatgtttgaccattcgtcttattcaaaaacttttgtgaaatatgtaaaactatatgtatatataaaagtatatttaacaataaatcaaatgataggaaaagaattaataattacttaaattttttgaataagacgaacggtctaatatgtttaaaaaagtcaatggcgtcaaatatttagggacaaagggagtaatagcgtacacacataatagcagacatcattcgcctaattgtactttttttaaagaatgcctaattgtactaactaacctcgatggacgcatggggcagcatcatttttctttaaaacatcttg

SEQ ID NO: 4686 - DNA, 1501 bp, Oryza sativa
ttcaagggaaaaatcttggtcgctcgtttaaagtgagttttccaaaacgagtcagtctagggttttagtaaaattattgggatttactcgtcagtcagttgggatttgatgggtgaaatgcattcggtcctagctcggtatcatgggttgcaaggtgtttatgcttcgtttgttactactattatgtatctaatttcccattattttatcgttatgtgagtctgtcttatttattcgcgctcatgtaaaatgatctatgcataaaattttgctcttatttgattcctttatttgagtctttattgctttatttaaatttggatttgagcatacattgatcctactcctttgtcttctctagatggccggtcacccacccaaccaccgcggagaaggcatgatcgacttcgtggcagagctggcacgcatgacactggtagtgggctaccccgacgcgccggagtacacgaccattccgccgctcagtggcgagcttcctcaccgtgtccgcttggaggtccatggctacgtggggacttgcctcgctaacatggcggtcgaggcatctggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgaggtagcgcgcctgaagaaggagaatgctcagttgaagggtcttccagcgccaggaggagtccggatccgcactacgccccgtaagaggacgactacacctgtgcgcatccagctggcgcccaggaacccacctccaccagcggcccccgcagcagctccagctccgcccgcagttcctgcagctccagctccagctcccgcgttcactctctccttcgctccagcatcagccgccggaggttcagccagtggtaccggaggatggctgtctgctactcccagtggcagcggcgagactgatccgtcaggctccaggagtcgctcagagggaccgggtgacgagcaggaggacgctttcgactccaccgaccgcaggagccgttccgagcattaggctcgtttttccactagttcatcgactgtctagtttttgtttgttagtttgtgtgtttaggttgcttgtttggggtcagttgacggtcgatatcatgtgtctatgatatggctgtcttaataaggatttttgcttgcctttttaagtgttttaattcagatcagaacaattgcagttttaattcctatataataaagcttagttcttgagcatctgtttttcttcttttccccgtctgttcttccctccaga

SEQ ID NO: 4687 - DNA, 1501 bp, Oryza sativa; identical to SEQ ID NO: 4686

SEQ ID NO: 4688 - DNA, 1501 bp, Oryza sativa
ctcgacggcgaggacgcggaaggagacaccggagaaagtagcgcgggtcctgattttatgctccatgtcgcggaggaagtcggaggcgtggtaggggtcgtcgatgaggcctgggagaaccgcttccaccatcttgagcaggttgtaggtgcgccccatcctcctgagccgctccctgttgacgaattcccaggacgcatcgacaccgagctggatcgccattaactcgtcgatgacagcagcgtcgcctgcctggatgtcggagatgatgacgacgcggcgggggcccggggcgacgccgacctcgcgcacgacttcggcgagaccgctcagctggagagccatttctctctctctcgatcgaattgggggcgattgattccctacttgtgccgggtatttatactagaaattgggctgaatattttgaaccggggagcgggaaatctgaaaatgaatttgagacagcgaacgaatccgtggcgcagcaacagttcagattgctcggatcaacgcgcgatccgtggctcaacaatccaacggtcgttgtgcgatgggactgggaggaggcgctatccgtgtcgaagactctggaagtccggaagtttctggaagagtggatgcatgggcctcgtgggctggtagtatatggggccgaagtaagggagcaggccgggtagaatccacgccagcccgccccggatttcaagaaatggtataagttcatctgagatcccttaattttacaacgaatcggattttcgccctttaaaccttagtaaaaaaagccggaccgatggatgacccggacgaactctcgtttcagcggtccacttgtccgaccggtgagccgggcggtccaaccgccattcacaatctacatgtatactacatactccctcctgtccacatgcagttggtgcactagttgtgattttttttttaatttttaattttatttattgaaatatttacaaaagtgttgacagaaaacacgtggcccgggagatctgcttaactccagtgcaggtccaaagctcaccttcaggtgtgttagcgtgccagttgatttgatcctgtaatcaacaagaaatagaagcaaagaaaccgtggttaaatctataaatgatagccgatcggctagatgccgatgacatatcatttacctttgagccgatgtcatctgtgtatcgatcggcagacatgaataagtaaagaagaactaaatctactcgatcggctgtagatattaacgatatatactccttatatcgatatatacttaaatcaaatgattgggatagatcagtcaccatgccgagacagtataaatcacttagattgaaatatatatcaataacaggactatatatgtttatagcgtagccgatcaaatagatctaacatgtatcggctaatactctgatactactctatatcaggatattaaagcatgtataatatatcaaacaaaggcctaacatacttagatacaacaata

SEQ ID NO: 4689 - DNA, 1501 bp, Oryza sativa
tatttcacctttccagagagaagttggagttacattgactcccccagctggcaaagagaaggctgaaggatgggttggtctgcagggtgttcgtgagttgcagataaaatacgaagagtctgataggtaactccttgcaagatgcaagatggcttcaattattcatctagcatgcagtaccagggggctttaggatcagacaattagtggttgagtaattcagatctcatgtttcatgaagaatatggtgtgtgttctctccaagcatctgctttcatatgttactgacatttgaggatatgtttgttgtgcagacctgcttgtgacattgcaatttctggtctcgggtgggttgcggttgagccacttggtgtgccatcaagcaacccagatgagagtgctgaggaagaagacaatgagagtggtgaactgcatttgagagtacatgttcccaagcctgttgagatctttgtccgacctccattgcctgttggtaaagcagcatcgcaatggtacagataccaggagttgaccgaggaagaagaggagttgagacctaaatggcattactgatgcttatagctattttagttacgatgacagcatcgtgtagtccaaatagagcacgtaattatatatgttctcagatgatgtgatagggatgacagttttagcatcagctgattaaaattactccaataatgattcaggaaggaattttggataaagacatcgacaagtgaagctcttgcgggtactctctgtttctaagatcttcgtcctagcacatataccatcacatcatttttcctttgcaacactatgtgtgacgcactgacgcttaaagcgaatgccgtaatgaatacttgaatatagttaagaggcaacaattttttttttcagatctgaatctaaaaccaaccaaacacttttcaacgggtctccaactccaacgagagctatcttccaccagagttaaagtttggagccctaccaaacgggccttcatattcggccaatgccttctatatatgttctagcttagcattcgcaacgtgtatactcaactgtcaactttgtggagctatatatagaatttatttagcaaaagaaaagaaaaaggaagaaaaaagccctacccagaaaacgtgtatccaaaatacgttttcaaagttagaaagcgcattaaaagcactacgcaaaagttcttggtagattttggttcggcccattggatcttccgactcacacgcaccaccatgaccgacgggccctcgaccaccggcgattcgccgccgccgccgccgccggagagcggcggctccatctcctccatggttgcctcctctgccgcctccgctgcggccgcggccgcggatttcactcgccgtggcgaggccttcggcgccgatatggcctccgcagctagggctgccatggacaccgccatcgcccactctcagtcaaccgccatcgccgccgcagaagctgcctcctcggc

SEQ ID NO: 4690 - DNA, 1501 bp, Oryza sativa
tgatcgtgtattgtctgcttggtcggtgcattgttattttcttccacgtgagttggcacaagtgcgtctcatatttcttgacctactcctatgtgcgttgattggttgtcattctttgaagctgcaggaccgagaaggtaagacgaatcttgtccctcgcagtatgcatttcagcgttcttatggaagaagcttctaatcaaaaggaaatgaatcgctctagtaatcccaaatccaacacgcaattctgaacgtcaaatggaacggaatgctagaaagcgaagggagactagaaggtcaaaaacttggaaaaaggaggagatgaaaaatggaaccgatttcataaggagctgagcttttcatagctccgcttttgataatttcgatagcatagcataattatcctccaagaaacgccggaagcaagagcaaaaccagcaaacggccaccggttccaggacagggttgcttccgggaaagatgcatgatgcacagttttccatcaacatccgtaccaaattaagtgtttctttgacagcgtgccagatttggatcggtcattcgttgcggaaagtagtaccaatgacttactgctactattaatctactactgtttcgcttaagtataggtaaaggaaatgtaaccctatttcgagaaaatatattagtggtagataggatagctaggagatccaaagagcagaatggtatactgcattagatatatccaatgtgccacgatgagtggtttttctttatctgtttgtactaatttgcgcacttttgaccgataagcgggccggcatctttttaaatagagaaacacgcgatatgatgataggcagtgagatttcttcacaaatactgtacagaacagtagagcagtagtagtagggcacaaattgatggaatcaacttagcaacctttgtagaccgtcgtcaattttacaagggagagatatagtagaatgcgggtacaacagttcatgctgtgttgagttatatattgtttttgggtttgtgattaaacagtgtaacaacacggaaaggttcaagacgagcaaacacgtcagcatgtacaaacgcagtgtatgagttaattaattatatggttagcgtgtatcgacattctcgataccagtttaaaatatgtgatgatattattagaccttgcacccctataaattagggccggtgaacaaaaccatcaacgccttagtttttgattttgaagaagaaattgttgtcagcatcattagatcttgtgtgagtatatttgagagtcaaatcagcatgagcggtttggaaaaccgccgtctgtagtgtagcggttttgtctccagagcgacctcttctctataaagaggaggagaacttccatggaatgagccacaaaaccaccatcgatcatttccatttccattttcaggagagatccacatcgccgttggcctttcatccagtgagtgagggagggagatctcgatctcggtctcgcgaca

SEQ ID NO: 4691 - DNA, 1501 bp, Oryza sativa
cagctatattcttctctctcttcaccgctaactctgtttgagtgcacgctattttcgacattgagcttctcaatcctctaagatagatccatctgtcaccgcttcgcaggcgccaaaaaagcctactagatcaacctcctctcctcctccgtgagcggggtgtcaccccgttgtcttcctcgtctccaacagctcctacatcgtcacccgcctaataactgattaggatctctcacccccactgtcagccctatctgtcaccctgccactaatccgtggcttagatggtgtggacgttgcctcgtcaccctcccgctctgcagccaccaaacattccctctaaccctagcgaactttcctagctagcccccttagaccataaaccctaactgatcgatccaccgctagttactgtagtgggagaatcgaggagccaccgctagaaatcccccctccgccttccaatacttacggaatgaattaggttagcaactatgaatcacaataagttagagcacgtacttatttttatttataataatgaagtagcgggttttcccgcgtaatttaaaattacgcgctaaattctaaaattaaaaacgatatttgacatataacaatgatttctatttctacaaatatgactagctagcgtttatatacaactataccgacaaaacatctaacattaacttgtatttctaacaaaacaagaaaaaacaccatgaaatttctatgtggcccgggcagtgaagcatgcagtgtgtgacgcgggactccggtgagataggcgaggaatctcctctcgtaagattcacctactcttctctcgtcaaattaacagcctatcgatgatcgattaacggaggctggcaactgggccaaataggcgaaacaaccaatgggcccgcgccacgtgcatccagcatcaatccaccacataataataataactaaataaaataaacaaataaattagtgatggatccgaactctaatactagtattagcaatacaagaaatagaaatagcaattggatcggaggcactataaatacatcctccgacccctcgccaatcccgcacacaacgcaaacgcaaactaatctcctcttctcctctcctccctttttctttcttgtgctaatattatatccatctcgcggcgacgcgacgatcatggagacccgggacgacgtcgccgacgcctcggcgcttccctactcctactcgccgctccccgccggggacgccgcctccgccgacctcgccgccgcccgccgttcccggaggcgcccgctctgcgtcgccctgttcctcgcctccgccgcggtgatcctcgccgtggcggtcctctccggcgtcaggctcgccgggcgccccgcgacgacgacgatggtcgtcccgggggtggtggagatggagatggcgagcagggggccggagtccggcgtgtcggagaagacgtcgggggcggaggagatggtgaggctgatgggcg

SEQ ID NO: 4692 - DNA, 374 bp, Oryza sativa
attacttttgttaaataatatctcacaaaataaactcataaatataataatcgtatacaataaatttatacactctattaatatacttcataaatttatattttcttgataccaaagggtaaaatggactttatgatatgaatttaacggtcaactaatggtcaactaacggaaggggtatagaagggatctaaattgaaattttggggtatggaagggaatgagcaaatcttaggggtatagaagggattggatgaatttttaggggtacagagagaattttctcaaacatttaagcttaacacaggctaaacatagactcttagtatttatagaagaaatttttactatagggtagggaacatgagaaaata

SEQ ID NO: 4693 - DNA, 446 bp, Oryza sativa
tatcacaactactccgtgttaattcaagtgttagtgtgatggaagctgctgttctgtgagtctatttatagcatggagatcgatgaatcgatcagaatatgtgcatgcatgcattggagggaatgtttgtgtgtataattaattaagaaattctaatcatttttagcagcttgattatcaaccggcagaacatgggagcacgatttgcagttatagatcatcgatcgaacaggatcgagctatacagaagttgacattgccggggtcaacggctaatatagctccgacaatggatatgttcgaacgggcgtctagattaggggtatttagttgggttgttctgacggcgttttgcgaggaaaaataactcgtttctgaagatctccggtcgatattgtctgcttcttgcacgtttggtttgacatcatgaaggtacgtataatcgt

SEQ ID NO: 4694 - DNA, 1501 bp, Oryza sativa
tgggttgacatgcaaacaagaggatgtcttctcgagggtgaaaatccactcccgtagtagctagctatactgagcagtgagctcaagagtggcaagagagggatgaagaggagatgctgggttgcatggctatttatagtcaccggacggcggccggggacgcacgccgacacgccgtacacagtacgtactgctgcttgggaatgtttttggcgcgcacgttgtggtggtggtggtgtggtgtgtgcagggtcaaccgtccggtgaacgtggcgagcagatcgaatgatcgatcgaatacccaaagctagcttaattagtgttagctagctagtgtgtgcttgcattctgcacaagtcatagctatagcgttaacatgagctgctcgatcgatgacgttgtaggtgactcgatcagagaagggaggatctaccagaatcccaaattaaactctgaaactctgaatgtcaaatcaaattcacatccctttgaccggagaacggcgtaaaccggaacgtgcggcttggctgggtcggagcgggaatccgacctccgtgcagctcattttttttgggttaggaatttgtggcatataattagttatgtgggctcagatctgctcttgacgggctttcattaaaggcctggcccaacccatcacggagacaacagtcttcaaatatgcttataggggtagaatttacgtgcgtgcgtttatagggggtgagtgtgtgttgtgcgttgtgagtgtgtatgtgtttatggtgtgtaattttttttaaaaaaacaccagatttgtacattacacgccattactaaacgcgccgatcgatcgatgcagcactggtatcatcttcttgtcgggcaaatattctagagaggaaacaaaatagccaggaaaatatttttagataaatagggagtactagtatagtacacgcatgattacatagcatgcagccgccaaaataagaagggacgcagtatcatttttgtctccagcctcccaacagctgaaagccacgattatacgtaccttcatgatgtcaaaccaaacgtgcaagaagcagacaatatcgaccggagatcttcagaaacgagttatttttcctcgcaaaacgccgtcagaacaacccaactaaatacccctaatctagacgcccgttcgaacatatccattgtcggagctatattagccgttgaccccggcaatgtcaacttctgtatagctcgatcctgttcgatcgatgatctataactgcaaatcgtgctcccatgttctgccggttgataatcaagctgctaaaaatgattagaatttcttaattaattatacacacaaacattccctccaatgcatgcatgcacatattctgatcgattcatcgatctccatgctataaatagactcacagaacagcagcttccatcacactaacacttgaattaacacggagtagttgtgataaagcttgtaattaagctagctatggcatccatg

SEQ ID NO: 4695 - DNA, 1501 bp, Oryza sativa
cgatctcctccgcgcggtcgcacgtgcccttgtagtgcccgaccgtgagacctccggcgatcgagcccggactggtatagccatcgccattgctgctgccgagcaacgcgagcaagacgaagacgacgagcttattagcagccatggatgccatagctagcttaattacaagctttatcacaactactccgtgttaattcaagtgttagtgtgatggaagctgctgttctgtgagtctatttatagcatggagatcgatgaatcgatcagaatatgtgcatgcatgcattggagggaatgtttgtgtgtataattaattaagaaattctaatcatttttagcagcttgattatcaaccggcagaacatgggagcacgatttgcagttatagatcatcgatcgaacaggatcgagctatacagaagttgacattgccggggtcaacggctaatatagctccgacaatggatatgttcgaacgggcgtctagattaggggtatttagttgggttgttctgacggcgttttgcgaggaaaaataactcgtttctgaagatctccggtcgatattgtctgcttcttgcacgtttggtttgacatcatgaaggtacgtataatcgtggctttcagctgttgggaggctggagacaaaaatgatactgcgtcccttcttattttggcggctgcatgctatgtaatcatgcgtgtactatactagtactccctatttatctaaaaatattttcctggctattttgtttcctctctagaatatttgcccgacaagaagatgataccagtgctgcatcgatcgatcggcgcgtttagtaatggcgtgtaatgtacaaatctggtgtttttttaaaaaaaattacacaccataaacacatacacactcacaacgcacaacacacactcaccccctataaacgcacgcacgtaaattctacccctataagcatatttgaagactgttgtctccgtgatgggttgggccaggcctttaatgaaagcccgtcaagagcagatctgagcccacataactaattatatgccacaaattcctaacccaaaaaaaatgagctgcacggaggtcggattcccgctccgacccagccaagccgcacgttccggtttacgccgttctccggtcaaagggatgtgaatttgatttgacattcagagtttcagagtttaatttgggattctggtagatcctcccttctctgatcgagtcacctacaacgtcatcgatcgagcagctcatgttaacgctatagctatgacttgtgcagaatgcaagcacacactagctagctaacactaattaagctagctttgggtattcgatcgatcattcgatctgctcgccacgttcaccggacggttgaccctgcacacaccacaccaccaccaccacaacgtgcgcgccaaaaacattcccaagcagcagtacgtactgtgtacggcgtgtcggcgtgcgtccccggccgccgtccgg

SEQ ID NO: 4696 - DNA, 1501 bp, Oryza sativa
cgactacgctgctcgcccactgccggcctatgcatctccttcctctgtcgccaccgcccatggaaagccgccatcaagcttgccacgcctcacgttacctgttcctcctgtgagcagaggaggaggaagaggaggaggaggaggaggaggaagaagaagaagaagaagaagaagaagaagaagaagaagaagaaagggaaaacgatgctagaggtttgcatgcgggccccatgtgcttgagaaagagatatatatagagagttgcagatctgacatgtgggcccaagggcattttagaactttcacgtgatttctctcttctctttcacatgattattttaatggtgtggtgtccaccagcaaatatccaacttttgcgagtgtctttccccaaaagtcacttcgcgtggtgtcctatagctaaaaccacgaagccacgatgtcttatagcaaaatttgccttaatctaaacaaaaccctgaacgggtatctagctatttatgaaggtgagaggacgaccaaggggtccctaggctcatgctccgcctggttggggtgcaccctacattggcctcacttgggtcatggtcccaaacaaagttacaagcccatcggtccaatataggtgtttttgcgattgcaaccaactaagaaggaatttggagatgaggctggtttcgttggaaagagtacttcgagggctttccatgaagtactcatggacccaaaatggagcccgtacgtatatttggcggccgtttgaagtcagtactatagcaggtggccgaattggattctaaaacttggtcaacttaatattgatgtgagcgacggttgtatcaacagtatccatggtcgtatcagatacaagatcctaaaatgaaccatatttgaaaacgaagaaagtatacataatggcaagtccatatgacaacataaacgatgatcccctcatgttaaaatgtatgatgttgattagttcaaaacaaataaccgacatcactaaaaagaaacaaagggagtataacactgaagctcgattaatgatgctgctggaacatgtttgttgtttataaatgaattcttaaaatttaaaaaacagcgattgaaccaatggacctgtatctctatcccctcacacaaatctcaaagctttggtggctatcagaaacaccgaacgaagtagtttcctcatcagtcaaatacatgccatgtgtttaaagttgtaaggtggtgtcatttatgttcaaaatcttgtaagatacatatttaaatttataattttggctcactactacaaaacaggtttttccgtgcggttctagaggggttttcacatgtggtagagctaaccgcacgggcgaaagggtctgcaaaaatggaatttttgcgtgcgagtggcgctcgccaaaatatgattttcgcgtgcgggtgcttatgttgtccgcacacaaaaattaaaaaccgaaaaataaaataaaatccgaaaccctaaccctat

SEQ ID NO: 4697 - DNA, 1501 bp, Oryza sativa
ggtggacagagaagacgaacgtggcgacggcgctacaagcgacggcagagagagggagaggtggcggccgaaagaggagagggaggggactctatttatagccatgggagagagagatcgggcttagaacgcgaggaatcgcgccgggaaaacctagggtttggtgaagagataaactcgaaaacgaatccaaattcgcgtcgaattctgtgcgtggttacaaattcaggctcccatcggatggcctaatcagttaaagaaaaagtcaaaatttgaattttcaagcttaattttgagattgcttttgagatattttcaatatagtttctttttcaacattggcttttaagtcaccaagaacacatttataaaagtttcacctacaaattcatcttcaaacttggacataaccctccaaacgggctctgtccaagcttgaagacgacactgtagcagggaagcgaattagacttgactgggcttctttttctccagcccgattggagggacaagaaatggacttcagaggaggaataaagccagctgaaaggaagggagaatgggccgagaaggagagaggacatttcctgtttcggcccgaaaaggaaaagaggattcaatttacttttccaattaaattaatcactgaaatgatctttgaattgttaaaaatacttccaattctcaaataatttcaagaacaatcctgaaaataattggacactcaaagtacttaacaaggttataatcagaccatttaatgattaatttattatttaaataattgctgaactgctctttgtattattaaaattaagaattgagctccgaaaaatccgagaaaatttcagagagtataattaaccatggataatttaataaaattaaatccagccatgctttatgtttaggaaattttatttcccacatttagcttcacttgtaaattaatgaacatttcatataaattctaataataatttattaaataatttataaatcctaagatgaaaatcaggatgtgacagcaggatgtcggaggaggagaggaccgtgtttgagaaaatcattggttgaaatccaaaaataactcaattcgagggccttagcaatggcaggcttgctgttgcagacggtgatccacaatacgatagagccttcgatgcaatgggggaggaaccgaggaagggattggagtttcgatccatggatgagctaaaaatatggttgcagagctactctatctgggtgcaccgcccattccatggtaacgagttcaatgcatctgttaagtacatggtggcatgccttgattgttattgtgaatggcagattcgtacaagaaagagggcgggtgataggtggaggataactagtgtaggcaaacaccacacatgctctaatgcggaagcatctggcaaacatttgcagctaacttcgaggtttataggtaatagattacagacatttgttagtgctgaacctacattgtctcctgtag

SEQ ID NO: 4698 - DNA, 1501 bp, Oryza sativa
tcatcgtttatgttgtcatatggacttgccattatgtatactttcttcgttttcaaatatggttcattttaggatcttgtatctgatacgaccatggatactgttgatacaaccgtcgctcacatcaatattaagttgaccaagttttagaatccaattcggccacctgctatagtactgacttcaaacggccgccaaatatacgtacgggctccattttgggtccatgagtacttcatggaaagccctcgaagtactctttccaacgaaaccagcctcatctccaaattccttcttagttggttgcaatcgcaaaaacacctatattggaccgatgggcttgtaactttgtttgggaccatgacccaagtgaggccaatgtagggtgcaccccaaccaggcggagcatgagcctagggaccccttggtcgtcctctcaccttcataaatagctagatacccgttcagggttttgtttagattaaggcaaattttgctataagacatcgtggcttcgtggttttagctataggacaccacgcgaagtgacttttggggaaagacactcgcaaaagttggatatttgctggtggacaccacaccattaaaataatcatgtgaaagagaagagagaaatcacgtgaaagttctaaaatgcccttgggcccacatgtcagatctgcaactctctatatatatctctttctcaagcacatggggcccgcatgcaaacctctagcatcgttttccctttcttcttcttcttcttcttcttcttcttcttcttcttcttcttcctcctcctcctcctcctcctcttcctcctcctctgctcacaggaggaacaggtaacgtgaggcgtggcaagcttgatggcggctttccatgggcggtggcgacagaggaaggagatgcataggccggcagtgggcgagcagcgtagtcgcaggaaagacagccggcggtgaagccggtgtcgacgaggtccgcggggaaggaggtggatccaagaggagacagccggaagaggcgagtgacgccgcacagaggtggtggccggcgccgatgcgggccatgcggctggaggagtccagacggggttgaggacgatagggctagtggcgcagtgacagaggggagggcacccggtgttccaggcaaagaagctggcggggagcttggggacacggaggacgacgacggtagcgaaggagattcggtggtcagcggtggaggtccctaggcggtcgagggcaggaggtgaggtgaccatcctctaggtgtgatgaggacacaactagctcagatataaccatgactaccttatgtattaatcaactaaaggtgcagatgttttacattagatttacatgttatatatttgaacaaacgttgctacacaatgagtttcctatgtttttgtttgcataggtacttgcttgggcgaaggaaaagagaccaagcgtaacaaattcatggatgatcaaagaagttgattggg

SEQ ID NO: 4699 - DNA, 1501 bp, Oryza sativa
ggttgatatgggttggatctgttagatataaaaaaaatattagtggggccacccttatcctgtggaggccggggccgaaacccccacccccacgtccgcaactaccacctcccctcacggccgaccacctccacctcacggcaatttctcccgtgccgcttcctcgattatcacattgtttggtattttggtggttgtagatttgagatatttttataaaaacggaacctacatgatgtgagcattccatttttgaggtgatctaattttagttttacactttgtatttgagtccctgtaatattcatatttacatttgagtctttctttgaggtcagtggttcagttcttgttgaaaaaaaaagtaaaaaaataaaaaagaaagaaaaggcagaaaggtgcaaagaaaaagaaagaaaaaaaaagccgcacctaaaaaaaggaaaaaaaaggcagaaatgtgcttaaaaaagccgcattaagaaagaaaaaaaaaccattcatccttggagtatgttttcagagtgcagagttgtgcattgattcatatctagtccttagtgttgtcgggtgcttgcttgagctagagttgagtctagactaggccagcacattgactagtaatttgaactattattcaactttgcattttctgattagtacaattgtgttcctttgctactatatattgtgcctcccaagttccacatatattcttctggtcagcactgctttgatccttgcaatcgccacatcacgtccttcaaggtgtcacgaaccagccactggttgtaccgtccttagcattgctggtaagacacttgtaagagcttagtaggacgcttccatttgcttgtctccactacaatccatgttctatagttaatagttctctcttttctattgacaatggcatgtgcacgtgatgaaagtactctggtgcaacaagtgctaagttctcaaatggagaaagcggagcaatggcagtaccacgaattatttgaaacaaagtttgtggttaaggatagagcatgtcatgctataattgatagtgaaagttgcaacaactctgtgagttcagatttggttgacaaacttgagttgcctacacaaccgcatcctcatccatattacatcgaatggttcaactcttgtggtaagttcaaggtaaatagaattgtgagaataaacttttcgattggaaattaccatgacactgccaattttgatcttgtccctatgcaagcatgttctttgttgtttggtcaaccataggtatgtgataataatggatcgcatgattttgttgctaatacatacacatttagacataatggtcgggaaatgaaattggtacccatgagttttactgaaattttcgaagataatcttgaaaggatgaagaatggaatcgaggaaattttcaaagatagtattgaaaggacgaaaaatagaatcgatgagattttcagacataccaggaaagatactaatattgcga

SEQ ID NO: 4700 - DNA, 1501 bp, Oryza sativa
cctgacggcctgcgacagcgcccactgcagcgcgccggccgcctccgcgcgcccgtccgccaccaccatcacccgcctcccgccaccgtccttcttgccgccaccgccaccgccgccggcgccagcgacggcggcggcggcggcgccgtcgccgtacgagtggcaccaccctcccgcgcatggcgcgtcagcgcaaccgccgcccaagctcgccttcgtcgccaccgccggtggcggcggcagcttggaggcagcgtggtaggcggccgccacccgctgcacgcgcttcctcaccctcgtcgtcgtcgtcgccgcggccaccgccaccgtccggccgccgcggcagaacgccggtagcctcctcccggccattgtcccagctagctagctatagctaaagtaagaattgaaggaattgagaagaagctagcagaagaaggtagtggctggagtgatctctggctttttagcgccggtaggcgcacacttatatgcaagtgcgcgcgcaaattagacaattagttatgctagaaacatttaaattatgctaaaacactgactaataaattaattaactcaacttctccttaacactgctgtgtctaagacgtgcagggcgtgaagaagagttgttaggtcgtcgatcacaatacctacagaagttaggatgtgctaacaatcatctaattgtgtcgataatgttaattaaagatcatcagcttatcaagacccaagtttcattgtttacggtcatgatatggatattaattgattatcgtaattatatatatatgcatacattttgcaatggcaagaggggccaattataaatacatacatacaccccgcgtgcgcctgttatctgaatctctgaaaatatatagtgcatggtggtatgtcatatactagctggtagtggtactagaattgattaacatttgtgcacgtataggtctggctaattgccaattggccaaccgcctttattccagcgcgcatgcacaccgatttctccagcaaccaacgaccagcctgcgtttaggttgtctctagttggaaacaatgttctactattagatactacacgttgctaaggagcaaaaacaaacccgatacctgaaacacccaactccgtccacgtctttaggctggagaggaagagggtgcatgagaagatgaaaccactccccccctaaccagcccatcaacatggtcatcttgtagtggctcaccgacaccaaaagagacaccagcattgagaggtttgaaagggaatggatcttttgaaatgacgcattcaggaatgttacaacaccaagaaagccaccatcgttcgtcttgaaactaagacgtggttttcacttgaagagatccaccagaaatagaaagagagattacacaacaatgtcctagtagggtttgatgaagaagtaggtcgcgatcttcctattggtattggataagtcgattgtggagcctcaacattgatgatcccaaggct

SEQ ID NO: 4701 - DNA, 978 bp, Oryza sativa
aagtaacttagtgaaatcttaaattacaatttagatatattacaaaagtaatttgtgatcttcatcaaaatataatcatgtgagatcttgttgtaaagatttaattgttacgaacacaacggtgtaatcggattgtaaatcagatgagtaatttaagagaaaattttatttgaagcatagatgatagaaatatttgttctatttgcttgatcaattattactatagtaaagtatgattcttcaagacatatctggacaacggctgattggatgataaggtcgctcattatgactaaatcgagagcgctctcgatttagattttacggatttttaaggtagagagttcatcgggatgttaagggagtattcttcttcggagattacaccattccatccctcaaacccttgaaaattggttcattttatcctgatccatcacatctctttagccaaacacatattaaaaaacaaatatgatacgcaagcattgtttccattttctttagttgtgcttctccattatcaattgccaaaatgagattctaaacccaacattatttatagatgtgcagtggctaagcttggctgcaggatcagatcgaaggggccaatagcccaataccaaatgctagcacgaagggaacacagtggttggaggaatgtcaaacataacttatcattgtaaaccagctagcattcttctatagtaccgtactattcattctgcgtaatctaatcatcgagataagggagggttaggctggcaccattttggtgagttacaatacattaaacctctgatcagagcttgacaacgttttccatccatcaaagatatcaaatttttcgtgcactcggatcagagaacgatcgaccgacaatataatcggccggtgaatcgatccggcccaagcagacagcaccactgtctgaactaactaaatgtctgcaatattgtagtacgtagtacttgcaga

SEQ ID NO: 4702 - DNA, 1501 bp, Oryza sativa
taaatttaggagatgaattgttggagtgatcaagcaatttttatgtgaacaacaaggtgttctgaatttattaatatattgattgtctatttcattttattgctgttccaacacattctattactcatactaatttcgtggttagtcttttcactggaaattatatgatgctttggataagatcatatcaatatgtatcaatgaattttaataaaataattagtttgaaaacataaaaatgatattcttagatgtaacttccgaagtaattttatacacttatataatttggggtcaaagttgtatctccaagaccgtaataaataataaagaataataacaaactactagtatcatttatttttttagagagaatctattctataccactgagtttgttcgagttcaacgatttgccatcgacattatctctttctataatataccagcgactttatcaattgttctacaatatgtcattgggttgggccttattttcaaaaatacccaaaatacctttgagacatacaagattaacaattaatttatctcatcagaagtttcaaaaaatatgaaaatttttatgtgtcctctttacacaacatgcaattttgtatacatgtttcaatttttttctggtatatttagtttttagaaaaaatatttttatgtggtgtatgcaaaataatttttttatagaagaaataatagcaaaaaattatcttatatagtgtatgaaagatgatttatattaaaaacaacaataaaaaagtattttatgtatcatataacaaataagttatatatttttctaaaaaaataaaaaaaattgaaacttgtatataaatatccatgttgtgtaaggatgccacataaaagtttttatttttttttttgaaacttctaataagataaatcaattgttaaccttgtttgtgtataagggtattttgggtactttttaaaacaagtcccagcctaatagcgtattgtataacaattgataaattcaccagtatattatagaaagtgataatgttgatggcaaatcatgaactcgaaccaactcagtggaataaatagaatagattctctatttttttaatcaggctgagaaagagcagcaggctggctcctgggctgagtcttgtgcggcaccactgcacttaataaggcccaagccaagcccatcatcagtaacccatccattccttccccgggcaacatccaaccgcacgagaaaaaccctagccccatctgacggccaccgcgcccccgcctccttctatatagcctctcgccacgcgcctccgcacgaaccctagtctcctctcccgctccacctccccgccgccgcctctcgccgctcgccgccgccgccgccgccgccatgggtgagctcctcctccgacgccgcctccctccatcactctcgtctccagtttcccacccctccacctccatctctctcctgatccgtcctccgtcgttttgctgtgca

SEQ ID NO: 4703 - DNA, 1501 bp, Oryza sativa
aaatccgatggagagaacatgattttcttataaaaaaaaagaaaaaagctaaagccacggagatagcgggtagcggcgtcgatgcggactttgcaggaacggcgaagaatccggactcatcttttcgcttataaaaattttatttacaagttatctattctttgcaaatataccgtatagcttatacccgaaatgatagggctggagatggctacaggcggcctggaagtcgagggcggggcggggcgtgccgttggtgtgagtggggaactgaacacagcggcaagccatgtgcagcggcgcacatccacactgttggaaatttggtcataattcggtatattttaatcaaaatttggtcataattcggcatattttaatcgaaatttggtcataatgcagcatattttaatccaaaatattaagacaataaatatgacatttgtaatttgagtagatctagtgacagtgctagatgtgtacaacatgagcatgcttaatatagaataagcattaacatagacaagagaacgcaataatattgtgactgacagttgtaggaaacgaagaacaaacagtaattgtgaaacattatacctcgagaatggcccttcactggagtttgaggcagtattgcctccgttggtgttgacgggaggctccccaagtctccagtgttgttgttgtcgctggttgtcaacatattggtgaagatgatgcggagcagttgcgcttgaagcgttacccaaaaacttgatcgcccgcctacccgtgcaggttctcaagcggacggagtttcggaggcacctgctcgtttcgatcacccgtgcgcgcgggatgaacagaactggggaaatagagagacatcgcaggaacagaaggagagtatcaccaaggaacaatagcaggaggaagacatgttctttgagagcctttgccttgcattatatatagagaaagatctccattaccacacaaataaatctcatttgttgtgaaggttaccacaaaataaatctcatttgtcgtgaaggttacatcacaatgaatctctcatttgttaatggtgactttattctcgtctgttacataacgaaagagcagcaagcaggctcagcttcagtcggccgcctcgcctcgccatgcccacggccgaggccgaatcggcgcgcgcgcgcgtgtggcagtacaaccatcacctcaaccggtcaacaaggaatctctaatatcaccctatttaagttgagattcttccacctagatttgcaagacagtattgttgtctctaacattacttatgggctcttgagattttaattgagttaaattgggcctgggccatttattccaacccacactgccgtcctgtggaccgcgtccaggacgcaccgatcggtgaggtgattcaagcgtgtggtctccatagaccaagctcaccaacgcccacctcccctcttcctctaccaccgggcagcttcacctacctccccgtccccggcca

SEQ ID NO: 4704 - DNA, 1501 bp, Oryza sativa
tttacttgtgtgcccatggcttcttacacaagggttttcatattaatgcattacatgtttttattttgttatctctatttgctgccttttttttcctagttcttttaagtgactcatctactctctcgagctagagctttcacaaaatcccagccatattttttttacgatttttcctaaataaaaacctatcgccttcttccacaaatacatccacgaaagagggaaagtagtaacaagacatagttatcctttctatgttaatatccatgctatctatgtaaatgctagattttttatttttataatactcataaagttttctgatactccaagtaaatatacacactagaaaatattgctttttataatattatttttcttattttcagagagttattttgatactaaaataataaaaaaaacatgtttctttccttaatatagtgtagtaatagataccattttccttaataattaagatagatataaatgaactttaccacccatgagaaagcaacattaacactcggataaatagaaacaatatgacaaatttggtataccattaaaaagtagcaattgcgatcttactgctactttaaactccaatggtgattccaccactactttttctaactttgtgattttgccgtctctgtttttttaactaatgcttgagctttatccccattttgttgtctcctcttaacaatgtccaaaatcatataaaaacaggggcaaaattcatttgaagattgtgtttgccctcatcttttcaaatcgaatatgtgaaaattcaagtgaaaaccgggcaaaaattcatgtcaaaatgcttgatgtcaaaccaagggcaaaatcacaaaaatattaagaaaagtatgtgcaaatctgcaagagcatacgttcctttgacaccgttaagatgacacggaatgggggcaagcacaagcttcagttcaaaaaaatgagggcaaaatcacaaagttagaaaagcaggggtaaaatcatcatttgagttgaaaataagggggataatgcagttgcctctctataaaaaccttttttttcttctaatttatctttgaactgacgtgctctctatcttcaaatatacctaaagaacatatcatggttttatgagtttgttgccatttttttaatatttattcatggaccgatgtgcttttgatattaaaatatgcctaacttgtgacaagtgacaagtctacgataatatgtcaagctagagttttttttttgtactcaatgatgtctaatttggctaacggtcatcgttggcaggacagaacaacaaagatatgacactaagattttcaatggctgagttgaggttactcaccttcaaagttgagcatctactggaggagttgagatgggaggctcagcacaacaaggctttggttgacgggcacaggaacaggatgatgcgcaacatgtatattccattagttcttcctcgaagcatgaagaggaagct

SEQ ID NO: 4705 - DNA, 1501 bp, Oryza sativa
ttcggtggttgtggagatgtgctccgtgttgaacgtggtagcggtggaggtggtcgacactggtagagagatggaagttacgggtgctggtgaagtcatcattgacgacgctattcaccttctcgcatgagacggaaagttggttattggattcattttgcatgcacttgtgaccatcaaagttacagtcaccatagctattgcacccgattttattccatactcaaacaaataagcaaatagtaagtgcttagtagagctcaaggtaatagtaccattcttccctcgtgagcataaatgtattcatacaaaatagtaaaatgtatcctcacaaagattgtaagtatatctcgcaactataaatatgttgtcattttagtaacaattgttcataaaatagtaatcatgttctccataacagtaaatgacgaggcgttaatagtggtttaggttctcatgattgtaaatgttgagtcgcttgtagcggcttaagatatagtagagagtatatctagttttatcaagacaaacattgcgtaatgcctcggacctaatataaaagtaggaattttaacctttgagaaactgtaaccaattgaaactgcaagctttaaaaaaacatctattggaagtgatattatatagacaaaataagtttcttactcttactctctcagtttcaagttataaaatgttttggctttggtcaaaatcaaacttcttcaagtttaatcaagtttatagaaaaaatagtaatatccaagataaatttattataaaaatatatttaattattattttaataaaactaatttggtaatgtaaatattactatatttgtctataaacttagtcaaatttaaaacagtttaactttgaccaaagtcaaaacatcttataacctgaaatggatggagtatttgtttgtttctattttaggaaacggccgtttctttccattgattttgagataagcagagctttaaaccactgccactattgtgcatttcatttgatttaacacttttaccccttatctccaataaaaacgatattaagatacccctatcttttatccaccgcttggaacaaaccaaaaaaaataaaaattcaaaccttctacactggtacacacgttctctctttccatgcaccgacaggtctctcccagatccaacccaaaataaatttggacgcatcccaaaattcggcaaacatatgacgcaaaccaaaacaaaataggcacaaaataatataatactcctatctaattaattatacacaattttttttaaaaaaaaagcaaggcaagcgaagcaaagcaaagaaggaaacgaataacaaagtcgtcgtcctcccggagctcccgctctataaatcgcttcctcctccccacccacccaaacccacacacacctcacacctcaccaccatcacctcctcctcctcctcctcttcctccgcgcgcgcgagatccagggagagggagagggagagatca

SEQ ID NO: 4706 - DNA, 1501 bp, Oryza sativa
ctagacaaaaaagtaagcctccatttctacaggacagatcaatacttcaaacattaacaccatcatcaaccgcgggcacaagagaacatctggaggaggggaggtaacctgcttggccttgtagccgaggcggcgggccttgtcggggcgggtggggcgggtgaggcggacgatggccggctgctgcctgtactcccagcaccgcacgcgctgcacgaacctcatcacgtccgactgcttcctcctccatagctccgacacgtacttgtacgcacctgtgcacagcaaaacgacggaggacggatcaggagagagatggaggtggaggggtgggaaactggagacgagagtgatggagggaggcggcgtcggaggaggagctcacccatggcggcggcggcggcggcggcgagcggcgagaggcggcggcggggaggtggagcgggagaggagactagggttcgtgcggaggcgcgtggcgagaggctatatagaaggaggcgggggcgcggtggccgtcagatggggctagggtttttctcgtgcggttggatgttgcccggggaaggaatggatgggttactgatgatgggcttggcttgggccttattaagtgcagtggtgccgcacaagactcagcccaggagccagcctgctgctctttctcagcctgattaaaaaaatagagaatctattctatttattccactgagttggttcgagttcatgatttgccatcaacattatcactttctataatatactggtgaatttatcaattgttatacaatacgctattaggctgggacttgttttaaaaagtacccaaaatacccttatacacaaacaaggttaacaattgatttatcttattagaagtttcaaaaaaaaaaataaaaacttttatgtggcatccttacacaacatggatatttatatacaagtttcaattttttttatttttttagaaaaatatataacttatttgttatatgatacataaaatacttttttattgttgtttttaatataaatcatctttcatacactatataagataattttttgctattatttcttctataaaaaaattattttgcatacaccacataaaaatattttttctaaaaactaaatataccagaaaaaaattgaaacatgtatacaaaattgcatgttgtgtaaagaggacacataaaaattttcatattttttgaaacttctgatgagataaattaattgttaatcttgtatgtctcaaaggtattttgggtatttttgaaaataaggcccaacccaatgacatattgtagaacaattgataaagtcgctggtatattatagaaagagataatgtcgatggcaaatcgttgaactcgaacaaactcagtggtatagaatagattctctctaaaaaaataaatgatactagtagtttgttattattctttattatttattacggtcttggagatacaactttgaccccaaattatataag

SEQ ID NO: 4707 - DNA, 1501 bp, Oryza sativa
cattgatctctgcacctagtgcattaagttggccggtgatcattttaagcttcctcttcatgcttcgaggaagaactaatggaatatacatgttgcgcatcatcctgttcctgtgcccgtcaaccaaagccttgttgtgctgagcctcccatctcaactcctccagtagatgctcaactttgaaggtgagtaacctcaactcagccattgaaaatcttagtgtcatatctttgttgttctgtcctgccaacgatgaccgttagccaaattagacatcattgagtacaaaaaaaaaactctagcttgacatattatcgtagacttgtcacttgtcacaagttaggcatattttaatatcaaaagcacatcggtccatgaataaatattaaaaaaatggcaacaaactcataaaaccatgatatgttctttaggtatatttgaagatagagagcacgtcagttcaaagataaattagaagaaaaaaaaggtttttatagagaggcaactgcattatcccccttattttcaactcaaatgatgattttacccctgcttttctaactttgtgattttgccctcatttttttgaactgaagcttgtgcttgcccccattccgtgtcatcttaacggtgtcaaaggaacgtatgctcttgcagatttgcacatacttttcttaatatttttgtgattttgcccttggtttgacatcaagcattttgacatgaatttttgcccggttttcacttgaattttcacatattcgatttgaaaagatgagggcaaacacaatcttcaaatgaattttgcccctgtttttatatgattttggacattgttaagaggagacaacaaaatggggataaagctcaagcattagttaaaaaaacagagacggcaaaatcacaaagttagaaaaagtagtggtggaatcaccattggagtttaaagtagcagtaagatcgcaattgctactttttaatggtataccaaatttgtcatattgtttctatttatccgagtgttaatgttgctttctcatgggtggtaaagttcatttatatctatcttaattattaaggaaaatggtatctattactacactatattaaggaaagaaacatgttttttttattattttagtatcaaaataactctctgaaaataagaaaaataatattataaaaagcaatattttctagtgtgtatatttacttggagtatcagaaaactttatgagtattataaaaataaaaaatctagcatttacatagatagcatggatattaacatagaaaggataactatgtcttgttactactttccctctttcgtggatgtatttgtggaagaaggcgataggtttttatttaggaaaaatcgtaaaaaaaatatggctgggattttgtgaaagctctagctcgagagagtagatgagtcacttaaaagaactaggaaaaaaaaggcagcaaatagagataacaaaataaaaacatgtaatgc

SEQ ID NO: 4708 - DNA, 1501 bp, Oryza sativa
gaacaattgttactaaaatgacaacatatttatagttgcgagatatacttacaatctttgtgaggatacattttactattttgtatgaatacatttatgctcacgagggaagaatggtactattaccttgagctctactaagcacttactatttgcttatttgtttgagtatggaataaaatcgggtgcaatagctatggtgactgtaactttgatggtcacaagtgcatgcaaaatgaatccaataaccaactttccgtctcatgcgagaaggtgaatagcgtcgtcaatgatgacttcaccagcacccgtaacttccatctctctaccagtgtcgaccacctccaccgctaccacgttcaacacggagcacatctccacaaccaccgaagtatctccccgtcgaattccaagttctttgtttcgtcgtggagattgctaacttttcacgctcatgtaatcatttgcaccaaacattgcaattaatcgagctttaaaaaatcgggtgcagtagctatggcgactgcaattttggccaatcactatgatatagagcatgcaaaatgaatcaatgttattttttaaagcccgcagtttcaattggttacaattttttttaaggtttaacttcccaattttattttatgtctgaggcattacgctacatttgtcatgttaaaattagatctaatctctagaccttaagccgctacaagtgcaccaagatttacaatcatcggaacctaaatcactactaacgccctgatatttaggatgacctaatctaatctctgtcggcttggcggcatgaatctctcactcgcagtcttcggctagcatagtgatgtgaccatcaagtatatgcatacaaacaagcatgagaaatataaaacaatgccaaagaatacatcggatgaatggaggatctacaagatatttgagtctaatgagttttggaatccagttcgacctccaaagacaacactgacttcaaacagacctagcgccttcatgtcaactccgatttgggtgatcttagacttgatggaaagcttatctcatcgcctttcaaatgtatccggtttcatatccaaattcatctcgagtcaacaggaatcgtaaaaacaagacattattgttgctgaaaccaaacttgggccttctaatagactagctaggcccatctcggaagtgtctccctccacctccacgaattagcacttaactctagatctattttcctctgtaaatgtctatgtacaccctctggaacaattgggtttttttagttgaattttggcaagtgccattcaccttgtctctagtgctcgctcgattaatcagcgagtatagatttagagcccccaatagtgggtgtgttgatttgccgggttgattagatctatcacttcaatcgcaactattactttgtacttaatcacctattcgcaatatttagattgcatcttatcttgttcttgcagtgttctctcgtttgcat

SEQ ID NO: 4709 - DNA, 1501 bp, Oryza sativa
ctaatcatcttccttttctgttaacaaaatcatcctagtcacgttaattggcgtagaaattagagaacccttaaaaaagaaattagagaacccagcagccagcacaaaaaagccaaaaacgaaatctgaaagggaacaattgcgaaagcaacggatgcttagcttgctctccccaggaggatgaaactgactttttttttctaataactaatgttacaattaaaacaaacagtaagcagatttatcatgcaaaaccttcctaaaatgtaatttactgcaccattatatttgctttttttttaaaaaaaaagttcaagattttttggacaagcacattgaccatcagtaaagattgtcaggttgggtaggttttccatgaagttgacctaaaatacttattttgaaaccaagcacaatttttttcattgacaagccaaataaaaaaatgggagaaataataataataaattcttagaagaaaggggtagagtaaagagcagattaacagctgcgcctaaaaataattaaatttagtcaaacgcccaatgcttcgtcttcctgcttccttgagtttcttctcctcttcctcctcctcctgtcgccatttcccatatcgccacctagaatcaacaaaagcgaccaccttttctccgtgcgcttcgattccaaggccctaatctaattaggagctcaccgcaacaagattgctcggagctttcgagcgtttcttttttttttttgtttccttccgcgatatttatattctaatgctgcaactagctgcccgaatcctcaaaggcggagcattttctaaagtggagttctcaaaaaaagcgtcttcttggggtggattgcaagttggtgacccaaatccgtcgctacgggtcgggagttcttggatttcccgctgattggttcgcagattggagctcttgatttggttgcgccatggcgctgttccggaagttcttcttcaagaaaccgcccgatgggttgcttctaatcacggacaacatatacggtaatggaagtatttccttttgcactgccatgacttatgttgcttgccaagtttaccatggacagattcatccaacctagcttctcttttgaaaaggtttcagcttgattgatatggataggctgctaatttaagcatagttgaattaagatttggcacttctgaagtgttggtagtatagtgtatcacaatatggattagagacttttagggccatgagagttatacgtaatgtagtggtggaagatttgtgtttttgtctgtttattgcaatttgaatggttaatcgtttcagttatgttatattctccctaaaaagttgtgttatattccaaaagaactgtttcatactttcgttatctgttcattagttaactgtgtgaagataaaagaactcaaaatagagccgaggtcctgaggatgcttgacacatgtagcttttatctatttcagtttttgatcattgcttctccatgaaag

SEQ ID NO: 4710 - DNA, 1501 bp, Oryza sativa
ttatttataattgtttgtaaacactgctccctccattccaaattgatggtacaccaagaccaagaaaagctaataactctctcatattatatttactctagcaacaaacttgatgcatgcatcatccacactattttctagccaatagaaaatcaagatattgcatgtgggttataaatacttgtgtggatgcatgcatcaatgcccatttactccaatgcaccaataacgaatagacttaatgaataaacacaaatatatagatcatttaagaataaccttaaaaaaattatatgcagatcaattttgaatgaagggagtagtatacatgcctcttactacatatttttggatcgatcacttgagaatttatggatggagggcacaagctgcattcacgtacgacaaatgcgatctacacccaatctttgcgcgtaaatttctgatcgatctgcatttaattcactctccatcgaaagttcatttaagagctagctaggggccgaccatcgatccatcccagaagtaattactactctagttattgatctgggcccttcatgcaaggtcgaacccatcaacatgcacgtaatataagctgtgtttagttccacgctaaaattaaaagtttaaagaaattagaacaatacgatggaaaatttgtaaatttgtgtgtaggaaagtttgatatgacggaaaagttgaaagtttgaagaaaaaagttaaaatctaaacatggccatactctacatctaaaaataacacataagattaagtggtgagatgaaaaagagaaatgaggaaaaatatatgtatcacctttaatcatgtaaggggcaatcttcacacaactaaaaaaaagaaaaaaaagtgaattggacaaacaaataaaataaaattattggggttagtgtgctacagtacagaggtaatataaagatgatgtattgtatataccaccttttatagataaaattgaaggtgtcaactacctttgctataaaacttgttcctatattactcgtttaattataattagcatttaactgcgacgctaaaacgcacgcttgcatgcatggtacaatattggtactgcaggagtatatatatgtacgacgcgcatgctacctgcagtatgtacatgtccctcgtctgtgcgttgcacgcaccgttttagaacgcaaggtaatattggtttaactttgatcgatcatatataaacataattaaaaatataaatttcaggtatctgaagaaaaatggatgtatatatagtctaccataacgagagatttcttcatagtattacacttatgtaatttctaaaatttatatcgaagggctagatagtcaaatttttatccccgcaaaaaaaaaggatagtcaaatttatagagtataatgttaacttagaaaagtcacacacggcttgtttatgctaccagaggaaatagctgtataattaattaattaattaattaagcccgacttacgtacgtac

SEQ ID NO: 4711 - DNA, 1501 bp, Oryza sativa
gactatatatagcaagtactttctgagacgaatattattggtgatcccgggtacccgggtacgtacaaatcagggtgcatgaacgacatagcaaaggcaggactaacaaaaacggaaggcaaatatatatatatatatatatatatatatatatatatatatatatatatatatatatatatatatatatatatatatatatatatatatatatgcatgcatcagtgtgcattcagatcggaagtggtatataatgtggttgtacgtagggtaagaattaagcgtgcgtggcaataacatcatagctttgtgggcaattgttcgtctcttctcctcacatggaaattttgagagcagagatcgaatcgatcgtcgaagaacgtacggtcctcaaccaattaataagcacatatatatcgtcttgagatatcgatcgagctggcgactgactagctagtaaaattgtttgaatttttctagacaaactgtattaagtttgatcaagtttataataaaatttagcaacatctaaaatattaaataagtctcattaaatctaacattgaatatattttgacaatatatttattttgtgttgaaaatactactgtaattttattaaatcaaatattttttattagaaaaaagaaaaggtctaacgactttaaaggaaaggaagtactgtatattgttgtacgcatgctagcaagcaaatgcaaggggcagtctggcagtgcatatatgatagcgtaatgatgatttgttcctgcggctccctccgagcactggtgaccagtttaggttatgtttagttcacataaaaattagaaattcgattgaaattgaaacgatgtgacagaaaagttggaagtttgtgtgtatagaaaagtttcgatgggatgaaaaagttagaagttttaaaaaaaagttagaaactaaacaggccttaggagtacatgttggtcaggaggacgcattctgcatttctgcggcaaaatcaatcgtattttccgtcgtggtgacacgtcgcggctcgccggggccgggctacgagcgtgaggtccccgcccgttgcagactcagcccagcccggcacgtacttccaacttgcctcgccgtgcgcggagaagaatagtgggccggcccaacttgtcggtgcaccactgcacctgcacgttcgtgggtatcgcgttacggcccatactgctctcgggctgcctgtctacaatacatgggccaacatcgtcataccagtccacttctgacggtatgagcttttgccgtttctccttgcttcttgcatttcgatgacgacaacgtactctcttcgtctcctactttaatcatttgtcttgcttaaaatactaggcacaaatatatttaaaataagacggacaatcaaaaacttatggttgcacttaaaataggacggagggagtaaatgctgcttgaaacaatgttaaatctagaaagagtcgctcaaaggcatatggtacctgag

SEQ ID NO: 4712 - DNA, 1501 bp, Oryza sativa
tctccaactctggcgtccacctcttcttctcctgcgccagcgaacccaaaatccggcagagggccgacgaattagggtcctgcggtggggtgggggtgggagggagggaggggagggggaagagggggagttcaccggctttagagggatggctgtgggaggcagcagcccgacggtgggcggcggatcgagcgggcggcgaggcagcggcggcggcgccgtagctgctgggtcgggagcgggcggcgggggcaaaacggaaagagtggtaggaggaggcggctggtggtggcgccccgccggcgacagggaagacaacagacagctcgccgctgccggcttgaggcaaaggagaggagagggagggggagggtgaaggggccggcccggaggcctcgccgacgccgttgacacctttcggccagccggcgaggccgggcggtggcgtgctcaggcggcggtggcggtggcggtggcggaggcggggcggaagcgctgaggagcggcggcgtgaggaatcgggagaggagagaggatttttatggtttggttgcctgcacgaatcttaaagcaatcgggtggtctaaaatttgcaagatttgtaagggggtttcctgtcaaatgatctatagacaatcccataaattaaacaagagatattttcattcattttgttctaattatgtccttagtgactttcaagagggattaagctcatctaacttacttttctctaacttgtgtcactgacatgtggaccatatatctattggactcacatattagtgcatcaaagtcaggggaacctcttccctctcgagagtcccctttcttctcgcggctcagttcttcagtttgttctttgagcttggtccctccccgaatcgatcaccggatttccacactttcccgtaaaaccgaaccccaatcgataaattcaaacaaactctcatcatcctagagctctactctagttttcctttttttttaaaaaaaaaatactacggagtagagctctacgccaccgtacactacggtctcctcctcatccccgaaacccaagctactatcctcttatcgccaactgacaatgacaagagggcccctagccccctactcctccgggcaccacatgtcagtgggcgtaacagaaaacaagtgttgacctcggggtgcgtggagtttttcccggagtcgtatcctttcgggtgacgcatacaagggcggttcggatcggacggctagtatatatccacctccgcctccgcgtccatggccaccgccgcatccacctccgccgccgccgtcgccgccgcatcgcgcctcctcgtccgccgcgcgccgccgcgcctgctgcgccggttaccccgcgcggcgctcgccgcctctcgcccgtcgccgccgtcgtcgtcgtcgtacggtgcagcagccgtcgccctcggccggcagccgctcggccaccgcgctaggatgggacacaccgccgccgccgccgccgccg

SEQ ID NO: 4713 - DNA, 1501 bp, Oryza sativa
gctggtggcgaggtaactgacaatctcaacttcgatccggtttaccaacggacggggaagtgttcctccttgggcttgctccaccggaaatgcgcggcgttgatccactctgggttgacgagcaacttgccgaacacctgcgcccacaccgccttgaacgtcgtcgggttcgtggcgacgacgtgggtgacctccgggccgacgtcgtcggcgcaggtggcgccgagctgctcggttctcctccacacggagtggtggtcgtcgctggcgatcgcccgggtgaacgccaccgtgcacccgagcagcacctcgcgccgcgtccgcctgatcacctccctgacgtccgcgacgaagctgccgccgccgccggcgaagaagcccgcgtggactcgccgcaggacgcgcagtgccgcggcgcgctcgctctcgtccacgccccgctccgacagggagtgcgtgcactcccacggcgacccgaagtcccggcagctcgacgcgaagtagtggtatctctccatctcgatcaggttgtcgctgttcccctcccagacctccgccgtgtcgtcgaggatgaccaccgcggcgcgctccgccgccgatgccggcgccgacccgaagacgacgtcgaggctcttcctgtctggctgcggcgactcgtccctcgatatgatccgttcgccgaagtagacgccgtcggggtcgagcagcttggcgaccgccgccgcgtagtccctgtccccgagggtgtacacacgtgcatctcgaacatggcgctcgcttctcgcaggaagccatggacgaacggcctgagcttggtgatgaacgccgagaaccagctggcatgatccaatatgaacaggcccctccccggatcatctgtgacgagctccgccaacccgttgacgtactccgtgccggagatatcgtaatccgcggtggagttgacgagcgtgtggtccaagtccacgacgaggatcagcttcctcgcccgcaggaggctcgccaggtggccgctcgtcggctccggcgggagcacgatcgagtcggtgctggtggcgccatgggaaacggcggcggcggcgtcgtctgctccgctccctcctcccgaatcttccgcgtcgagatctccctcctttcccccggcgattccaccagggttaggagcggcccctgcactggcgtcgtcctccacctctccccccagatccatcccaccagtgggcggcggcggaggggtccattccggcgagcgaggctgccggagaggttggcgatcggcgccgcaacgggaagtgtgcggtggaagggaagggagcgggtggtgcccggaggaaatgaattgaaatggggggaaatgaaattgggcgcggccgtgccaatttgttcccacccgcggggggaaggaggatgggcccgtaaaatgccaccgcatggcccacgcagcccagttattctcggccttcctgctttgcttgctgctcgtgagtcgtgacatttccct

SEQ ID NO: 4714 - DNA, 1501 bp, Oryza sativa; identical to SEQ ID NO: 4710

SEQ ID NO: 4715 - DNA, 1501 bp, Oryza sativa
cgcatcatatccttaggccagattaaccaaaagaacatcaataagcaggactatatatagcaagtactttctgagacgaatattattggtgatcccgggtacccgggtacgtacaaatcagggtgcatgaacgacatagcaaaggcaggactaacaaaaacggaaggcatatatatatatatatatatatatatatatatatatatatatatatgcatgcagcagtgtgcattcagatcggaagtggtatataatgtggttgtacgtagggtaagaattaagcgtgcgtggcaataacatcatagctttgtcggcaattgttcgtctcttctcctcacatggaaatcttgagagcagagatcgaatcgatcgtcgaagaacgtacggtcctcaaccaattaataagcacatatatatcgtcttgagatatcgatcgagctggcgactgactagctagtaaaattgtttgaatttttctagacaaactgtattaagtttgatcaagtttataataaaatttagcaacatctaaaatattaaataagtctcattaaatctaacattgaatatattttgacaatatatttattttgtgttgaaaatactactgtaattttattaaatcaaatattttttattagaaaaaagaaaaggtctaacgactttaaaggaaaggaagtactgtatattgttgtacgcatgctagcaagcaaatgcaaggggcagtctggcagtgcatatatgatagcgtaatgatgatttgttcctgcggctccctccgagcactggtgaccagtttaggttatgtttagttcacataaaaattagaaattcgattgaaattgaaacgatgtgacagaaaagttggaagtttgtgtgtatagaaaagtttcgatgggatgaaaaagttagaagttttaaaaaaaagttagaaactaaacaggccttaggagtacatgttggtcaggaggacgcattctgcatttctgcggcaaaatcaatcgtattttccgtcgtggtgacacgtcgcggctcgccggggccgggctacgagcgtgaggtccccgcccgttgcagactcagcccagcccggcacgtacttccaacttgcctcgccgtgcgcggagaagaatagtgggccggcccaacttgtcggtgcaccactgcacctgcacgttcgtgggtatcgcgttacggcccatactgctctcgggctgcctgtctacaatacatgggccaacatcgtcataccagtccacttctgacggtatgagcttttgccgtttctccttgcttcttgcatttcgatgacgacaacgtactctcttcgtctcctactttaatcatttgtcttgcttaaaatactaggcacaaatatatttaaaataagacggacaatcaaaaacttatggttgcacttaaaataggacggagggagtaaatgctgcttgaaacaatgttaaatctagaaagagtcgctcaaaggcatatggtacctgag

SEQ ID NO: 4716 - DNA, 1501 bp, Oryza sativa
cactataaaattgaccattcaagatttatgcaatgaaaagaaataacgttttccaagttaccctcttgtcatattttgttctaactataagaggaaaagagctcaaatacataaacaatggagaaaactctagtcaaatcctcgtaggccaacaagttaatagggctattcaggtatgagcaagaatacttttctttgggctatatttggctttattgtttgatggctaacatatatatgaattataaaagtaggcagaagatggagacatatgtgattgtattgatgtgaatctacaaccagcatgtaaacatccgatgtaagccactttcttaaagagatggctttcttacatatggtggctaaatttaattcgtatccgtatccgaattattcgtattcgtatccgcatctaaactatccgagaattatccgatccaaaagatatccgtatccgtttttattcggagcggacggaaactatccgctccgttttcattaggggtgcccccaatcaaggaaattgccacccctacagcaccaatccgttcacaatgaggagcgagcgcatagtagtgccttccgctatgggtcatgttagatggttcgggtgtttttcttttttttttctcttgcccatttcagctaacacgtattgcatttatatggagtacatgcctacatgcttatgacatgacgtcgttatttagggagccatcgacgatgacctcaagcccattgccgccgctgccgtcatcacactcacggtggttcacgctcgcaacctcaccagttgccgccggtgttcatccaggccttccgccagcattctcctgatagccgctggtgatgtccaccacattatctactccattcgattctaagaaatcacttatttattttaaatttcttactcttattcagatatgctctatttgccctaaaatataagaacctttagtatttaaattttgtcctacttatggagcaatactcccttcaccaaccatcccttattttatttttactcaatcttacctccaaacaccatctcttattatcttctccccaaccaccactcatttaataagagatatcatagtttttttctttattcttaatctctaaaaggaacatagtagtcgttaaacttttggacagatggagaaggtattcatagaattcaagacatttgtctctttgttcacttaatgatattgatcttatcaataaatgaggtattggttttaatgtgtgtacaacaacaaggtcacttaaacatttataacaaagagagggatgcagtgatacctgtgcaattatgagatggtctttactctatatatcttgtgtagttaatactatgatttttcttgtgtaattaaatgcattttatatctgccattaattccaatatagtatctcttaagtgaaaactagcggaacctctaaacctatatatacaatggtctaatgctatgaaatagaccactcaagatta

SEQ ID NO: 4717 - DNA, 1501 bp, Oryza sativa
atttgccaccgttttttttaatcttgtaaagttgctaattgaataacagttatagttgcatttttataattttttagtgtcagtctttgcaattgcccttagaggaagtataatagtgagctataaatctactataagcttaggtagaggtgacagataataaaaaatcaaggatgttggctttcatgcaagagctagtttaacacaagctcctaagtaaatatattaaatgtataggtgagagatagagagaagaagaaagttgtagccaaccttatagttaatacattatatatgttggctttaagatggaataatagtaggaagtggactctactgtattattcttgctcttagtaaattctactccactgggtcgaagatggggagcgtttgcctattggcacgacggggaaatgctttttaactgcgtgtgcaaggggacggttctgttagcaccataacctcgtggttaaatcacgtggtttaaacgttttagccgtaccttcccgcaatagaaataccaaccgtccacggacacgttgtttgacaacacagcatgcccaaactccaaaaccacgcctcccactgacatagtaccgaccagcctactacgtccaatatgtcccacctgtcagcgacctgtcccgagaagcgtgcgcgccagggaaaaacatcatccgacgcgattgatctatctcccctcgtcgcgccacgacgcgatccacctgcccgatcccgaggctctcgagctcgaccccgacaggacagggcccacacgctcccccctttcccccgccgtccacgtgttccgccgcccgcacacgcggcgtcccgtccagtgcgcccgatcggggtcagcccgccacgctccccccccagaacatacgcacccactgtaacgtgggccccgcggtcgcctggtcccacatgtcagtaatgcggcgcgagcgcgtgtagagcactagagcccagtccagcgtgcggattgggtgcgtgcgtgcgtaatccggggtcgatccggagaggcgagccgccgaccaatcacgagcggaggatcccgcaaccgtgtaccttcctctcctcccccttctccctcccgtcccgcctcacgcgctgacaggtgggccccacgcccgcggggggagggcggggcccacccgccagcgtcgagccgtggcataccaggctcgcgcgggcgaaatcccgcttctgccccccgcgcttccccgtcttcctcctcctcctcttcctataaatgcacctacccctcggcgccgggttgcttcctctccctttcttttccatttcctcctctcctcttcccccctttggcttggggcttggcttggcgcctcctccaatcgagcaggtttccccaaatcttagggttagggtttcgtctattcgttgccttcctcgccggattagcgcgtccagggagggtgagcggggtgtgcttggtcgcgtcgcgtcgtgccgtgccgtgccgcgcgtggga

SEQ ID NO: 4718 - DNA, 1501 bp, Oryza sativa
taacattttcatgaagcagcaaggaacagtcaaattttccaacaccaagaaattagttgaatttacttgctttgtctgtcgaatctatataattgatcgagaatagacaagtctcacagtctgctataaaaaaggacgtctttgcaaaagttgtttagtaagtacttaagcaggaactacttggccaacaaattatagattttcttaccaagtcaggagaatttcacactcatcaatttatctggaaacaaaatcctatgtgtgccataaccaatactaaagaaaatacatataatatagcactggtattggtgaagccgcaatcatcaagctgagcactatgatgacctacgtttcggtggtggcgacgcagaggagatcggcgaggtgggcgactgccagcgggcattgagcgtgtgaaaaaaaggtgggagagggtgcgaaagacgggagtcacaggaggtagatggtgggagggatctaggaaggctagggcaagcgtcgatctgggcgacctcggtggcagacagtacagggacgcggtgattagtgggtgagggttgtagaggaaggcatgcgaaggaaaatgggccgtgattgatttgctggcgtgtgtgattttcagctggtgaccctgcgtgcatgcgctgttgtcagatctgatgtattggatgattttcggacgttagatttgatgaataaggtccgtaggatatcaatgatgaactatagggtagattataaattaagttttatttgataaaaaaataatattattgatcgatatttgtatttacttttatataattatgatattattgctataaatatcataatatttaaaaataccattaattttaaagtggaagagtatttcataccgcggccgtccacgccacttgatgacacgctgtcgccagcggaagttcccaaaagtgacgaaatttcggcatagcgaaatttcgcagctcgacttggaaaacccaaaacggcaaaaagcacggagaaacaatccatcgacgtggtaatcaatcaaatcgaaagaaaaaaaatataaaagaaaagaaaagcgcacgcccctcaaagcagcagcggcctccccttccttggagcagagaggactagaggagcaccgaatccaaggtcgaggggaagaaaaaaagagaaaattccacgaataaaaattcaaaaaaaggaggaggaaaaaactgaatccccttgcggctcgtgctccttctccccgacctcgaggcaaggcaaacccatccttccccctggcctcccttctccgcttcgccggctcacgccttccctctctcgcgaggcggccggcgagatctgcctgcgccgcgctcccgctcgcgccgtggtcaggtgagccccatctcccggcccgatctcgtgcgggtttcctgccaattcgggggggcagggcgaggtgaccttgtcgtgtggttgttgttgttgttgttgttgttgttagggtttcgtcgcgtgatgg

SEQ ID NO: 4719 - DNA, 1501 bp, Oryza sativa
ctctctcgctcgctcttttctctctcgcgcagcgcgcacggcgaggacgagctcggggacgggcggtcggtgtgggcggtcggcgaggtgaggcgagcgtggcggcgcggaggcggacacatcgttgattcgattggcgaggtgaggacggcggcgcatggggggcggagccagttgtgggtggcggagcgggcccgaggacgacggcggccaccggaggcggaggccaaccgggtgcacggggacgcgcggtggccggtaggctccccctcctcgttgtgggcgcacggggacgcacggggacaccaccgccactgcagctcctcctccgagccgtcgcgccgcgccccatcccacctccccgtgccaggatcggcgatggagactggcggacgcggttccaccgaggacgcaggcgtgaatggcgaccgggaatcccgctccaccaccccagatccaaatgcgagctcggtgatgacacatggagcttgggtcggcggccgcgcgtgcgtcggcagcagcggcggcggccacgacagcaacaatgccggcacactagtgccagcgccggtgccggcgtcgtcgtcgtcggtgagcgcggggaggccgagccggcggccgcggtggtggcggatgtggctgcgcgagagcgaggcggtggtgatggagtcgacggagcagagctggagctgtgatgacgctttctctcgtggcccaatcttctggtgagggggataactctcgctttgatcgagtgcgacgtttgcgatgtggctaccaaccagaacaagtccaggacgcctgcaatcgctacactacaaacgatgtcgtatcaaccgtgacgcgcggttgatgatccctgcaatgcaaacgagagaacactgcaagaacaagataagatgcaatctaaatattgcgaataggtaattaagcacaaatgaatagttgcaattgaagtggtagatctaatcgacccagcaaatcaacacacaaactattaggggctctgaatctatagtccttgactaatcgaatgaagactagagacaaggtgaatggcacttggcaaaattcaactaaacaaaacccaattgtttttaaggatgtacaaagctatttatagaggaaaataaagctagggttaagtgctaattcgtggaggtggagggagacacttccgagatgggcctagtctattacaaggcccaagacccaagttcggtttgagcaacatcactgtcttgttttggtgattcccgttgactcgagatgaatttggacatgagaccgaatgcgtttgaaaggtagcgagatagctttccacaaagtccaagatcacccaaatcggagttggcaagaaggcgctaggtccgtttgaagtcagtgctgtctccggaggccgaaatggacttggacttggaattatcattggaacgtgtgaagttatgtgcgtttccgacgaagtgatgtcctcatcatcctccccttcttgaattggagt

SEQ ID NO: 4720 - DNA, 1501 bp, Oryza sativa
accacccccagctggcactggcggcaccatccgcagtagtagcatgaacacaggtagtagatggtacagaaggacaaatttgattcgagaggagagtaacctgcagccattggggaatgcgcagaggacgccgtcgccgcgcgggtggacgcccatcctgtacggcacctgctcctccgtccccatcctcaacacctgcactccccacccccacccccaccaccagcaacgtcagatcagcacgggacgagatcgagatcggcgtggaaatctggcggagatgaagaaaccggatcgctcaccgggtcgggggacagcgccgccgccgcggccgccccagcggaggtgtcgagcgcggccaccaccagcgcgttgggcacgccgctccgcccctccccgccccctcccccgagcgccgccatgagcggcggaggcggaggcggcgtagcgggggactccgacgaggccgcgcccgcgtccgcgtccgcatccccctcctccaccggaggaggcggattgaggatgtgggcgaggggcagccacgaggcgcagtagatcgggaacccgtacgtctgcccgccgccgcgccgcgccatcgccggagttggaggtggtcggcggcgcaagcggatcggatcctctctgactttcgcgtgcggttgggctcttgaatcgaatgcgcaatccaacggcgagcagcgaacaccggtttattccggtttgcagaaaaaaaaccgagaaaatatcagttcggctttcggtttcggccgaagaaaaccgggagcacgccacctccgcacggccagcctccctccgtcgcgtgaatggctagaggctaattttcggttttatcggtgggtcggtttattagtggagttgaaagccgagccataaaccgaacacggaacagaagaaaaaaaaaaaaaggcaaacaacaaccgctggccaaaaaaaatcgaactcagaacaaccgttggctggatacacctggctaccatccaaacacgcccacgtattttcttcgaatttaaactccagtgcagtgtagttagcactagcatgctaagaagattgtgtttcatacaacttgatggtctttgattagatcttttggtgtgtgtatttaaaacagagactgaagatctactacttcatttcactgataaaagaaaagatacagaccgatcgttcacacacacacacacacacacacacacacacacacaagaacaccgccctacaagcacatcaggaactccctaaagctacactaaatactttctggaaaaaacaaaagcaaaattctagcatttttgtgccatcgtgcaagccacctgatccgatcggactgttaagctttgatacatttgctactcattacatgctgatcaactactgaacaacagatcatcctctgactcatcttctgacgatgatggcgaggccgtactgtcacaagtgaaacatgagaaatcagaatgtagctcacaaatcctatctt

SEQ ID NO: 4721 - DNA, 1501 bp, Oryza sativa
ccattattgcagctaggaggtggctgcagctcatccggtgttaatctcttttgatttcggttgaagcagccctaggcaacgtctcttaccgtcagcccgaggccttgctccgtctcttgccatcagcccgaggccttagcctcatgaccctacgtccaggttgctaccatgtgagcgaagtctggtggaatttggagaaaagggggagcgaaaatagaaatcgatttctgagatagcttttgagctgaaagaggtttgcgctttaaaaattcataactagttcatatgaactccgaattcagtgaaccaaatttctgtggattaagaaaaacgtgatcttcaatgttgtaaaataaaaatgaccaacatttgtactggttttcccagtaaaaatataaatagctatatgtatcccttgtgtggtctagctcttatgaaattcgtaagaaattattggtaaaagctaaaattatgaaaccaattttgttgagcttatattttagtactctttgctgttgtggtgttgtttttggaaaaactacctcttaaatcatgtttaggagtttatttagcattcctatgtttctaacttgtaagatctataaataaataatgacaacacatatagctgtgaaataatttttcataggagctgtgagtgatgtaatttactctaaaaataatcattattatgaaatcttggtttgaaatgcattttacttgtaatgtactaaaggaaacgttaatatttacagaactgccattttcagcacctaagagcttgtcattttcatatctcccaaaccataagtgataatctggtgattctttcacctaaattcaagttaaaatatgatctacccactgtatttatttcataatttattgatcattttgcatgtgcatgtttatttggctcttattcgcatattgcttcttttcgatagattcggagattccggagagtaacgagccatatcccgaggaggatagtgactaccctcagcagcaaggcaagcacctaagcatatagaacctatactttctctaaaaatgatttggttgcaatctatacgtatatatatgcatgcattgcctagatattaatattgtcagtttatggtgtatgggtagaacctatttatgcatttagttcttgtgttattgctgtccttatatcctattaccacttgttgggattacttgggatttcttattcattaatgcttagccatgcttagtgctaatagaactatagggatggacagtgctattaattgtggtatataaacaacttgcattattgggcataaaacttgagcacttacactaaataatggttgatgaaatatgttggacttggacgggtgatagggcgatgatgggaggttggtttcccctgatgcaagtagccccgtctaggtcgttaaggaccgaacattttgacatctattcaagcacccttcgtacttaccacatgtcttatttgggaccggcttgt

SEQ ID NO: 4722 - DNA, 1501 bp, Oryza sativa
  unsure (1)..(1501): unsure at all n locations
cggtcagggcgaagtcgaccaccggaaatggcggcggcggcggcggcggcggaggacgcgctccgtcccccgcggtgggaggccccggccggatccgggcgggcggccgggcgggatgccacgcgccgggcgacggggggagcgccgcccgctccctcaacgcggcttgggacactcgcttgggaaacggaaactggggccgcagggaggcggcggcggcagcggcggaggcggaggggaggggcgacgcggccggcggtgtgggaggggaacggtcgagggggggacgggggagggaggcgtcggcggcggggggagttggaacttgggaagagggggaaggcgtgatgattgatcgggtggtgggggggagggggggacntnacnggtgcgtccgtcgatgttgctgctctcttggagtctcgatctgctgctgctgtctcagccagcggggggctgagcggcggagctacacgcgtccgtcccctagagcgctcgcttagccctgagctaccacgccgtctcgcgcacagggctcggtgtgcgaactgccccggtccatcgtgactaaaggctgtgttcgggccgacatgcaaaacaaaacaccaattattatatgattaattaagtatttattatttttttaaaaaaaataaattaatattattttttatgcaactttcgtatagaaatatagctcggctcattggaaaaaagcagagctacaattttagggcctcgttggtaatcaacatgctcggacagaccttttccaaatcagccaaagcaattccattggttggcttattttgtttggatggatttgatgaaggatctcctgcttatacttggttgaaaatactcagatgggctttggcagtttggctgaaaatcttcagcccaagggtctcaccggatggcttgtttggttgaggcttgggctaagacttttcagccaaacaagtgggacccgcaagggagttggatcatcagcagtggctaattatgtgaactctctagtgaccatacacaaaaaataaaaatcccaaaaccaccggccacagaaaatccttcaccagccatataagcaaaataacccaaacaatggtttttctttggctaaattgaacttggcagatttggctgatcagccaaagcttcatgccatccgatgaggcctgaaatagctatccgatgagaatcttagtttgagcatatagcccttgagacgttcattggttgccatattcaatcatgcaaaaggtaactgtctgttgtaaacatcttaaggttttgctagttatctagctcgcacttgctcgtatatcagatacagcgtgtcgtatatttagttgcttgaacattgacctgagccagaatgagcagttacaaaactgccttcgtagctaggttgagcagaaaagcttgaatcgagctcaactcatcccgcatgagcccatgtaggtgtggggttacgcaggggcgtgtggatacaaaaggc

SEQ ID NO: 4723 - DNA, 1501 bp, Oryza sativa
  unsure (1)..(1501): unsure at all n locations
actaagattctcatcggatagctatttcaggcctcatcggatggcatgaagctttggctgatcagccaaatctgccaagttcaatttagccaaagaaaaaccattgtttgggttattttgcttatatggctggtgaaggattttctgtggccggtggttttgggatttttattttttgtgtatggtcactagagagttcacataattagccactgctgatgatccaactcccttgcgggtcccacttgtttggctgaaaagtcttagcccaagcctcaaccaaacaagccatccggtgagacccttgggctgaagattttcagccaaactgccaaagcccatctgagtattttcaaccaagtataagcaggagatccttcatcaaatccatccaaacaaaataagccaaccaatggaattgctttggctgatttggaaaaggtctgtccgagcatgttgattaccaacgaggccctaaaattgtagctctgcttttttccaatgagccgagctatatttctatacgaaagttgcataaaaaataatattaatttattttttttaaaaaaataataaatacttaattaatcatataataattggtgttttgttttgcatgtcggcccgaacacagcctttagtcacgatggaccggggcagttcgcacaccgagccctgtgcgcgagacggcgtggtagctcagggctaagcgagcgctctaggggacggacgcgtgtagctccgccgctcagccccccgctggctgagacagcagcagcagatcgagactccaagagagcagcaacatcgacggacgcaccngtnangtccccccctcccccccaccacccgatcaatcatcacgccttccccctcttcccaagttccaactccccccgccgccgacgcctccctcccccgtccccccctcgaccgttcccctcccacaccgccggccgcgtcgcccctcccctccgcctccgccgctgccgccgccgcctccctgcggccccagtttccgtttcccaagcgagtgtcccaagccgcgttgagggagcgggcggcgctccccccgtcgcccggcgcgtggcatcccgcccggccgcccgcccggatccggccggggcctcccaccgcgggggacggagcgcgtcctccgccgccgccgccgccgccgccatttccggtggtcgacttcgccctgaccgagggagacggtctcgtccctctcttgtctgctgcagcttcctagctcctgggctgcctccccccgcggcttctcgggcgccgcgatgtcggagggcaggggaggtaacggcgcgcgagtgatggtccgggaggcggcctgcaacgccatcgcgggcggttcggctggtaattctgctctcccctgcgtatggttctagccagggttggtgggttttttttggcttcggtctcgggatggtggcgtggggttttgatccttctgattgctcttcgtttggtggctgtgttgggc

SEQ ID NO: 4724 - DNA, 1501 bp, Oryza sativa
ccccgagccccctaggcggactcgggcgcctcttggctatttattacccacgcgtctgaccccctgaggggggatccgggccgctcggccacgtggctgggggaaaggactttttcccctcagcatgggtaccccggacccatatgaccaacaacttcaataagaacactctaaaaaaaagataaagggcttcaccgaagcgatgcgcaacaactccattaggagctaagctcctacatggggagtgaccggaccaagagttaatgaataggctctagcagtacaccataataaactctcttggcacagcatccaatacggcagcagtactaggtgtggcattgttaaagacacaatcattcagtgtttccaaattttccaagccactaagataattagagagtttagccatttcttagctttcttagaaacacctctgaccacttgggatcatcagttagagaatcgccttgaggaagttagagaatcctagaaatacaatgattatgggacggatgtaagacacaaggatgtgttgtgggttaccctgatatgcttgtatagtcacgtatccgtgtcggatacggcaacggatacggatacgtatcggatacgctccaatacgtatcccgtacgtatcccacatatttgtgatttgcaaaaaaataaataaatcaagatacgccagcgatacgcccacgaccttcctctgtcttcgctcgcatctgggatgcgccaccgcacgagctttggcccaacttgatggctgatgtctctcgtgcatgcccggcgttgccgccggacgccggctgcagccgcgcgcgtcgctgccgtgcatggggccacaacgtcccctccgcgagacgacagagccgccgctgctgggcggcggcgcacctctttcgccgccaacctcgacagcagaactttttctttcttcgcttgaccgcctggccgggtaatccattctcttcaaaagtttcatgcttgaatctgctgcgcctttcttgttttccttaggacaaagtactaccgtttttgttagttacaagtggtagtgcatctagcaatcctagtggttactggttagtgcggctgttaatgttgatgcaaagtcatcaagaaatatatgattgaactattaatctttggttttggggatcttaatcgcttcttaatttgaattgcctatagaagagaaaattgcagaatattgatatggaatcggctacactaatactagtattatatcactatttctttacaaaagttccttgatttttttgtatttttaatatatataaatacaatttccttaattttttgtgtgtttttaatatatatgtatatgtatatatatatatgtatatatatgtatatatgtatatatgtatatatatatatatatatatgtatatatatgtatatatgtatatatgtatatatatatatatatatgtatatatgtatatatatataagcgtatccccgtatcgacgta

SEQ ID NO: 4725 - DNA, 1501 bp, Oryza sativa
cgcaccttttcaatatacccttcaattggtggcgtgagtgttgccatgtatcggtttgcagggaatggtgtcatgtcaggaatcatagcagcagctcgcagcttctcagggagtgctgcaatggcctccttcttgagacttagaagagacgattctgcagtttgccgtgcgcggtgccgtcgcattagcacctgactgtattgtttggcaagtcgccggccatcttcgactgtcagctcgtatttagggattgcgtcctcatcaaccaatccaagactgatgtagtcaagacctggtggacccatcagcacacggccaccatcaccctcacgggtacctttggacttggctttagccttggctaaatcaagttcacgttgacgttccttagaaatgagtccaagctcctcacgtttggcctcacgaagacgctccttgggggatagatggcgcagaggagttgaggcattcagacaagactctgcaatctgagtaatacgctcaatagcctcacgacgaccacgcccaccgccaccacccccaccagtggaaggcgcgccgcccttctttgctccaatggtgttacgcttcaattgttggccagacttgagcttagccttacccttggctgttccactcactggcgcatgctgttgaagctggtgatgctggcacgtcatcccagatgccaatgccgggttgatagtaagtcccttgaaaagacgccgagacatgctaatggatgaacttaaagccattgcaccacctaagctgcatgaatcaccatgtgtaaatcattttatcttttgtgtctttcatagtgaaagggtgatttttttttcaagacaggtggtattgtcaattataagaatgctaaatatatacatatatttttaaattaaactctaaaaatatcacaaaaaggaacaggtaagagaacactttaaccctcgagttttctgcaataacacaggttccttttaataacacagaaaagtagtaataaactaacatgttcctcaaaaaacatagatatgttatatacttgcaggctgcagcaagtaagatagctaacgagaacataaaagttgcccaaacaaactgcactgaatcaactgcacaagagacaattttacattcctactcccttaatgtgccacagagcaagaaacaatgaagatgactaagcattgaaacagcaacacaaggagaacatgcggagttgcggcggttaatctgacaaagcaatataaacgcttgtaatcatcaggactcagggggccatgggggtgggcccaccggcccaggattgaacttggttattcgcaatgggaagagatcattttttttttacaacccaaagtctaatagttgtataatatatagcggtataagcataatttcataaagtcatagataaataaaattgaccataaattgaatgtgcttagcatatgaaagtactaaactactaattgacaaaacatatcaaatttataga

SEQ ID NO: 4726 - DNA, 1501 bp, Oryza sativa
tcactaacctttttcgagatctgatttgttcctgacgagttcacatctttgatcccaagacaaaattaatgttcgaaataaaaattatctatcatgtgttgatgcaccaaaagttgggaggatacaactaatacctgtgcatgcatgccatcccctccccaccttaggatgcaaacaaaaaatactgcaaaaaaaaaatgaaatttagtacgtaattttgggattgattgttgtatttattcctacagctataatatttgtcacgagaggcagttgtcacgttggcttaacgattctcgtatttacctttatgcaaatctcaaaacgacttccttttttggctggctagagagagtacaagaataaccaaccaataagcggcaatagacatcaagatgaacgagacacattgtgaataagtaacaaaacatacacacatatcacatatatacacaagttgggtgttcatcgtcttcggttctgcaacagatgccagctacatggatgatactcctaaaggaaacgcccttactttacagcaacaagaagcggatatttatttgcaagataatcttgactatttacacaatacattattcagttatctgaatatcatctaatacggctttgtttattgcattgttgaggataacacatcgacaatacacaaagatttttattgagattcggaaagcttatttactcctgcttcttcacaacaagaactgggcacttcgaatgatgcatacagtaattgctgacacttccaagaaacaacctgcagcagcaataggcaacagttagataatccacgatgagttttatgtataaattggaaattaattcatgcaacaagcaattgatttatgctatatccttgtcttcgataatgctatatctggaatcaggagagctttatataagtaactgaatagttgtctgatgtaatcagagttattcttttacttgataaaactgttgttcaagaaaagatagttgaatgcaaagagttggtatcaatgtcattgtagaaatgcagaatgtccgatatgtattaggcctttggaatttataaggaacataacaaaacagaagctgttgagttgagaaaaacaaaagaaaggaatggaactgaaaagaagggcaatcactacatctgcgtcactcaatgataaaattattagaagtaatattttatcttcacctgtaaaatatattactcttatctttataatgtacagagtacaataaacttaatgattatgagcagtttataaagagcaccaccaaaacatgttcagttgacaacgattaatcccataggtgaaactgaggcttttctttgctgaagctaatggaggttttctgccagtccatctagtcttgctcactaaaataccatattattaggatctacacaaaaaatattatttatcttcacccataaaaaatattactcttgtttttatattgtgctcctcagtaaaaccatgattgcaag

SEQ ID NO: 4727 - DNA, 1501 bp, Oryza sativa
tagagtaacttctttatagaaagttttcatgcaaaatataccgtttagcaagcagtttgaaatcgtgctataaatatctacattttcatccaacctttttttgagaaaagaacggttacttaattgggcttgccatcctcccaccctccttctctcctcgtcgtttccggcccattaacccccaatagagagaaaaaaacccaaaaccaaaaaaccctaactcttctccccatcgatctcctctctgagctctctccgacagccgccgccaggcgaggacgcgccggcgcccgtcgcccatcgcgccgtagccgacctcatcacctctccggcgccccgcggcctgcgccgtcgccccgtctcgccgtcgcacccgcaccgccccggcgccccgcgagcccgcgacgccgcccgggcctggcgagtggcgtcggcgcgctgccgtcctgttcgtccaccgaccattcaccaccgcacttttcctgtcccgagagccgagaggccgaaggtaactctgcctaaatcctaatgcctactgttagatggtagtgctaagtgctgtgaatttaggatttaggaacttttttaccatttgaatccaggggatggttcatggttgatttattgcatatatttgaacaattgaactttagtaatttaattagtagtttcatggttcatggttcatggtttcttatcattttgccattttccatcctctataaatttgatatgttttgtcaattagtagtttagtactttcatatgctaagcacattcaatttatggtcaattttatttatctatgactttatgaaattatgcttataccgctatatattatacaactattagactttgggttgtaaaaaaaaaatgatctcttcccattgcgaataaccaagttcaatcctgggccggtgggcccacccccatggccccctgagtcctgatgattacaagcgtttatattgctttgtcagattaaccgccgcaactccgcatgttctccttgtgttgctgtttcaatgcttagtcatcttcattgtttcttgctctgtggcacattaagggagtaggaatgtaaaattgtctcttgtgcagttgattcagtgcagtttgtttgggcaacttttatgttctcgttagctatcttacttgctgcagcctgcaagtatataacatatctatgttttttgaggaacatgttagtttattactacttttctgtgttattaaaaggaacctgtgttattgcagaaaactcgagggttaaagtgttctcttacctgttcctttttgtgatatttttagagtttaatttaaaaatatatgtatatatttagcattcttataattgacaataccacctgtcttgaaaaaaaaatcaccctttcactatgaaagacacaaaagataaaatgatttacacatggtgattcatgcagcttaggtggtgcaatggctttaagttcatccattagcatgtctcggcgtcttt

SEQ ID NO: 4728 - DNA, 1501 bp, Oryza sativa
gcctcagctcagcgcaacttcaagcgggcgacccaaaaagccaatttccttaaacaaactgctaaccacatttagttaacgttgattgactccatcaacagataagcacgagaggaggcgcgagagagggagaggaaaaaaaaagcaaataaagtgggtacaggcacgggtgcaacagccaaaaactatggagagcagcaaaggaggagaagaaaaaacaaacgtgggtttcttgggggtggatgactaggaaactgagagggggaggagagtggggggacctggcgggaggcgggatccggaaacccgcccacggtattgggcgcgcgcgcccacagaggcagcggaaacaggggccgtcgctgtacgatttccacaaaaccgggagccagagccaccccaccccctcccctttccagtttccgcggtatatgtggtggtgtggcgccgcggtctgtggctagcttgcctgttcgctgggccccaacggggacgtggacgccacgcgctgcgctgtgctgccccgcgcggcccgcctcctcctcctcgcctctcgggcacgcaccactgaccaccctcctttccctgcgccgtggggtccactgccccccggagtcttggatctgttcgctctcttcacgccaactgtcagaggacagaggttaatcataaacacaactgcacagtaactagtactactagccacgatttttaccgtgcttttaaagatttattttttacagagtagaatgattggagaagggaggaaaaaagtggagccggagtactagtttctttgcagaatcctttttttttgcgggggttctttgcagaatctgagtcatcgccacgtcaaacaacctgcggtttactgtaaaatcaacggacggccgggccgttgtttcctttctggaatgaaagcagccctggaagatggtagtagtaggagtagtaaataaactggagtagtatacgtagtactaccaacacgtaatagtagcaaaagtgtgtactgctgctagtgtactccaggacgacgcgcgcgggggtagtggtagtagcggcacgcgagcaacagggaaaaagatagcacgcggttccaccgaaatctcccggccggggcgcctccagttttggagctagaatccattcctcggacgcggcttggcgctcaagcccgcagttaaaccacgcggtgggccccgccccttgattcgcctcgttttttcttttccctttttttttctggtgcggcgccgaacccggccttccgaaaccactggcgccgaacccacttataaaacaggcacccctctctctcctccgctccccgtcattctcacaccaaacatctccatctcaactcatctccaacaagcaaggcagtatcgagtcgagtcctcgcacaggcttggagaagaagaaggaagaatagtaccacctcggatctccaacaagtccggcgcccagttgataagggtttgcagaagcatttcgaaga

SEQ ID NO: 4729 - DNA, 1501 bp, Oryza sativa
aacaccctattacgacaccctatataatatccgatgtgacacggtaaaactttacacccctgaatctaaacaccctctaagtaaaattgttgtgatttatgaatggggccaatccacaatgcaagttggtgtggtaatatttactgcaagttaattgatcagcatatcaaatacgaagtagtagaatgtaaaatccggaggaagcagaggcggagcagataagcacgatgatcaggaggaagaaagaagtagcagaatgcatgcaacgataggagcgtagtgatgtgcatacaaatgatgaggaagatcttgaggccggaagcagccgggacgtccctgacggcgagcggcaggacgaccagggaagggacgtagaagaggggcagccacctctggatgaagagggtggccggctcgaagaagtccatgaaccccttggcgagcgcgggcgcgaaggcgtcgaggacgacgaggacggagaagacgcagaacatgccgaagagggcgctggggaacttgatggacgccgccgcgaacgcctgcttcaggaacttgtcggaggccagcacgatccccagcgacaccagcaggtgcgcgatcccgacgagctataaaatccatacatagctcacgcatgtcagttcgatcggcaggtcatgcgaaatcgcgacgaggctgcgtgcattttgactgattgacgactcacgctgggtaggcccgagggagaggtggcgcccgcgcctcctcctcctcctccggcggcggcggcggcgtggatcggggcgatgaggcggtggcgaggattggcgggagccatggagattgccgccgcttggcgggaggaggaggaggaggaggaggggttgcgtcggcatcggcggggaggaagcgtgcggaggcggggcggcgacgtggcggtggcggagggcgaaaggcggcagcgatggctgctgcgtagcgaggcaatcatgcagggggaggatgatgatgaggtcgctgccatctcttctcttctcttctcttcttctccttctcctttggccagcgagagagcagtggcagtgacagtggatgagaagggagctgggagcagtggcagaggccaggtggaagagaggagggcggcagagggatgcaagtgtggccagaaaattgggatgatttggggattgggattgttgggctaccacgcgccagcatatcgtcgttgcttttaggcgtgggtattcgattcggtttacactagtatggtctatgtttggtaaaactttaacattgaagaaaagtaaactgaaattatgattggaaaaaatctatctatctatctatctattaaattaaattattaaaacagccttaaaattaaaggagacaccgtatttattgtgcaggctaaaaattcccacattaatcgaagaaaaagaaaaatatctaaaccattggatcataatagatctagattttagcggtaagatttaatcagagtttcgcaaagtatata

SEQ ID NO: 4730 - DNA, 1501 bp, Oryza sativa; identical to SEQ ID NO: 4718

SEQ ID NO: 4731 - DNA, 1501 bp, Oryza sativa
gtgtggttgtgacttgccgctgcgccgcacgcgctacataaagctttggcgagctcgccgcttcggcttcaacggtgcagcttgccaacctaaaccgataatatcgctcgctcgctcgatccatggcgggcgtggtgcagaccgtgcagtgcgaccagccgagcaagcagcagctgacggaggcggcggaggcagcggctgcggctgcggcggcggcgtcgctgaggatatttgggtacgaggtggggggtggtggtggaggaggaggcgtggcggcggcggcgggtgcaaggcgggaggcggcggacgtggtcgtcggggcggggaggaggttcgagtgccagtactgttgccgcgagttcgccaactcgcaggcgctgggcgggcaccagaacgcgcacaagaaggagcggcagcagctgaagcgggcgcgtctgcagctcgccgtcgccgccgcggggacgccggcgggcatgggcttcgcggcggcacaggcgccggcgccgccgccggggcacgtgatcgccgtagggcatcacgcggggtcggttgcctcctacgcgctgcccaggtgggtctacctcgcggcgcaccacctgcagcccccggcggtgggcctgccgttccacgccaccgttcaggcagcagccggcgcgtgccacggcggcggcgacgtcgagacgcggttgctcagcgtcgccgccgctgggcggggcagcagcactgcaggcagcagcgctcactcgtacgaggtgtgtgctcctgcggctccggcggatgacagcgacgaggaagcctcggcgatggggttggacctccatctcagcctagctccggcgagctcggcatgaccggccggtggccgggagtagtaactttatttggtgcaccgcggccgacttaacatgtaactattctcgtgtgtatccccttcattttcttcccatttttttagggcaaaccctgttattttcgttgtttgcacatctcgcaaaaatgcaagagctcgagatatatacagtacatgcttgatcaatcatcaagctaatatacctatgtatactcacacagttgcccccactgcatttggtgtaattatcgctaatttataattctctcttatcaagtcacaccatcttatgccttattcgatttagagcagattgaagaggattgaggggaaatatttccacaccaaaatatgtgtggaataaatcccctccaatccctcccacatggggactaaccgaacaaagccttaattatttgttagtcattcgatgatcaatgtaagacgtggattatttacctctcttcaccatcgtcaatattagtaggggtgaaaacaggtcgagtttggttggatcttacccttcctgtatcctaacccgtattttataattgaaattgggtcaatcacggatagtgctgaatatagatataaactcggataatatcggtcacaaatataggacgaatatatgccaaaacagatacgtac

SEQ ID NO: 4732 - DNA, 1501 bp, Oryza sativa
aaaatccatccaacagttatgaaaaattcttaaaagaaaaattgacaacactcatacaacatatacaactccacaagatcttaggtccaaactcaactcacatattgagatataaaaaagacaaattcagcatatgaatagcaacgtactgtttacatatgaatctatctttttgtttttcaatgtgtagggcgagtttgaacttaatttttggtggaccagtagataatacgatactcttcaatgtcatttttagaatttttcacaaccatttgtatcgaatatggaaggaaaaggtacatgaggggacatccccacaggagattagaatccactcctgggaaaatggatttttgagacaacattttctttaaaaaaaacataaagcacatagtttcgataattcgatgaataatctaaaaataacaagggctaaaaaattgctctcccccctccccaagataatatttttttttcgaggggacaaacagggagctcctgcaatttcactatagaagaagagagttgattcagtttgtaaggaaaaccggacctaaaaatcttacaacggcacggtttattaaaggaaaaccggcaaaaacctcgacattgacaaactgaacctaagtacaaccgtccaacaagaggaaagctcctaaaacgaagccttcaagaaggttacgccgacagaacagcgacatcatccgatcctaatgaatctaggttttcacccggagaaatctcttgaagtggagttgaatgagggctccagtagcaacgccttcaagaaggtgaacggcgcccaagggcgtcgccgttgctagcaccgagagcggagcaaggctttcgccttggagcacccatcaaccatagcatctacgacgggagccaccaaatgttacctgcacaccgagggtacctgcaatattcccatccccacccgaggacgcgccggatctgggcaagagagccagatccggccgttctcctcaccaccaatgccagccgacgccaaaggagtgccggagaacgccagtggcagccgcgggatgcctgcgtgcgctgcccaccgccggccgccacgccgccgccggatctgtggcctccaccaccgccgctccatcgccatcgccattcccgccggccatcacccacaactccacccagcgcaactcacctcgaccgcctccatcacccgtccccaccgccaccgtccttgcggccgcgcggctttgccggcggtgtggagattgtgggtacccaatacccacacggcatggttatccgactagttataggggataacttatatctatagaatatgtaacagatcatgacttgggtattatgtttccttgtatattacggaacggcctaaagtcctggtttgataatattgtaaagtagatttaggaaaccgataccgtattggttaaggtttctatcttgtaattctgccccccaccctatataaggtgggcatgaggccctctagggggca

SEQ ID NO: 4733 - DNA, 1501 bp, Oryza sativa
gcagctcgccgtcgccgccgcggggacgccggcgggcatgggcttcgcggcggcacaggcgccggcgccgccgccggggcacgtgatcgccgtagggcatcacgcggggtcggttgcctcctacgcgctgcccaggtgggtctacctcgcggcgcaccacctgcagcccccggcggtgggcctgccgttccacgccaccgttcaggcagcagccggcgcgtgccacggcggcggcgacgtcgagacgcggttgctcagcgtcgccgccgctgggcggggcagcagcactgcaggcagcagcgctcactcgtacgaggtgtgtgctcctgcggctccggcggatgacagcgacgaggaagcctcggcgatggggttggacctccatctcagcctagctccggcgagctcggcatgaccggccggtggccgggagtagtaactttatttggtgcaccgcggccgacttaacatgtaactattctcgtgtgtatccccttcattttcttcccatttttttagggcaaaccctgttattttcgttgtttgcacatctcgcaaaaatgcaagagctcgagatatatacagtacatgcttgatcaatcatcaagctaatatacctatgtatactcacacagttgcccccactgcatttggtgtaattatcgctaatttataattctctcttatcaagtcacaccatcttatgccttattcgatttagagcagattgaagaggattgaggggaaatatttccacaccaaaatatgtgtggaataaatcccctccaatccctcccacatggggactaaccgaacaaagccttaattatttgttagtcattcgatgatcaatgtaagacgtggattatttacctctcttcaccatcgtcaatattagtaggggtgaaaacaggtcgagtttggttggatcttacccttcctgtatcctaacccgtattttataattgaaattgggtcaatcacggatagtgctgaatatagatataaactcggataatatcggtcacaaatataggacgaatatatgccaaaacagatacgtacactataagttaaaaaacaactagttaacgtatatggtcaaaattgtttttttttcgttgtgagatgtagaagttaaatttaaacttgcatgtttgcggagtaatatatcatatgttaatatattttctcaaatttttttcataaccatttaagtgatatacagacaatgaggggatatcccctcgaaggataaaaatctactcccactattgttgtctgtatttgctcacaagctaaacgtgctagctcgagttaacaaacaatctaacaagaatagattaacccaagcaaacacaaattactagagggatggagaagaagtactgcagagggacagtgacactacagcgtcacaccgatcaacacacgacggcgagaaacaagcgactgaggtcaagctgaaatactggcgacgtttcatcggaagtggattttc

SEQ ID NO: 4734 - DNA, 1501 bp, Oryza sativa
aagcttcaacctggaaagatcttctctggctagccggagatcataatcagtgagggccaacttttcttctgccgctattttctcttccagcaagctctgtggatcagcacctgtcaataaaaacatagagataatcacctcacagactcaatgacagatgttagaacattagattgaacacaaacaccgcatctagtgtacatggataagcttgcacaaaaaagtgagtagattgttgagttataccaagaacagacccaaacatttacctgtaatttatttgttctgatagcattgcttggcccataatccatatgctactcaattttaatgatattattaagtagttgcaaacggtgacataaacaatgaaactgccacgccttgtgtggtctaagtaaatttaattgtactgttcaaattaataatgccccttcaactgcgaagtaactaaccaaccaaatcgtctgtagaatgtaagtcgagcaccaaggcacatacacctaacataccaacaacaagatgaattcaacagcgccaattcggacgtaatgcagggatattatgaacataatggcaacacaggaagcagggagcgccactacgccgcgagatccagccagctgaggaaaagggttgggggggaagggggggtgcaaatgcgggggacgcaggggctcaccgggcggcgcggaggacgcgcgggcgacgaggtcgggcgggaacagcgcggggtcggagaagaaggagcggaggcggagcgcgtgcgcgtggcggccgtcctcctgcagctcctgcaacagctcgagcgccgtgaggtggtacctctcctccagcaggaagttcaccacgcagttgcacagcgacgcccaccgctcctcccccgcccccgcccccgtcgcctccatcacctcgggatctggtggtggtggcggtcgccggcgccccacccggtcaatcagccgccggcgacgaggcgcgctcccgccgcatgcggtggtcggtggatctcgagagaggccggtgggtcgggtcggaaactcggacgagacgagagaggcgaaggcgtgtgatttttggaagggaagagaggaggaagaaagaggaggagatcgacggagaggatcgaggcgcgcgctgacgtcagctcggctacagaccgctggtgtgtctgatgtggacacgttgcaaatttcaaatgggccgaaatgacgaaggcccatcaggtgccggcccatataaagcccggcccttccttccacctgctagtaatctcacgaacccttgcgccgtcggtctctctctctcgctctcgtccccgccgcggcgccgccctgctctccccctagggtttgatttgatcccatcctactctctcgtggtccgcggccggattgtgcgagctccgatcggagtgtgtcttaccggtggtttcttgtgtagtgccgctgcgatttcggagggccggtagtccggcggcaaggaaggaggcggggcgcga

SEQ ID NO: 4735 - DNA, 1501 bp, Oryza sativa
ttattttctctggataagtctatattccctcttttcctctcctcctccgccccccaccccccttctctgtcgcacacacagatcattgatgcatacgtggtaaccaacggtgaaattcatcggtacgcggcgccgggaccggcatcgtctccatcgaacagttctgcatggatgagctttcgtcccaacataatgcctcgtgtagccgatacgacacgtgtagttagttgcagtatcgccgagttggatcgctgcggtagcgccaaattcgcatgggccgacttgatccattccagaagcgaaccttggtgggcccactctggtcgcgcaatatggagagacgtgcacctcgcgtccaaaagtaataaggtcacttcagatccctcaatttgtcggcaagtttacccttgaaccgccagtccagatatagtgcgtccccgaagtttcaaaaccatatcaacttacgtcccaaggcagtatagctcccgtttgatccgacgtggtgctttgactacggtcaattttgttgagtcagtgtgggaccctgcgaagtcgacgaaggagcggaagtaggccatgagcccatgactgaataacaaaattttgtgaaatgagactgacagggtgcagtatgatgcttatgcaccactgcaccagcttctcaatgttacacaaagatgcaaatataaaccaaacgtacagaataacagaactcaatatctcatcatcatcatcatcaacaacaaagtagtagtcaatgaaccgagtattccatcctgaaccttcctgtgactgatgtgaaaaacaaaaccaaaggagcacatcaagtatagctgacaactcaaacttctgaatatacaaggactgggaatgcagatgtttaagcgtcgaatacttctgaaacttggcaattcagacagataaggtaacagagaacatgttgcatagtcgtaaaaatggacatcattcctcaaattcagcttcggtcatcaaactgaccattttaaaatgccaatctagcagacagcaagcgatatgccttgtgttccctagtttttaccaagcaatccttgttctgagagggcattccattactccagtggcttgaatttcttccctccataggagttcatttgaaaagatgggacatactctttacaagcaccgattcatggagagctaatgatgatgtcccctttagcactaactacaattgctaggaggtaataaatttccaaaccagaaggatgattcagaaacatttggaagttatgaattgttttgcaaaaaaaaaaaaaaaagaaagagaacaagttataacgtgttgcgtgatcactcaaactaacactatattttactttgtaggaacatcacctcattctgtttcttaagagaagtccattgctaacatagctcaaattaagcttgtatttatacttaagttgttacagtttgcacctatttatatcaccaagtatgcttgatcacaaacccccacaac

SEQ ID NO: 4736 - DNA, 1501 bp, Oryza sativa
ggggcggcggctaatggccacaggaatacgcacgcgagtaggagatcaagatcgcggcgggtggcgggtcggggcgtatagtttaaaggcgtgggtcgtggcgaggagcgccccacgtcgcgccgcgccggagccccggagcgccagcgccgcaagggattttttttttgccctctcttcacattctcatttgtgtgcgggttcgccgagcccgcgtcgcggctgcagctaggggagggtggctacgacggctgttcatggagattaactgcagcttgattttactggtatggttaatttggcgtgaggcgttgagcagcctttatcatttcctcgcttgaaagatatcagctgcggagtattgtgaaaatcatttccttgcttaaaaaaattggtacagtacattgttgtgcagtaactttagcaaagctgtatcttgaattatggcacattgggcgttgaaaagggacacgtttgaggcccgtttgaactgattgttttatgaattatttccatattcaattatgattatgtactcaacaataagaataaattaatcattgtaagaagataattttaatgagtacagcttagaacaaagagtagatgtcagtatgtcacacaaccctatgtattttggtttaagttgcagaaagctttatgatatgtcatatataaccacagatattatgacctatagtctcataaacccacactgctaaccctttttatctactataaatatgatttctaaacttataaccaaaattaaatttataagttcgtttaatccgtcgtctaaatgttatcatcctcattatcactctgtgcattctaaaatataaacatttctgcacatatcctaaaatgcttatattttaaaatggagagaataaattaaaatagtcagtagtgcaattttatgaaacctgaagaccataatacctaggttatgcaccgcatatcaaaaccaccatggttttatgcaactcgaaaataaaataaccagggttctaaaatatactccttatggtagaagaagtttcttttgtcgagcaaatatatttttagagttgtggaatgaataatttgcgaaataattgcaaagtagctgaacgggctcgaatttaaacttttgtccttgctaaaaatttaactttgcctagtttgttttttgtttaagaaaaaacatttatcaacaaacacacggtaagtaacattctgcattctgccactgcgttaattcatcttgggtgaacatcatatttacccaacccacccgggttaggtttcttgtggtggaaccagtccacccgggttcaaattctagacttgacacgggtgctcgcatttatggctaattattctttcaatggtaggcgacgtacccgtcgacagcgaaacgcctgtggtgacttcgtcaatctcaagatatgccggcccagtcttccggaggtgctcataggggtagggtgtgcgtgtgtgcgttcataggggtgag

SEQ ID NO: 4737 - DNA, 1501 bp, Oryza sativa
gcagctcggtccggaggcgcgactccctctcctgcagctcctcgacgagccgcaccagctccccgacctccggcgccgcgccgcgcgccggctgcacctgcgccgacgaacgcgggaagtacgccccgaacgaccgcgcgaagacgcccgtcttggaccccgacgccgacgccgaggccgacgcgggcgagccggacgacctccgccgcggcgtctccggctgccccgccgccgcatggtgcgccgccgcctgcaccagcggcggcggcggaggcggcgccttgcgcgaggacgacgtcttgggcgtcgcagggctacgctggaaccccatggccgccttgacacgcccggccaccattgcctctgaagaacaccactaggatcgcgcggcggacatggacatgggtaggcgttttgggtttaaagagaggtggggagttgggcgcggtttccgaggaacggtcttgggtttggtccgagcagtgaaggttggatactgtaggtgtactcctcgtcagctcagctcgagctcatatgaggtggaatctgaacgttggaggagatgagatggattaaaactgcatctgcttctttgcacgatccgaatctggaagcccccccctcttgaccttttttgctttgctgctgctttgctctgttcatctagcagcgcagccaagattaattttatcactgatctaaacagattagggcgtggcactactgctttggtgccactgccaccattcagggtgaaaaaaaaggatagagcctctcccacgcatcagatttgaaatggacggtccggattggattcttccaaccacgtttgatccgtgtttgccgctgatccgtatgtaagctttgtctgcatctccttgcccctgtccattaaacaagaagacgccggagcctcgtcattacggccggggttattactcatgctacatgcatcatcaacagtcaaacactccagaatccagatgctcctgatgccataattcacctggaatttgaccaaacgatgctgtttcgatccaaccccgcattgccgttgcaatttctgggccatgcgaaacgatgcacacacatggctgcacgctgcatgcacagtgtctactactccctccgtcccataatataagggattttgagtttttgtttgcaatgtttgatcacttattttattcaaaaaaaaattgaaattattatttattttatttatgacttactttattatttacagtactttaaacataactttttattttttatattttaaaaaataatttgaataagacgagtggtcaaacgttataaccaaaaactcataattccatatattgtgggacggagggattactccatatctgatcaaatccaagcgagagtgtcatgcttaattaccttttgccattttcatgtactaatcggagtagtcgtagtacattggtactgccttacatgcccgtatattgctcgtagcaccagaatagtactg

SEQ ID NO: 4738 - DNA, 1501 bp, Oryza sativa
aaagaccaacttcaacgatgtgtcgatgtttgcgttcagctgagccattttgttgatgggtgtgtggacatgaaacatggtgtgtgatgcctattttattaaagaaggtattcaatttttgatactcgcctccccagtcggtttgcatggatatgatttttctattaaacatacgctcaacaaggcactgaaactcttgaaacttctgaaaaacttcagacttatacttgagaaaatagatccacgtaaacctactgaaagcatcaataaaacttacatagtacttctttccacccccagcaacaggagcgggaccccaaacatctgaataaatcaactcaagaggattgctaaaaacgctagacgacttgggaaagggtagctgatggcttttccctttttgacaagaatcacaaactaacaatttattggactctgctgaaactggtagatcatgattatggactactttctctactatagcataggagggatgaccaaagcggcaatgtcatcgctcaagggacggtgtggtggctgctagtgcttccttgtcttgttgagtcgaaagcgatgaagatggaagcgggaacagccggccatgacagcgtcctctaagaagcatctccttcatggcctgatctttgagagaaaaatgtttagggtacagttcaaagtaggctgcattgtcaaccataagacaataggctgaaatcaagtttttactagcattgggaacatatagaatgtttttcaagtgaagggaacgtgttggggtgttaacaactgaatgacctatgtgagtgattaccatacctgcgccgtttgcagtttgcacttggtcctggcccttgtatttgtcccggatggtcaacttctcaagttccccggtgacatggtccgtagtgccggtgtctacataccaatttgaatctactccataggatgctgttgtgcctgcatatttctcatcaggaacaaaatcctcatcatacctgtaccagcaatcaatcacggtgtgcccccttttgtaacaaagttggcacttggggcgataatcaacgccattgcctccttgtcgctggttggagttgttgccgcgtcctctgccgcggctgtttcctccatggccgcgttgctgctgctgcggctgcttattgttgcggccccttcctggattgccgcggccacgccctctgttggcgagattggccgagtgttcctggcgcatcttcatgcgctgctcaaagctgagcagctgtgagtaagcctctcctaggcttacatgctcagatttggacactagggaggagatgatgggctcgaaatcttcatctaatcccgcaattatatacgagatcaggtcttcttcatcaacgggcttgccggaagtcgccagctcgtcggccaacaccctcatcttgctgacatattcagcaatgccgaggtcgcccttcttcgtgttcgtcagtgcgatcttggtgttgatggagcgcgccct

SEQ ID NO: 4739 - DNA, 1501 bp, Oryza sativa
acttctttccacccccagcaacaggagcgggaccccaaacatctgaataaatcaactcaagaggattgctaaaaacgctagacgacttgggaaagggtagctgatggcttttccctttttgacaagaatcacaaactaacaatttattggactctgctgaaactggtagatcatgattatggactactttctctactatagcataggagggatgaccaaagcggcaatgtcatcgctcaagggacggtgtggtggctgctagtgcttccttgtcttgttgagtcgaaagcgatgaagatggaagcgggaacagccggccatgacagcgtcctctaagaagcatctccttcatggcctgatctttgagagaaaaatgtttagggtacagttcaaagtaggctgcattgtcaaccataagacaataggctgaaatcaagtttttactagcattgggaacatatagaatgtttttcaagtgaagggaacgtgttggggtgttaacaactgaatgacctatgtgagtgattaccatacctgcgccgtttgcagtttgcacttggtcctggcccttgtatttgtcccggatggtcaacttctcaagttccccggtgacatggtccgtagtgccggtgtctacataccaatttgaatctactccataggatgctgttgtgcctgcatatttctcatcaggaacaaaatcctcatcatacctgtaccagcaatcaatcacggtgtgcccccttttgtaacaaagttggcacttggggcgataatcaacgccattgcctccttgtcgctggttggagttgttgccgcgtcctctgccgcggctgtttcctccatggccgcgttgctgctgctgcggctgcttattgttgcggccccttcctggattgccgcggccacgccctctgttggcgagattggccgagtgttcctggcgcatcttcatgcgctgctcaaagctgagcagctgtgagtaagcctctcctaggcttacatgctcagatttggacactagggaggagatgatgggctcgaaatcttcatctaatcccgcaattatatacgagatcaggtcttcttcatcaacgggcttgccggaagtcgccagctcgtcggccaacaccctcatcttgctgacatattcagcaatgccgaggtcgcccttcttcgtgttcgtcagtgcgatcttggtgttgatggagcgcgcccttgtggccgaagagaacatcccttcaatcgtgctccagagagatgcagcactgctgcatgtagccacctgggagagaacatctctactcatagtggttagcagataacctagtacctgctgatcattggcgatccattcatcgaccgccgggttggagacctcaacctccttctcatttttcttgatgatgatggtcgccgacggcttctttgtggcgccggtgaggtagctgtcgaggcgtgctcctcggatgacggcgagaacctgaaccttccagatcag

SEQ ID NO: 4740 - DNA, 1501 bp, Oryza sativa
catatttctcatcaggaacaaaatcctcatcatacctgtaccagcaatcaatcacggtgtgcccccttttgtaacaaagttggcacttggggcgataatcaacgccattgcctccttgtcgctggttggagttgttgccgcgtcctctgccgcggctgtttcctccatggccgcgttgctgctgctgcggctgcttattgttgcggccccttcctggattgccgcggccacgccctctgttggcgagattggccgagtgttcctggcgcatcttcatgcgctgctcaaagctgagcagctgtgagtaagcctctcctaggcttacatgctcagatttggacactagggaggagatgatgggctcgaaatcttcatctaatcccgcaattatatacgagatcaggtcttcttcatcaacgggcttgccggaagtcgccagctcgtcggccaacaccctcatcttgctgacatattcagcaatgccgaggtcgcccttcttcgtgttcgtcagtgcgatcttggtgttgatggagcgcgcccttgtggccgaagagaacatcccttcaatcgtgctccagagagatgcagcactgctgcatgtagccacctgggagagaacatctctactcatagtggttagcagataacctagtacctgctgatcattggcgatccattcatcgaccgccgggttggagacctcaacctccttctcatttttcttgatgatgatggtcgccgacggcttctttgtggcgccggtgaggtagctgtcgaggcgtgctcctcggatgacggcgagaacctgaaccttccagatcaggtagtttcccttgctcaacttctccgtgaccgtgattcctccgagggaacctgaggccgaagactgggacgaacttgccattgatagattggattgaaaggagtttgtggtgctctgataccatgaaaggaaacagaggtgcaagaagcggtgtcgtcaccgatcttggtgcgcccgcgtatatttatatggttgccaatagccggcaacatggctttacaggatcataacaaccttggctaatatctctctaactaatcctgattacaatcattatctatcagctaagataagatcgatacggccaggttgttatgcttacacatgattatatctaataggagtgattcttgagattaaacatgtagttttgagctgttttcattccttctctgttagctactcgccccgaagttgtaataaggtggcgcatgagcttgccgcgtatggctgtaatctccagaccgtgtcttcctgggcaggctgccctcctagtctgtaacggctagtatccagcgattctgctggtttggtaatataaatatctcggtttctcaaaaaaaaaagagacctggtcgttgagacccatttaatatgcacgtagatcggtcaagctagggcacttgcactagtgggaacacggaatagcgcatgtttgacgtggagcggcatgtgcga

SEQ ID NO: 4741 - DNA, 1501 bp, Oryza sativa
cagagccttattcgtttttgcggactcccagagtccagctgcccagcagcaaagcaatccgcttccactcgggaagcctagtctatgatgcccgtagacatcccgaatcacacagattcgtttctgaccactcaggtcatccatctaccacataggctgattctggttacgattcccacaccacaacaacttttcacaaagcacaggcaaacaaatctacgcaacgggaaccacctcacatccgcccatgaccgtgggtacggctattcgaacagttagttaacctctgcagaggggtacactttacccacaagacacgaacttactccagacactggccggtgttagaggttcgcgacaaagccttttccaagccaactcagggttacctcatgccacatagaaggatcaaatcctcacataaatataggccattttagttttcacaaatcaaactccaaccacctcgatcggtaattcagcaagcttctcttccttgcttaccaggaacctggtttggctccaaccaaccccgccccggcgttcccaactattggcatgcgaggtttccctgaaccgactagttacttagccatggtgtctcattccaccttgtggttgcactttgattatgctcgatgagtttcccataggaatcggtcctaatatgtgaatacgggacagttccacataggcacaacccccgcatcgcgagttttcacaattcattttatttttaaacacatctacaccacatgttgggttttcaaggctttacaaacccatttcccaagttttcgacaaacaacggtgtatgtgggatatttggtatacgcgctcagagagcacggataccgaggtaccacaaaggtggagtgacaaggagtcagggtagtacagcctacaggaattagtgcgactactgggtaggtccgtcggtttagcgcgcaaaccgaggccaagcaagttaagtgtgtgattctaacaatgcaagttgcaaacaaaataataatgattttccaattataggagcaattggtcaaagggtgacttgcctagctcaaggtcttcacggagcttcacgaatcttcgagaaaacccgcgatcgacgaaaatccggtaaccgcaactatacgcaaacaatcaaaaacctaaacaaaagaccaaaagaaagatcctatttagactaaataatagtgccattaaatagatctcaattttacggaaatactggaagtggaacgaagtcaatcgaatgaacggatcgagagatatgaattttggaatcttaactggaatttctggacaaggaaatgatttattggatttttctagaacacgagaaatggtttatggaataatattctcaagaatattattgatggtcactgatgtgcgggaccaaaggaaatgattcatggaatttttggaataaggaattgatttatgaaaaagggaaaaggatttagtaatccctttggataagaaaaggaaggaggga

SEQ ID NO: 4742 - DNA, 1501 bp, Oryza sativa
gtcaagctacgtggtgccatgtcagatgaaatcaccagaaaaaaaagttacagggaggaaaaacaaaccgatatcatatcagcagttgagggagtcttcttattttggaataagttcactttggatccatttatttgtcgcctagtccgattttcatcccctgttcgcaaaactaggtacgatgggtccccaacttaacgaaaccatttaaataaggtccttttgaccaggtcttcgtccaacatgtcgttgacgtgacgcttatgtggcaattagatcggaaaaaataataaaacacgtgggacccacatatcagtttcacacgcaaataataaaaaaatgggtgggcccatgtgggcccacacgtcatcctcaccaccatcttctctctatctcccctctctctatcctctctatccatctctctctccaacgacggagcggagtgggcggcggccggagtgggcgacggcagggcggagcggcggcagagcagaggggcagaggcagagaggggcggagacgaggggtgaagcggcgcgttgtgggcggagcggccggccgacgggggagaagtcgcagcgcggcggtggccggagggccgcggggcgccgaccgttgggagcagaggagccgcccgtggcctgtggccgtctgcgggtgcgtgccggcgtccaccttgatgttggtgttgccgttggcgacgaggccatcgaccagggtcttgaggtcggcctgcgcgtcgccggcgacgtaagcggagcggacagaggcgtcgcgctcgacttcgacctccatgagcttagagaagacgccaaccatggccgccgtgttgtacgtgcaggcctccgtctgtaggtacgcgccccggtggtcggtgaacacgtcgttgccgttgggcccgccgacgacggtgccgtcgaggtcgtgcgacttctccccccgccgcgctgtggaatgaaagcatactgctcggcaactactggactacctagtgaaatagctcttcaaatctacaaacaaaattacagaaaattacagacatgtgaatcaatgacaaattgttcattatacttttgcaaattgcaatgttttcacttgtcatttgtcaaatactcaacaaatgttacatttttatgatgccaaagcctttcctttcccctttctatccatttgtgctgaatcgggctagttgctttgctgccttgcccttgctgacttgttggtgttgctgcctgctcggcttagagctgggctgctgcacgcaggcgcacagccgtgcaggccaggtggcaccgcggcactaggagcgggcaagcaccgccgcgccggcctgcagtctgcagaggctcgccacctagcctggacgctgcacccacactgttcatggcttcactcaattcgacgcgattggggttttggaatggggaattttcgaccaacggccggcgttgtgggccgcgccaccgggggcggggagcagcggcggtggtgggcacga

SEQ ID NO: 4743 - DNA, 1501 bp, Oryza sativa
ttcctaatttatacttatgttgtttttatttctttttattcagatcaatgggcttacttccagacagtggcggacgcaagattaaaaataagatggagtgaaaatgttgtctttataaagacacctaaatgcaacaaataccatatttataccgtaatcgcataaagatatactcgaggcgaacaaaaccattttatgacaaagaaataatatttgcgtcatatataattaatcatacaccaaaagatgcagtaggacaagtaaataattaatatgcaagattgcaagtaactgcgcatgccttccatttttacagtaaataacatgcagtagaacagtgttaactaggagtaccaactatttccattatcctaaacagatgattaactaatctagacagcaacagatcatttgcaagaagaacaatcaaatttgctttgttacttgactacaataaaatggtccaaggaagaggatgatttgattaaaatggtccaactgctactactgcccctaccggcttaccactgaggttgctgactcgctagcgccaggcggctaggcgctagcttgcagcctgctagttgctgttgtgcccgtgctgcggagtgccggccaggccaaggagcgggtcggccggagcagacgtgaggcgacgatggtcgggctgacagcgacggcgttgcgttggcgccgagcaggaggaggctcgagaggcgaggaggagacgaggaggagagagctgctggccgccggctgcgagcggcatcgggccagtcatcggccgtcgctcggcgccgggcggcagctaggcgtcatcgtcgcgtgcgccggtggccggtgtggcagtgcgggacggcggtagcgagcaagtgcgagacggtgtgcggagtcgcggtccttgtgcgaagacgaagcgttggcgcaacgatgcggtagcgagaaagcaaaactgtggtatgggccggggtggggcggcgcgggccatagctgggccggccgtcgccccatgccgcctaatgggcacgtccgcccctgcttccagattattactatggctttgacaagctagtccaaattttcagcttctgatatacggaaccaaaacatggcaacttttagcatcaacctgtatcacgtatggaacggctttgagacgttgtacagaatatatcaaattccacaagattaggggtcgttttggattgaagccaaaacgtgaccctaccaaaattttgataactttaatagtaaacatgctagtttggattgaagccaaacaattggtagtgcccacgctcaatttggctacattctaaaatcttcttcactctcatactaaattttggctttatattggtattaaaccaaacatagattagctaactttgctctaccaagaaattggtagtgccaaaatttgcctagattttggtactaccaattaattggtagggtagagaaccaaataggccctagatgacttgccttctttgtgacc

SEQ ID NO: 4744 - DNA, 967 bp, Oryza sativa
catcctcttgccgccgctttggctgcaagcgccgagcgccagctcgcgccttaaccgtccaatgtcggttcccctctcccaaaccgacattgccgtccatttaagcccaagccctccccctccaaactccctcattttcgcctccgcgccattgctgccctctgtttcgccgtcgccgatcgtcgttgcgcgtgtcggaggagccggcacgagcaaggacgcggaagaggactccggccgcgccctcttcttcctcttccccggcccgaggccggagagattactcccgcgccgccggcctctcgtcacagcgcccctcctcttctcggtgatgtctctctccgttcttcctcctcgctccatctcctccccctagctttcggtagtagcttgagtagcctccccgtagttagccggcgccgccccgaccgttgccgtcgctcgccgtgtgttcgccgccgtcaccgctcgagctccgtagcacccgctcgtcgccggcctcgctcggcgtagttccgtccaatccgacgctagcgtcgagttcccgacgccgcgtagatgctctcaccgccgggaatcgacctctcgtgacctcgtcgccgtttccctcttctcccgccgccggttgccgccgccgcaatccgccgccgtcgagcaacctccggcgaatccgagccgttggctcgtctccccttgtcacgtgcaaccgcccggtgtgcacgcttttgcccgtatcaccgtggttcgctccgccgctcgccgccgtcgcccgccgtccattcgcggccgggtcgtcgtctacctcccgccggcccgcgtggcagccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcggaccgcgcg

SEQ ID NO: 4745 - DNA, 803 bp, Oryza sativa
ccaggcgacggtgagagacgacggcggcgtcggcgcggggttgccctagacagtggtggcgaaggagaagccgatgctcgatctcgatggaaaaacgtcgaagtgttggtggagaagacaagggcgcaccgggaatatatatacccccggatctttactcccggttgaaccgggagtaaagatatctttagatttttaatcccggttgttgttacgaaccgggagtaaagatatctttactcccggttgttctcaccaaccgggagtaaagatattttcccgctatttccaaattctgttttaaacccggttagggttaagaaccgggtctaaagataatagcactgatattgaatttcgttgcatatgttttctaaaatagtaaataatgcattaaaaattctaattaacatatgtaaatcccacatgcatgatttaaaacctttaaaaattctaataatcatatatcattagcatatgcatgatattaaattgttaaaaattctaattaacatatgtaaatcccacatgcatgatttaaaacttttaaaaattctaataatcatatataattagcacatgcatgatattaaattgttaaaaattgtaattaacatatgtaaatcccacatgcatgatttaaaacttttaaaaattctaataatcatatataattagcatatgcatgatattaaattgttaaaaattgtaattaacatatgtaaataccacatgcatgatttaaaacttttaaaaattctaataattatatatacctagcatatgcatgatttaaatttgtt

SEQ ID NO: 4746 - DNA, 1501 bp, Oryza sativa
agtgtgtgtatttatccaacgcggcttactcgcctgaaagtctaaaatagtgccaaattaaacgcgtaatgtatatattcctccaagagaaaaaaaactgtaagtcagtatgcccagggcaatgaacaccaatcaactaattagaaatacatttacatgtcttgattgagaccatatgcattgcattgcaattgatgtccctcttcttacacgtatgcgtataagaacagagattaataaagctctattttatacgttcggtagcttggcgaccaagtagcatatatatacctgtgtgaatctgtgataaataaaaccgtactccttggtcggatgtagcggaaaatatacggtggaaaccatatatgtggtggaaactatcgttgggtcgaaaaatggacgtttgtgataacgtggacgtatctcggacgtctatttctcgatccaacgttagttttcaagtttccaccaaatatatgatttccatcacatattttcccccggatataatatataaacgtatctatgtacggtggctatggtcggatgtagtatgttgcacgtactagctacacatcttggaccatacttagctactatactgtactttttgatctcttacgtactttcgtcagtgcctgactgacactactggaaaactaattttcgctgggtcaacccaaaatcacaatagtcccggttccaaaaaaaccgggactaaaaatgatctttagccccggttgaaaaccccatagccattctacgatctttagtcccggttggtgttaccaaagatgatctgtaatcctggttcattccctgtcagaggcatgtcaggggaccgaggatctttagtcccggttggtgccaccgaccgggactaaagatcaccactttagtccctttgatattaccaaccggaactaaaattctaatccctagcacttatcctctcctccacaatcgcgcaaccactttctcccacagatcgatcgatcctcccctctcctcctctcctccccttcctcttcccctctcctacacagatcttacccctcctccccttcttcctcccctctcctcccggtggtggcaggcaagcggccggcggcggcgggggctgcgcgctacggcggctggtaatgccgcgcccagcggtggcgggtaggcggttcttgcgataccatgttttaaaaatcaaatttaatttagttgtaattcgtattatagttttagtcacgagatactatatccatcttgtaaattctttacaatttcagtttaaataaatatatatatatatatatatatatatgaaatgtatttgggaatatattatgtgcacacaagtgtatcgacttttgagatcgcgactacggtatttgtatggtatggggaccgttggaaccaaggtatatgtgatgtgaccatcaaatatatgcatacacccaaacatgagaaatataaaacatggacaaagaatacatagagtgaacagagg

SEQ ID NO: 4747 - DNA, 1501 bp, Oryza sativa
gggtattttgctagtattatacaatatttatagaacttttgcaaaataaagagcgattaaaatttaataggctgtgtcaagtaaaaaaaacaatcaaatactaaaagatatgttacgtactcccttataagaacatctgttagccaatcaaatcaaggtatatatacatatttaattaaaatttaaaaattgataaggacgcaaaggatatttcttgccactacaaatttgcatgagaattgctagaaataaagttttcagggttggagtagaattttttttttgttagttctactttcgtgagaaatgccccgtcattgtaaggtctaaaacattatttgaaattgggtataggtattaataaactaggtgagtttttagataatggataaaatccagtgtttacttcaatagaagctatagccattattacatagttcttagttgaaaaccaaatataaactaggtgagtaagtggaaaaattaaataagaaatattaaccaaatataaactaggtgggtaagtggaaaaattaaataagaaatattatgattggttgagacaagggactggatactcaattgctatattctgatataaactttgaatgcttatattttgaacgaggaaaagatgttcttttatcataaattcgatttggtcttttttatatatatataaaaaacgagtacggtcgttatttaaaaatgtccattttgtaaagcttatttttaaagaccatggcttatttagctgaatataaagctcgataattaatatttttaaaataagtacattttaaataatgtagacttacataaaaaaacagtccattttataaagcttatttttaaagaccatggcttatttagctgaagataaagcttgataattaatatttttaaaataagtacattttaaataatgtagacttactaaaaaacactttttaatagctatgccataaatagattaaaatatgatgatttttaattgaataaatctacatgttaaatgaacaatttaatgaagttggcctaatcctaccaaaatcttttgaaatttctacgttcatgcataagaacatgctaaatggggcgcgccatttggcgcgagattttctagtatagtactaatatttatctgttcgacgcctccaaataattcgttctcgtgtagtcgtcagctacgtaccgaaagctttgcgctttgcatgcagcaccatcaccatctagttctactaataaccagtaagtccatacttctcgatacaactatggattaaaatataaacatgtaaatttaaatgcaaactacaaaataaatataaacacggatgtttaaattcaaactataaggtataagaaagaatacattcttaatttgtagattgagagattgagttttaaattgaacgttatgaaaggatggaatataggtttacttaaaagccgtgggatcggtggaagactaccagcacatcagcaatttttgcaaaaa

SEQ ID NO: 4748 - DNA, 566 bp, Oryza sativa
cgccctccgcgaggccgcctccgcagcgtccggggggccgcctgcaaatgggcggcgagggggcatggaattttgcaggcggcccccttgccgccctgggggagggcgatttttgcctcccccctataaagcccagcccctcccctatgaaatttcattatattcactaaaaatccaaaaaaaacgaaagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 4749 - DNA, 1501 bp, Oryza sativa
atacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttagccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtatacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctttcgttttttttggatttttagtgaatataatgaaatttcataggggaggggctgggcttta

SEQ ID NO: 4750 - DNA, 1501 bp, Oryza sativa
gacggcgccggcgatgaggaagaagcggcggcggtcttcgggtcaacggtgacggcggtgctccggcggtcttcggcggcggcgaagcggtggacggggatggcgacgcaacggcgaccacgacggtgacctccccgagcgacggcgacgactggagcgacggcggcgcacggctggagcggcggcgacaacggcggcgcgaggtctcacggcgctaggacgctacaggcgacgagaggcgaaggcgagggtggcggcgggtagaggagagctcgggggtccttttataggggcaaggaggcggcggcgaaggcccacggcaaccggcggcgagaaggaaaggttagggttcgagagagagaaacgaatccgattcgacctcgaatccacgagtttccaaaccgaattaggcgatgattccaaaagagaaaaggaagaggagatcgagaagattatttcccctctaaagatttcaccggatcgagaaaggatcgaccggattggaaagcggcggcggcgaagcggctcggctagggtttcgagcggcggccggcgcgaggagaacgacgaccccgacaagtgggtcccgcctgtcagcggctgagagagaggagggaggggcgcggcggactgggtcgacttgggccggggaggagagagaaagagagaggtttttgggccgactttcggcccaaagccaaaagagacttttaaaaacctttttcaatttaaattattcatgaaatgcaattccatttattaaaaatactttcttggctcaaataaatcccagaaaaatctaggaactatagaatcaagagaagtatttaatgaaattttatctggccccattttatattggaatttattaattaaaattagatcttctcttttaggcttttaagatcatttctaataattccttttaaacaacaatttataatttaaggatttttaaacaagaaaagctcttaacaattataattagatcattattgatcaaataattactgaactgttctttgtatcatttagaaattgagctctgaaaaatccgagaaaatttcagagagtgtaattaaccatggagaatttaataaaaattaaatccatccatgctttaaatttaggaaattttatttcccacatttaacttcacttgtaaattaaagaacatttaatataaattctaataataatttattaaataatttataaatcctgaaaaaatcaggatgtgacaaataagaaactatatttttcaaatccatcatctaaaaaaagcaagtgatcaacgcatacaacgaacgacagccattttatttaaaatttttaaacgcatgcatccatggcaagataacctcatcactctctggtcataaggaaggaatgagtctccgctctagcaaccgaagatgatataaatgcctatatttagtctcattggtggtccatgaagctctctcggccccatatatatatagctcttgtactatcacgt

SEQ ID NO: 4751 - DNA, 1501 bp, Oryza sativa
ctttaactgtgtcgtcgccacaatagtcccattggaagaataactaacccattcagcatatggttaatttttttaaaatgttttgtaatacaaatatatatataaatttaatatttataaatcaataactactccctctggcccataatatagcttttgtccagagaagctaattggcgcgcgtgtgttgtcggcacgtgttttatacccacgagaccaacaccgctacgccttatcttttttcccggcttgacgatactatcgtaactaaccattcttagataatgactctaattagctaatgacagtaattaaggtaagatttgttttttcaaaagttgtttttactgatagattgaatgaaatctatacatgaaagaaacctttaaataaatttaaaactttctatgaaaaaattaaaagccataactaaactcaaaacttcaactcgaaatttgaatttttaagttaaatttgaaaactttcaacttttcatctaaagtttaaaaaacctttcaaatcaaattggaaacttttaactcaaatttgaaaactttcaactctagatttgaaacttttaattcagactggaaaactttcaactcaaatttaaaaactttcaacgtagatttgaaaactttcaactctagatttgaaactttcaattcatactggaaaactttcaactcaaatttaaaaactttcaacatagatatgaaaactttcaactctagatttgaaactttcaagtcaagatttgaaaactttcaacttagatttgaaaactttcaactcttgaattgaaactttcaattcagaccggaaaacttccaagtcaagatttgaaaactttcaactctatatttgaaacttttaatttagacttaaaaaaaactttcaactcaaatttagaaactttcaacttaaatttgaaaacttttaactcagagatttgaaaaacacgtgtgctgaagattaaaagaaatcggaaaaaacacttaaaaaaagaaaaatgcgcagaggaaacgtagcgctaaaatagaaaaaaaaactgcgttgctgggggagagggcgccagctggcgtgtgtgcatcttgcgcgcacgcgagatatcaacccccgcttctctttatagttgtatcattataatattcctatatcctatccagtaataggtgagtactcctaaatgagtaactaatcaagcttaaggattaagctactgcattatgtactcgaattaagtgagcagatcaaccccgagctttacttatgctgtggcttggcgcgcaaggagaacgtgttggtcatgcgccagtgttacgcaaccgcttgttctccgcggcttaaggcggcgcgcgcaaacctataaataaacaggaagactcgcgccgccaccattccaccaaagaaagcagcgcagtgagacagacggattcgaattgacgatccatcctttcttcctcaccgatgaaggtgaagagcgacaaggatgcgccgg

SEQ ID NO: 4752 - DNA, 1501 bp, Oryza sativa
attacttctcggctcccagagccattccacttgattaatcagctcccagagcctttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaaaacctcacatccgcccatgaccgtgggcacggctgttcgaacagttagttaacctctgcagaggggtacactttacccacaagatacgaacttattccgaacacccgtcggtatcggaggttcgcaacaaagcctttcccgagccgacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaatggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagagctcaatttacggaattattggaagtggaatggagtcaatcggagttgcgaattgggtgatatgaattttgaaagtttaattggagtttctggaataggagagatgatttatggaatttatagaaataatattctcaagaatattattgacagtcattgaatccgggaccaaggaaaatgattcatggaattttggaataaggaattgatttatggaacaagggtggaaaaaggaaatcaaggaggga

SEQ ID NO: 4753 - DNA, 1501 bp, Oryza sativa
tttttttgttttttttacgcctaaaatgtattaaatttgatgttaagattttacacgtagatataatactatatattgaaagtgtatacccattttttctagatttttcgatgatatttgttaattggtgtatacggagtgtatacactttgtcagggttatagataccacatatctaattgtagttgactaagctcggcagggctcaccatataccatgtcttatacgaaaaaaaactcgtatatagaaggaattccggataaggaaggataaatagagttttgtacggaaacgacaaggactactcggatcatatccatatttatctccctagttctacttggacaatggggcatctatgcgtataaatacgagccccctaggaggagagaggtaggaggagagaggacaagccacaagacacaacagatcaatataatatagatcgatacaagccaacacacgccaagacaagctgctggatatcgatatcagagataagcctagacatacccatccgatgcctacgaaggctggcaagagggatctagtgccatctctgatctcgcggagtgtggattcgaggaggaagactaccccaccgtcgactacgagttggttatctagccgccaagtcgataacagctatattggttatcccaaatattgtacttgtgtgattcaaataaataaaggagcaacaccggcttcggccaacaggagtagggctattacctgtcagataaggggcctgaacctgtataaaatcccggtctccatcttttttacctcaatctcgcatattgatgacgctctctctcgtggcccgatcttctggtgaggggataactctcgctttgatcaagtgcgacgtttgcgacgtggctaccaaccagaacaagtccaggacgccgtgcaatcgctacaccacaaatgatgtcgtaccaaccgtgacgcgcagttgatgatccttgcaatgcaaacgagagaacactacaagaataagataagatacaatctaaatattgtgaataggtgattaagcacaaaggaatagttgcgattgaaatggtagatataatcgacccggcaaatcaacacaccaactattgggggctctgaatcaatagtcaccgactaatcgagcgataactagagacaaagtgaagggcactttgcaaaattcaactaaacaaaacccaaatgtttttgaggatgtacaaagctatttatagaggaaaataaagctagagttaagtgctaattagtggaggtggagggagacacttccgagatgggcctagtctattacagggaccaaggcccaagttctgtttcaggaatagcactgtcttgttttggcgattcccattgactcgagataaatttggacatgagaccagttgcatttgaaaggtagcgagataagcttttcacaaagtctaagatcacccaaatcggagttcgcatgaaggcgctaggttcatttgaagtcagtgc

SEQ ID NO: 4754 - DNA, 1501 bp, Oryza sativa
tatggataagaaaatgaggcactttggaatcattaggaaatttgaatcttttttatccacaggaaacctttctttaattttggatagtgcgacaccgcaacaattcacataatccaaacgacaacaactcgcattccatcgcaatcagtaagaacttttctgcattttatagccttcgcccaaacatgcatcatcaatgaatggcatttgtacccccaatccaataaaacaggattgcaaaaaaaaaaaaagcgcatcttgcctacgatgtacagtccagaagagcaaagcagcgaaaaggggataaaccaaccaccaatcacaacagatacctcagattccaaatcgtcgccgccgacacgtcgccgccgcgcctaatcttgcaccacgcgaccacctccccgccgccatccggggtgacccgggagcacaccacggcgtcgtcctcggccagctccacctccgggaacacggaatcggagggcactacagacctgctgtgcaagcaatggccaagggcccaagaccaacgaaaaggtcaagaatcaagaacccgtgaggcggaagaaacccaagaaaaaggaaggggggaggaggagggtggccgcacctagcttggcccagacgtcaccggcagcgtccggcgaggaggacgcgcagggctgggagctggagcactcgccggcggtgaagaaaccctaggagctggagcactcgccggcggcgaagaaaaccctaggcgctggagcacggcggcggcgaacagaagcagcgggaaagggttcgatggtcgagaagaaactaatctcgagctgctcacggtcacgggagggtagaagcggaagagatattggatatttggatccttgacacacgctagattggacggtgcagatggcatcgatcaactgttgagagaacagtagaacagtaatacagtacctgggggcaaaagttgtaggcaaaagcaataggttttatatgatttcatcagtttcactctcatccagctgagaaccaaacgtctccgataaattaaggagacagttcaagtcaaaaggagggaggaaattagggcaaaagttgatgctagtgaatctgaaatccacaaagagaaacgattggtttttggatcatctacagtgatctaatcccgttgccatcagatgcatcagatcagccatcgcctgtttgcaatttgcaacgaggagcaatgtagcaggctagcaactaaagcttgaagcctgaagcatgaagctagcttgctgctggttcagagtttctgctgctcccccgcggccgccgccgcagttagttccggttacccgtggcggcgaggtatctctggcccattgtatatatgggccacaagaagggccaacttaaatgggtctcatgtacgccaccgcgatccctttatggcccaataaacgcaggcccagttttgagcttttgttcttcccttcctcaaccgaaggccgcagcaaacgacgaaacaaga

SEQ ID NO: 4755 - DNA, 1501 bp, Oryza sativa
cggattccttgaaccccggagatgctcccacccctttgaatcgaaccctcgtcgtctcgtcgtgttttccccttttgatctccggtgattgccgccgccgcaatccaccgtcgtcggctcctctcgcgtcgattcctctcgccgccacgctcccggggatccccatgacctccccctggctgccccaaggccgtcggccttctcctttgtctccgcgccgtgtcgccgcttccgccgccgcctaacgccgccgtgcgtgcgccgccggtgaccatcgggtcccgcgtcaccgcgtgcgcgtcgcaacaccataccggttcggctaagcccgagcccgcgcacccttcgctcttctcgcgcgcggccacgtcggcgtgctggcgagcttggtcgccgccgccagccaccgtcatacctcccctctcaaatccgtgccgttaaacggattccccctgacctcctctagctgccggcggtggccgctcgctccggttcgccgtcgctcgccggaacgcctcgcgcgtcgtcggccgtccgatcccgggcacctcctcctcctcctccttccctttcgcccctgcccgcgtggccgaccacgtggcagccacctcagccccgggcccgcttgactgggtcaagtcgcgcccagtcagcctcctccctccgtcttccctcccatgcgcgcggtccacggcaagccgtgcggctgcacgtgggcccgccgccatccgtccacccggcgcgccgcgcccgaactgcgcgcatccgaaaccctagcgcccgcctccgcgtgcaccctccccaccgtgaacccaaccaccgccatctgggtcccgcgcggtggaccgcgcccaccccgacgggcctccctctctccccgcgcgccctcatgggccgcctcctcgcgcccgcgccggcccatttggtttggccgagccgcgttagcctttgggccgcaccaatgccaccgaaacaagtctaatatacatccctccttgatttcctttttccacccttgttccataaatcaattccttattccaaaattccatgaatcattttccttggtcccggattcaatgactgtcaataatattcttgagaatattatttctataaattccataaatcatctctcctattccagaaactccaattaaactttcaaaattcatatcacccaattcgcaactccgattgactccattccacttccaataattccgtaaattgagctctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccatttgatcaattgcccctataattgaaaagtcattattattttgtttgcaacttgcattattagaatcacacacttaacttgcttggcctcggtttgcg

SEQ ID NO: 4756 - DNA, 1501 bp, Oryza sativa
tattttgtttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcggctcgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtttttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagctgattaatcaagtggaatggctctgggagccgagaagtaatgaactgacccgggaggtcggtacattaccaaatgagctgttgaaaaacatctcttaaagtcgaatcgagacgcaagtctcttttcgtcccaaacttagaaagaaataaatcacttagtgatttcaaaatgatttcaaacaaaagatttgcaaaacaaccttgcctctctgccaagcttgcattaaacacctaagttcccgtgacttgctgagtacgaaagtactcacccttgctctatataaatatatatatatagttcctccgccctgaagggaagataaagtgaagtgaagatttgggtttcgtcctggttcccagccgtcgcctgtggtgttgggtgttagaccgttggttccgctgctgctgctgctgttggtgttttcctcgtccgcgtcgtcggttgtattctcgggctgtctgagctgcaacctaagttaaggtaaataagtcc

SEQ ID NO: 4757 - DNA, 1501 bp, Oryza sativa
ctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttctactgctttcaactactgcttttaaatgctagctttatgcaaaagaacctctagcctcctgtggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttattcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttaaaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatattatgtgtcagtggtatgactgcctcaattaggagttgcgtgcctctttttcagtgttttaatcaagattaagataattgcacttaaattcataagcaagattagtttctgagccctctgtttttcttccttttctcatatttctacctatccccttcaga

SEQ ID NO: 4758 - DNA, 1501 bp, Oryza sativa
cctacccgccaccgctgggcgcggcattaccagccgccgtagcgcgcagcccccgccgccgccggccgcttgcctgccaccaccgggaggagaggggaggaagaaggggaggaggggtaagatctgtgtaggagaggggaagaggaaggggaggagaggaggagaggggaggatcgatcgatctgtgggagaaagtggttgcgcgattgtggaggagaggataagtgctagggattagaattttagttccggttggtaatatcaaagggactaaagtggtgatctttagtcccggtcggtggcaccaaccgggactaaagatcctcggtcccctgacatgcctctgacagggaatgaaccaggattacagatcatctttggtaacaccaaccgggactaaagatcgtagaatggctatggggttttcaaccggggctaaagatcatttttagtcccggtttttttggaaccgggactattgtgattttgggttgacccagcgaaaattagttttccagtagtgtcagtcaggcactgacgaaagtacgtaagagatcaaaaagtacagtatagtagctaagtatggtccaagatgtgtagctagtacgtgcaacatactacatccgaccatagccaccgtacatagatacgtttatatattatatccgggggaaaatatgtgatggaaatcatatatttggtggaaacttgaaaactaacgttggatcgagaaatagacgtccgagatacgtccacgttatcacaaacgtccatttttcgacccaacgatagtttccaccacatatatggtttccaccgtatattttccgctacatccgaccaaggagtacggttttatttatcacagattcacacaggtatatatatgctacttggtcgccaagctaccgaacgtataaaatagagctttattaatctctgttcttatacgcatacgtgtaagaagagggacatcaattgcaatgcaatgcatatggtctcaatcaagacatgtaaatgtatttctaattagttgattggtgttcattgccctgggcatactgacttacagttttttttctcttggaggaatatatacattacgcgtttaatttggcactattttagactttcaggcgagtaagccgcgttggataaatacacacactttttttcttgacacggcaagcacttcgcagaaactacagggaaattttcatttcttctggctaatgatcagttgacttataaaataacacgcaggcagtacgtacgcttggtaattaagttcagtgaaatcatctttataaatacctattagagcttgctagatttaagaatctacttgtttcttcctcttaaaatctcaacttttccttgctatatatttcgaatatattcttgatcgcatacaatctgtgctttgaatttgttagagatcagggcggcttgattaagcaagattaattcattcaagattcaaccatgaggctgttcgagg

SEQ ID NO: 4759 - DNA, 1501 bp, Oryza sativa
cgcgttcgttaacgtttctttaacgtttcattcgcgttcattcgcgttcggtcgcgttcgttcgcgttcggttacgttcgttaagcgttcgttcgcgttcgttcacgttcgttaagcgttcgttcgcggcggcggcgtctcgcggcggtgggggcgcggtccggcgccgtgggccggcccggcggcgtgggggcgcggcggcggcgtcgtctcgcggcggtgggggcgcggtccggcggcgtgggggcccgatggcgtcggcgtcatcggcggtggcggccgcgccgaagtcgttcgtcggcagtggcggttgaccgcggcgtggcgtagtggcgtcggcaacgagctatagctaggcacgcggcagcggtttggagagagagagagagagagagagagagagagggctatatcgagaaagagagagagagggcgggggctctcacccaagagacgcggcggcggcgtctgcggcggaggcggcgaggaccgccaggcgacggtgagagacgacggcggcgtcggcgcggggttgccctagacagtggtggcgaaggagaagccgatgctcgatctcgatggaaaaacgtcgaagtgttggtggagaagacaagggcgcaccgggaatatatatacccccggatctttactcccggttgaaccgggagtaaagatatctttagatttttaatcccggttgttgttacgaaccgggagtaaagatatctttactcccggttgttctcaccaaccgggagtaaagatattttcccgctatttccaaattctgttttaaacccggttagggttaagaaccgggtctaaagataatagcactgaatattgaatttcgttgcatatgtgtttctaaaatagtaaataatgcattaaaaattctaattaacatatgtaaatcccacatgcatgatttaaaacctttaaaaattctaataatcatatatcattagcatatgcatgatattaaattgttaaaaattctaattaacatatgtaaatcccacatgcatgatttaaaacttttaaaaattctaataatcatatatcattagcatatgcatgatattaaattgttaaaaattctaattaacatatgtaaatcccacatgcatgatttaaaattactaaaaattctaataatcatatataattagcatatgcatgatattaaattgttaaaaattctaattaacatatgtaaatcccacatgcatgatttaaaacttttaaaaattctaataatcatatataattagcacatgcatgatattaaattgttaaaaattgtaattaacatatgtaaatcccacatgcatgatttaaaacttttaaaaattctaataatcatatataattagcatatgcatgatattaaattgttaaaaattgtaattaacatatgtaaataccacatgcatgatttaaaacttttaaaaattctaataattatatatacctagcatatgcatgatttaaatttgtt

SEQ ID NO: 4760 - DNA, 1501 bp, Oryza sativa
tgtaatatgaccaaaaaaatattggaggatgaagttgctaatattttaggcacctccgatttgtatataatcaccaaagtaaattcactataaattttggcatgacctcccctcttttttaaagaaattttgaagcttgctcgggctggaggaggaagaagacatatataaaggggtgggactttagtcagatcccggtgatctttagtaccggttggtaacaccaaccgggactaaagttatgaccaaccgggactaaagatcccagggggcctgagatcaaatatgcccgttaccctttttaaccgggactaagatcggtttttattgcaaccgggattattgtggaattcggccgaccgataaaagatggtttctccaccagtgtgtacgtctccagtggcctcggcctcctgggcgtgccacgcctgacgtgatcgatcagtccctggttgtatgccctcgcgttgtccacgctcgccgcgaaccctcccgccgacggccacccgctctccgacaccaccacattcacgttccccgcgccagccttctccagcgcggcgtagatggcatgcatcatggcgtcgaacaggttggtgtaggtgagtccgttattttggtccctctctgtggggctcacccggaacgtggcgtagttgaggttgatgcacggtttatccttgtaggcgaagtaggggtagacgttggccagcagcggcgcgccggtgctcgccaggtactgagctatgccattcatgtaggtatacgcgaacacgccggcggagggagggtaatagttggcgatcacgtcggatttcaccgcggtggaaaccttgatgccgccgatgccggccgcggcaagggcggagttgacgttgcgcatggccgggaggatgctctccgtggtgccgcctaccacctcgttgccgacggcgatgtacttgatgttgacggccggatagtaggggctgatgttgtcacggacccacgcggccgcgttggaggagctggcggcgaggttggacaactggtcgccgacgtcgaggatgagggcgatgccggagttgcgcagggcgttgagagcctccttgtcggggtagtagatgcgcatccgtttgatgcccttggatatgtacatatgcaccacctcgctccgcgacgggaggttattacccaccatgccatagcacacaccgatcatttgcacggctgcacgtgcaccgcaacagttagctggagtactacaaacgtggaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 4761 - DNA, 1501 bp, Oryza sativa
ctctctccgctctgcccgcgcgcgtgcgcgtgagtcgccggcgccgagccgagtcttccctctccgctccctcgctgccgctccccgcgctcgttcgcgcgcgcacccgcttggttgccgcccgtgtcgcgtcgcgtctgcgccgcccggtcccgctgccctgccgcctgcagccgcgcagccgcttggccccgcgagccagcgcgcgtgcccgagccgcgccactccatccgccgcgcctcccgttgcgagccgcgcgcgcgtgccgtggtggccgaccgcccggtcgccgccgccgtcagcctctgcacgcgcctgtcgccagtgtcgccgctccgctccaaaccgccccgccgtcatcgccgtcgtcatcgcccggccccgccactccgcgcgcaagccgccaagggatggaggcagcatccctcctccctctgccgcgtcgcccccgctcacctcctcctttttcccgaatcggcaaatgggcaagccccctttctccccctccttttccccttttttctcctcgccggcgtcatcctccctgtcgccgctttggccgtgaccgccgaacgccagctcgcgcccttgaccgcgcaagtcggttcccaaaccgacattgccgcccatttaaaccccagcctcccctttcccttcctcttccattcgcctccgtgccattaccgccgcccccgtgctctgtctcgcctccgccgtccttcgccgagcgccaggaggaccggtgcgttcgaggacgcggaaggggacttcggccgcgccctcttcttcctcttccccagcccgaggccggagagattactcccgcgccgtcggcctctcgtcacagcgccccgtcccgcacggtagtgtctccctccgttcttcctcctcgctccatctccccccccttagttttcggtggtagcacgagtagactccccgtagctagccggcgccgccccagccgttgccgtcgctcgccgtgtgctcgccgccgtcgccgctcgagctccgtagcacccgcacgtcgccagcctcgctcggcgtagctccgtccaatccgacgctagcatcgagttcccgaaaccgcgtagatactctcaccgccgggaatcgacccctcgtggtctcgtcgccgtttccctcttccctccccgccggttgtcgccgccgcgattcgccgccgtcaagctctctccggcgaatccgagccgttggctcgtctcccctcatcacgaacaaccgcccggtgtgctcgcttttgcccgtatcgccgtggttcgctccgccgctcgccgccgccgcccgccgtccattcgcggccgggtcgtcgtctacctcccgccagcccacgtggcagccacgtaggcgccacgtcggcgccagctcagccgaggtcgggacgggccgacctcggtcagtccctccccgtgcgcgcgttccaccgcgagccgtggggctgcgcgtgggcccgccgcacctgcgtcctccgcgaaccgcg

SEQ ID NO: 4762 - DNA, 1501 bp, Oryza sativa
aaaaataactgaaattcagaattaaaaataaggaatattgaaagaagagtccatataagaacccaatacgagattaattaaaattcagaataaaaataaaataaaatcctaaattagaattaaaataaaagaatatttcgtatagaaatacaatttaaaaataactaaagtttgaaatttaaaataagcaatattgaaagaagagtccatacaagaaaccagtacgatattaattaaaattcaaaataaaaaacaaataaaatccagaattagaaaaaaaataaaaagagatttcaagtaggaatagaatattgaaacaatccaaatatctactattataaaaattgaagatgtttccacagtcggtcatctgtgtttgagtcggttataaaaaattgaagatgtttccacggttcgtcatccgtgtttgagtcggttttttttttgtattaatctatatctcttctctactattataaaaatttgttaacgaccatgtttttatcggtattttggtaagtcatccgtgtatgagtcggtttttaagtttgtttgcttttggaaatacatatccgtatttgagtcggtttttaagatcgttcgcttttggtaataccgaaagaatcatgcaagaaatatgtttaaaaaactcgcatgctaacttgagacgatcggactcctaactacagctcatgattttctaaaaaaatatatatatccaagcgaaatcccacagtgtattttatcttaactaaaccattgaaattagaaataaaaaagaaaaaaatattaagagaatagtctatatagaacacaatacgagattaattaaaattcaaaataaaaaataaaataaattcaaaagatagaaaaagaaaaaaataagagctcaacttgaataaaatttataaataacttaaatttgtaagaaaaaaataaagacaattgaattaagaggcaatctagaacacatgatgagattaactaaagttcgaaataacaaataaaataattttcaaaaataggaaaaaaattataagaattgaagtttgaatataatttatgaataaaaattatcggaatgaaaaatatgcaattttttttaaaaaaagtccatctagaaaacaacgatgacaaatagcattaaaaaggggagaagcaataggcatgtaaagcagtagagtgttggtggttgatgggatatcaacaaaaactataaacaaaaccccaaatagaatcacaatgatgattaagaggagtgacgataggtatgccgttaagcagcatggtcacgacggttggcgggacttatggataattaaaaaaaccacaatgataatcatattttatgtttaaaatgtcaatggcaataagaaggggaagcagcgggtttgctgtagaggagtatattggtgaagccactaacgattggcgagacttatagaaagtaaaaaggaacacaaataataattatatttgatttttaaaatcccgatgacaa

SEQ ID NO: 4763 - DNA, 1501 bp, Oryza sativa
aataatggctatagcttctattgaagtaaacactggattttatccattatctaaaaactcacctagtttattaatacctatacccaatttcaaataatgttttagaccttacaatgacggggcatttctcacgaaagtagaactaacaaaaaaaaaattctactccaaccctgaaaactttatttctagcaattctcatgcaaatttgtagtggcaagaaatatcctttgcgtccttatcaatttttaaattttaattaaatatgtatatataccttgatttgattggctaacagatgttcttataagggagtacgtaacatatcttttagtatttgattgttttttttacttgacacagcctattaaattttaatcgctctttattttgcaaaagttctataaatattgtataatactagcaaaatacccgtgcgttgcaccgggtaatgatatggtgactgaaatttgatttgaactatttatatgaagaaaatgaattgtaatttaatgaaatataaaattttctgcaatattaattacactcttttaaattatagcaaaagtgatattgcgttgcaacgaatagaaaaaacagataaagttgaattaaaacatattaaattctaattaaatgaaatataaattttctgaaatatttaggtattttttaagtaggtaggtatacaattaaattaatttataagtaaagtaagtgtaagaaataaaatgttgtggttggatttaacttttattaaattttctatattaattacactcattgaaattttattggaatttacctagcttaattgctaattttgataatacaaatatcatttcagcatttattgaaataaaaatctaaataaaaatccttttttctctatgggcctttttcaacccattttcttcttcagcccgcaagagaccaaagtctacttaatacccccatactcctttcatttagtggaccgcgggcccacgtgcggcccaaaccctcaatcgatctcagccgttagttttgatggacggctcagatcagattaaaattgatgaaaccctaaccctaaccctccccccagccgagccgagccggccgcctcttcctcccccgccccgacgccgcctctccccctccctctccccaccggcgtctctccccctccccccagccggccgactcccccgccaccggcgccgtccctcccttctcgccggcacggcgcggcgatggtggggtgcggcggtgtgtggcggcgccgccgccttcccccaaggcgagcggcggcggcggcgccctcctccccgcgagcggcggcggcggccactctctccacttcttcccctttctctttgtgtggcggcgggagggccggcgacgccctcccctccgctagatcggggggaggggatgtgcggcggagcgggagaggcggcggcctggacgacgtggagacaggcgtcggcgccggccgcctttttttttttttgcaatttta

SEQ ID NO: 4764 - DNA, 1501 bp, Oryza sativa
aagagatatacaccgtagaagactccgagttgaagaagaagaagaagaatgggaaagaagtactgaaataacaaaaattggttgatgtaactattaccgagggccgattccgacatgacctccttgctatgataaagattggggctttcctggatgagtagaaccagatctccagatgagatgaagggctggcttataaaatagtggtgggatgtaggaaagggggcggtggagagttcgccggaggcgatggcggtggaatgagcacctagggtttctttatgggaagatatttgtgatggggaactggggatggtggacaaggaagaaaaggatatgatcaagggctcgaggcccggcctgagtgcctgacatgttgcgggctgtaattaagcgcctggccaggccgagaaggcccaaatgaacttctttcttttctttttcatttttttttaaaaagtccactttaggctatgaactatgtagttttatttgagtcccttaaccataaaatctgatataaaactcccttaattattaaaactagttggatgacccgcacaactacacggctatcatcaatttaaaattatctatttttacacataattttatttaaaattattattcatgctattctaataattttatagtttttaaaagcaacgccagtcgctaccctttactcctttgtcacatttttatttgcttacttgatctatcactacttctattcatcctcttgagaactttaaaagttaggccttatagtttttagagtaccttatcttattgggtttcgtttacataatttttagaagtatcgtcaaacatcgccaatttactactctacggccatctgttgccacctcaatttattgtcatcgggattttaaaaatcaaatataattattatttgtgttcctttttactttctataagtctcgccaatcgttagtggcttcaccaatatactcctctacagcaaacccgctgcttccccttcttattgccattgacattttaaacataaaatatgattatcattgtggtttttttaattatccataagtcccgccaaccgtcgtgaccatgctgcttaacggcatacctatcgtcactcctcttaatcatcattgtgattctatttggggttttgtttatagtttttgttgatatcccatcaaccaccaacactctactgctttacatgcctattgcttctcccctttttaatgctatttgtcatcgttgttttctagatggactttttttaaaaaaaattgcatatttttcattccgataatttttattcataaattatattcaaacttcaattcttataatttttttcctatttttgaaaattattttatttgttatttcgaactttagttaatctcatcatgtgttctagattgcctcttaattcaattgtctttatttttttcttacaaatttaagttatttataaattttattcaagttgagctcttatttt

SEQ ID NO: 4765 - DNA, 1501 bp, Oryza sativa
tcccacgtgacaatggtaaatcgtaccatgaaaattgaaagaatttcgttgaatctacctcccatcctttctccttttcttcttcctcattcctctatctccccatctctctccaccgtgcacatgtgggtcagcgggcaatggagacaccgatctggtcggagagcaccctcagccatcgccgtcgcaagtggcaagaagagacggcgtcaccattttcctcgcttctcgttgtcatgttgattacgctatccttcacttagatccagaatacgccgatggctgaggactctggagcactgtctgtaattacattggtgatgttcttttcttctgaaaataaagatgaagatgaagaatacgttttttacataaaacaaggtggtattaacgtatgattgattgagttttaattattacaaacttgaaaaatagattaatatgatattttagagcaactttcatatataaatttttcgcatgaaacgtaccgttagcaatttgaaaagcgtgccacgaaaatcttaatcttcatccaacttttattggagaaaagaacgggaccattgcccccattcttgtgaacctcatcatgctccagaacttcttctccggcgcgctaccaaccgatagtgacgggtgattggctggtttggtggtcgtcggagatgtctcccttgattgttcgttcttggatgggtggtagtagtcgggttaagcaaaaaaaaaaattcaaagattgaattaaggtagttgttatcacaacttctttttgcttggatggatgctattgtcggtgtctccatttgttgcttggatggtgttgatggtccttaagtaccaaattcgatttatcaattcatgcataataacaattgaaagaatataaaatagaataccaaacttagaggtagtagtcttggtgaatatttatatataggtaaatatatggacaaaaatcatccgccatgtgaccaaatacacctccggacaatcggacacgattacacggtttggaggccccacgtgtcaatcaaaaccacctaaaattgagtccagccaaagtacaacatgttgggggcccaccaggcagcctcccaaccgaatgagtggccggtaggtgagccagaagttcggtcgaactgcctttgcatcccctcgccatctgccaacacgtggagcaagatactggagtcctaattgcggttatgtgtggtttctgagcttaaccaacccacaaaccatcattacaactaggggtggcaacggggagggtcggggctgggttggacgggaacgtgtcacaccctgatccggcaccgccgtacaacggcacctgacaggagcgtgtcgtaggaaaaacggcgcgaaccgcttcctacgaaaccgcgatcacagtaccagtcctaggacatagcgctggtacccacggtgacaaatatgaatcattgcaatccttaaaataaatagaggatttatttaccttgacttaggttgcagc

SEQ ID NO: 4766 - DNA, 1501 bp, Oryza sativa
gtttacgtgtaaattgtgagacaaatcttttaagcctaagtgcaccatgatttgacaatatggtgctacagtaaatatttgttaatgacaaattaattaggcataataaatttgtctcacagtttcctgacggaatctgtaatttattttattattagacaacgtttaatccttcaaatatatgtccatatatccaatgtgacatccaaaacaaaaatttttgccatctaaaccaggccaaggtcccgtcgggcttgcctccttccctttgacctatctatgccatgatgctcatggcagcttaactcttattggattttcttttctaactggattttattctaaagattaacctttgctgtaaccaactgagctaccagaaccacttgcctaaagtctcttttcttcatctatgagcatcccagtggaggagtttgctcaagaaccaagagccggccagggagttggatgaaaattaagatttttatggcacacgctttttaaactgctaaacggtacgtttcatgcgagaactttctatatgaaagttgctctaaaatatcatattaatctattttttaagtttataataattaaaactcaatcactcatatatcaataccacctcattttacgtaaaaaaacttaatcttcatctccatcttcatcttcagaagaaaagaacaccacctaagtagagtgttgtattagtttttttactactggctcaatcttgggataatttactatatattatgataaatttatttccattagttcgcgtgaatattgacggaatggatatgcatcatcaatatccatgcatccatatataaatacttgtagtcaggccgaagataaagattcacacctcctacttctttcacgcagcagcgtactccctattttaaatacaaccataacttttttatccaatatctaaccgtccatcttatttaaaaaatttataaaaaagttttaaaaattaagtcacacataaattactatttatatcttatcatctaataacaataaaaatacaaattataaaaaaaattaaataagaaagacggtcaaacgttggacactaaaacccacaagtacgcttaatatgggacatagggagtagtactcttgaaggaacacatttgtacatacaacaaatagtgagacaaatcatcatccactatttgatactccctccgtttcaggttataagacgttttgactttagtcaaattcaaactgtttaaagtttaactgagtttatagataaatataataatatttataatactaaattattttcatcaaatcaatagttgaatatatattgataataaatttgtcttaaattgaaaatattactacttttttctatagacttaaatcaaatttaatgtagtttgactttgaccaaagttaaaacgtcttgtaacctgaaacatagggagtagtacgagtagatgggcgaggcgtgggatggagacgaagaagacag

SEQ ID NO: 4767 - DNA, 1501 bp, Oryza sativa
aataactgaaattcagaattaaaaataaggaatattgaaagaagagtccatataagaacccaatacgagattaattaaaattcagaataaaaataaaataaaatcctaaattagaattaaaataaaagaatatttcgtatagaaatacaatttaaaaataactaaagtttgaaatttaaaataagcaatattgaaagaagagtccatacaagaaaccagtacgatattaattaaaattcaaaataaaaaacaaataaaatccagaattagaaaaaaaataaaaagagatttcaagtaggaatagaatattgaaacaatccaaatatctactattataaaaattgaagatgtttccacagtcggtcatctgtgtttgagtcggttataaaaaattgaagatgtttccacggttcgtcatccgtgtttgagtcggttttttttttgtattaatctatctatatctcttctctactattataaaaatttgttaacgaccatgtttttatcggtattttggtaagtcatccgtgtatgagtcggtttttaagtttgtttgcttttggaaatacatatccgtatttgagtcggtttttaagatcgttcgcttttggtaataccgaaagaatcatgcaagaaatatgtttaaaaaactcgcatgctaacttgagacgatcggactcctaactacagctcatgattttctaaaaaaatatatatatccaagcgaaatcccacagtgtattttatcttaactaaaccattgaaattagaaataaaaaagaaaaaaatattaagagaatagtctatatagaacacaatacgagattaattaaaattcaaaataaaaaataaaataaattcaaaagatagaaaaagaaaaaaataagagctcaacttgaataaaatttataaataacttaaatttgtaagaaaaaaataaagacaattgaattaagaggcaatctagaacacatgatgagattaactaaagttcgaaataacaaataaaataattttcaaaaataggaaaaaaattataagaattgaagtttgaatataatttatgaataaaaattatcggaatgaaaaatatgcaatttttttttaaaaaaagtccatctagaaaacaacgatgacaaatagcattaaaaaggggagaagcaataggcatgtaaaggagtagagtgttggtggttgatgggatatcaacaaaaactataaacaaaaccccaaatagaatcacaatgatgattaagaggagtgacgataggtatgccgttaagcagcatggtcacgacggttggcgggacttatggataattaaaaaaaccacaatgataatcatattttatgtttaaaatgtcaatggcaataagaaggggaagcagcgggtttgctgtagaggagtatattggtgaagccactaacgattggcgagacttatagaaagtaaaaaggaacacaaataataattatatttgatttttaaaatcccgatgac

SEQ ID NO: 4768 - DNA, 1501 bp, Oryza sativa
caggatgacagccgccggctgcggcgtcgcctcgctcgcctgaggtggaccgcgcatcgtctcctccgccagcaaaccactgctcttttccccctctcctttagctctcaccgcttccatttcttcctccccatcagtgttgtatcagccctgtggtctcgccccaaaccctagcgctgtcatggcggcggggtcgagcccccttgtgccaggtgccgagaaggcgctggggtagcggcctgtctcgtcccaatccgtagtgcggccatggccggcggggatgagctcctgtgcaccggtggcgtacaaggtgttggggcggcagtgagaggaaggtccagcttggaggagctgaggagggagacgcggtcacggaccggtggcggtggccttggatccaagcaacagtggcgcacatcgcaagcagaggagatgttggagccagggtcgagagggacggcaggggcattgcggaggtcggcgcgatggatttcggccacggcacggcgacaacgacggtgagctaatgccacatcgcatgttcctaacttggctatttgtttcaatctttcatggatgtgcagttcccagatgtatatgttgctgacaaagggatagcagcatgcgggttttcctcattatttatggattgcttcaagatcatggaaaatgtactggagaaacaagagtaagtccaggatctgttcctaattattttacctcacattattatttcctgttactttgctttggaagatcaaacatgcagtggttcaccccctatgtttcaatggcttgacagtgaccattctatttcatctggagttgcataagccttaccatggaaacgatatggccttatgttgaggcccagtattcaagtaaggtagttctatataaacacctctgcaactcaaagccaagttagtgaggcctaacaaaagggtcctcaactctattttttctattcctgcatctattttcatgtatctgtgtttgccccacattttgaggaagcgatcctgggtatactggtaagaatttgccctttcattagagggggggggggggggcatctaatgcaatgtgtggttttctccaaacctatgagactgacatatcattatttaatacaaatcatgatgccattggattttcccattcatgtgttcagatatgttgcacagacgttctccatgatatgttcagttcagcagctggaggcagagttgccactcgtggagaataactcttgtgatctttgcatacagactacctgtatgttgcttctaacaggggtatgtgcagcaccacataacacaaactcctctaaaagaaacatctttcacgtctacctgtttctgctaacaaaagcattttgtatttctctcattcacatggagagttgattggtttgtttgcaggaatttgttggcatttgaattcgaggttagacagtggggttgtgacaaaaggtgacacactcacacactttgtttca

SEQ ID NO: 4769 - DNA, 1501 bp, Oryza sativa
ataatggctatagcttctattgaagtaaacactggattttatccattatctaaaaactcacctagtttattaatacctatacccaatttcaaataatgttttagaccttacaatgacggggcatttctcacgaaagtagaactaacaaaaaaaaaattctactccaaccctgaaaactttatttctagcaattctcatgcaaatttgtagtggcaagaaatatcctttgcgtccttatcaatttttaaattttaattaaatatgtatatataccttgatttgattggctaacagatgttcttataagggagtacgtaacatatcttttagtatttgattgttttttttacttgacacagcctattaaattttaatcgctctttattttgcaaaagttctataaatattgtataatactagcaaaatacccgtgcgttgcaccgggtaatgatatggtgactgaaatttgatttgaactatttatatgaagaaaatgaattgtaatttaatgaaatataaaattttctgcaatattaattacactcttttaaattatagcaaaagtgatattgcgttgcaacgaatagaaaaaacagataaagttgaattaaaacatattaaattctaattaaatgaaatataaattttctgaaatatttaggtattttttaagtaggtaggtatacaattaaattaatttataagtaaagtaagtgtaagaaataaaatgttgtggttggatttaacttttattaaattttctatattaattacactcattgaaattttattggaatttacctagcttaattgctaattttgataatacaaatatcatttcagcatttattgaaataaaaatctaaataaaaatccttttttctctatgggcctttttcaacccattttcttcttcagcccgcaagagaccaaagtctacttaatacccccatactcctttcatttagtggaccgcgggcccacgtgcgggcccaaaccctcaatcgatctcagccgttagttttgatggacggctcagatcagattaaaattgatgaaaccctaaccctaaccctccccccagccgagccgagccggccgcctctttctcccccgccccgacgccgcctctccccctccctctccccaccggggtctctccccctccccccagccggccgactcccccgccaccggcgccgtccctcccttctcgccggcacggcgcggcgatggtggggtgcggcggtgtgtgccggcgcctccgccttcccccaaggcgagcggcggcggcggcgccctcctccccgcgagcggcggcggcggccactctctccacttcttcccctttctctttgtgtggcggcgggagggccggcgacgccctcccctccgctagatcggggggaggggatgtgcgccggagcggaagaggcgccggcctgaacgacgtggagacaggcgtcggcgccggccgcctttttttttttttgcaatttta

SEQ ID NO: 4770 - DNA, 1501 bp, Oryza sativa
cccacgtgacaatggtaaatcgtaccatgaaaattgaaagaatttcgttgaatctacctcccatcctttctccttttcttcttcctcattcctctgtctccccatctctctccaccgtgcacatgtgggtcagcgggcaatggagacaccgatctggtcggagagcaccctcagccatcgccgtcgcaagtggcaagaagagacggcgtcaccattttcctcgcttctcgttgtcatgttgattacgctatccttcacttagatccagaatacgccgatggctgaggactctggagcactgtctgtaattacattggtgatgttcttttcttctgaaaataaagatgaagatgaagaatacgttttttacataaaacaaggtggtattaacgtatgattgattgagttttaattattacaaacttgaaaaatagattaatatgatattttagagcaactttcatatataaatttttcgcatgaaacgtaccgttagcaatttgaaaagcgtgccacgaaaatcttaatcttcatccaacttttattggagaaaagaacaggaccattgcccccattcttgtgaacctcatcatgctccagaacttcttctccggcgcgctaccaaccgatagtgacgggtgattggctggtttggtggtcgtcggagatgtctcccttgattgttcgttcttggatgggtggtagtagtcgggttaagcaaaaaaaaaaaattcaaagattgaattaaggtagttgttatcacaacttctttttgcttggatggatgctattgtcggtgtctccatttgttgcttggatggtgttgatggtccttaagtaccaaattcgatttatcaattcatgcataataacaattgaaagaatataaaatagaataccaaacttagaggtagtagtcttggtgaatatttatatataggtaaatatatggacaaaaatcatccgccatgtgaccaaatacacctccggacaatcggacacgattacacggtttggaggccccacgtgtcaatcaaaaccacctaaaattgagtccagccaaagtacaacatgttgggggcccaccaggcagcctcccaaccgaatgagtggccggtaggtgagccagaagttcggtcgaactgcctttgcatcccctcgccatctgccaacacgtggagcaagatactggagtcctaattgcggttatgtgtggtttctgagcttaaccaacccacaaaccatcattacaactaggggtggcaacggggagggtcggggctgggttggacgggaacgtgtcacaccctgatccggcaccgccgtacaacggcacctgacaggagcgtgtcgtaggaaaaacggcgcgaaccgcttcctacgaaaccgcgatcacagtaccagtcccaggacatagcgctggtacccacggtgacaaatatgaatcattgcaatccttaaaataaatagaggatttatttaccttgacttaggttgcagc

SEQ ID NO: 4771 - DNA, 1501 bp, Oryza sativa
gaggccaccggaggtcgggtaggcggagcagatctcggccatggacagggccatgcagccgttgaaggcggacacgacgagccacccgagcgtcatggacaccggcccgccgtagcggagccccgtgctgtacgtcgtcgtcacaccggccatcacggagatgatggagaaggagaaggcgaagttggagagaacactagctcacgaaggccaaaaacaattaaccaaagatgccaatgaacagtagtagtttgcgaggcttcgcatggtaaattcataagataagctgctccttacgagaggccgcgcttcagctcttgcttgtagccgagctgccgcagccgaattttatctcgatcgccatcgccggccggatcggcgggcacggccacctcgacggagcgagagagcgccatctgtatcgtgcttcctttgcagtagatttgcaaaaactttacaggctcagtgcatggtactagtgtctggtttaggcagtagcttctctacgatggaagaatcaagatgtggatggggatattatttgattgggtaggatagtagcaaaatttaaccgtcgcctttcatttccggacaataatgcaaattgctttgatatttttggattgtttcagcttgtgcattaattggtcttcagctcttcgatgtataccggatccctcgctgtctctgatcgatctgtttgttcacacctgtgtggcgggcgcggaggaaaaactccgaggaaaagcccatgaaattgatgagtcctcggcctattaggcccaataaacaccacaagaatatcttggggaaaaagtacacccaaggtccctcaacttgtcatcgggttacaaaaacatccccaaaccacaaaaccagatatacaacgtctctcaacttacaaaaccgttcgttttgggttcttcagtggtttttaaccctggttttatccaacgtgacggctgagtcagcgtaggacccacatatcagggtgccacgtcatcatctctttcctctcctttcccttcctcccctcccccccgggtatttaactatttgccacttttagatttgtcaattaactatttgtcacgtctatctcaatgacatatgggtccacatatgtctataacatatggatccagttagtttccacatctaaaagtggtatataattcagtatctcccccccccccccctccccctcacttttctgctctcgcagggtcgggaggaggtcgccggtgacgtgggagaaggggagggcggcggcagcggcggactctggtgtctacgccaccgagcgccaccgtcgctcttctcctctgccggccaccggctctgtagcatgatgaaggggaagggcatcctcaagccgaggcgcctaggatgcggcagcaaggacggcgacaagggttgtgcagcggcctcctaggattcggtggagatagcgtggcggcggtggaccaacggaggccgcgccacaggcagagcggggtgg

SEQ ID NO: 4772 - DNA, 1501 bp, Oryza sativa
aaattatattctcctcgtccaatattctttatttctttctgttatttataaactttattcctatatgtagtctaaactcttctttcaatattttttaattttatattctgaatttcagttatttctaaattgtactactatgtgactctagatttctatcacaatattcattattttaattctgaatttctattattttaaattgtatttctgtatgtactctagactcatctttcaatattccttattttttttaatttcgaatttagttattgctaattgtattcctcctatatgggctctatatgggctctagactctttttccaatactccttattttttaatttcgaatttaattatttctaaattgtatttctatatggtctcaattctacttttaattttattattttttattccgaatttcaattagctctaaattcctatatgctctccggacttttcattcaaaatttcttattttgatattttttttatttctaaattgtatttctatatgctctttaaacttttcttacaatatttattattcttttaattccaaatttcagcaataaattatatttctatatgaattctaacctctatttctattttttttaattcctaattttagttattcctaaaatgtatatcagtatggactctagtttcctattcatatattccttattttttaaatttttcgatttttagctcattttaattgcaattttttaagaactcttttttttcttttttttctcattaatatgagaatttgttggtcgtgagggggcacatgaaggctctttttattattactttaataagttaattaagtcaatagattatgtaataagtggatgtagtttcgtaagtaaatgtcggatttaattccattatgttaaagagaaatactgaatacagcgaaggtatatattaagtagtcccttcgtcccagaattttaagaagttttagggttgaatacgattattaaaaaagtaggtaggagtgagtggtggagggttgtgattggatgagtagtgaaggcaggtgaaaaaagtgaatgatagagggttgtgattggttagtaagagaatgttggtggtgaagttgttatattttggaataaatcctaatagctaagagagccaacaattaatcaagtagtacactcacatgggtccttgcctcctgggcacatatttatcatatccccatcacaaaccaaataactcaaaaaggccccataaattagccccaaaatcccaacaaactatccgccgtacataaacaaagcaaaatctccatcacgcaataattcacttcaccaaatcaccagcgaagccgctgtatatatatagcacctgcaacgagccaggatcgatcaaccacacacacactgacactgtgacacaacacaacacggcggcgcaacaaagctagcttcaacgcccggtcccggcgatggggtccttctcggcggcggaggaga

SEQ ID NO: 4773 - DNA, 1501 bp, Oryza sativa
actggtgattattgcctccatgtgtaccatgcacctgcagcattccagatggccccgatttggccaaacagagatagccactggatagggaggctgttgatgacgccatgaaggattaggatgacggcgcaaatcaccaacacgacatactttgaagccatgtagccgccgccattggctcctcccgtgctaagcaagatgatcacctgtagcagctgcgccagcgagaagtctacgctcgcaatagctgcccactgccacaacagttgaagacaaggacagggcaacaatgcaaatttttttctcgaaaaatgaagttataagctggagctaaaaacagtatctagatccaccagacaatggtagtatacctgtccaacgatattgaacctgtcgaacacacaacacaataacaaattcaggctcgcaaattaagttgaacaacagcatacatgcataatccacagcaacaaatattcaaaatagtaatgatcaaacataatcttcaagaaggcaccatctcaagacaacaattttttttcaaggatatcaagaaaacaattgcacctaaccattttggattagttccagtgcataaagacaggggaaattgatgcagactagctcatacatgtctcacgtaccagccagtgacccaagaagccagggacgcccattccttgccggccagcttggcgctccagtagtagaggccaccggaggtcgggtacgccgagcaaatctcggccatggacagggcgacgcagccgttgaacagcgccaccaccagccaccccagcgtcatcgacaccggcccgccgtagcgcagccccgtgttgtaggtcgccgtgacgcccgtcagcaccgagatgttggcgaacgagaaggcgaaattcgacagggtcctgtgtgtatatatatccagatgaatcgatcaagatggtcttagttttgaaaagaatgaactaattagcacggtgaatgcatgctaagtctgaataaactgaaacttgttgtgtgcatacgagaggccacgcttgagctcctgcttgtagccgagctggagaagccggaggctgtccgggtcgtcggcggcctgatcgccggcggccatcgctaattggacggagcgagacatggccgtggatcagttctctatctcctgtaggctgtttcctgggaggctagctatttttgacgctatcacctccatagctcactaatcctgcagagtatagtttacatgctcgctgtactagtcaacttcccaaaaaagaaatgtccaagtacgtacctctctcttatatataattcataatcaacgaaatggttggaaattttgtataccactgatgattgattgatacgcttatgtcacgattttcctgtagtattgccaactaccgttgactaactgaaggataagatgcaatatatcgctgtataccttatgcgttccaaaaaaaaaactgtataccttaggacttttggttcatgttta

SEQ ID NO: 4774 - DNA, 1501 bp, Oryza sativa
tcactgatcatatcaatcaaggtaagcctgcagttttaactctaaacatatatgctatcaagaaaaaaaaaaggatggatgatatggacacatttgacagaagtaaagctaagcaagatatgggcatcagttctacctataaatatatttcctaatcagaaataccatagacaaaatgcaattttttgttgtccagcaagaaggaaaatactgccatcaacaaatagtattttcacaactaaagaagagggcttttggcactaatttaactagttcaacacatcatggagatttcattggattaacacaaaagggaaattagacatcaaaagatgaaaagccccacatgacacatttgacttttagagttcccattgcaacaaaatagtgaactaaggccgtgtttagtttcccccctattcccaactttccatcacatcataccacatcaaaaactttcctacacacataaacttccaactttttttccaaactcccaactttcttcaaacttccaacttttttcaggaactaaacacaccctaactgaacaataacaccatgcagaagacttatttgaactttgatccttatgtgttatatcagaaatatatgatttaggaccaaggtaatatcatatggaatgatatagtgataaagagtaatgatatcattggaatactaaatatctagaattctagatctggacaatatgaaagcacatcatgacctttggtaatccaccaatgccaagagcaatatcaagcttaagagaaccagtggagatcacaggtgtgcgccttgtgcgggagaaccgctccaaacataaattagattctctatcaaaatcacttgcgagttgagagacagcgacacttagtgtcgactctttctcgagaacttttacaccatcgagtgggggatcagtctcatagtctaattgcacatcaactgaaaagaatcatatcattagaaggaaaaaagaaatgaaatgtttgtacggcagaaactgtgagtattgataataagtggacaaacattgagcatacctgaggttgacatcgaacaactttttgataagaaccaacaaaatctgtcgtttatccaattctagcaaatcacagggaagtaaagatggactgcattacttcgtagttcaaatatttgacacatatatcataaattcaagaaaaataaagcgttccagatcttaatgttttaagagcggcaagctgtgaaccaaacatcacatacattataagtgttttttcattaacaacttgagctgaacatatctgtgttccgtattattgtcagaatggaagaaaaaaaatgaaatccaacgtttgttggaacacttgacagaacacaaaaggcagaaccatactacactgcgcagagctcattttctcctcacacactcacaacccactcactgactcacatcggtacttacgggcaaaaacctggagccgcctaagtgaaacgctaataccctcgc

SEQ ID NO: 4775 - DNA, 1501 bp, Oryza sativa
taacttctaaaaatataaatatgcaactgacaagaaaatgaactacaaaaactataagatctaaatatgaaagttccaaataggatgaataaaagttgtgacatgtcggacaatcaaataaatgagcggcaaaaaagtaaggggtggcgacttattgactttcgaaaactaacccgatgataataagattcaatcttttaagatcggctagatggctatttaacaaaattaaataaaaccatgtttaaaaatagataattttggatgggtgttagccgtgcaacaaataaaggggtgacaaaggagtaaggatagcaacggatgtgaattttaaaaactatgaaattagaaacacatggatgataatgttcgatccttgaaagttctaagacagcgagatgaatattttaataaattttaagtagaatcgtgtgtaaaaatagataattttgtgggtactagccgcgcaattgcgcgggccacctagctagttagctctaaatctaagttcgaaaatttaaagttttacttactgaggacatatccggtgaaaatgagttaaatgttgaaaactcgtgaaaatcatacctaaaagtttcgtaaatttatgaaaaaaataatagagataagtgtagatataaaatacattctcaccaaatttcaactccaaacccaagttcgtttatgagaaaaaaaaagacaaatttcaggtgaacagtgtcctgttactattcacctgaaatttgtcttttttgttactcctaaacgaagttaagtttgaacttgagatttggtgagaatgtatttcatatctacacctatccctagtattttttttatgaatttacaaaacttttaggcatgattttcacgagtttttaatacttagctcatttttaccggatagtccccttacttatgataagcataaatataagccaagatgagactgttaagctctgcaaaacagggcccgtggactgggcgagcacggtgttttcctgttgggccgagccgtcatagagtaatgggccaccgttgcgaggcgacccaatagtgtagcgctgttcggcccagtttttattgccgccctcttctttcccctcgtccggagggcgcggcgggcggcggctatacgcgagtacgcgacggcgggttcttcccctcccgcttgcaacggcttcgcgtgtggcggcgcgttcgaatcctccaccaccggcggcgcctgctcccggcgcggcggcgcccccgcccccttcgcttgcgactgccccgccgcccagccgtgtgcgcttccctgcccagcctccatgcgagctctcgtagcctcctccgctctcctccggagatctgccgcccgtgccaacctctccggcgcgggcttctgtaatggcgcgcctcccgtgtcctctcctctccgccgctttcccctccaggtacgccctcgaatacttccccatctctaaggccctctttccagcttgagatagatttagaagag

SEQ ID NO: 4776 - DNA, 1501 bp, Oryza sativa; identical to SEQ ID NO: 4752

SEQ ID NO: 4777 - DNA, 1501 bp, Oryza sativa; identical to SEQ ID NO: 4754

SEQ ID NO: 4778 - DNA, 1501 bp, Oryza sativa
ctacaattgaggcgaatcaaacgatcggcccattacaattgaaggggtggtcgccatcctcctcatgggccattgcctacagaacgaattgggttgggacacagccgctaggaaaagcctgatctacatgcctatccccaatgcattaaatcaactttacatcccttatgtttccatcgagtttaaatcgcatctctgaaccgcaatacaagaagtctagacccacaacttgtaaaactaacttaaattaggttcttcggcgatatagataggtgatttcgctgataaatataaaaaaatgcatacctaactctaaggctataaatagacccctccaagagaacatatattgtaagtgagtttcaataaatatatttactttctttgtgtacacttagaaaccactgtttgtcctcttagacaacaccatgaaaattcagaaaatgtgcaatattgtatttttatcaatcctaatttcagaaaaatcctttatcaagaaaatgttggaattaatggatgggccttagcccactcgaagattaattctttggaaaatcacaaaagctcacctcatgagatggcatgcgtgtggagtttagtaccaccttgcttattttaggagaaggggaccttcttaaaagggaggatgccctcctagccacttgaagcatgtgtggtggagagaagagggggaacacacgcgcgcgctcgctcgccgggcagggcaggcggcgcgcgtgcacgacgtacgcgtcgaatggtccgcaaaattggctcctcacccttgcgcagatgcagcctccttttgcagttttgttttgctgcaagaaaattcggatttgttttgttgtaggaaacattccgaaaaatccggtgcgtgaaaacggcgtggagtccagataagttacgcgcgacttatccggttcggttacgcggagtggagatcgtgcgggcgccctgatcaagcgacctatctctatataaaccgagccgctgccttcacgcaacacacgtgaaatcaatctagggtttgcctcctcctctgtgttgtgccgtcgctcgtagactactccatcccgatcgtcagcgtgcaccggcaatcgggagagcaggtctccggaacctctgccttcgacgtcctgcaccgggagaaggcggcaataaggtttttgggaagcgctccgcgcgactgctctctgtttgttcgcgacggctcgccttcctctccgctcgcgtgctgcacgccttcgtcgacgctcgcaacagcgagtagttcctgccgagcaaccggtctttccgccacctcggtacgtgttcgacatgttgcgcatatttgatctgttcatgttttactgcttagtttacatgtgtagatctaatgatgtgttactgctagtatacatctgcaatgttatgatttatttatggaatatattaaatcattatatgcctatattctcaacaatccaaaaaccttattataggcgctgtgattttacta

SEQ ID NO: 4779 - DNA, 1501 bp, Oryza sativa; identical to SEQ ID NO: 4755

SEQ ID NO: 4780 - DNA, 458 bp, Oryza sativa
ctgcacccccgaattttagttattttaaattgtattcctacttcaattcttatttttatttttctaacttctgaatttattttactttctattttgaattttaattaatcatgtgttttgttctagattgactatctttttaatatttcttatttttattccgaatttcagttattttgaaattgcattcctacttaaactttttttccttttctaatttaggaatttattatgttttaatctcggtatttcagtttttttaaaattgcattcctacttaaaattttttcttttctaatttcgaattttaattaatctcgtattacgttatatatggaccgttattccaatatccctttgtttaatttcgaatttaagttatttataaattgttttcatacttgaactctccttttcatttttcactgaataatacgagaatttctatcctctacagc

SEQ ID NO: 4781 - DNA, 1501 bp, Oryza sativa
tagtttaaaatttaggtagatgcttcgcaagttaattaggcaacattaggtggttttataactttagacttgggaaatattcatatcacctggacactgtggaattgttggtgaattgtgaaattgggttcaccccgccccctctattcaaaatccccaaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccgtaggcgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatgtggaatggttggcctgggttggcttgggacgagctgggacccagggtcgggttgccagttcggtctgaatcatcataggccttgggttaaggcaggttcgtgtgggttcacggccttgattaataacattgtatagttctaagatagtgtttacaaaatagccctgagcaactaaatgtctttaaatgctgtttactgcaacccgaaccctttatgttataattcccttgtactcccttgcatttattctgcatttgtgggtgtgtcttgttgagtacggtggttgtactcagtcttgctcaattttttcccaagcccagaagaggagctccttgaagatgaaggctttggtgtctagctcgtgcctgccgtcaagcgcctgtggtcgtcgccctagtcttccgctgtttttcgtttgtctctgtgtgtgctgggccttcgctgcccatgtaataagttaactatttacgcttccgcttgttaaactctgatttgtatcaacttttggtgtaccttgcctcctgggacaaggattaatgcacgcacgtcaggaacgcccgttgggttatttctggtcgtgacaagttggtatcagagccatccttgaccctaggacgagccgtagatcccaagccttagcaatattttcaaaaataaaaatcctttgttatttgtgaaaactgtctagtctctctctgtcttgctgcttcacttatcatcaaaatctgacctttgaaatcttgcttttctttttgtttttgtttgtaga

SEQ ID NO: 4782 - DNA, 1501 bp, Oryza sativa
attcgtccgattttgtgcccgcaaagttcgccggcgcaatcaatggtggccgagatctccgcgccggtttccatctcctccggccgctttccctctctcccgacgctatttaattgttccccgtgcctctctcctccgtttccgccgttcgccgctcgctctcaccgtcggaatcgcgctcgcgccgctttcctctctctccgccgtcgccgacgagttccggttcgccgccgccgtcgctccggacttcctcccccctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgcttcggccgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtccccctcccgtcggccgtgccggcgaggctgccttcgggcgcgccctcgcggctgccaagtgggcccggccgtcagccgcccgcgcccgcgggtgcggctgacgcgtgggacccacggcgccggccgccgtcagccgcgtgcgcccggtccaccgtggaccgagaggctgacgcgtgggccccactcccgtggacccggtccgcgcgccctctccctcggctgacgcaataaacccggtttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagtcgaagccgtcggttgggaaagcgagcaaggcaagtcacatcatctttgaatatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagcttaaacaaaacctcaactagtggacactctactcgtggtatccctagtttaaaatttaggtagatgcttcgcaagttaattaggcaacattaggtggttttataactttagacttgggaaatattcatatcacctggacactgtggaattgttggtgaattgtgaaattgggttcaccccgccccctctattcaaaatccccaaaaatggttttaggctgggctcggggtgcatggttttgatggtagcacctcggccatataaggaccggt

SEQ ID NO: 4783 - DNA, 1140 bp, Oryza sativa
ccctaacactactactgtctactcactactgcatagggcaacattgcaaaaagccaacaataaatgtctactgacctttgaactttgtcgggcagcaggagagctggagagggaggggacctgacaccggccgccggcagaatggcgacgtcgcttcaacgcctccctttcttccctttccaaggggtgggggcgaccgccggactgggcacctgggcccaagcgcctaggcagccggcctataggcgcttgccgcctcccgctggcgtaccggcgctgcccgacaggggtgggggactggaggaggcatagaggcggcgccgaggcggaggcggagtcgggtggtgccgaggaggacttgaggagggaggcaggagatggggaggtggcatgccgacgcggaggcaaaggcgggaaccggggaggcgatgtgtcgggaccatcgtgccaagcctaaggtgaaggtggagtcggagtcggagtcgggacgcgaagacaaaggaggcagctgccagccagcaatgcgtgcgactatggctggcggttgtctgtgcctctccctaaccctagcacagctcagggggtgtcctcatgggcaaaattctagggtggtccagggatcacctgaaccgcccattggaactgccactgctagcgacggggcattgaccggaagaatctacttaaataagtagagaaatattttcctaccaactatgcttcaaataaatttttctcttaaattactcatctgatctacgatccgattacactgttgtgttcataacaattaaatctttataacaagatatcacatgattatatttttttaatgaaaacttacataatactttttacaatatatataaattacctttagatttcattaaattacttcttagacgtataaaagtaaattcaataaagctgaaaagtaatttgcatatatagaagtaacttaaaacaaaaggaaagtaacttgtcacgacaatagaagtaaatccgtttgtgggggtaaaaacatgagtctatataaatattaaatttaataagtacaaattatggaattgactaaaaccatttgtcagggttacagttaaggtatactctctacccttggatgtatgccgtatactgata

SEQ ID NO: 4784 - DNA, 1501 bp, Oryza sativa
atctatatccggtctacgggtatcacccgtcgacagtggcgcgccaggtaggggtatttggtactcaaggttctactactatgtcatccagcttcgtcgacaacaacgtcaacaccagcctcagccaagcgctccctgcttcaacaatgctggtatgaactcaagtcggcgaaatcgtcttcccggtttacaccacaacgccaatctcaaccggtcctccaatgaccggaaacgagaacgcagtggctacaaaccaaggcgactccatgtcaaaaaatccacccgtcgaaacggagaacggatcatcgacgacatccaagcacgggaaggattctgatacggccaaaccttgtccttccaacataaaccacgagccggcaaagatgacttccgaagccacaaggtcttggtgtcctatccacaaaaccaagaaacacaccttgcaagattgttgggttttcctcaacgtccgtgttgaaattcgcgcctgcaaagaacgtggaattcagcgtacttctccaactcgggatgtctattgtcctattcacaagacaaataatcacgacctctcgagctacaaagtcttcctcggcgccatgaaagctccgtctcctaagtcatacgtccccgtcagggataacggcaaggaacaaggagcgactccagcctcagatcgattcgttggggtaatcgatatcgatcctcacgaaccatcggtcttacatcttctcgaagactatgggtcatcaacaacgagcgtgccacgggaggtattggctatcgatgacgttggcacgtcagcgcaagccaacgcagaagcggcgaatcaatcgactactccagcccaacacatcagggtcgttcaagctatactgagggaaactccttacgatcccgttctgaacgatgacctcgagcgttggacagaacgactacgggaatcggtgaccaacctcagcaacgcgtttgaagaagccgctaccgcagcgcaccaagatcagccgccaactggcgacgccaatggtgaagatccggaacggagggaatcacctcaacgagccactcctccacctcgcggagctggcgatctctgagatcaaatcaatggccgccgagaagcacgacgcacacgagacaatgtaaatcgctctcggcgtcatgtctcttcacgactccatgataacggaaatcgaggagaccgctcaaacgaggaccgggatcacgacaaccaccacgatcgcaacgatcgcgaacgacgggggccagacaatactggtcatggccgccgccgtaacggcgacgataatggagatcggcaccgagacaacagcgagagacaacgacaggattcccgagatccaggccgttatcctcgtaatcgtacgccagaaccaagcgacccatcgtcatcatcatcatctgcgtcctcctcatcgtcagacagacatccacgaaggacacacgaccgccgacaacccaccgtccccaacgctcggtcgtt

SEQ ID NO: 4785 - DNA, 1501 bp, Oryza sativa
attcgtccgattttgtgctcgcaaagttcgccggcgcaatcaatggcggccgagatctccgcgccggtttccatctcctccggccgctttccctctctcccgacgctatttaattgttccccgtgcctctctcctccgtttccgccgttcgccgctcgctctcaccgtcggaatcgcgctcgcgccgctttcctctctctccgccgtcgccgacgagttccggttcgccgccgccgtcgctccggacttcctcccccctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgcttcggccgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtccccctcccgtcggccgtgccggcgaggctgccttcgggcgcgccctcgcggctgccaagtgggcccggccgtcagccgcccgcgcccgcgggtgcggctgacgcgtgggacccacggcgccggccgccgtcagccgcgtgcgcccggtccaccgtggaccgagaggctgacgcgtgggccccactcccgtggacccggtccgcgcgccctctccctcggctgacgcaataaacccggtttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagtcgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagcttaaacaaaacctcaactagtggacactctactcgtggtatccctagtttaaaatttaggtagatgcttcgcaagttaattaggcaacattaggtggttttataactttagacttgggaaatattcatatcacctggacactgtggaattgttggtgaattgtgaaattgggttcaccccgccccctctattcaaaatccccaaaaatggttttaggctgggctcggggtgcatggttttgatggtagcacctcggccatataaggaccggt

SEQ ID NO: 4786 - DNA, 1501 bp, Oryza sativa
tctctatttaagagagatggcgagttacagagtttgactctaactccaccccctaccatttattacaactccaagtccaactgtagctaaataggactagtatattcgacatctattctaacaaaatgtgtcaaaaatagtaaaaatataattgaaatgtagtaatatatctcataaatccaagagtttgtggctcaaccaatggtggctcctcctcttcaatttgaacttcctcatcaataggatatgcctttttttcacctttgcttcatgtttccaaaaatgtgatgcaatgtctccattccttttcatgtctcactgcaatttacaccacaaaataaagacataaccaacaatttttcactaacactactactgtctactcactactgcatagggcaacattgcaaaaagccaacaataaatgtctactgacctttgaactttgtcgggcagcaggagagctggagagggaggggacctgacaccggccgccggcagaatggcgacgtcgcttcaacgcctccctttcttccctttccaaggggtgggggcgaccgccggactgggcacctgggcccaagcgcctaggcagccggcctataggcgcttgccgcctcccgctggcgtaccggcgctgcccgacaggggtgggggactggaggaggcatagaggcggcgccgaggcggaggcggagtcgggtggtgccgaggaggacttgaggagggaggcaggagatggggaggtggcatgccgacgcggaggcaaaggcgggaaccggggaggcgatgtgtcgggaccatcgtgccaagcctaaggtgaaggtggagtcggagtcggagtcgggacgcgaagacaaaggaggcagctgccagccagcaatgcgtgcgactatggctggcggttgtctgtgcctctccctaaccctagcacagatcagggggtgtcctcatgggcaaaattctagggtggtccagggatcacctgaaccgcccattggaactgccactgctagcgacggggcattgaccggaagaatctacttaaataagtagagaaatattttcctaccaactatgcttcaaataaatttttctcttaaattactcatctgatctacgatccgattacactgttgtgttcataacaattaaatctttataacaagatatcacatgattatatttttttaatgaaaacttacataatactttttacaatatatataaattacctttagatttcattaaattacttcttagacgtataaaagtaaattcaataaagctgaaaagtaatttgcatatatagaagtaacttaaaacaaaaggaaagtaacttgtcacgacaatagaagtaaatccgtttgtgggggtaaaaacatgagtctatataaatattaaatttaataagtacaaattatggaattgactaaaaccatttgtcagggttacagttaaggtatactctctacccttggatgtatgccgtatactgata

SEQ ID NO: 4787 - DNA, 1501 bp, Oryza sativa
ctcagctctgaattacatcaagagaaaaaaagagggaaaagagaaaaagagtttagcaggataccgaatctacctcctgtcctcctgctgctcagtaaatctaaaattctagacagaaagaaaaaagcgagaacaaaatgggggcgagaaggagaagaaatcggatagccggagttgtaggcgctctactcggtgtcggtggcgcgggaccgcttgcttgccttggctgcggcggcagcagaaggggaggtgctgttggtggcattggtgttattggcgctggcagcggcagtgacagagcgggagaaggagccggagagattagcgtagagatcgacgacacgggcgatgttggtgttgagctcccggatgagggcgacgttgcgggtgaggccatcggcgtcgcgggcctcatggttctggctgatctcctggatcagcacacggttctgctccaaaatcccctgcacctcgccaaagttcctctgcagcacctgcaccaccttcccccctcccccaccgctgctcctcgccgtcccccctacccctccgccactgccgttcgcaaccaccacctcctcctccctgccgccgttgctgatgacgctgtcctcctccattatcccctgatttgatcgctcgctcctgcatcaaagaatggaattggaattgaggagaaagattcggggagattgtgagcctaaatcctaccaacagcacacacataaatatactacaaaaaaatcaaattttggcagcaccacctctgcaaaaaggacactagagactagactaaccaaataatcatttcaacataagactaaacaagctcacaggtacagcagccatacacacataaccatgactgacgatcattaatgtttcgcttgcagccaaagctcaaaagacaccagcacttcagccctacttgatttagattatcgagtagattgttgttgcagattatctactctaatataggggtaaatcaaatatttcgagaaataaacttaacatatactgtagcttaaaacaggtggtctacacaatgtggtagaagttttttcagaaaagtgtggagcaaataatatgtttaataatccggtgaataagcttaaatattaactaagcatctaaagtagtgataaggttgcataagtgatatatagtggtctcatatggagctacacccgttccccatgcatatgttggcttcaactattacctaacaaggaaaaacatcaaaacaacaagcatgagtacaggattcagcaaagcatatgaattaaacagtaaacatcacataggaactattctattgccatgttaaacatttatcatactccaaatgcaatgaatagctaactacatgctcatttgctcatgtcattacttatattggtattgcttgggtgaatgccagtcaacattcaccctctttcataacatagaaaagtaggcccatatgcccacacaaggtgggccttcttcataccataga

SEQ ID NO: 4788 - DNA, 1501 bp, Oryza sativa
tttgttttttttttgattgtttgtttaggcggcggaggtgttgatgaggcggtagatcaatgggcgcgatgccggcggtgaaggtggaggaggaggaggaggagcggaatccggtggcgtcgagcccttcggtctcggaggggagcgcgcacgccgccgcgctggcgtcgcccaccgcggcggattccatcttcggtcgcaggtagtgatccccccgcccccgcgccgcggctcaacttaccgtcgctgtgctgttggctgttgggtagtagtgggtggttgtttgtttgcctcgttcggatgcccccgcttgcttggggctatggtccggaactccggacgggggggtcgctgcttgtgctttgcctgggaaagatggggtttttatgcttcgtctcgttcgcagatgcggctgggctgggctgggttggattgcgatcgcagcagctttggcgatcttgagaaatctgtggcctttggatttatttctgattggtgacgtggtccttgtgcagcatgacggctgtttggacaggactgttggttgaccttttaacatgtatcttgccgttgctgctggtctttacagctgtagtcttcgttgaatgaatttttgttccatcacacttttaacacttcaatggtgggaagggttttgcttgctttgttcttttagtactctagttcactgggtaattgtatctagttctgttgttttggaaattggcatgctttcttggttgaggcacggtgaagtcgctttgcagtgattgctaaaatgagtaaagtttatcgtctgtttgttttcaggtgtgtgttttgatcatttaaaccgcaagtatccactatactgtttagcatatctgcggtgtgttattagttagtgcatcatatttcaggcaccctgtttatctaaaatgccattttttatttcgacatttgcttttggattggacatatattcagtatgtggatagtttttttttttaaaaaagaagctgatgcttctgaatgcagaaatcagttttttataagttgttgtgttatttataatgtttcaggaaatctccactaatgccatgaaactatgccatttttagataaatagttataccgattttatagttgagtcatgtcttttggagcctgtaatagctgatttgcagtttctgaatgatgcgtaatgctatattattggatttttcatgtactggaatatgagttgacccatcaagatgactatgtaggagacaaaggttcatccatgagatattccatttgagttattttatgaatttttataaggatgctacttgctgcaaaaaaaaaaaagacgccgatgcaacaggataggaaagttcgacatgttccaagcattcaaatacttccttgcagtttctgggagcttcaaaaactaaaacaccatgtttagatagttttaaaaaatgaaacgccaagtttcaaacccaagtttaataacatgttgacaggtttgacaacc

SEQ ID NO: 4789 - DNA, 1501 bp, Oryza sativa
atctcaaggggataccacatgcaccacttctacctactcttcttttgggtggggacccaccctatcttgaccaaatcttgacacgcacctccgcctggaagctaaatcaacgcctgtccttgagtgatgcccagcgccgtcactcgtcagacacaggggatcaccctgtcatttcttcattaatgggcggagttttgcaatggccgctgtccgaatgaccctccgatgggatgggtcatacctgcctccactccgctggaagctgatgcaacatgagagcacggttgtctgccgatgacgtgaccggcgtcggaccagtgacagaccggtcattcttgtccaccacgtgtcagtttagcatgccacacatctgcccttcttcatacagtgacttccttgcaatggttgcgatgaagcctggcatgaatcgagccgggactgatgtgctaactccaggagttaccacgctggctccagctagggacgagtgccaagaggctctcatcattccgacgggacggggcgaggcgtgtgacagtccgcctgctgccacctaacccgcgatctgaccggtctgtgaccgatcacacactgcgaccggtcacggaccggatatgcgtgcgccgtgctgcattaaatgcggcgtggcgcgcttgtccattccgcaataaatgtggtttggtgagcgccgctgtgcccacctaactcacaaacatggcgccaataccacagggggtcgggggcaccccagccctcggggccgaagcaggagcggcccgacccctcgggaagacaaaggaggggtggccacgtctccctcaggcccgacccccccccccccgagggggttaggccacgtgggtgactgcggctgcccaagcctctagtcatgatacccccgatcccatgtcaccgacagtagcccccggcgttatgccagggcgatcgcccccctcgagggaagcgctcgggcgtgacgccactccttaggtctggtgacaggtgggaccggtctctacaggtgggcaggaacccagcggtcgcaaatcgcgcgcatcggctagggaaaaaacgaccgataataatgagtggcctcttcaagaccgctacatttctcgaaatagcgcgcgaatcgggacgagccggttcatttcgcctggagatatgatgatggcgcttcggtcggcgagcgtagttaacgcgcgcacgatatgtctcatctcgactgccacggccgcacatccgcctcgtgcgccgcaaaagggcgagtgggattagtggaggcgtgggcgcgagaaacgagggggcgagatagtgggcgcgggaaacgaggagccgggaatagcgttggcaagggtataagggcgccaaggaagagattcgtttccttcctctcgccattattccccttgccttcgccgcttgcgccctaactccttgtttcctgtgccctacccttgccgcactcactcgttctcaagttcctcctccgccggcgtca

SEQ ID NO: 4790 - DNA, 1501 bp, Oryza sativa
tgctggtttccatattccacgggggacaatgcttcttgtgaacacatttgatattcacagggatcctcatatatgggatgaaccaacaagcttcatcccagaaaggtactacatatggattcttccaaaaattttatactattgcatgaatgtccatgttatataaagtgtaattacgtacatttatgtttctacagatttgaggatgggcgaagtgaaggaaagatggcaatcccatttggcatggggagacgcaaatgccctgcagagaacttgggcatgcaaatggtaggccttggccttgggacaatgattcagtgctttgagtgggaaagagttggagaggagctggtggacatgactgaaggatctggccttaccatgcccaagaaggtgcctttggaggccttctatcaacctcgtgcttcagtgatgcatcttctttcttaggctttgttagttatagcgcaatatcgaaatgtgttgtgatcgttgatccaactggcatgataaggtattgcttcacaaatgataggattgtttttgttacaaacaagaatgaaagtaagtccatctcttcgtctcaaaagccataaataagaacactcttgtggtggactactcataagaacataagaacagagaacaaactttcaaaaacatgtactctctttgtttcatattataagtcatttgacttttttcctagtcaagtttaaccaagtctatagaaaaatatataagtattttcaacacaaaacaaatatattatcaaaatatattcaatgataaattttttgaaactagctcggtattttaaatattgctaaattgttctataaactttgtcaaacttaactaggaaaaaagccaaacaattaataatatgaaatggagggagtaggaataataaatgaaagtttcaaagattttatcatgcaaaaaacgtgttgcatttgtgattggagagagtactgaatcacaatgcaagctgccctgtaattaactaagtaataaaacaaaaaaaatttgttatggcacacattgtgcacgacaccttttgattagcgaagaaaacaacaactctgctatacatccgacggacgtgtacgaccagcgtacgactcaacggcgaaatacacggtgtaaacccaattgaattagcgatcgttgcagaagttacggacggcagacggccaatgacgtagccgtacgcttggccgacgtagccgtacgctggtcgtacgcgtcggttgaacgtatagcattttcgagaaaaccaagacacacgctttggcacttgcacaattgcaattgggcaattgggcgtcccgtgttatgtttgacgaattagtagtttggtgatccaacttgctagtaccacttgattatacttgagatttccagaagcctgcatttcagcaaagcgatatacaccagtggcggaagcatatatatgtacactgtcactgacatgctcgtcgagttcacctcgccgcca

SEQ ID NO: 4791 - DNA, 1199 bp, Oryza sativa
tactcattactgtggtcaacgcttacgtctgaagatagacaaccacccgagtattatacactctcattaaagcttttaatttgggcttttgtccacattgcgggctaaaagaaatcagcaactctacttttcaactttgtgcttgtaaaaataacaaactttgtgcttgcgttgtttttggttagctcaattctttttatatcaacttcatgtaacacctgaaattccatttacaaataacttatatatatagaaagttagagcaaccatgtgttcagtttgttactagctagtagctaatagcctatgcgttgcaacgaactttctaatagaagaaagggttgtcaatactagtaagtcgattacacatgtaacaccaaaacaatcaacacttctaggatttctatgatttttctattatacaaacattcattagtcacatgtccttgatataatgcaacgagttataattgtatatacaatttatataaaaagacatgactaattaaatgggcttactactaggtgggtggtggtggtagaaccatgaccaccactaccttcttttaatgtagtatagaatttggctcggatttaagttagtcatagatttttagtcctcatgtgaaaaaaaatgcttacaaaccatagactggaattttttgaaacaaaatatgttatttgtgtaaatatcggatagatatattagtggtttttctaacatgtgaaataaaatatatacaatacaatatataatcaacgacacacaaacaattataagttttatctaggatatttccactacatagcaccagccacacccacaacgctagcccttcgctctttttccttgaaggttaaccaaaagaaaaaaaaaacccacatcactccacgcggcaaaaaaaactcacacaaccgcaacacacaagcagcagaggatgcagtgcagtccgttcactgacacgtgggccccacagacccccgggtccacgtgccagtgagcagcactgaagcactggagatgatctccacggcaagcagcagcagcagcgcccgttacctcctccccactgcggccgttttcttacaaatccccccctataaataccccaattcaccaacgcccccttcttcttctccaactccctccccctccaagaagcgaacaagccaagaactcctccaactccgccctccaa

SEQ ID NO: 4792 - DNA, 1501 bp, Oryza sativa
ttggggcggtgagaggaaagctccatgagcgtcaccggggagctcgctgcggaggatgaagacgacgccgacgccgcacgcgaacgatagcgagatcgccgcccgcctcgctcgactgccccgctggccagccggccgctccccgcgccgtcgcctgctccgcccaccgctcgcccggtcctccggcaggccagtacgacgggcgcagctgccgcccgctgtccgaccggccgctccccgcgccgtcgcccgctcctctatctggccgctccgccccgcatcgtgccctctccggcgatctgcttggaggggaggggagagaagctgagaggggatagagagaagtggggaagaagacactaatgtttcgttgacatgtggggcccacatgggtcccatgctgactcagcagtcacgtagaataaaaccgagatcaaaaccgccgagggatatattgtgaccggttttgtgtagttgagggaccccgcgtatctggttttgtggttggaggacgattttgtatcccgataacaagttaagggacctttagtgtactttttccaggaaggaaaggcagggccggctctgtcacttccaacgcttggcccaagaggacagaaactacaaaaagaacagagcctgcacttccaggagagatcgatcgattgatcaaaccttttgttcccctttcctctggccccagaactctgttcgtccctagtagcattccctctttctcgggcgttttgatgaacgaaagaaacaatctggactcactagaactctctctctggttgcagttatctactagctttcccaaacttcaagtctcaaaaagcaaaggccgaactttaggtcacatgacctgcaccaaaaaggtggctgactgggctttctcctgtatcaaagcagatcagctccccaagttcttcgatcatcggcgaacggcaaacgtagggatgcaagtggtttgtcccgctacccacataaaaacccgcttgctagtttatttctcgcatgataatacaaaatttagaagaaaaaataaaatagaagtgggataaacgggataaaaaaaacccactaggcatccctgtgcaaacgggacaaaaaacccactaggcaccttgtcgatcttcttcctccctaccttctttcttcatgtaccttctagaagcttctagcatcttccaccacttgtatttccttagtacatcatcttttccacctttatttactgagttcggttgctattgcactgggtaggagttcgtccacaccagcctgcggtgtcaggccgatgcagtgggtagctaggagctcgtccgcaccgtcgtcccgtaccgggagttgctggccaccaccgccgccgccgtgtcgcactgcgcgctagtcttattttttgaatgtgttaatttgatccataccactgcaattttacctattcagaaaaataccattataattcgcctattcgtaaccgtgtcattccaattttact

SEQ ID NO: 4793 - DNA, 1501 bp, Oryza sativa
ctatcagcatgagttttagatatcagtagtaggtgtgcacggttttatgaaatcttatacctggtgcttggtgaggcggcggcggatggcgcgggtcttcttggggcggaggtcgagggggaggaggctcttcttcttgtacgcctcacgcagcgccgccctctggttctgcgagatcaccgtcagcacccgcgcgatcgacgtgcgcaccaccttgctgcaaaaccacagagattcaatcaatcacaagggcacacagaaagaggagagaatgagcgcgagcgcgagcgcgaagcgcgtacatcttggagagcttgttgggggcgccgccggtgaccttggcgacgcggaggaggagagcatccgccttaaggtccttgagctgggcctgcagctccgccttgttcttcccccgtagctcgtcgaccttgatccgggttgcaccacacacgcacggttagatccgcaggcgagcgggaggagagaagaacggaatgttgtagcttacccatggcgacgaaggcggcacgccggacgacggcggcggcgacgacgtcgccggtgctaggaagggaaaaaggtgagaaggcggcggcgaaggcttatatatagaggagagagagacagcgagacgccgcggagtggaaaaaaaccctaggctgagttgagatgggctttcatgggccttgttgggctttatgatagatggctgggcccattgactgtttaaggtgagttgaaatgggcttcccataaggattcgaggatttggatttgtcggttttgatgttaacagctcggagatgacagtttaatgcaaaatttaagttttagcttgagtttttatatacttgaccggattttagtgaacttttagcttgagccggagcaataaagctgatgatacctgtggttttcgagcagttatcatcggttttgtgaatgtcgtatttcacgactatgctcgcactatcagaattgtactattgaagtacttacttgacaaatgaattgtggagatcatggataccccatacatacacggcatgtatagtttgactgggtatggagtgctatatatagatagaatatctttaaaatgacttgggttaaattctaaacttgtatgtcaaggtaatacccaagatcctagtcggttacgattgtattttatttgtaactacctattccgttagggatatggactgtattttgtaatacggaccccttcttttatataagaaagggtccaggtgcctctaggggcacgttttttcacccagatcatacgatcaataatatactcggcagatcaatccccggacatgagtagggtactacttcttgattaaaaaggcctgaacctgtataaaattccttgtctcttaaaccatccacttttccagtttgatagccaccccctttagtattgtcgaaatcttgttttgacagttggcgcgccaagtaggggtagtgtcaagtacttcgccgactaatgcga

SEQ ID NO: 4794 - DNA, 1478 bp, Oryza sativa
ctgagaggctggagtatgatgccgacttctctggtgctaagctggatcggggtagaggccggatcccgcctagatctacggggagaagatgcccttgtggtgaagacagcagccaaatcatcggggagtttcatcaggattggcggataggccccatcgtcttgatcgagtcgtgttggagtagattggatctcgttcgagtggtttgaagccgactcggtggagacgatcttggggtagatcttggccgagtttgggataccgaacggggcggagatctggcttcttcccgactggttcgaatccgagtcgaggagagaaatcttgacgaggtcgttggtgatgaagtcgaggctgccgaaccggaacgcctgcctaggagggaagacgaagtcgtcgatgtcggaaacgaaacccatcgcattagtcggcgaagtacttgacactacccctacttggcgcgccaactgtcaaaacaagatttcgacaatactaaagggggtggctatcaaactggaaaagtggatggtttaagagacaaggaattttatacaggttcaggcctttttaatcaagaagtagtaccctactcatgtccggggattgatctgccgagtatattattgatcgtatgatctgggtgaaaaaacgtgcccctagaggcacctggaccctttcttatataaaagaaggggtccgtattacaaaatacagtccatatccctaacggaataggtagttacaaataaaatacaatcgtaaccgactaggatcttgggtattaccttgacatacaagtttagaatttaacccaagtcattttaaagatattctatctatatatagcactccatacccagtcaaactatacatgccgtgtatgtatggggtatccatgatctccacaattcatttgtcaagtaagtacttcaatagtacaattctgatagtgcgagcatagtcgtgaaatacgacattcacaaaaccgatgataactgctcgaaaaccacaggtatcatcagctttattgctccggctcaagctaaaagttcactaaaatccggtcaagtatataaaaactcaagctaaaacttaaattttgcattaaactgtcatctccgagctgttaacatcaaaaccgacaaatccaaatcctcgaatccttatgggaagcccatttcaactcaccttaaacagtcaatgggcccagccatctatcataaagcccaacaaggcccatgaaagcccatctcaactcagcctagggtttttttccactccgcggcgtctcgctgtctctctctcctctatatataagccttcgccgccgccttctcacctttttcccttcctagcaccggcgacgtcgtcgccgccgccgtcgtccggcgtgccgccttcgtcgccatgggtaagctacaacattccgttcttctctcctcccgctcgcctgcggatctaaccgtgcgtgtgtggtg

SEQ ID NO: 4795 - DNA, 1501 bp, Oryza sativa
tcacggcttcgcggagcgagttcatggagacgggtgatccgccgccgctacacaaaatcaatcaataataacagcagcaactctttgtgatcaacacccaatcattcttccacgaatccaacgagaaatggtagatgggatgggagaaattaaggagactcacgacgattcgaagagcaccttccccaccctggccacgacgctcagcttcacctcctcctcctcctcaggcacatcgcccgccttcgccctccaagccgcggcgaggaggtccggcaagaacctctcggtgacggtggatgcggcggccgccgcggagcagggggaggaggcttcggcggcggaggaggagacgagggcgaggggcttggcgccggtcctgcgctcgatggggtcgcaggggaagggctcgaggcggagcgacccgtcgtcgtcgccgtcgtcgtcggggaagggcgggagcgtggaccagcgggagacgcagccggcggcgtggacgatcttgctggaagggcgggtggtggcgccgcggtggtggcggccgcgtggggaggaggagagggagagcgagcggagggaggaggagagggagggaggaggaggggccggggtcggggcgggcgtggaggcgttggagtggcgcttgtgcggcgggaggtaggccatggccgccggcgacgaggttttggaaagttggtcagtggcgactgccaatcaagtggagaagtggagacggctgaaggcaggagaataaacaattccgtagggttttatttaggatttttttcccctactttaaaatagagaaacaattagatacatatttttggaataaatttcacaaaacctacgtatatatcgtatatattttgactaaactatcacgaaactacatatttaatactccctccgtttcaggatataacacgaaactacatatttaatactccctccgtttcaggatataagactttctagcattgctcatattcatatagatgttatgtctgaattcattaacataaactctctccgtttctaaatatttgacgtcattgacttttttaaatatatttgacagttcatcttattcaaaaaatttaagtaattattaattctttttctatcatttgattcattgttaaatatacttttatgtatacatgtagttttacatatttcacaaaagtttttaaataagacgaatggtcaaacatgagctaaaaagtcaacggtgttaaatatttagaaacggagggtgtcggtgacatgggatcgggggtatcatgactagaggcttgggcagccgcagtcacccacgtggcctgaccccctcggggggggggggggtcgggcccgagggagacgtggccaccccctcctctgtcttcccgaggggtcgggccgctcctgcttcggccccgagggctggggcgccccgaccccctgtggtattggcgccatgtttgtaagttaggtgggcacagcggcgctcaccaaa

SEQ ID NO: 4796 - DNA, 1501 bp, Oryza sativa
gtcaaacgtttaacacctacatgaagtattaaatataggctaaaaaataactaattacgcagattgcgactaatttgtgaaacgaatcttttaagcctaattgctctatgttttgaaaatttggtgctaaagtaaacatgtgctaatgacgggttaattaagcttaataaattcgtctttactgacggattctataattagtttttttattagtgctgaatattccatgcaacactctatataatatcacatgtgacacgccaaaactttgcactcctgtaccaacaccaccaaaaacaccccctaagttgatgtttgtaaaatttacctacccgctaccaacaaaccatacatgcaaccaagaaaacacggaaaaaggagagcgaagggcagtatggtaaattgacgttccccacgggacagggtcagcaagacatgcgtggcgcgtccggggagaacacccgcactgccagctaagcacgtccacctcatgtgggcagtgggccccactcagggtaggctcgggtcgtcaccttcacgtcggccgtggagtggagatcccgacggaatattccctccgcatccacgtggcaagccctgccccctgactaagcggcctccgtggatttaatcgaccacatttcaacttttcaactttcactctgtagaactgaaaagattaatagagcagagtacatttcagagtattgagagattagcctcttggcttactaaaaagataattaacgtacgattaatgttaaaacttctataatacaaacttaaatattgcatttacttgctaaaaaagcacttctatacataaagctcttttaaaaattgcaccgtttaacggcttgcaagcatgcacgtcataatatagtagctagttctctgtaatctactagtatttgtgttagggtaaatataaaattttggagtaattttatgagtattaaacttatttctacgaaaatcatgtattatttgtgttgctaaatgtgtccttttggccgtatgttcacaagtgatctccattactttagtgttttaatggagataaggtttggatggcataacacaatattccactatgaaagtgagccataggtaggattaagtactgtttaagtgcccaagccaaacgttaacaccatcaccaacaaaataattaggtaggtgaaccgctgctttccgtttaggattaagagcaacacgacgcagattgaattataaacagcagcgtttatattaccggtgtaatgcccatgttggcccctagcatttaccttaatctcaatactgccacctctactaaccacaaccccatcttttgtcttattcgagtttgcaaacgaaaaataatttataaatataacttttacatacgtcttcataatgatctaaaagcaaaagctgataaataaattacgatgaaaaaaaaatcaaaatcaactctaaatttaaggttaaaaatttaaaatttaactgataaaatata

SEQ ID NO: 4797 - DNA, 1501 bp, Oryza sativa
ggtggtggtggtggtggtggtggtggttgttgttgcagcagaagcaagcagcagcccagcatgtgagctgagtggccaaggcataaatgttgatgagaggagaagatgtgtgagaaagagagccaatattgccaagggggttaccctacccctcttgtgaacccctaaactaaagagttgagaaaagtagatggggttgcacattgcacacctgtcctacttaatgcagatcaccatccacctgtgagtgtgtgtgtaatgcatcaatccacgtttgtttatcatttcatcctctctgatgatcagatgattcttcactcagtcacatctatgctttggggtcacaggttaatcaacggatgatggcacaccacacactacctagctaccactcctacttggtactcccattggatcaaatcaccgccacattgtttcatcttttcctcctctgatttgatctgcacttccaactcaaacctaactgagtttgtacttggtgaaccctctgatgagcctgcaaccaccactacaccccatgcctactgcctgctggactcagatgtcacatggcacaaaaaccatagaattgaactgaattattaacctcacatgtttcccttttcacacacttgtcaattgtgagctttgtatgtatgttcaaacatgagtaaataacatggttgtgctgaagatgaagctagggggtcaaatgttgcattgtgtctcaagatcccaaaacaagaattgttatagttatcctttatggcagtaagtactactagtaagtactagtaactaagcttagatttggtctgaagagatgtgccaaggaccaacaaggagagggagtaaagcatccaatggaacagttaaattggatgctattggctcacttaacacccccacaattaaatcttggcatgtgcagtaaaaattgtttgaccgtactgctgtttgtggcaatggtaacttggcaggataggagaagataaaaaggagattagactggatagatcttgcttaggactagtagtagtactggctagtccaggaagagtgattggtctatgttagatcgggattcagtagttattgattgggaattatatattgtcctcatggaccaagccagccagagtaatattttttttccttcctttttttgttcagagtccttgccctaggatatggttggtttgtagtaggatgcaagcaatgtaggtcagttcaaatttaagaaaatggatgaggctatctctttaggtgtcctttgggtgtcagatttcctgaagtttttgcgggaatttaaataattcatctgaaaattctgtaaaatttaactactccgtagtgtccaatccccaagcagtcaagcaacagcttactgtatttatttgtggatatttatgtatttgattatgtaaccttctttttgctaatcctaagtagtattaaccaattacaaaccttctgaaatagaatatttgattacttggat

SEQ ID NO: 4798 - DNA, 1501 bp, Oryza sativa
caagctgccgtgtgtcttcacgattaattcttgaacttgatctcttttagataaagttttcattggctgattgtattctttacatatccaaatccgctaaagaatattactaaatttggtgttaacagttgtattcgattttgcggttcggagacgacatttaaactcagcgacaaatggagggacctaaaagtgaacttaacctaaaaagatgacatgtaggtgacataccaggcccaaggcccgagcctcaaaggccccttttcatgtaggaataagtctgttttgcctccctctactcatgcccctagttgaatcactccctgagcggtttcgtaggcggtttcatcagatgtgatagttgattcgctgagtcataggtgggacgcatttgtcggcagcctccacctcatctctctctctctctctctctcatctcttcctcttctctcgtcttccataagcacagaggcagggcggcaacaacggctgtgcggggggaggaccttgccaactgtgctgcgggcggggggaggtgctcgccggccggagcgccgtgcgcgggggaggcgctcgctcgccggccagagcgccgtgcgcgggggaggacctcgccggctggccgcgctgcgcgcagggtaggacctctctgggccaatatgtatttttattgttttgctcactgacatgtgggtcctatttatgtttgttttatttttatgccacacaagcaccacgttgatgccacattggatgaagacaagtcaacccgccatataagcggcacataggacaaaaccgcctccaaaaccgtccggggagttgatttgcaaacggtttcgagagttaggggatgtcttatacctggttttgcggttgaggggtgtgattcaatcaggggcatgagttgaggaaggaaaaatggacttattccttttctgcacctaaaaaaaatggaaccaagaaaaggaaaaagttcactttgggtccctcaaatttgtcaccgagttcaaaattcatgcctagaccacaaaactggatataatgcatcccccaacttacaaaaccaatgctaacgaggtccatcggcaacattatctccggttttggctgatgtggcacctacgtgactcctttgattaggtcttcgtttcacgtggcattgacgtgacgcttacgtggcaattgaatcccaaaaaataataaaaccagtgggcccacatgtcatcctcactacccttgtctttctatcctctctccgccctttctctctatccgctctctctttctctccccgatcagtggaatagggtgggtagtggctggagcaggcgacgggcaggacgggcagtggctagagcagcagtgggcggagtaggctggcaaagcggagcgggatgtcaacggggcggggcagaggggaggagtggggcgacaggtggtgacgggacagagcacaggggcggagcgaggcagtggcacggagcgggcggagcggcga

SEQ ID NO: 4799 - DNA, 1501 bp, Oryza sativa
tggacctcgttagcattggttttgtaagttgggggatgcattatatccagttttgtggtctaggcatgaattttgaactcggtgacaaatttgagggacccaaagtgaactttttccttttcttggttccattttttttaggtgcagaaaaggaataagtccatttttccttcctcaactcatgcccctgattgaatcacacccctcaaccgcaaaaccaggtataagacatcccctaactctcgaaaccgtttgcaaatcaactccccggacggttttggaggcggttttgtcctatgtgccgcttatatggcgggttgacttgtcttcatccaatgtggcatcaacgtggtgcttgtgtggcataaaaataaaacaaacataaataggacccacatgtcagtgagcaaaacaataaaaatacatattggcccagagaggtcctaccctgcgcgcagcgcggccagccggcgaggtcctcccccgcgcacggcgctctggccggcgagcgagcgcctcccccgcgcacggcgctccggccggcgagcacctccccccgcccgcagcacagttggcaaggtcctccccccgcacagccgttgttgccgccctgcctctgtgcttatggaagacgagagaagaggaagagatgagagagagagagagagagagatgaggtggaggctgccgacaaatgcgtcccacctatgactcagcgaatcaactatcacatctgatgaaaccgcctacgaaaccgctcagggagtgattcaactaggggcatgagtagagggaggcaaaacagacttattcctacatgaaaaggggcctttgaggctcgggccttgggcctggtatgtcacctacatgtcatctttttaggttaagttcacttttaggtccctccatttgtcgctgagtttaaatgtcgtctccgaaccgcaaaatcgaatacaactgttaacaccaaatttagtaatattctttagcggatttggatatgtaaagaatacaatcagccaatgaaaactttatctaaaagagatcaagttcaagaattaatcgtgaagacacacggcagcttgatttatctattaattaggcagggcttactaattttccttttaatatttaagaaagtgtgtttagtgtcgaatcaggactctaaacagcctatgggcataaatatgtacactggggttattgtaaactatctctcgatcaatacaacttttggcacatcaccaccctctgttccgaggtttttatcaccggctgcatcgtttcgatctccggcgaagggataagtcctaagttccactggctctgttatcggttatattggtgttgttcaagactgcatcgcttcaatatcttggattgctatagttcaattggtatatttgcttacccgatatttcaattctatctttagttgcatcgtgtcagggttatgggtaaggtataccctctacccttcgatatatgtcacatatcgata

SEQ ID NO: 4800 - DNA, 1501 bp, Oryza sativa
cagaacatttcacaggagaaatattggatgtttaccttctttctaagatagaatttcaggatcaagaataaatttcgggacgcgcctatggatcggtcgcccaatcgatttggaaaaaaaatcaggcgcactgatttttctcttaaattatttatctaaatcatgatccgattgcaccattaaatttgttgtaattaaatcttcaaaacaagaccacacatgaatatattccgacaaaaaaaattagcttattattgaattatttttaaatgttgcacgatgttccaccaagtatatcagaattgttccactaagtagatcgaaaatgtttcactcgtttaaattgggtgttgtttcaccttatataaaaacaatatttcagcaaatagcgaaagaatgtttcagttcactacaacattaaatctatacatagtgaaacattgtgagtacactaggtgaaacattttttggtgaaacaaaaaataaaccaaattcccttaatagggggtttccaaaatatgtgggttttttttgttgcaatggaatgtttcgttcactgtattagatctataaatagtgaaacattgtgagtacactaggtgaaatatttttggtagaataaaaaataaaccaaatttccttaatagagagtttccaaaatatgtgggttttttgttgaaaaagagtattttaattcactgcaacattatatttataaatagtgaaacattgtaattatactagatgaaacatcttttgtggaaaaaaggagagagaagtgggtgggcccacacgtggggggaggggcgcgcgaggggagcgcccaatccggctccccccgcgccgggcgaccgacgtgaatcattctcgtaaatttcggttgtcttcacaaaaagtccacgtgtcaagaaacaagccagtgcaaaaattaacttacgctttgcatcaatatcgatgaactaaatacaatgtgagcgtagcttaacttgttaggtttcttgtggtggaatcagctcatgaacttaacatggatgttcacatttatgactaattattttttcattgatagacaacatactcgtcgattgcgagacaattacagtgacgttggccagtttttcggaggtgctaatagggacgagtgtgcgcgtattgagagtatatgcgtttgtgctatgtctctaaaaaattcaaggaactaaatgtcaacgtaatcattcgacaaagtttgtcattctatatgaaaacctaaatggattgactatacaacatgtgagaaaatccaccccacaattttcgtttttttatcgttacatctgctttaatattcgtgtaattctttgaccataactctctcctattcctcctatttcccttcatgcaccaccacttctctttaatcgatcagtcagcctcatcctcctcccgatccgccactgcccaccacgtcactacccagccttgctagcatcggaaacgagtcaatcgtgccaacgaggtc

SEQ ID NO: 4801 - DNA, 1501 bp, Oryza sativa
aagcaaaaggaagaggagtcggtaaactagtgttttcatttaaaattgatcgaggcgttgggcgatcaaaattgtgctagtttatttatagctttgtcgtactattaagaggggtaatgacctagcaaagagataattttaattgtcacattaggtcattatgcatctaggcttgtgctcacatttcacaacacacaccttttcactgagttcggcctgaccagggccggtctgaccgcttgctccaagccggtctgaccacaggtcagaggccagtctgaccagccacctagtggcggtctgaccggcgtaactggtcggtctgactggcggcacttgtgcggtcagaccgccccctggtggccgggatggtgttgctctggtttgggcgatacagagccgacggagccgtattcgatcagactgagctgagggtggtctgaccgagccgaggccggtctaaccggccactcaacgtcggtttgaccggccagggcaatggggcccaatgtcaggcctacaacggctagaaaactagccatagagtagcactgtctgaccggccatacacctcaggtcagaccggcagtgcactgagttgggggatgtcgcccccaacagctagttttggtgggtgggagtataaatactcttggcacccaattcaattgtatacaccccttgcacctctctcacacacatttgagcttagtgttcatccattgtagtggttgaggttgttatagccaagagtcaagtgcattgctttccacatttctcatgagaagcttaagaaagctcatgacaaccttctttccactactcaacatggagctcacattgatgttggcatatcttgtgatttgcttgatgatagtgcttcttgtcatattcctcatgttgcatcatctagcatttctacctcttgtgatgatcttatagatatgcctagctctaggtcttgtgtttctatttgtgatgtctcacttgttgttgagaacaatgagcttaaggagcaagtggccaagctcaacaagagtttggagagatgcttcaaggataagaacactcttgacaagattttgagtgaacaatggtgcatccttaacaaggagggacttggattcatttcaaagaagggtaagaaaccttctcaccatgccactcgttttgtcaagagcaatggtaagtattgctccaagtgtcgtgaggttgggcatttgatgaatgatggccccggtggtaagccttctaagacatgcatgtttgattctcattatatgtttaggaagactcatgatggtagtattgttgctagatatgtgggttcccctatacttggtggtaaaaagaatgccatttgggtgcccaaagctttggtctctaacctccaaggacccaaacaagtttgggtacctaaaagagtttgatcttcttttgtaggtgaactaccacaccggtgggagctattgggtgcttaatagtggatgcactcaacaca

SEQ ID NO: 4802 - DNA, 1501 bp, Oryza sativa
gccgcgtctccccatcacctccaccgccgggatgtgctgggaggagtgggagggaggtggggagggggtcggaagcttggtgaggtctcgcatcttaccgccgctgcatcgatgcaatcgatttgggaatgggagagaaacacgagagaaagagtgagagacgggcaggagataagatttttgcaatgtgaggtgtgaacgagaggaggagaagtcgctgtccacctaggcccacaaatgatatgatagacttgaagttttcttgttttctgtggaggaatcgcttctttgtgggacaaatcctcccctccagaaatcgcctctttctgggacggagggagtacgggcatggtctattttgtaaataaatctcctctccctacttgttgctaaacgccttcttcttgtcacgctaaccgtcaggtgaactacaacactatatacgtgcattcccaactggccaacgacctatacccgtcgggcccactaaaggcgaactccttgcatgcttattcaacgatgtctttctccttgcaacgtgtcgacaaaaccaccagttcctcctccactcaaatatgctttgccactcaagaaaaggaggggaggtggatgacgatgtatcgttcgcgtgttcatcgccatgaccggagcgagcagcattccattggctttccccttatgccggtggaagaggaggggaagcctcgttaacataggctatgttctttggacaacttttccaactttactctctcgcgctaacactttttaaactattaaatggtacttttttacaaaaagtttatacatgaaagtttttttaaaaaatcatattaatcaattttcaagtttttttaaactaatacttaattaatcatatattaattaggtatctcattttctgtgtgaaggaaattagttctcaacacaagcaaatgaacacagccatggttgttaatagaaaaacaaattggctgtgccaactatccctatccgaaaccatggttttatcgaatcttatactaccaaactatggtttcagtacatgctattgacgtatgcttttctattttgtattgtataaaagtttttttttaaaaaaaccgagcctatgttttgagtccaactcgttcccgatcccgtgtgcccaatccacctgaagccctgaaccgtccatcaataaatcggacggaccacaaccacagcctctcgttgcccccagaccccccacgccccgtcccggtctcgtgcgaacaagaaacggacacacacacacatctcctcgtcgtgccatcgtgtgacgacgtctcgtctcgtctccctctcccgacccgacacccgagtcttcttcccttccccaatctcgcccttcctcctcctccgatcgatccagcccccgcccctccccgcccctcgccgcgcgcgcgaaggagagagagagagagagggagagagggagggagatcgcctcgccgccgcggcgtgggatccggaggtggtg

SEQ ID NO: 4803 - DNA, 1501 bp, Oryza sativa
tccgcagccggtggtggaacagcaccgccctcttgaggaacccgatctgcctcgacgcggcgtccagcctcgcggcggtgccagcgccgacagcggccccgaacgcgtcgagcaccctggcgccgcgctccctggcgtcgtccatggaggcggcggcccacagctcgcgcatcatggtctcgacccagtacccgcggtcgccccgtgctgcaccgtcgactgcggcggcggcggcgacctcgggtgcgggcgcggcttgcggtgccggaggctcgggagaagcggcggaggaggcggcggcgtcatcgccgtcgaggttgaggttgagcatgcggtcgatcaccgcgttgaagtccctctcgcattgctccagcgcgagagccctcgccgcctcgtcgtcgccgggaggaggagaagccatgcgcgcgccgcacgagagacgagagacgacgcggccgcggccttcgcctgccatatgaagaggcgaaggcttctcctcgcatcggattcggagtcgtgtactccgtttccgtctgtgacgctggcggtgataaaacaccgccatgtatttctgtcaacggaaaaaacgtgggccgtcacatacatcggcccattaaccacgtctacgaacccgcacgcggctcccctactgatcctcgccgatggccgtcgcatgcctatcgtcctccgccgccgccgaaacctctcctcgtcgatcccatcttcctccattgttgtgcacggcgttcgctcgtcatacagtgcccgaagccgaaccatccgctgctcctccacctacacaggtagattgatgcgtggcagtgaaagtgaggcagtaaagtagcgatgtgtgtgtggtggcctggtgggtttgtttatgggttggcggactggccgcgaatagcccagcagatagtttgtgggtttgcaggctgcaacaaacactgctaacagcaagggtaataatagagcccacttcctaatattagcccatctcaaagccaatatatataatagattagctataaaattggctacaattttctttttatctctctatctctcacttatatatttaatgcatttgtcttggaccttatgataagctagctcttgcatgagagccagtatccttaatttttcaatatctctcttctatacctgagcttacagtaggcttatagctcactattatacttgctctaatgggttgcgggctgctgcaactcgccccgcctgcatggttaggtgtgatactttcgccgtatcatggtggtctgattatgatatatccatgacaagacatcatgataagtcgtagtatcataatatttgaatgtgacattggtttctggaggtggaatcgtcgaagtattatgatgatatcttgtatcatcgatgtttcatgtagatagtactccctccgttctagaaagaagcaattcctggatccctgatgcaaatttagtactaatgtaaaatgatgaaaataccctccgtg

SEQ ID NO: 4804 - DNA, 1501 bp, Oryza sativa
gcaatgggttaaaagatacaggctggctaaggaactggactgatcccacaagagcagttaaaagaacttgactaccctaaccagagcaaacgtggaaacagcagaggcaacatttgcctccagctttaattttgtagcaaaggtgaagcaaacgagatggcataatgctaaaaattggatattgctaacagataaattatgccatgtaacttaaatatacaaggcgtaataattgaaagccatgatgaaagggcactctacaaaaccaactgcctagaggaacagtgtggtaatcaatctccctagatacaaaatgcatggaattctatgtccagcagttttcgcgtattgttggcatttttacggatctcattactgtcaaaatcaatgggacacttgcaagatggcatccgattagtcctagaaagaaacctatctgataatctaagtcaattcatgttattaactagtactggcactcaagtaatccgcccgaggaagtacttatgatgtacatatcagcagctctgaacaatttcatgtgctcatatcaaaatatcccctatccgcactaacagaaaaaaacatcactcgagctattcagccaaaccctaaatcgcatcagcaagccgcccaatcacgaaatcgacagccaggcggtcgagaacgaaatcagatgagaaagaagcaagaatcgggcacctgatgaggttcttggaggtgatcctgggggccttgatggcggccccgatgaggctgctccccgtgatgaagatccccctgcaagcaaaaagagcaccaacgcgcgatgaggacggcgcgcgaaccgggggctttcgcagatccggcgacgcagatcgatcgagcgagcgaggggttgggggggaactcaccaggcggcgccgaggacggagacgccgatggagacggctatgccgatggcggagaaggtgtagggcgagatctgcacgagcgcgcgcgcccacgacgacgaatcagacgacatcctcgctacaccacctccggatcccacgccgcggcggcgaggcgatctccctccctctctccctctctctctctctctccttcgcgcgcgcggcgaggggcggggaggggcgggggctggatcgatcggaggaggaggaagggcgagattggggaagggaagaagactcgggtgtcgggtcgggagagggagacgagacgagacgtcgtcacacgatggcacgacgaggagatgtgtgtgtgtgtccgtttcttgttcgcacgagaccgggacggggcgtggggggtctgggggcaacgagaggctgtggttgtggtccgtccgatttattgatggacggttcagggcttcaggtggattgggcacacgggatcgggaacgagttggactcaaaacataggctcggtttttttaaaaaaaaacttttatacaatacaaaatagaaaagcatacgtcaatagcatgtactgaaaccatagtttggtagtataagat

SEQ ID NO: 4805 - DNA, 1501 bp, Oryza sativa
tttagaattattatttattttgtttgtgatttgctttattatcaaaaaatattttatgtatgattatcttttttttatatttgcactaattttttaaataaaacgaatggtcaaatgttataagaaaaagttaaaacgacatccactgtgggacggaggtagtagtgtggtcgatctgagtctcatgatgattgagaaaaatgcccatggcaaaaggaggttgtgaagattaacaaggcttgtgcccattcagctgacggctaaaagcgtgtgctttttctaatttttactctaacaacagctcatctactaccctactactactcatggatgcaggtccacctacatacgtactaccacaaggcttatgttatgtgtatgtactttggtcgcatcgatcggaagaataacgaatcaagaagcattcacgtgccacatcaacttgatcacgaactttgaatacaaattgaactatccaattatcatccatcaccaactctccataattactgatttggatacacgagaaagatataaatattctggtaaaaatatatactccttttttttcctaaaagtactccacgtatttgatagtaggaattttagcatcaaaattgcttcgttttcactctggaaggcataaacataacgttcttcatgattacagttggtgaaactgtactgcttgccactaagcatcagcggcagtataattgctactcacatgagtttggttgaaattgaaacgatatgacggaaaagttaaaagtttgtatgtgtagaaaagttttgatgtgatagaaaaattagaagtttgaagaaaaatttagaactaaacacggcgtacatggagaggaagcgagtcagtgactgttttcaagtgcacatgaaaacagcagcgtcccaagtgaagtgtagtgtgtacacccaaccaaaaacccaacctctcctcaccgaaagcaaccaaaccaaaaacccctcctcctccatgctttcctcgccttgattaatcccgtgctccggcgagctaattaaccctacaaattaataattactacctcgctttgagcagttgacctgtgtgcttctttgtggattaaactctcgtcgttagcgatggatcattccgccgccgccatggcgaacaagccgtcgctcgccgtcgcggcggcgtcgcggcagaggtgggcgctggccacctcgctctgcgcgctcctctgcctctccctcgtcgtctccgccggcctcctcctcctcggctcgacgcgcccgttccgccggccgctcttcgcggcgccgcagcagcagcgggaggtggtcggggaggcgccgtgggagaggtacgtcaagctggcgcaagcggcgtcgccgggcggtgcccgtgatcgcgcgcctgatcttggcggggatgagggggcggagggggacgacgatgatgccatcagcaccgcaccggcgccggcgccttcgccggccgccgaggagggaggagatgagg

SEQ ID NO: 4806 - DNA, 1501 bp, Oryza sativa
cagctactctaggagcatggtatagtttgtgcaatccatcattcaagcaggatatatgaaacaaaaaattttgacatggaaattaaatgacatttcattattttcatccagcgctgcatggagatatgctttcgcagaacctagtgttaccaagacaaacaccatttagtgttccgtttcgcaggtagaatatccaggatttcagacatggctatcacaagaatttaagatgtgccaattatcaacacataaaccagggctatcggagcagcgttcatatgtatccatgccataattgtcatattagttcaacatccaaacgtgagctagaaaggagcacataaagcactggacactttccatcatcctagttgagcataccaaatcataaattgccacattgcgtcaaaatacatatcccaaggaggggtaagatagtaagatagtactgaaggatccatggcttgagtaaggaaaaaaaatgcacaaatgtaatttcgacaatttttgttcccaaactcgcatactcagtcacacacaaaatattatgcacagaatcgcccaaatcacagccaatcacaaatcacaggaacttcctctcgccaattcgaccaatccatcacgcgtgcccatactcgcagcaaggtatgggcacgcatcgaatccccagcaaatcaccgagaccccccggcgcccgcgcacgcactatcatacgctccaagcgatccaaattggcgagagcgggagagagcaagacgcacctgagaagacgagcagcgacgggggagcaaccgccgcagcggcagcgtcggctccggaggcggaggccatggcgcgggatctcggcagcgcgcggaggaagcagccgggagaggacgcggaggcccgcgcggttaggaggccgccgcagggtggcgtggtggtggtggtggcggcggcgagcaattgcgccatcggatggctgcgacgcatcaagcagccaaaaggcggagagcacggcctccaccaggtcacaccgagtaccactgccccaacgccgcgcgcctccttgctcctagctccccggggattgggcgcacctcacgtggcagcggaggccggagggccccatgcgtcgctgacaacatggacccagtgagcagaagcggtttttgcttgggctccggcttctctcatgggccgccgtcgcgtcacatgttgtgggccggtcggcgatgctgctttttccaaccagcttcgggcccgtgcgggcaaactccccaggaataagttcatctaaggtcccttaactttacactgagttcgatattcgtccctgaatcacaataccagatacaatgggtccctcaactgtcaaaaccggtgtagatgaggtccctcagcggtttagatggtggttttaactgatatggcgctgacgtggctagtttgacttagttctagtcctatatggcggtgacgtggtacttggaagcaaaataaaaggtgggacccatgtgtc

SEQ ID NO: 4807 - DNA, 1501 bp, Oryza sativa
tatttgtcgacagcgagacgtctgcgatgaattcatgaatctcaaaaatatgttggttcagcattccgaggtgtctatatgtatagggtgagcgcgaggcgtctgcggtgactttatgattctcaagatacgttggtttagttttcggaggtatttatagggataaggtaaacgtgagcatgtttatatgagcattgcttgtgtattgcgtttcgtaaaaataaaagtactccctccattccaaaatataaggcataatcacctttaactcaaagaccaagaaataattattatcatcttgtagtttggattatcataataaatacaattcatgcatccaatagaattagagaacatgagagtggaggatttaaaaaagtaataatttaatggagaaggggccatagttaattgtctacatgcatgcataccttagagcacccacaatggtaaagtaaggtgctctctataaaacatgtacatctcagcaatagactagattaatagtaaatcacctcaatagtatgtctacatgggtatctatagctctctaatacattgcatcgttttttactatagactatctccaggttagtagatagttttgctctctcttcatttaatctcttccaagtaggaaaatatgctgatatggatctcttgtagagagactatagataactattgcgggtgttcttatattatagaacatctaaaaaagtggttgtgacttatattatgaaatggagggagtagaactagcttgataatgctgtgagaatacagtagtactaattggataaagatagacagatagtagtactccttatcaaaagactccgcacggttattgaagtatagttgtatacgtttggaaagtacgttgaaagtccaaagtacaaaatatagtacaaagactccccatatattttacaaccttcatgccaacttgtaatatcaagctcagatggatcttcattccttaggagaatatattttattgtatatgccacctaaatagtcattattttttaaaaaaaatataatgtgatagatcaccatgagataaattattccataaatacgcaagtttacattcgaactatacaagttatattagaataaaaataataaatataactaaaaaataatatttttagaggtccgctttgttctttttgtttgaacttacatgggtcgaatttaaacgtgtatgtttggagcatatctcatagtaatttatcttattattttttaaaaaatattttgatgactatttgagttgcacgaaaaatactggtatatccccttgacatagagttgaaaacactttcatcaagcctatctacccatgcattcatgctgatgcttgcttgcttcagctgcttataaatacacatgcaattctacaaccactggcgatttcaaaccaaaccctagttaattcaagtcagtttcttaggcttactgcctcgcgccatggatgggcgagacgagctga

SEQ ID NO: 4808 - DNA, 1501 bp, Oryza sativa
aaggcgccggcgccggtgcggtgctgatggcatcatcgtcgtccccctccgccccctcatccccgccaagatcaggcgcgcgatcacgggcaccgcccggcgacgccgcttgcgccagcttgacgtacctctcccacggcgcctccccgaccacctcccgctgctgctgcggcgccgcgaagagcggccggcggaacgggcgcgtcgagccgaggaggaggaggccggcggagacgacgagggagaggcagaggagcgcgcagagcgaggtggccagcgcccacctctgccgcgacgccgccgcgacggcgagcgacggcttgttcgccatggcggcggcggaatgatccatcgctaacgacgagagtttaatccacaaagaagcacacaggtcaactgctcaaagcgaggtagtaattattaatttgtagggttaattagctcgccggagcacgggattaatcaaggcgaggaaagcatggaggaggaggggtttttggtttggttgctttcggtgaggagaggttgggtttttggttgggtgtacacactacacttcacttgggacgctgctgttttcatgtgcacttgaaaacagtcactgactcgcttcctctccatgtacgccgtgtttagttctaaatttttcttcaaacttctaatttttctatcacatcaaaacttttctacacatacaaacttttaacttttccgtcatatcgtttcaatttcaaccaaactcatgtgagtagcaattatactgccgctgatgcttagtggcaagcagtacagtttcaccaactgtaatcatgaagaacgttatgtttatgccttccagagtgaaaacgaagcaattttgatgctaaaattcctactatcaaatacgtggagtacttttaggaaaaaaaaggagtatatatttttaccagaatatttatatctttctcgtgtatccaaatcagtaattatggagagttggtgatggatgataattggatagttcaatttgtattcaaagttcgtgatcaagttgatgtggcacgtgaatgcttcttgattcgttattcttccgatcgatgcgaccaaagtacatacacataacataagccttgtggtagtacgtatgtaggtggacctgcatccatgagtagtagtagggtagtagatgagctgttgttagagtaaaaattagaaaaagcacacgcttttagccgtcagctgaatgggcacaagccttgttaatcttcacaacctccttttgccatgggcatttttctcaatcatcatgagactcagatcgaccacactactacctccgtcccacagtggatgtcgttttaactttttcttataacatttgaccattcgttttatttaaaaaattagtgcaaatataaaaaaaagataatcatacataaaatattttttgataataaagcaaatcacaaacaaaataaataataattctaaattttttaataagatatatgattaaatatta

SEQ ID NO: 4809 - DNA, 1501 bp, Oryza sativa
ttctgataatatatattaatacttctttttgcaattggagacacttcgtcagatgcatggtgtttcttccttgccgagaatcaatgatcatttgagatgttccatcactaattgcaacatttgagatgctttaaccagatgcaaaactcaaaaatatactaatgcaacattaaaaaaaccaatacgtacgagaaacaatcaacaacatgaagaaaaagaattattgacaatcaacttcaatatggtgagcgcacgcctttaatgcgacaatacatatcatttgcaagtacaacaatatgtaaaaaaaaagaatataataagatgaaacaagataaacaatgaattgtaacagtatctaaaaaaactgttcaacataatcctaccagtctagattagccttcttcctctactcagagtggccagatccgctttcttcctctactctctagtggctagatctaggctcctcatgaaaaacaagtaggattcctcactttgggtaaccactctactctcggacaaacatagtgagggccgaggacttggaagatttggaaggcggaggtgcagcccacctatgagtaagcaaaagtgtgcggccctcctatgagacatattaattcataaatatgcaaagttaaattcactatctacaagttataacaaaaagaacaagggttggtttggtttgtggcctagataggtcttaccaaattttgtcaatgccaaattttggtaagttttggcatgactaattttgataaggtaaagttgtgtttggattgaagccaaaatagtctaagttcactattgaaatgacctattttcttagggggcttttaactatttgccacttttagatttggcaaataactatttgccacctctatctcaatgacatgtgggtccacatatgtctatgacatgtgggcccagtggcaaaaagttaattgccacatctaaatatggcaaacggttaaatatctcattttcttaggcatgtcaaaattttgcttcaaaccaaatagacactaaacactattaaaattgacaaatattggtaagcctaatttaggccccaaactaaacctgccccaaatcaaagtgaaactagttaacatacattcacatttatatttattagtttaggtacgactcgtagaagtcgaatgacttacatgtttgcacagtgatataactcattaatcttacttattaatttcttttaaatattttaataactttttagatgatatgtaataaacctctcgaggatgaaaactctttcccggatgcacgccaatccaccggacagtcaattcaatgaaccatcccactggacactggcgcatccgcgcatgcacaccagagtgcaatatggactgacccgaccatgcatcaaccgtgcgtcgtctataaatacgaggcaaatgcgccacgatcctcagctcacaagtcacaagcaacacagagtgaaaaaaaatggcacgggttcccgtct

SEQ ID NO: 4810 - DNA, 1501 bp, Oryza sativa
ggcgatggcgaaggggctcgccggcgagggcttgggctcgaaggtgacgccacggcagctcgagaacttgatctcgatgggcttcgttgtcagctcgtctcgcccatccatggcgcgaggcagtaagcctaagaaactgacttgaattaactagggtttggtttgaaatcgccagtggttgtagaattgcatgtgtatttataagcagctgaagcaagcaagcatcagcatgaatgcatgggtagataggcttgatgaaagtgttttcaactctatgtcaaggggatataccagtatttttcgtgcaactcaaatagtcatcaaaatattttttaaaaaataataagataaattactatgagatatgctccaaacatacacgtttaaattcgacccatgtaagttcaaacaaaaagaacaaagcggacctctaaaaatattattttttagttatatttattatttttattctaatataacttgtatagttcgaatgtaaacttgcgtatttatggaataatttatctcatggtgatctatcacattatattttttttaaaaaataatgactatttaggtggcatatacaataaaatatattctcctaaggaatgaagatccatctgagcttgatattacaagttggcatgaaggttgtaaaatatatggggagtctttgtactatattttgtactttggactttcaacgtactttccaaacgtatacaactatacttcaataaccgtgcggagtcttttgataaggagtactactatctgtctatctttatccaattagtactactgtattctcacagcattatcaagctagttctactccctccatttcataatataagtcacaaccacttttttagatgttctataatataagaacacccgcaatagttatctatagtctctctacaagagatccatatcagcatattttcctacttggaagagattaaatgaagagagagcaaaactatctactaacctggagatagtctatagtaaaaaacgatgcaatgtattagagagctatagatacccatgtagacatactattgaggtgatttactattaatctagtctattgctgagatgtacatgttttatagagagcaccttactttaccattgtgggtgctctaaggtatgcatgcatgtagacaattaactatggccccttctccattaaattattacttttttaaatcctccactctcatgttctctaattctattggatgcatgaattgtatttattatgataatccaaactacaagatgataataattatttcttggtctttgagttaaaggtgattatgccttatattttggaatggagggagtacttttatttttacgaaacgcaatacacaagcaatgctcatataaacatgctcacgtttaccttatccctataaatacctccgaaaactaaaccaacgtatcttgagaatcataaagtcaccgcagacgcctcgcgctc

SEQ ID NO: 4811 - DNA, 1501 bp, Oryza sativa
acttttcaaaattaaaatgtcttaacaaaattcaatacagggagaatatatattagaaaaatattgagagcattatatatcgtattgaagcacagtggcagtcgttttacttttatagagaaaaaccgacacatggatatataccacggccattggtaagtgtaggctaatctcacacgttatttttgttctatgatagtgtatatccattcccgggtacttgtcaccacatactatttatactcaaattttgaccacaactattctagcagctaaattgtaaatatttgaaattataccatagtattgaagcatgttgcatgctaaatatataatcatctaacttccacgcataaaatttgacatttgagaaatatttgagaacgaagcgaacattagagtgcggtgaaaacgacttgtaagaaaaagtatggtaaaaagacctggttcaatcctatgtcctaagtaccatgttaatgagagaagaatatacggtttgacacatgtggaaattttaaaagtatggcgggggattaaattataatggtgtaaattaaaacaaaagacacatgtggaaatacaatttagaaaaaaaaggtgatactgtttaaaaaataatcttgactatacacctagacaatataattaataaatataccatagaggagttcatgtcaaaacaacgcatcaacaatggaatttttgtttggattattggaagataaagatagaactagtagtttgctcactggataaattccaaagtaaataaaatacttttgattcttgaaatacaaatatactttaaatcaaaaccagctgcccaaaagttggccactaaaagctgaagcaaatagcatacccttccatttggcaaacgtccagatcatgatctgattattagcctataggcaaccaattgaaccaaagatgccccgtaatatcaccccctaattctcagatcgagcaccgggacgacacttaactgacgtaatcggtagaaaaataaactattacaactatagcaacccaactaactacaaacacaggtgaggtgatcaccggcatgagaaatttgaaatggaaaataaaaatagtgccatgcgttgatccgtcccagtacaccaatttcagaagcttgggtgttatgcccccaaatcgtcacttccccctgattcacaagcaagccccaaatcatcagtgtgtgacagaaaaaccccccttaaaaacgtccgtgcggtgggcgtaggttaagagagaccgtgcgcgcgcgaaatctctcacacgcccacagctcaaacgcgcgcgcgagaggaggggaggggtttggtttgcttggacactttggtttggtcgggtagctcacctcactctcatccgaccagcgactctctccctcctcctcgcttgcacacttcgtactctctctagtcccccgcatacatgtcgtccgcggccgtggcgtctccgagggagacggtgtcgccgcccatgtcgctgg

SEQ ID NO: 4812 - DNA, 1501 bp, Oryza sativa
tcacccgaggtccttcggtggttttgactccggttttggtctacatggcggctgagtcagcgtgggacccacgtgggtcccacatgtcaggtgtccacatcatctctctttactctcttatctttcccttcctcccctctatctctctctctcgggcagggccgatggtgagcaggttgagcagcggcactgcgacggtggtcggcggcgacagcgactgccgccgcgcacaccacgcctacctcgccgctgccgccacgaggcccgaggcccccattgcgtcgtcccccaatgccaggctctgccgcctcatcgcccgcgacgacctcgccgaggccacgcgcctcgtcgaccgctcacgcggggagacacccgacgccgccgtcgtgaagaccaacgccggcgaagtccatgagccgaagcaccaggcacacacagccatggacggcgttgaagtggtgagtgcacttatcggctagtactatgactggctggtgctggtgctgcggagaggcggcgttggcgggcgagagcggtgtaccacgagctctagcaccagcccgttgtagtactggccgataagtacgctcaccacttcaacgtcgtccatggctgtgtgcgcggccaccgccgccgttgcagtgccgctgctcaacccgttcaccatcggccctgcctgcgagagagagagagcagagaggggaggaagggaaagagaagagaggaaagagagatgacgtggacacctgacatgtgggacccacgtgggtcccacgctgactcagccgccccgtagaccaaaactggagtcaaaaccaccgaaggatctcgggtgatcggttttgtatagttaagggaccccatatatctggttttgcggttcgaggacgcttttttatcccgatgacaagttgagggaccttcggtgtactttttccggaaaaaaattctgctagatgggccacattttcccaacaaatatcgggttcggcctctaggcttccatccacgaacgggggctctcaccggcccagccgccgccgacgcgctctgctccgctcactctctccccaccgcccaccgcatccgaagcacgcccctccctctcggtctcgtcgccgccggtgcgaccgcggtttcctcctccccgctccacctccgcaacacaaccgtcttcgagcctcgggcttcacgtcgacctcatcggcaattcggcaccgcaccctcccctccccatcgccgggttcgccttctccgcgcgcaactcgtcgcgtcctcgagctcggctaattaacgatacttttactgattactgaagcggttaacgacaagtccaactaacaaagtcgtcgggttggtgtcagtggcccagtgtgccacctactcctcctactcaaagcctcaccgcctcagcatcgcacgacgcctaattaatcaattcctctcccgcgacacgcgcgcgagctcaactgcctcgcttcctccctcctcccgatcgacc

SEQ ID NO: 4813 - DNA, 1501 bp, Oryza sativa
tggtatggacttggtagtacaactacgggggagcacggacacagctgatgggattaccatcgatgactcgcactttgttcctaggaccttgttttggcaagtccttcgctgaagatgcagtagatcaacattcacatgactgtctgttcctctttgatttttcctgaatgtttagaccttttcataaataatatttattaacaaatatgttaaaaagatatatccctacttctaaaaccgaaccatttggctcctcctttaagtaatgttgtcaatacatactccttcttgaacaaatataagtatttttaggattcaaattctattactcctatatagggcagctctagctccacctcttctggagttagaggtccgccagataatttcagctccatttaaaatgggagcggagttaggtggagctttctcactccagatccaactcatgtagctaaatttaggagtataaaatataaacatttttaggacgctgattctaatgtataggaatccaagcattttcagcccatcagatgtttacaggagaggaaccaaagcaattcaaactttgaccatgagataagtgaagagaatctttcagtttatctttaatctttacttaaataacttaaaaatattatattagtaagaaatgcatgctttaccgctgcatgctgccgtatcttatccttttattcattttatttttcaacgagtttttttagggatatgttttcaacgagttgatagcatatatacgtgaaaaatgctaatgggtcaatttagtggaagaacaaggtactcctgtttagtgagaggaactcatgataagaggtatttcatccatttcatattataaatcatttttttaaaaaaatataagtttgattaaatttatagaaaaatatagtaacatctcaacacaaaaacaaacttataaaaaatatatttaatgttacatataataaaactaatttggtgttgttaattttttataaacttgagcaaataaaaaaaatgtttcactaaataaatcaaagcgagtacaaactcaaagcaacttataatatactccgtaaaacataaaacagagtactcccaagttatttttcgatgaggaagtaaccatcagttcatctaatttaacagttaattaaacatccaaaggcatctaaatactcgtcaaccaatcatcaattgattaagtggttaatcgttcttgccagctagtatttttcaccgtattagattattgaaacaagagccttgtatatggcattaaaccatcattgccaagccaccaaaaaaaaaagaagaggaaatgcacgaaaacgaaaatgatagcagagtacatcgcagttgcaagacgaacgatgagctgcagtcggtactgggtacgaatcggggaaaaaacatgttagtaattcatcaaggaagccagcgcagcgacatctccatttgtaattaattattaatctcaagtatggaacacaaaatg

SEQ ID NO: 4814 - DNA, 1501 bp, Oryza sativa
gcgctgaggacggcaggggcggcgctgaggaaggctgtcaaggcgacactggcgacgacgaccgcgccgacgatggggacggcggtcggggtgacgctggggacggtggccgcgccgacgatgcggacggtggtcggggcgacgctggggacggcggccgcgccgacgatggggagggaggcggctgtcccgtaggattagggctggccatagcggcgaggggtcggtgggggcagccagcggatggggcgtcgcggtgggcgctgatgcggcatggcggcgggcggagaaaagccgcggcgtcgctgggaagatggcggcgctcgagaatggttgattggggcggcctggtcagtgctagggttagatggctcaaagggtatttcggtcattacgggaaaaaaataacagtacaaacggcgtataactgacagactgtggacggcgatgataaagtgtagaggttaagtgaaaggcaatggtatattatgaatgttgataaaatcagtggcatattgttgaactatgctgaactcagtggtagtgagtggattctctcttttctttatcctactatctctgtttaccttttctcatagatttttattcgcgcatacttagatcattcatagtgcaacaacatgacgagatcctcacaccccatctatgttgtcgctccacataggctaggcccatgtcccttagaggatcctcgcatcttgcagaggacacacgtgcctcatcaggggattaatgagcaacatgatattcacccacatcaaaccatcatccatggaaatttccttagttaccttattattagtggatgtacattagtttgtttatcttttttaagaacttatgtactttatttgatagcaagaagtttaaaataacatattatataagtgatggtaacttctcccatagaaagattagaaagatcgcctaaagtcaggcgactagggaaataacaagcatgcatattagtttagcccgatataatctcttaggtatttcgtatcaccaaaaaaaactatactctctttgtctcattttaagtgcagtcataattaaaaggcaacaaaagtaatgtactcagattattaaaaggcaacaaaaggaaaaacggaattaaaaaaaaggagaaaaaggcctccaaagaaaaaaagggaaaaaaaagaaaaaaaaaagccctttgacgttggaacagtccaaacgtcgagaagctactagccccgctagggttcgccgccgccttcccctcccccataaatcccaccaaccccccctctcctcgtctctcgccttcgccaccttcgaatcgaaactaatcccccacacctccgcgtgcctccccccaatctcgagcgcacggaagccgccgccaatggtgatcgccccgctcccctccatggcctctctcgccctatcaatccttcgatctccccccaatctcaccctcaccgtcgttgcgtttgttttttttttactttttttt

SEQ ID NO: 4815 - DNA, 1501 bp, Oryza sativa
aaacactatcgtaccccctttgtttttttaaatgtacgacgctattgatttttggtgcgacgtttaaccattcgtcttattaaaaaattatataaatgttatcggttttgttgcggtttgttttatcaataaaagaactataactttaacttatatttctacatatttaacttatatttctacatatttgtactatatttttaataagacgaacaatcaaacgttacgtgaaaaaccttcgagtcttatattaaaaatcggatctagtatatattatcatcactattctcaaaacttttcagagttaatcacaaatgaacccaacactatttacatgatgttcggggacatccccactccctgtcagcatgtagaaaatagatgggagagaattcatatagacatctatacacagaatctgcaatgcgaaactgctgataatggcagcttcaaacaagcaagcagcagcgttaattctcaggctttggaagccgcctcctgccaccgttgagggcccgtatcagctgcaggtgctcatcgctggacacgtggagctgcagccggagctgcgtcagcagctcctccttctcccacgtcagcgcgccggtggcgtggaacaccctcatcagcgcgccgtacgcgtccacctccaggcggtggatttgctcgcctaccgccgccgccgccgccgccagcggcggcggaggttgctcgttggccaggcgccgctgcattattggcgcaacggccggtcgcggcttcattgcggtggcggcgcgcgacttcgtcctgacgtcgtcgtcgtcggcgcgctcttctttgatgtgtggttggcattgcggctgcaatggcggcggcggcggctggttcgccgccacttgggcgtcccccggtgggctcctcggcgcggcgcggtcgccgttgtcgctctcgctgctgctgccgtcgctgctgctctcgctgttgctgctgctgccgctgccggccgacgagacggacttggcgtcgtcgtcggtctcctcgtcgctcatctcctgctgcttgttgacgaacacggcggtgggtggtggttcgttcgcgcgcaccacctccacgttgcgtatcctacgagcagctccccctcctcttcttccatggcgcggatccgcttcgagttggcctcgaccctccggacctcgccggcggcgtcgtggtccgtcgcgtggcggctcctcttgatcttggcccattggtgggagggggccggcggcggggcgaactgatcggcggcggggcggtgcttcgcggcggcggcgggggcgcggcggtttgcggcggcgttggggcgcgccgtcggctccctggcgcccgggatctcctcgccctgcagggaagaaggcgcggcgaggtgtcaggctacggaagcaagattccaagaagagaagaagagggttgggtggcggcggcggccatggataccttgtaggtggcgacccagatgtcgccgtcagtcagcacctgg

SEQ ID NO: 4816 - DNA, 1501 bp, Oryza sativa
gctccccatcgccgccgcggaacaatcgcatcgctaccgccgtctccaccgcaccctcgccctcaccgccggctcaaacctccgcctcgtcgcccgcttcgcccatcgccatcgcgccgccgcctctcccctccaccccctaaccctaaccgcacctcaaattgcgtgaatattgcccgtctcgctgcagaatgatcctcttgaacgttgtcgcccgccgtttcccgccgctgtctcccgccggagccgcccctgcttccctgctcgcgccgcgatgaacaggaaggagagctggggtcggctcacaccgccaccacctctccctacggtgagcatactgtcacttttagtttttcattcattcatcagattcatttttcatccatctcatttagtttctccatctatatcagtccatgttcagctggtcacattcaacattgacacaaacaccttaactgatcgacatagtaatatagtatggatcaagacagtgttattttcaggaaattggtatgtcgagaggtggttctctcacctgaccatgcagacatgcagtacacattgaatccttcctctaaattatacgctgtgtgattctgatctgttaactttatacaggtcaattattcctgacagcagttgcttgaatgcttcaaagacttctggatccaacctgaagcccttattgtttgaggtcaacaagttcagggaacaatgaagaatcgttaaatacttcttttcaaaaagaatagttaaatactaaaagcaggaaggtttcatgaaaggtttcaacgagaggggaaccatgaatgagctttggttgcttatatcagattgctccttctgacgtaaattttgttacagcctttccacaacgtattatgcagctatcaaatttgtagctataaattcgatgttgtattatatacaagtattgaaatgaggtatgccctcatcttgtttcttggggaggaatagaggcaaatggcaaagggcgaaaaattggccatcagtacgtcaaatatcattaatttgattcttttcataaggaaagttgttgcttcagttgaaagtttatgattggccgttatggcctccacactagactgcttgttggatcttttctataggtttttcatattctggtttactgcacatgctacgagaaaacccaataagtatagctatccatatgtttcttgacgaattcagccaatagtaataactcagtcttaactggataaaactatgttctcactcttgcatgataactatagggctaactgaataacctgaaattttcagggcataatagtatgttgcatgccggtaaccctaaagtagcaatgaagaaactcatatgttacatactacaaatcccaaattcacgaatacgacaactttgggtaactttgagaatttaatcaagaataagtaccgttaatgctatcctgtgtttgtcaacgacaattatatttctgaatattttttaacctct

SEQ ID NO: 4817 - DNA, 1501 bp, Oryza sativa
cacttgcttttctatttttgttgattggtagccatttgatttcaagatggtttgatcagcaaaacaaaattgggaataatagccgctcagtcgggaatttccggcaccgtttttcatccctacttacacgccacccacacaccattacaccaatgaatttacatacattaagagaccctccactgccaatgcctgcaggctgccacctcccccatccccatcctgaggtagcaaaaggcaaaagcccctgatctttcttttttaaaatttttttgccctccctcgtgtgtacgtgtgctaactttttaataacggtattgctatatttatggcgcatgttttttgaggaaaaaacagtcgttttttctagtggtaggatctcccttgatgtccgtgcttagcttcccacgctgattgattttgtcgaggtgtatatcaaggatgacttcatcacttgattactttgttacaaatactcaaagggacatgtgattttgtgagtaattattttctactttgctagcttctttcttttctccaaacggacctatgatttgtgagcttccctcttctttttgttgcgattatattgcatatgttatttagacacttacatatgtaattttgggacttacatcctaaatacactaaaattacatatgtaatttaggcacttacatatgtaattttgggacttacatcctaaatacactaaaattacatatgtaatttaaacacttacataggtaattttgagacttacatactaaatacaataaaattacatatataatttagatacttacaatgtaaatacatgccgactattttttgttgaaaaatatggcgccataaatatatctactccctttaataatgcaaagaatcccggcctttacttcaaagaagctactaccacttatgatgcgctcaatagacagcgcataaaaaccaggaaatgactagacaataactaatactaataccaacacaagttagaaaagacattttattcaggtatatttgtaaaatctccatcctaagttggcaaataactgaatgaacgtttatctcattccggcacgcattacgtatgctagaggtcatggattattattcccccctctcccagcgacagacagctagcgagccaacctaccagccgccgccaactgttgattaccgggtgcgcgcccgcgcgattcacatattcaccacgtcgtcttcctcgtcgtcgccgctctataaatacgggccgcctgtgctcttcgtacttccaccgctttctcctcgatccagagctatacatatccatcagcagcagcagcagccaaattcaccatcctccagcgatcgatcgatcacctgcagtactagttctctcaagcttcttggtcgccggccatgagctacgggagcagctcttctggtctctctctcacttcctctcttttttctttctttgcttcttcgtgtcttctttctccgccgccggcgtgtg

SEQ ID NO: 4818 - DNA, 1501 bp, Oryza sativa
cgtaccccttctttgtgtattgtgctgcttctaccacagccggcctggcttcacttccttgtcccttctcggagaaagctatagagcgaaaagatatttgcaggcaaagctatacggcctgcacacacacgtactccctcagttctattttaagtgcaaacgtgagtttctatgtttaattttaattgtttgttttatttgaaaatttttataattaatatttttattgttatgagatgataaaacatgaatattactttactcgtgacttatgtttttaatttttttttcaaaaatttttcaaatatgacggacgatcaaagttggtcgcggaaaatcatatatggctgcacttaaaatgggacggatggaatagtcctcttgttctatagaaaactaatctattacatattataatacaacaaatctgaacgtctaaattcatttgtgaattgtgaagaactcgagtacatttgtgtttagattttatacatattatcatattttcttcgtctcaaaatataataacttctagccttcaaaatttatcttaaaatataacaacttcttcactaacattttcttaccatcaatctcaatctttcgccgtttaatttcctcacctatctccatttctcgtccaatcataatattttccatatttatattctatctattttcttagtgattgtgtttaatcttaatgactcgctcccctcacaccaaatcctcgcaccaccggctttgtcccgccgaggagaacccattcccctagtttcccctctcttttagccaccctatcccgccgccaccatcaccttctttgccgccagagccaagcccttccatccgctattctggccatctctctagctccttgtatcgggcaacacattccttgattgagccaagctcggtaacacatttgaccgccggtgtcgccacctcccagccactggagcaccggcgcgccgctcatctcttccttctgctctacatgggaagaaagaaggaaaaaagagaagaggggagggtggaggaggaagatcaatctgaagagtaggctccacgtgtagatggggatgaagattgtgatggcatggttctaattttataaaatttgaatggcatatttataaatatacgaattgtaatagtatattttttaataaccacatttgtaatggcataaatagaattaacccaattttcttccaaacaatagcgtgtcctcctggttgctattgacacgctggcagagccgaatttacactggtctggcggcgccacaggccacacacccctctggcccaaaacacacacctcccccctctccctcctatttcctcctccccatcccaccccgccgtcttcgtccgcatccgggtcaaatcaaatcgagagagagccccatctcgcctcgcctcctcctccctcctccccattcccccgccgccgccgccgagggcgccgcgacctgagagcacacgcacgcccgcca

SEQ ID NO: 4819 - DNA, 1501 bp, Oryza sativa
tgagtatagtagtagttgtgataaaatctgtgtactactaggacatttaaaaattaaaaactgggagcgtgtagtagtagtacaagtttgcatatttttggtcgtgtgtaatataattattaagctgtggaagaaagaagtcatcatctcgagatcgagagagagaactctagagaagtgatgatgggttaccttgcgccattgtcgccgaggccatggagccacacaatggtggcctggtgcctccccttgggcctcaccacgtacgtcctcccgtactccacccgccgcccgcctcgcccccctgcacgcattccattcgatcgttcgtcagcacacgccggcggcggagaaagaagacacgaagaagcaaagaaagaaaaaagagaggaagtgagagagagaccagaagagctgctcccgtagctcatggccggcgaccaagaagcttgagagaactagtactgcaggtgatcgatcgatcgctggaggatggtgaatttggctgctgctgctgctgatggatatgtatagctctggatcgaggagaaagcggtggaagtacgaagagcacaggcggcccgtatttatagagcggcgacgacgaggaagacgacgtggtgaatatgtgaatcgcgcgggcgcgcacccggtaatcaacagttggcggcggctggtaggttggctcgctagctgtctgtcgctgggagaggggggaataataatccatgacctctagcatacgtaatgcgtgccggaatgagataaacgttcattcagttatttgccaacttaggatggagattttacaaatatacctgaataaaatgtcttttctaacttgtgttggtattagtattagttattgtctagtcatttcctggtttttatgcgctgtctattgagcgcatcataagtggtagtagcttctttgaagtaaaggccgggattctttgcattattaaagggagtagatatatttatggcgccatatttttcaacaaaaaatagtcggcatgtatttacattgtaagtatctaaattatatatgtaattttattgtatttagtatgtaagtctcaaaattacctatgtaagtgtttaaattacatatgtaattttagtgtatttaggatgtaagtcccaaaattacatatgtaagtgcctaaattacatatgtaattttagtgtatttaggatgtaagtcccaaaattacatatgtaagtgtctaaataacatatgcaatataatcgcaacaaaaagaagagggaagctcacaaatcataggtccgtttggagaaaagaaagaagctagcaaagtagaaaataattactcacaaaatcacatgtccctttgagtatttgtaacaaagtaatcaagtgatgaagtcatccttgatatacacctcgacaaaatcaatcagcgtgggaagctaagcacggacatcaagggagatcctaccactagaaaaaacgactgttttttcctcaaaaaacatg

SEQ ID NO: 4820 - DNA, 1501 bp, Oryza sativa
ctgcgtttctgatcaaataagatagcacacactgtgtaaacattattgtgtatcctgcaccaactactcatagaagtttaaagaaagcatccctacaatatatgacaagaacttatcataagtagcattagtcataacatcgcaaactgccaacgggggaagaatagtttgcaccaatatattaactagtaacaatcatttgctcaataatgtggaacaactattgatgctttagtagacaggcaaaggcaatgaacatggagatcaaacacattgcccgtcatagagtgaacaagttttacaacaatggtgcattgaagaatagcacacgaaaacaattcccgaaacgcattagtgtatagaaccaggcaatatagcatgactactggcaaaaaatgcagtttctccctcccagcacaacgcgaatcaagtcgaaggtaatctagcaaagcattcgcaattcatagtttcattaaattcagctctaataaacctaaagctaaggaatagaaccaccacgtatggtgacgatcgcagattcagaatttcagatcaacagaatcaatagaaaatatcctacaactacgaccagcgaacgcctcaccttggtaccaaatgggcctacgggaggatccatgtcgaaccgcttctccccctgcgaaaccacagacagatcggcaaatcacgaaacccatttccagaacagacaaaaaggagcaatactccaacccgaagaagcaaaaaaaaaaacgaaaaaaaaaaggcataggcatctccaccttgagctccgccgcgagctcctcgcgctccagccccgtggcgatgggcatgacgtcctccaccgtcgccggcttgtcccctgcagcgcgacccccaaccaccgaccgatcagcgccgcccccaccaccccacggaagcacatccaaacacgcgagatccgaggaggagagcccttaccggacaggagagggctggtgcggcggaaggcggcggcggccgccgtggagagcggcgcggcgcgggcgagggaggcggggcccgcggcgcccgatgccgccgcggaggcggaggcggaggcggcgcggcgcagggccggggccagggtttggaggcggcgccacatggcgggcgtgcgtgtgctctcaggtcgcggcgccctcggcggcggcggcgggggaatggggaggagggaggaggaggcgaggcgagatggggctctctctcgatttgatttgacccggatgcggacgaagacggcggggtgggatggggaggaggaaataggagggagaggggggaggtgtgtgttttgggccagaggggtgtgtggcctgtggcgccgccagaccagtgtaaattcggctctgccagcgtgtcaatagcaaccaggaggacacgctattgtttggaagaaaattgggttaattctatttatgccattacaaatgtggttattaaaaaatatactattacaattcgtatatttataaatatgccattc

SEQ ID NO: 4821 - DNA, 1501 bp, Oryza sativa
tcggatttttcggagctcaattattaattttaataatacaaagaacatttcagtaattattcacatattaaattaatcattaatgagctggtttcaatgtttttaaatacttagggtgtccaagtatgttcaagatttttcttggaattatttgaccattggaagtatttttaacaatcgaaagatcatcttattggttaatttatttggaaaagtaataaaatcttcatcctcagcttgggcccttttcagcccattctctcccttcctctcagcccgcagacaagtctgcttttcgtccctctcgctacagtgttgtcttcaacccctagacagagccgactgtctccagcccgtgcacagttgccgccgcctcctccttccaaatccggcctctccgttgctcctttttccaaattagttgtgggaatggaatcctctcaatctcctcttccttttccccaagaaatccccaaaatttctatggaaatcctttccaatttcgcggatcaatctttcctttttccggcgaagatcctaaactttcccgagtttttcccgtcgatttgggcccgaacccgagctcctgtgcctatataaaggaccccctcgtcgtcctctacctatcccctcaagttccatcttccgccgtcgtcggaatcgctctccccgcgctcttcttctctctccaagcgccggcgccgctccagccgcccctagccgtcgcttcggtcgtcgccgtcggtcgccgtctccttcatcagcatcgcgaggtcgtcgccgtcctcgtcccgtcctccgtttccgccgaagatcgccagagcgccgctgacactgtcaacccgaagctcgccgccgcattttgatctccggcgaggccactgctgctccttccgtcgtcgccaagctttgccgtcgcctccattggattcgcagctgcgaagtgaagcccggccacccctccgttgttgccgcacatcgccggaaagtcgtcgccgccgtggacagtacctcgccgcccttcgaagctcgtcgccggccatcttccgtcgctgtccgtcatcgcgtaagtgttggtaaggaccgtcgtctcgtgctcttcctcccggtgccctccgtttgcattattgtgccgtggttcgccggcaaccgctgcccctatgccgttcaccggtgtaggtttttccctagggtcttaatccaacataatctaatccgtgatttgtctagcgttgtcatctccgtgtgttgtagccggaccgtcattgtcgaccctttctctctgatcgctttggttcggtgagacttctatccgttctcttttttcagtggcatattatttctttttaatatatgccatctactaaatataacctaatcttttctgaatgttgctttaatcttttcttaattataaatcatttgtaaattgtttaattaatttggaatagttttttctttaataggtttaattggaattaaatcttataaaattcataag

SEQ ID NO: 4822 - DNA, 1501 bp, Oryza sativa
atctgtgtctctgtgagtaagtgttagggagacactctcatggtatgtgtgagtgacaagtgacatccgtatagtggtgtgtcactacgacagaaaatggcatcagtgctttttcgtaacttggtatcggtgtacgaaaatgaatccgacacaaaactcatctctgttggatgttctgtacccggcacccattattacctgtgtatatactgttggaattaatggatgggccttagcccactcgaagattaattctttggaaaatcacgaaaacccacctcatgggatggcatgcatatggagtttagtaccaccttacttattctaggagagggggacctccttaaaagggaggatgccctcctagcaacttgaagcatgtgtggtggagagaagagggggaacacgcgcgcgcttgctcgcctcgcctggcagggcgcagtggagatcgtgcgggcgtcctgatcaagcgacccttctctatataaaccgacccgccgtcttcacgcaacacacgcaaaatcaatctagggtttgcctccaactctgtggcgtcctgatcaagcgacccttctctatataaaccgacccgccgtcttcacgcaacacacgcaaaatcaatctaggatttatcgtgcgggcgtcctgatcaagcgacccttctctatataaaccgacccaccgtcttcacgcaacacacgcaaaatcaatctagggtttgcctccaactctgtggcgtcctgatcaagcgacccttctctatataaaccgacccgccgtcttcacgcaacacacgcaaaatcaatctagggtttgcctccaactctgtggcgtcctgatcaagcgacccttctctatataaaccgacccgccatcttcacgcaacacacgcaaaatcaatctaggatttatcgtgcgggcgtcctgatcaagcgacccttctctatataaaccgacccgccgtcttcacgcaacacacgcaaaatcaatctagggtttgcctccaactctgtggcgtcctgatcaagcgacccttctctatataaaccgacccgccgtcttcacgcaacacacgcaaaatcaatctaggatttgcctcctactctgtgctgcgccgtcgctcgtagattactccatcccgctcgccggcgtgcaccggcgatcgggagagcaggtctccggaacctctgccttcgacgtcctgcaccgggagaaggcgacaataaggtttttgggatcctcttcgctcgcgtgcgcctgcaatcgcgaaaagttcctgccgagcagccggtctttctaccacctcggtacgtgttcaatatgttgcgcatatttgatctgttcatgttttactgcttagtttacatgtgtagatctaatgatgcgttaatactagtatacatctgcaatgccatgatttatttatagaatatattaaatcattatatgcctataatctcaacaatccaaaaaccttattataggcaatgtgattttacta

SEQ ID NO: 4823 - DNA, 553 bp, Oryza sativa
atgataacaagaaggtggggatgacaacagggatttggggggggggggggggggcaggaatgctcacacaagttcggctcctcttcttcttgttttttgctttctctctctagtgctgaggagagaaatgcgactttttatttttctttttttgatatttttttcacaactcacagcacactggaaccaaccacagaaattcttagctcaaatggacaaattatgaagcatgtagaatttttcaaagttctacccgaaggggtcctgaagcttctcgccttggaaacaaaattttgcaagtggaatttggcgattttaattttgccaaacatagattgatttggcttactagattgaccgataacattggaccattaatatatcttcatagaattaagcatcgttttggatttccacctcaagctatatatacattggctagactggtcaaaatgggagcaacgatagcgcctttcagtcggcacttccttcctaaggggatgcaggactgacaactatactatataggctgacggggcttgtttagcctagt

SEQ ID NO: 4824 - DNA, 1501 bp, Oryza sativa
catacacacgtaacatctgataaatttaatccgtttctgaaccgattccgcaccgactccgcaccatttccgacatctgcatccgtacactatccgcacccactccgaatccgcttaaaaatatggtttaagatatggtatgaccactatccgtccgaatccgctctattttcacccctagccactctggcgcgcttcccctgccacctcagcatcgccccaccacgtcggcagaaggacggcggcgccagccactctggcgccacaaaaaaggaccatttctagcataattttttttaggggtctatttgcgaaataagttttttaaaagaaccaaaatgtgaaaaatccaggttacagcagactgtgataagcaatagctatattgcctatatatacacgtatatgcattgctaatccttcaattttgtccaattcttttaaattgtattcacatgttgcaacgcatgtttttttttctagtcttaaccttaactaatcttaataactaactaaaagattcgtatctttccgatcgtcaccttgtccatacgctaatttttcgtccgtcccccctccccctcaaaaaaaaagggaaaatccattttacaccctcgaacttttatgcttgtctaaaatacacccccgaactataaaaccgggtataatacaccctcgagctatcaataccggacagttcaagggtgtattatacccggttttgtagtttgggggtgtattttagataagcataagagttcaagggcgtaaaatggacttttccccaaaaaaaaatcccagtcgttactttccatcctgagaatcggagacagggaaaactgaagcatacacgcaaatagaatcaaagatagggaaaactaagcatatacacacaaatatatccaaaaattcccatgcagctagatcgggtgccaccgttgttgccaaaccaccgcattgcaatgtaaatctaagactaaagcctaaatcctatgctaattcatcaaattagactcggttctaccaatttggtaatatatcaaattagacttgatttttactgatttgaggttctcgaggtgtcacactatgaaacggaagtttttcccgttgcaacgcacgggcactatgcaatatcttaactaattaaaagattcgtatttttcctttcgtcacaccgatctttcgtccgtctgtaacatcacgcgcacctcctctccaaatcccacatcatcataatccgacccaaaaacaaaatctcaatctcaatccaatcagaatcatcgcaaaatcatccaaaatatcaagagatgattataggagatggaggggtgaacaggagcaacatcatcatcgcataaaaaccccaaaatcaatcacaacaacgacatcattatcacataagaaaaacaatacaaacaacatacacaatcaacaacaccggcggatccagccgaggggacagcggcgtggcagcgggcagatcctctcggtcggatcc

SEQ ID NO: 4825 - DNA, 1501 bp, Oryza sativa
agccgtagatgcgtcgctgtccgtgcctccttaaaactacacaagtgaaccgctgctatccatgcctactagaaaaactacattcttctagtgaagcacaaaagagggccactgatgtgtactttagtgcggggagagatgtgtactatagcacatgtgagtgaccaatttcggtagagctcgacctagagggatgacggcgcatctaagtttgaactctgacaccacgttgataggcaaaactcaagcacaaggtgctgaatcatgacaagcttggtggaggcacgaaatctagcatggataccgatcaacggttgaagcagtcaagtaggctcaatcttgagcgtgagctccgcatagaaggaagtgtgcctatagggctataaagatagttggtctaaattgcaagaaaggtaatatgacctagtaaaaattagtttaaggtgttctggtcaaaattgaacataggaatatctgtgccgcaagatgcaactctttttttttttctcaaattgctctctcgttcttttcctcaaatcagtctcttttcttccagtttatttctcaaattagtatgaaatgttatcttagttagccaatttattataaatgcacatccgagctgccaacatgcttgcagaatagcaagaaatccatttacacaatttatagctgctaaaatattacttccgcggttgacaaatacttatcaactttgagcattaattttcaaccaatatcaacacgaatatatttgaatgtaagatgttagtaaaatacttctcattacaaatctactgatacgactttgaagctaaataattatgttattttttataaaaataatttttgtcaaaatagtactagacctcaaatgtcaaaatcaaatacagtagtagttactcctatttgtgaacggagcgagtatttaaattgtgagtgagttaaacaaatatccatgtaaaaaaataattacatttttcttcatcaaaattacaacagcttgagaagacatcaaaagcaacgggcaaaaaaaaaaggtgaaaaccgaacgcatttgcactatctgcattgggtccattcatcagttattattccagctaacaaaaaccacatgcccaactccttgacggctgtaccctgtacacacccacgaaacgcaaaacctcccaaaaattcaaattccccccgtcctcgcgaaattaccacatcacccccgccccgtcccaacggtcgaccagatccacccgtccatccaccaccccaccccacgatccagccgttgaaaccatgaacacgagggcagaatcgtccatggaaaagccgcctcccttttaatcccgctcctcctcctcctcccccaccaccaccgccgccgcattcgaaaacctcgtcgccgatctcctcctcctcctcgcgagatcttcgaggcttctctcttcttcgatctcttcgatccccgtggtggtggtgatctggttcgcggcggcggaggagatgg

SEQ ID NO: 4826 - DNA, 1501 bp, Oryza sativa
ggacgggtggatctggtcgaccgttgggacggggcgggggtgatgtggtaatttcgcgaggacggggggaatttgaatttttgggaggttttgcgtttcgtgggtgtgtacagggtacagccgtcaaggagttgggcatgtggtttttgttagctggaataataactgatgaatggacccaatgcagatagtgcaaatgcgttcggttttcaccttttttttttgcccgttgcttttgatgtcttctcaagctgttgtaattttgatgaagaaaaatgtaattatttttttacatggatatttgtttaactcactcacaatttaaatactcgctccgttcacaaataggagtaactactactgtatttgattttgacatttgaggtctagtactattttgacaaaaattatttttataaaaaataacataattatttagcttcaaagtcgtatcagtagatttgtaatgagaagtattttactaacatcttacattcaaatatattcgtgttgatattggttgaaaattaatgctcaaagttgataagtatttgtcaaccgcggaagtaatattttagcagctataaattgtgtaaatggatttcttgctattctgcaagcatgttggcagctcggatgtgcatttataataaattggctaactaagataacatttcatactaatttgagaaataaactggaagaaaagagactgatttgaggaaaagaacgagagagcaatttgagaaaaaaaaaaagagttgcatcttgcggcacagatattcctatgttcaattttgaccagaacaccttaaactaatttttactaggtcatattacctttcttgcaatttagaccaactatctttatagccctataggcacacttccttctatgcggagctcacgctcaagattgagcctacttgactgcttcaaccgttgatcggtatccatgctagatttcgtgcctccaccaagcttgtcatgattcagcaccttgtgcttgagttttgcctatcaacgtggtgtcagagttcaaacttagatgcgccgtcatccctctaggtcgagctctaccgaaattggtcactcacatgtgctatagtacacatctctccccgcactaaagtacacatcagtggccctcttttgtgcttcactagaagaatgtagtttttctagtaggcatggatagcagcggttcacttgtgtagttttaaggaggcacggacagcgacgcatctacggctcaataatgtaaagaaaaccttagtctaaagttaaaacaatatctatataccccagacgaaaatagaaattctaattttgtcctaacccaatgaaactcaaaagaaatggagtaaaaaaaaagatatctatataccccagaccaaaatgaaaatactatttttaaccaggcatccaatgaaactcaaaagaaattgagtaaataaaactaacccaatcaaactcaaaagaaattgtgttaaaaaaaagg

SEQ ID NO: 4827 - DNA, 1501 bp, Oryza sativa
acaacacatggtccaggtgataacgcgttcgatccgtcatatccagatgtcaatagatagcaggcaatattaaatgacatggcaggcaatattaatttcgtgaaatcgacagacaattttgcccttctggcatgttgttagcaaccaatcagaaaagggccatgtttttcatatgttagacacatgttgagtgaaagttcagctataaatacccctgctagatagcgtctgcctccacgcatcatccatcttcacgagctaaaaacctcactaccacaacaagcatcttggtttctgctaaaacaaaggtccctctctcgctctctgacacacacacattccttcttcttttcttttttttttgtctctcacatatacacttttttcactctctagagtgaattttctttgcatgtatataacagtcgaagtgatatcatgttttcattgataatacctttagtattgccgtatgagatggtttagtaaagagaaaatgctaattagattctagcaatatgttcggatctacataccacgtatatataacgtattgattgctcaaaaaacgtactacttataaaggtggagatcagatatacatatgctgaaaggctttaactaattagcagttcctttttcattgtaatttatttgtcgcgtgaaagattttcaaagtttcatttccaatgcattcttaatttagaggaaggataatagtgagctactccataagcttatatggagataaagataactaaaaataaaaataaaggacgttggatctcaagcaagaactaattctacacatgctccaagataaacacattagacgtataagtgtgcgagaggaagaaaaactaaataactttatagctaatatattttgtttttgtctctaatataggtttataactagcagtgagcttatattattaaacttgctcataagaattataaccatgagtattaatgagggggcccaaaaatatctttaatttatttttactgcaatttttaaatgcatttgttttacttaatcttatcttacttcgtataattttatatgttagtttagtaaatctttattgattgtaaatttagcttatgtattggttaaaacaatttattatttaaccttttggctaaacaaagattgtgtttaaattagtgaaagatggaagcgatgagagttgttagattttcgtctcaagggcgagaaaaatgactaaaacttaaattaaatatttctctctatgcgttttcatacacatattctgatatatcattgtgtatttctatcttttgctgttgtaatagaactaacacactctttcatcgtcccttgctgtcagcagacttcattatatttcaacaatggatttaacaacaggagccatatggttgttcctggctcaactgttcgtcgctgcaacaatgttgagtaagattgcaacaagagaaagaacaagaaccactggcacaaaattctctagaccac

SEQ ID NO: 4828 - DNA, 1501 bp, Oryza sativa
agagaggagctggaggtggccggcgacgggcgccgtgccagtggagttgaggcccctggcggcagcggcccgggtggagagcggacgatggcgccggcgaacatcgatgatagtcggagaggtgctggaggtggcctgcattgtgagggaggccgacagcgaacggggcatcgggccttgaggtcgtcgggtggtgaggagagcctcgtcccctggcggtagcacaggcggatggggatgccccgggatctaggcggatgcggcctggagaagactgcgttgggcgggcgacttgggctcggactggccggcggcgggatctcctcgctcaaaggcggcttagagaagctcggggcagtgaagcagcatccgggagatggcggcagagatccatgaggtggcggcgatgaccaagggcgcagcaccgcccaccagatcggcgtagggttttctcacttacatgtggatcctttttctgactaggatgccacgtcagctaaactagaggtttatattgctaggggatctaaattgcacggttttgtatagtttaggggtgaagatttctaatattggggattagggatgtcatacaaacccgatgtaaagttaagggacaactggtgatgcaatctcatgtgcattgtatatattcatccattcgaaatcaagttgagattaaccatacgttttgtttacctaatcgatggtcaatgttatgcttatcaccacctcatggtcaacctctacatcaccatcatttgaagcttgaaattaaagatatatatacataaggattggtaaaaattgtactaaatccttccatccatctaaaaataaattatatcgctaatgtgctagcatattcaaaatgttatttctgaaacatccaacccccctaacatcaaaccttcttcacatcacacatccaaaagataaaatttagaaaaaatagtgggtgagtttatctagttgtggtactacactatagatcagaattaccttgataaaaaagtttcatccaccgatgttaccaattttgaacccctgcattttgaaagcccttgttagttgtagcttcaatcatctgtttcacaaaggttaactttctttatattacaccagaaaatctttaagaattataaagtacttcatccgttaaattataagactttctagcattgcccacattcatatagatgttatgtatgctagaaaatgttataatatgaaacggagggagtagctgacaaaaccaagtaacattagtagatgacaactgcacacttgtatttgccttttggtttcactggccataacctaaataattttcagtggtgcaggaattaggctagacctaaataatatgatttcgtagttgctttcacgaagacagcgcatcagcttcattaatttgtactagaaaaattgtaaaaactgacaaaaacacacaaatccattaatttcacggtattttcccgcttgattaatatgttacaaa

SEQ ID NO: 4829 - DNA, 222 bp, Oryza sativa
cgtcaccgtcgcgccgagccccgtgccgagccgcgccgagccccgcgccgcgccgtccgcccgtggccatttccttcagccgcgccgcccgtcgcgttgccacgaggccgcccgcccctcccccatgcccttataaaacccggcccctccttttctccaccccacacccatccccttcattttctcccccctcttctccttctccacgcgccgccgtcgtca

SEQ ID NO: 4830 - DNA, 153 bp, Oryza sativa
tgacggcggcggcgcgtggagaaggagaagaggggggagaaaatggaggggatgggtgtggggtggagaagaggaggggccgggttttataagggcatgggggaggggcgggcggcctcgtggcgacgcgacgggcggcgcggctggcggtga

SEQ ID NO: 4831 - DNA, 1501 bp, Oryza sativa
tgccccataagggcaaatcgttcatgtcaaccatatcattcgatggctgcttctactgcgccacaagccgagctgtcttggtagtggagaccggggctgacaaagaagaaaaccacggaccggcgccgtggctggtggtggcagctcccggcgacctcctccccaccacctcaccggccttctccgcccgacgccgcctcaccggcttcgcgccgtgctgctccacatcgccatcgtcccactccgcccgccgccgtgctcgatctccccgtgctcccgccgccgcctcccttcccttctcttgtgtcgccgccgctgcatcaccggctagccatcggacctcctcgtccagacgacctcccccccaatgccggccgacctgcctaaggggagatgagtgagagagagagagaggaggaagggagaggagaggaaagagatagcctaatgacgtggcgttctgacatgtgggcccatgtgggtcccacgttgactcaccgtcacgtcggacaaactgggccaaaaccacccaagcatgtaaaacgaatggttttgtaagttaagagatggtatatatatgattttatggttggggcatgattttgtaattcgatgacaagttgaggtaccgaaggtgtattttttcctactcctatttgtgttcatacttcggagttcaactcgtcatatggcctccccgcaccggaatatgggcttgatgccgattgggctagcatatggaatatactcccgacagattattgggctgggtatcaaattttacatcctagcactctccacaggaacccaatttccaaaggggcaattgagttattgccctacttcgatatccaaaattgattttgcccatgttttttattttttcgattttacccctaattttttgaaatgaaacagtcgtttgcccatgttccgttaattcttactaaccgtgttaaatgtaggggtaaaaagacaagtatatccttagatattttcctgtacttttgacataatcaaaatacaaatctatttgatgccatactatagcagtaaatttatcaaaattttgtgaaagtttgccaaaatttgggacaaatttgaaagtggtgtacaaaagtaccggaaattatccaagggtatacttgtcctttttaccccacatttaacaccattagcaagaattaatggaatatgggcaaacggctattgcgtttaaaaaagtagggggaaaaacgaaaaccctaaaaaggcaaaatcaatattggacctcgaagtaggggccagaatgaaattgccccatttctaaaaggctattttaaatcggaaaaggtctgatcattcctcaaaaataaactgtgtatagagcgtctcacaactatcaaaaccaaatcaagtccctcggttgttttagcggtgattttctcctacgtggcatctacattgatctattttttatttgatgcaacacttatgtgtgattaccgctaaaaatgtgatg

SEQ ID NO: 4832 - DNA, 1501 bp, Oryza sativa
catataatagtggctaagtctaaagagtttggcaacattcattttgaaacttatctctttgctaattggagggagtgtaaacttttagacgtaaagctgggatcccagggaaggaaatccatcaactgacttgggagccatctctccttcagagggggttagaacttttttctgtgtctagctgttcaaattttggtcctgtgtcctgtacatggtattgcgtattaaccccattaactgctttagtctgaatgtgttcttttactgggagtgtgccatcctcaattttttgtgaggctttcagtggcttctcattattggtattctctagaggcttacatccattttgtctcttcaactacatgttaactatatggtttgaattattattttgggtattggaatcttcttggcattctgatagcctgatattgttctgttgcatcttttcatcctttactgcatcaattgggtagcttacagagtacaacccatttttggaagctatttctttattgcatcaaccagaaaaaaaagattaactgagtcataaataactgtccctttgtgtgtttgttggtattcgtttttatatatatctgatatatgtaataagcgtacataaaggttggcacatcggctttcctttttgagcaaagatgtgcttgtgcactgataacatgagtgtgcttgaaatctgttgttaattcatgggcctgaacttctaaacagaattatccacaccacagacacatgaatattttactatgtcagtaattacacctaggaactatgcatgttaatttgatgagccgctcttcttcattgtagggtgaattggttacagagtatactaacaatgggagcaagataacttgcggtgagtttatgatgcatgcgttgctggcttgctgccatttttgggccattaattgaatgaatttattatattggcagtccctgcttcaattttgtttatcaacatatgggaattgttatactttcagtggcacatttttttaaatttattaaacaatggttgtattttaatacaaagtagacaaaggcatcctgttggcaaaagggcaattgcaccttcacaagttgaatctttatgattttgtaggtttcactgattaacctttgacattatttaattgaaatttgaccatagtggaaatataattttttggggcatatttaccttctttgcggtaactttcttgatgtaaggcttgtcatgttgtagcaaaaagaacattttaatatataaaacatctggatttcttttttgcattgctcattttactttcaggactttatttgaaaaaacataaatgcttgtattattgtttcaagcacagtttgtggaaaaatacatgtttgcttacagcagtaaccttattgacactggactggagaacatgttaacctttgaaatctgaacctgggatgtgtgtgtgtggtggtggtggtcaggccaagaagaagatggtgaggc

SEQ ID NO: 4833 - DNA, 1501 bp, Oryza sativa
ttcttgcacagctttaccctttagtgcacttgtatcaccctgagcttcttgggttactgtttattgcacacaattgccttttatttgctctggctcaacatctgcagcaatttcttcacaatcctcttccttttcaccgtccacctccatgtcagcttcataatcactatccttgtctgaatcatcacataagtccactatttcaggctcctcaacgtacacttatgcaacccctccctcacaaatgcagtctgatatgaattggcacaccttgtcactcagtagagcacgcatcccagtttggatatctttccctagaaaaagccagtgcaaaagtgtgccctctaacaccctgcagtgctcacgcaaatgtgcaaaaatcccactcaatgtcaccttctacctagctacataaaacaatgcctccgcaccacctacatagctcttttcccttccttctgtcacaaaatcacccttcatatggaacctcaccacaagagtatcaagcacgtccatgccttcaatagccttatcctaacatgcaaaatgcaataaaaaaatgacttagctccacccacaattgtcctaaacatgcaaaaaaaacaaagcacacatcttttctgcaagcaaacgaataaaatagccccaatctgcacagatccagcaaaagcactaactaaactactcctaatatacaccgactccaacacatcatcctcctccaccaaacttaaataacggaatcctcaatcccaatactaccagcaccaaaaggcaaagaaatttacctggccactcattgatttgtcagctgccccatgtcggccgaggttatgcaccgccgtgccctgcaccgatgcctccgcaccgcccctagcctagccggcatccgccgtgccctgcgagcgggcctcggccgcgccctgcgccggagccggtggcgtgctcccctcgagccctccgccgccgccagctcgcccttcgccgagcccaatgtcgtgccccccgtcgagccctccgccgccgccagctcgccctcgaggtcgcccgccggttcgcttaagctcgatctagggttttcgactgaggagaatgggagaagtgataatacacgcgcccttttttccgtctcatttaaccccacaccaactgtcgctcccagtcagcgtgccacgtcagacggtcaatgtgccagctcagctaaaaccgccctccatactgctataggacgagaattgactggttttcgtaagttggaggatgggtcatacccggttttgcggtcaaaggacgaaaatcggagtgggcaacaaatagagggacccgagggacccaaagtgaacttattccaatcttaaaaacgtcaacgttgcaggcttcaaaagcaaattttctccaatcaacttgcatagactggctggtggggccacggtctatagaccgggcttagctaataagtactcggtttgttgattggttcgtgcgcgacagcaaggggaag

SEQ ID NO: 4834 - DNA, 1501 bp, Oryza sativa
cttcgtcctccccaacgccgcccagctcctcacccgccggaggcggaggccgtcgagcaggcggccttcgacggagcaggcgcgcacgaggaaggctacaatggcggcgtcgcctaggaagtcgggggagaagaggcggaagacgaggtcaaggtgcgcggcacggagggcggagcgcatcgcgaagttgagggcacggagggaggggtggatgccgaggcgcgaggcgagcacctcggcggcgtcgggcggccaaagctggatcaggaagccgtcgacgccgaggagcggcggcttgtgctccggcacgggagaaggagaggaaggtggcggcaggagcatgggggagataaaagaggacgagctcaagcatggcggcgagaggagtggggcgacggcgggcggagaaggccggcaaggcggtggcgcggagcgaggtggtggcggacgacgatgatggcagctcgcgcgcgcagctcctcccccgcacactcgccggctcccatctcctctaccgccacccagttcttccgtgctgccgctgcccagctcctcccccgccgccgacgccgcccagttcctcccccgccgccggcacctcgccgcctcgaccatcgctcgagctcgcttgcacctttgccacccccaccctcgattgagagacgccggtcgctggggcactggacgacgaggcgccccgcggccggcggcggcggcggtggtgtggtgccggcggtgttcttcgcagtgctggagaaaagtgaagagagagagaggagagtgagtgatgacgtggcatgctgatagatgggtcccacgctgactcagccgccacgtagaccaaaaccggagtcaaaaccactaaaggacctcgggtgaccggttttatatagttaagggaccccatatatctggttttgcggtttgaggacgttttcgtatctcggtgacaagttcagggacctccggtgtactttttccggaagaaaacagtccacccatctgatctctagtcttgggcttattttggcccatttcattatcccccaaatctctttagggagggagggagatacaggaggaaaagtaatgggctgaaatcggcccaacactgatacagtgattttttttccatttaaattaccgaatttgctatatatacggcgagaagttagccggtgtagccgccgcaggacaacgccgctgaagaccacgacgcaattctgccctgcagccactgtcgacctcctgcattgctgctacctccttttatcacctttaagatccaatcacactcgatatcagagaaatcttttgctttcagcatattataaacacatggtcattttgttatatgccttttcaaagttaatttttgggaaaatagctactttagtccctaaagtttgtctataggatcagtttagtccctaatcttttaaatggtcgaaagaaatccttaacctttgtcataagacctagaatagtccttgggtccacc

SEQ ID NO: 4835 - DNA, 1501 bp, Oryza sativa
ggccatcgagtggctcatccgcgccgccgctgccgccatcgacgcactcccatcgctcgactgctccttcgtcctccccaacgccgcccagctcctcacccgccggaggcggaggccgtcgagcaggcggccttcgacggagcaggcgcgcacgaggaaggctacaatggcggcgtcgcctaggaagtcgggggagaagaggcggaagacgaggtcaaggtgcgcggcacggagggcggagcgcatcgcgaagttgagggcacggagggaggggtggatgccgaggcgcgaggcgagcacctcggcggcgtcgggcggccaaagctggatcaggaagccgtcgacgccgaggagcggcggcttgtgctccggcacgggagaaggagaggaaggtggcggcaggagcatgggggagataaaagaggacgagctcaagcatggcggcgagaggagtggggcgacggcgggcggagaaggccggcaaggcggtggcgcggagcgaggtggtggcggacgacgatgatggcagctcgcgcgcgcagctcctcccccgcacactcgccggctcccatctcctctaccgccacccagttcttccgtgctgccgctgcccagctcctcccccgccgccgacgccgcccagttcctcccccgccgccggcacctcgccgcctcgaccatcgctcgagctcgcttgcacctttgccacccccaccctcgattgagagacgccggtcgctggggcactggacgacgaggcgccccgcggccggcggcggcggcggtggtgtggtgccggcggtgttcttcgcagtgctggagaaaagtgaagagagagagaggagagtgagtgatgacgtggcatgctgatagatgggtcccacgctgactcagccgccacgtagaccaaaaccggagtcaaaaccactaaaggacctcgggtgaccggttttatatagttaagggaccccatatatctggttttgcggtttgaggacgttttcgtatctcggtgacaagttcagggacctccggtgtactttttccggaagaaaacagtccacccatctgatctctagtcttgggcttattttggcccatttcattatcccccaaatctctttagggagggagggagatacaggaggaaaagtaatgggctgaaatcggcccaacactgatacagtgattttttttccatttaaattaccgaatttgctatatatacggcgagaagttagccggtgtagccgccgcaggacaacgccgctgaagaccacgacgcaattctgccctgcagccactgtcgacctcctgcattgctgctacctccttttatcacctttaagatccaatcacactcgatatcagagaaatcttttgctttcagcatattataaacacatggtcattttgttatatgccttttcaaagttaatttttgggaaaatagctactttagtccctaaagtttgtctataggatcagtttagtccctaat

SEQ ID NO: 4836 - DNA, 1501 bp, Oryza sativa
gtgcagagctccggctccttctcgagctagggccaccggcgctgcacggccgcggcggcgaagagcatctccggcggcggcggcggcggcggaggcggggtttgtgtgggcggcgcttcaagggaaggggattttaggagaggtgtgacggggaagtgggccaaatgtttgtggacttatggagtttttgggtgattctttggaggcccatattgtagggcactccagcccaaatattcgccgaaaggaatatagttagcagcacagaagtctatacgaagtcctccagtatggactcaaattttcctctctcactgcaacatcagaagctgcatttgcttgaattttgaaaatcaggtgaattttacttccttggctggtttgcacagtgattttctttttatgtggtgtctacgtggtaagccccacttatcagttagaaacgatagacccacatgtgagttacaactttagtcttcaaccccacctcccctctttctctctcgttctccttagtggcactgtctgccacacgatctccttgaagacgcttgaatctagcggtggagcgatggtgtctacttagactcatgcgatgaacctgtggacaactccgatcgcctctactgcacctcgatctcatccttaagtttgatagggaggaagatgagagccatattgtcgtgtgcctgaggaggaggagtccttgccggacacgctcacgactagatctagtctctcccactctactccctttctccggtctccttcgcgttcgctacctccgccatacaccctaagctctgttgccaccacgactctttctcaagttcggttaggatagctgtaagctaaacttgaggaaaacacaggagagatgaaggtggtgtatccgtgtatgatctcagcgccacctggaggttagctaggatgacaacagcgtgatgctattgggggagttcaatagaggcagtgagatctagaagctcaacgaagccgaagaagcgactccaacgggctaattgcatcaagagccaggcatggacatggtgcagctttggttggagcatcaagaccattgtcttgtcgctgaaggccacggttagcagaaagagagtagtagagggagaatagcgtgataaattaaggttcactagcatgtgggcactacaatttttcttagtgactttagcataggagaccatgtcagcataccacgtcagacaaaattaatgtacaatctagtcatagaggtaagttgactttagttttcaaagctaagggaggtgcagatcttggtactgtggtttgaggaagcgaattcagattgagcccctagggaaggcggtgatatagacattttctgggaggaaattagttgagtacgtactccgtactaattattataaaattaaaaattggatttatctgatatttgaaaacaacttctatatgaaaaattttccgtacaaaataaactatttaacagtgtaaaccgttt

SEQ ID NO: 4837 - DNA, 1501 bp, Oryza sativa
tatctggtttgtggctgagggacgattctgtgactcggtgacaagtagagggaccttgggtgtactttttccccaaaaaaatatcaccggtccatccctgcaaaaaaaaactcggcgcacccacgcaagcgggccggagattaacgggcctcccggacaggcccctcccccattaattccgtccggcccaacacagcccgccgtctccgttgcagtcccgtcccctcgccgccggacgcgacggcggccaccacagcatttttgatttccggattcctccccttctccgttccgtccatccatccatcccggaaatatccccaaaccctcgcctccccctcccccccgccgccgccggcgcggccgccagatctgcggccatggacgacgacggcggcgcgtccccgtcgtcctcgctctccccgtcccgctccccgtccccactccccgttgccgaccccgtcaccgtcgccgcggcgcccccgggccacctcgccctcgccatccccatccccaagcccggctcctcctctggaggtgggggagggggagggggaagggaggacgcctggagcgacggcgccacctccacgctgatcgacgcctggggggagcggttcgtcgcgctggggcgcggcagcctccgccacccgcagtggcaggaggtcgccgaggtcgtctcctcccgcgacggctactccaagcagcccaagtccgacgtccagtgcaagaaccgcatcgacacgctcaagaagaagtacaaggtcgagaaggccaagccggactcctcctggccctacttccaccgcctcgacaccctcctcgcccccgtgcacaagcccgcgggcgcctaccccgccgccgccgccgccggggccgcgggcgcgggcaattccggctccaactccgccgccgccgctaccgccgcccggagcaccgcgcccatggcgccgcgcgtcaacttcccgcagcgcacgcgcacgcagttcctcccctcttccggggtgaagcggaggatgccgtcgcctccccaggtatcagcgtcgtcggagtcgtccgacgggttcccgccggagccacctatggcggccgcgaatggcaagaggcggcgcgaggtggaggaggaggtgaacggtgcggacagcggccaccgcacgcagggcctgcgcgagctggcgcaggcgatccgccggttcggcgaggtgtatgagcgcgtggagttggcgaagcgggagcaggagctccggatggagcgcgaccgcctagaggccgcccgcgagctggaggaccagcgcgtccagttctttctcaagatgcagatggagctctccaaggccaacaatgctggcgcctctgctgccgctgccgcagtgggtgccgttgccaccgccattgctgctgccgatggcaatggcacgaggagaaccgctatggccactgatgtcggtaccagcagcaatcaccatgttcggtaccgcttccaggacagcaggcactgcca

SEQ ID NO: 4838 - DNA, 1501 bp, Oryza sativa
actatatatccagattcactgtactatgatgtatcaaattctagtatgaggttgtattattttgtgacggagggagtagcgttataagcggattagatcattcgtggattaattgtagaagaattaagtattatattgctctctccaacgcaaagcataaagaatttgtaattatatttatagtactacttatcttatcaatcagctctcttttacttttttttttcatcttactcacctatcttcccacttccccttattaatttattaaagagcgctaaaatctattcttcttaatattgctaaataaacaacttaaaaatgaaggacaatatagtatgactcttataataaagccttaaaacttatatttctagaaatgttgagtactctctccgtcttataatgtagagtactagctccctccatcccataatatagtaatatgtctcatcacattctagattgctatattataagacggatggagtaaataatccacgttaataattcaattggttggataagccggaaaagaaacgttaccttttgcaatattgctactgtagcaacgtagctctggaccatggtacatgagtgtacaagatcagacacgagatgatcttaattaatttctcctagcgtgcgtggctacagtgcgtaagaataattgaaatttgatcggccgacacatgcaatgcatacgtacgtacattacgtgccaagagaaatatatggatggatggatgcgaagatagccgaattggcgcgaataatccgagacgacacgacgacagtgtcacagtgcaagtgtgcactaccgacgactacagtatgcatatgccccccaatcgatcgatcgagttgacgaagtgcatgcatccgtggatgcaaaattagagcacatagaagtatatgacagcttaatttcttgttaattcgtgcatgtaagcatgtttgccggtgtactacatctagagaggtgcgagtatactcattcaatttcagaataagaacattttgtactcttcgtgtttatctcaaaataaggtttttttaatcggattttatgaaagtaggagataaatgtaatgggagtagattaagaaaaagtaataattacactgggatttgatagtggaggtatcctagttttttttattttgtattggtaaatgccagatagatgaaaagtaaatttaagagagggagtactctgtattaatttatgtgtgattacctacatatatacggaggatccataaatacgataaggtatgttcacaatgcctatgttcacatggttactgtagtttaccaaacggccatatatatacctatgtttttttaacacaaacaactttattaagcaagaatagatattaggggataaaccctagtacacgatgaaggatagtagctgaaagcaaaagagccatcacttaaaaaaagagggttaactgaactacagaaacagccttcctgatgtaaccgaacaaca

SEQ ID NO: 4839 - DNA, 616 bp, Oryza sativa
caaatgggagccgagggggggcatggaattttccaggcggcccccttgccgccctccgcgagggcgattttgtactgtgcggggggccgcctgcaaatgggcggcgagggggcatggaattttgcaggcggcccccttgccgccctgggggagggcgatttttgcctcccccctataaagcccagcccctcccctgtcaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacactgcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 4840 - DNA, 1501 bp, Oryza sativa
atacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgatcaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatatgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgcagtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttgacaggggaggggctgggcttt

SEQ ID NO: 4841 - DNA, 1501 bp, Oryza sativa
catcaccaacagattatctataattttctcctaaaaatttgcttttgggtttcctaaactgaaaataggaagtgaaaaaactcctctctccaacagataacctaaattcaatccccaaaacttaaaagtgggcccgtctgttaaactaccaagaaaaattccatcttttttttctttcacgcgcagaaagatcgctatctcccacgcgcgggaatgaaggagagagaggcgggattgcgtgattggaagcgactttcacgcccgcatataaacggagcgaggaaccggtggaagggaactccaaaacttaggtaggagagcaagggatctgttggagctgatttttggactaaaatccctcaaaattagttttgggaatcatataggtagactgttggtgatactcttaatcgatgatggatgagtgagggcttggggtcctatttatagggcttgggcgagcagatgagctcgagcgccatcaacgcaattgatgagctcggtgttcgggcatggcaggggtggcagagggctgagagagggaagggaagagcaaattgagtggcgggacatcatgttcaaacatttactgacgacagtggggtttaatcgggggcgaagacaagcggcggcgagctggcgtcctcccgggctcgacgcacggcggcggcgaggggtaaaacagtcggcttggcggcgttcggttcgagttgagagaaggaaaagtgactgtcgacttttaccccaaacgcgtggcagaatttggtcgttttatccccggtagaagcaaactcagtcttggcgtcagcatcgggtgggcacgcacggcggcaggcggtgttaagctgcggcggcggccgtcccggtttctcctccgacgagattagtgcagcggtatatggttgaggctcactggacggcggatggcatgcacggggcgccaaggcagcgcggctaggggtggccacggttgtgacaggacacgtgtcgcacaagagattaagtctttcgcaggagcgtaagacttcagtcttaccaaattttcttccggaaaattgatggggaggccacggttttagagggttgtggtccccaaggacctaacttagactttgccaaagtttaggtggaggttgggctgctgttgtcgggctgaccattttatcgaacacctagagtgtgatgaacagtaaattcagaaattttgaatattttgcctaaaaggaatagaaattatctaaggcctttggatgggttttgctaagtttttgcactatagcaatgtctcactagaattagggtaatctaaggaaattttctaagttttgaattttgaaagaaatttgctaaaaaaattagggtttttgggtaggatggtataaagttggttttaaaggaattctaaaggggtattacttgaaccaaagaccaaggttaaaaaggaacttttaaaaaaaactttgattaattcaagtaaaaaaccaacataatgcagttaaat

SEQ ID NO: 4842 - DNA, 1501 bp, Oryza sativa
aatctgttactttaagcacagcagcctagcgactgcagattgatgggcctttggttctagcaaacaaaagataatagtaataaaaaatgttatgtattggttggataatatgtagaccacagcattccatagtcaagtttggcataagatgattagaaggaactacgtatactcaaactacatgcaatggagctatgagtttccagagaaatgttaatacaattcaagtaccgcgacagttagttctacaaatttaagctgctgtccatatcagacgcattaatatatatttttttatttattttagataatattataatttattatttattcgtagtaaagcacgtgcattcagcttgcataatagtaatggctacagtagatataactaaattcttttgtacccccaaatgcaattcaaaaatttgaagtgtttaggtcacaccactgcacaagtgagttatcgatgtgcattgtactctgtacatataatcgtattaatggttgactagagattctatacaccacactgcaaacttttagcaataaatcgcggtacatgcttaagccgagagttgccttttagggcacccaccaaattaaattgagctcctggctatctattatattatcaaaacagctatgaaaggaggcaccacgtttgctgtggatgctcgaaattcccatattaatcggagaaaaagaaaagaagagtcaatctaaaaataactgaaattcggaattaaaaatatgcaatattgatagatgagtccatataggaacccaatacgtgattaattaaaatttggaataataataaaataaattccaaaattagaaaaacaaaaaaagaagagttcgagtacgtaggtgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttgggggatctgtgtatgaaggagctacaaagtatgagccagcccctcccttgttctgggttccgaatctggaaaagtccagtcctcctctaagtgggcaaggtcctccttttatatcttaaggggataccacatgcaccatctccctctcttctgtggggacttactctaccttttcataaatggacggagatttgtatagttgccgtccgaatgaccttctgataggacggcccatacctacctccacttccgccggaagcaggtgcgacgtgggattatggctgtctgctgacgacatgaccagtgtcagactggtcacaaatcgctcattcttgtccaccacgtgtcagtttagcaatctacatgttggcccttcttcacacaacatcttgcctgtaatggttaggatgaagcctggcatatatctaaccaggactaacg

SEQ ID NO: 4843 - DNA, 1501 bp, Oryza sativa
ccaggactaacgtgccatctctgggaggtaacacgctagctccagctggggacaagcgcctagaagccctcgtcctgacgggatggggcgaggcgtgcgtcagatcgcctgtcgccacctaacccgcgatctgaccggtctgtgactggtcacaaaccggataaacgagtgcactgcactgcgttacatgcggcgtgacacgctcagccaaaccacaataaatgtggttaggtgagccccgctgtgctcacctaacccatacacgcggagcaaaaatccacgaggggtcggggcgcctcggccctcggggccgaggcgggtgcggcccgaccccctcggggggactaagaggagggcgaacacatcaccctcgggcccgacgtcccccgagggtgccaggccacgtgggcgattgtgtctgcctcaaacctctagtcatgatactcctgatcccatgtcaccgacagtaggaatacaatttataaataactaaaattcagaattaaaaataaaaattattgaaagaagagtgcatacaagaatccaatacgagataaattaaaaattggaataaaaaaataaaaaaatcgaaattagaaaaaaataagagttcaagtaggaatacaatttaaaattaacttaaattcggaattaaatataaaaaatattgaaataagagtacatgtaagaacccaatagtagattaattaaaattcagaataaaaaataaaataaaatccgaaattaggcaaattaaaaagatttgaaacaactgaaattgaaaataaaaaataaaaatatcaaaagaacataataataaataaaataaattctgaaattagaaagagaaaaaaagatttcaactaggaatacaatttataaataactaaaattggtgataaaaaaataagactattgaaagaaaagaccatctaaaacacatgacgagattaattaagtaacaggcctatggaggagcagagttgtggcggttgatgagacatctaaaaactattaataaaacagtaaatagaatcctaatgacgattaaaagaaaggatgatgggcagatcgtgaagcaatcggtcaaggcggttgtcggggacttctagaaagtaaaaacataaaccccaatgataatcatatttgatttttaaaatctcaattataataaaaatgagaggcagcgggtgggtcgtataggagtacaatggcagagtcgtcgatggttgttgcgtcttttagaaagtaaaaaatgaattccaacgatagttatgttcaatttttagaatcccaatgacaataaagattatgcggcggacgggtcgtagaggagtattttgacagcgtttgacatgatttctaaaaattataaaaaacatgaaacccaacaagacaataaactctaaaaactataaggtacaatttttaaaggttcgggcttctaaaaagtaaagaaaataaaccccaataataatcatgttagattttaaaatctcaa

SEQ ID NO: 4844 - DNA, 1501 bp, Oryza sativa
tgtccgtggcttgctatacttatatttactgtatattttgtgtttcctccgttacgtgtacttgcaatgcccacattactcggcgatttacgattttatacgtaatttttgttgaacattttataaataatagacatatcaccactttgtattatgtttttacatagattattctatgtttctttctaaaaacacctccttaccgtgtatgcattgatcaaatgtgtgaagtaaatttcaaccaaaatggtattaaacatatcgattctcagtgttatagtcctttttttttataaagcaactaaatagacccacaagcaacaatagttcaaatataagaaaggaaaaaaaaacatattgctttatctcggaggacatttcgatcataattccaacaatattcagacgtgtgtatccaacacacgtgtatgcgcgttatggtactaactgtggacaacaacactctacacgagacaatatgtaacattaggcgacaacaaaaacgacggtggaactgtggctgccaattccactagtccaattagggagcactgttgcgaaaaaaaaacttggtagccagtcagaaatgccaaaaaaaaaagaggaaatcgtttagggtaggagtcttatttattgatgataagtgtggtgtacgtgcatatatacatccaacaaatactaaaaagaacctattactcaaatggaggaggaagcaagctaaagtaaaaatgatccctacaagcatgagcctaataataataccataacggaagaacaataatccacgcgaccacgcaggcaaagaaacgaaaagaaaagaaaaccccaacaaaaaaacaattaaaaaaaaggagtaatagccggaaataagacgaccatgtgttgttgggcgcggtgaggggcccaacccagaaataagcgaggcggacctgggctatatatacccctacccagtctcctctttccggtttcctcttcccttcccccttcctcctcctcctccccctcctccggtgcggtgcggtggagtccccttcctcctcgcgctcctcctcctcctcaaccctactccttctcctcctcctccgaatccaaacctgacacacagaggcggcagcgagaaggtggaggagaaatttgaacggaaaaggttgggggatcgcatcgcaacgaacccagcactgcagcccccccgattccgattgggtggggggtcggatcctcggatccccccgcgccgccgataattcggccccgcccccgcccagatccccgcgattccggcgccggcgccggggatgagagccccgaggacatggtcgccgtggcacgagtgaggcggccccggttgctgcgccaccaggaggaggggaggaggaccgcccgcgcccgcgcccgcggcggcggcggaggaggtgtctgcggtggtggtggtggtggtgacctgaggcggaggagggaggaggtggtgggtgatccggggcccgaggcggccgtgcca

SEQ ID NO: 4845 - DNA, 1501 bp, Oryza sativa
cagggctgaatctcgccgcccgcggagagcaccaccgcgacgcagctcggctcggctcggccaccggcgacgcacgcgctcccgctccctctcccgagcggcgccgtccctccctccgtccgccgcccccgcgcgtgtgaaccaggtggaacccatagtgtaaaaaagcggacgggcccggcggttgaaccggcaaaaaccggaaccaggtctctcaccggtcggttcaataaaaagaccgctcgtgcatttgacccggtaagaaccgggtgaactggccggtttttgttgaaaaccggtgaaccgggctcataagaacaggtggttcattgcaagttgggctaacacttggggctggacttgtaaggcccatcatcctaccccacggcccatttacattttatgcaaaataggagagaaaacatgcgtgggaagggatttgaacccataacctgtgcgtcgagaccttatcatgcttaccatttagctagctaactcatcctgtctaatagaaaacatataatagtcatatgccttcggttcagcattgaaccggctgacccagtggtccgaccggtgaaccagtgaaccaacgagatcaccgggtcgaccaccggtacgggtttttttactatggtcgtcgaggagggccacgggcgtcgtcgagggcggcacgagggggaggcggaggcggcacgagccggcggcagcgggagctggagagggagaggaaaagacgagagagaggaaagagcgtgagcagcggctagggtagaggtggccaaacgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcggcacggcacggcacggcccgcggcacggcacggcccgtttcgccggcggcccgtcaggccgaaagcgggccagcggcgcacgcgccaggccgaaagcagggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 4846 - DNA, 1501 bp, Oryza sativa
acctcagttgaaaaaaaaggatccagaagtagaagacgtttggcttataccccagttgagctgcctgtgggagtggagctgaagccattgctaaaccgttaattccgctgctgttttcttttcttttgtaagtatgtaacgttattattattatgatggatttgaatattaaattgtcagtttgtgtacctcggctgattcctggacgaggattttatgcacaaattagttcggaaattataagtgaatttctgggcgtgacataacttatttggtaaaaatctctccaaagttagtaaaatttttactcccatatagttctcacattaattcttctacttgcatatattttgcgagttgtcatagtaatatttttactcggatatattttcctcgtagtaatatttttactcgtatgttctcatagtaatatttttactcatgtcctcatagtaataattttactcatgtattttactacatgttctcttttactcccatgaattctcatttgttgcttcatttatcttagaataatatgtgaaatagcaatatgttaccgttcgttttgttaccttgaaccatgaaaatttgattatgagtaaataatacaaacattgtagaagtcactatgcgggtgaaaaaatattacacatcaagctagcccacaaaaacaagaaatatgttcttctaggagtgaggaagaacagctggcccagcattggatagccggcgatagtaagcatctatcctggcttgcttcaccacgtgacgacgtggtcggccttgacgccgtgcgtcccaggctcctagtccacacatcggttgacccatcaccatcgcacatcaccagccatgcgccatagatctgacctcactagtacagatccttccatctgtgacggcccataacaagactggaatttgcgggccgtcataaggaagtaatctcaatcgggccgaagtttcgcccgattgagatatggtcgcacagccatggtatatcggcataaaactaaagcccgtcacggatgacacttatctgtgacgggctatagttgaggcccgattgagatgagggttccatatctcaatcgggcctaaaagaaacccgtcacagatgagggtcatttctgacgggctccaactagaggccagattgagataagtttattgtccgtcacagatgacactcttttttgacggccttttattaaggcccgatagagattacttgtatgcccgtcacggttgattgttttagggccattacagatatttgttgcacagtataaataccccccaccacctagtgtaactgtatcccactgttcactattttggtgggaggctgttgggggcgattttttgtcctttttccaaggaaaacagaaattaaattctcaaaagtgatcaaaatggatcaatcaagtgagtaatataaatcattaattgagcaattttatcacgtcttacttttgcaatactgatcttataatat

SEQ ID NO: 4847 - DNA, 1501 bp, Oryza sativa
tctttcaaatgatttttcaaacaaaaataaaattttcaatgaaaatttattgtgccacgaccacactgaccattggaacccaacggccaaaagtggggccggttaggcccactaggggttcggccgaaaccctggttcggccaaaccggttaggccaagaaagaaacctttctaaagataaaaaggaaacataaagtccttatgggacactaaacacaccttcctaaagataaaaggaaacaaaaagactcttcgtaactaatagataaactgtcatgttgcatcctccttgaactcagtcacttctggataaacttcctttagtagattaatttccttaaccaaatacagcaataatctgactattggcgacttgataattcccatcggccgattccaggactatgaagccgataatgattttaggccgatgacgtcttcggggcttgccaaatttcactgttaattgataggtaggtaagggatattgaaggaataaatttttttgatttatgacctgatagtggattagaatgtagaagttgatttattttaggacaaaatttgaattccagaagcagatttattttgggatggagggagtagattactgtagcagattaatcctgtagcaaatgctagcaaacggtatactctgggccggtttggcacagctctagctcccaactccaacttatatagagccggagctgtgccaaacggtccagatcctaagttttctagagtggagtttgtagagttgctcctaaaaaatgaactaagggggtggagctgggtttttctgctccacagctccactcaaccccaaaggacccactaccctttaattatttgacatatttacgtgaaactgccactaacctacccccacctcctcacctccctcccgtaactctccaagtcccacccatcgagcgaggcggcagcggcgggcgaataggcggcagtggcgggccaaccgtagcgcgcggccgagcaacaaggcgacgagggcgcttcggcggtggcttggcgcgggcgggcagaaggccgcagcgctctggcggctgctcggcgacgcgtaggcgggcagcaagccgcggtgctccggcggcggcttgacagccgggtagcagggcgacggcggtgctctggcggcggctcggccaaggaagagcgctgtaaggatggcagcggcggcggccaaggaggcgacgggggtggaggcgtgcatcagctcgagaaggagcgccgcaagatcaagatgttcaggcgggcagcaggtcgcggctctccggcggcggctcagcggacgcgaccagctggccgacggcggcgcacggccggcggctagggctgtgaggagctaatcccctctaccattttttcattttttttccaatttgaaatctagaccaaaagaacaataggtgattttgcatgtatgtcatgggtgattcttgttttataagaactatgtagaagtgaaaaattatgtgtt

SEQ ID NO: 4848 - DNA, 1501 bp, Oryza sativa
attgcttcggcaggcgaaggggttccaaggtacttgacgcagtagatatctttcggaccagaggatgccgaagtagttctgttcccacacaaagaccagctggtggtatcggtacaaatgggcggttttgaagtttggcgtatcttgatcgatgggggtagctcagctgatgtcattttcgccagaacgtatgccaagatgggactaccgaccctggcgttgtctcaagtaccaaattcgcttgggtgttcggaggcgaagcagtgcaagttttgggtcaagccctcttgaaagtcgccttcggcacacaagaaaacaagagagaagaagagatactcttcgatgttgttgacatcccgtacaactacaacgccatcttcggccgaggcactttgaataaattcaagggaataccacatgcaccgtcttacacagtccatcattggatgggcgcccacatgtcttaggtcaagacgccgtccatgccttcgaccggaagcaaggcggtcgttcgcccccaggtgggtcccagtgccatcctccggctgacacgggggacatccctgtcattccctcttaattccatggagacttttgtggattcgtgtatggggggcacgctcgactgcgtgccgatgggacggggcatacctgcccccactccgcctgacagggggcgggacgtgggtgcgctgccacccatcccatgcgcctgtgaccggtcatagaccagtcaaacccgattgacgcacgtcaatcgggcggcgcctcacgtccgcccacgccacattaaacgcggtgagggacggttggggcaccgctcatttaaggcgtttggcagtgcctctccctctgcccactcggccgccacgtggtagctaagtgagggccttggggcagtgcgctccaagggcccgaggggtgcaacagggcaccccgaggccctttggccgcttcacgagcgctcgttctcccctgagggggtaggaacaggccatgcagccacgtggccaaatgaaaggattctttccctctatcttgcgtaccaccgggcccatatcaccgacagtagcccctagcactacatctgaccgtaaccctaccagggcggtctggcgcggtgtctcataacttcctgttttgtgatggtgggtcccatggggagtccaaacggccgtcatcggtttgcctagcttgagcacctaccatgatgatgacttgaccgctaataactgcgccacacacggggacgcgtagggcaggaaaaccgaggggtctgctagaccgcgctcggaatcattacttgccatcacctcgactgcctgactatcaggcacgcgaggggacggaactaatggtgggcccgcccaaccgcaaccgtaatcattgcacgtcccacatcgattttgccgctgacaggcgcattaaacacgggacgtggatttagtaggggaagcaggacgagtgggcacgaaaaacgaggaggcgggcgcggccgacg

SEQ ID NO: 4849 - DNA, 1501 bp, Oryza sativa
aagtaatccttgatgtcaaacaagaacagatcggctaaagcctacaaaaggaaaattgaagacagttaaatttcaaagcgaattatatagccgatctaagatttatgacaatgaaagacttactggtatggcaggagcagctcgttgttcttcctcctcaatattgtggctgcctgcagccgatggagtacgatcactgggcgtcgactgcacaggaggcgaaggaggaggagaaggctgaaaaaaagacaagtgttaattaacatcagttatgatcatatttaaaggattttatagaggaaaccttaccggtggagctggtttagatggtgctggtgctattttttcttgacgacagttttttttttctacaaatacaaaattgataaccaatcaactctgcaagttttttcaggagatgatcaagatgggttatttccccttgagaagtgagctggagcagcaggagttggaggagtctatttgcgtgaagccgatgatgttttttctcctaagtcactcagttcggctgcagcttggtcgacatcttccttaatctcttcttcatctagggcttgttctatggatggatctaaggcaggcaagtcatcggttggcttggatttcttcttcttggcctttctctttggagccagagccgatggattagcggctgatgccttagttttcctattcctactggcatcagctagttctcttagctgcccttggagtagacttgaggtcctgggggcatggtagccgatgacgggggagttagtccacctccatttggtaagaggcctgaagcatactcgatgtccttgccgctgttgcttttgcgaggatgggaagattctattgtctgcaagacagaagatgagactagtaaaggtacaaatcggctgacaattattttacaggattgacaaagtaaggatttacctgagggataacatctgggaatagatctgtcatgtacatggaagctgattggtggaacaagtgctgcttccattcaccccaccatctgtcaaagttcctgctcctgaactttgctagttctacatttttgatgctgcccaaagggggtcctgggatgttcaacagccgatccatcatcaatgttgatgagatttcgcctctaaattgaattttatcggcaaaataaaagccgattggcagctgtcccatcccaaactgcctggccgagctcattggatggtagaactcgtaagacacttgtatgtttcatccttgatggatgccaacaggaagaatacatggactgatagcagccaagaagacctctctagacttatcatatctttcagaattgatttcttcaaatctaaagtctgatggcagttcaaagctcattgagtcttcatatgcaaaccaaactcgagcatctttctggaagccctcatagaatctgcagaaccagtctttgagcagttcagccgatagctttgctccagaatcggctggtgttgatgca

SEQ ID NO: 4850 - DNA, 1501 bp, Oryza sativa
tcacccaacatgtatggccctctatgaatcctcgttgtatcagatgaccgtgtacgtcctctccgctatcaaacatattctcgttcttgcaatctgcacatggacaacacatgtaattactgtttcttcttatccgatcctcctccacggcgttcataaattttattacgctctttcggtactccgtagaatgacgtttcaaatttttggcatacatccaacttcgatcaattggtacaaaataaaaaaaataaattagaggcacatattataagatcagtattgcaaaagtaagacgtgataaaattgctcaattaatgatttatattactcacttgattgatccattttgatcacttttgagaatttaatttctgttttccttggaaaaaggacaaaaaatcgcccccaacagcctcccaccaaaatagtgaacagtgggatacagttacactaggtggtggggggtatttatactgtgcaacaaatatctgtaatggccctaaaacaatcaaccgtgacgggcatacaagtaatctctatcgggccttaataaaaggccgtcaaaaaagagtgtcatctgtgacggacaataaacttatctcaatctggcctctagttggagcccgtcagaaatgaccctcatctgtgacgggtttcttttaggcccgattgagatatggaaccctcatctcaatcgggcctcaactatagcccgtcacagataagtgtcatccgtgacgggctttagttttatgccgatataccatggctgtgcgaccatatctcaatcgggcgaaacttcggcccgattgagattacttccttatgacggcccgcaaattccagtcttgttatgggccgtcacagatggaaggatctgtactagtgaggtcagatctatggcgcatggctggtgatgtgcgatggtgatgggtcaaccgatgtgtggactaggagcctgggacgcacggcgtcaaggccgaccacgtcgtcacgtggtgaagcaagccaggatagatgcttactatcgccggctatccaatgctgggccagctgttcttcctcactcctagaagaacatatttcttgtttttgtgggctagcttgatgtgtaatattttttcacccgcatagtgacttctacaatgtttgtattatttactcataatcaaattttcatggttcaaggtaacaaaacgaacggtaacatattgctatttcacatattattctaagataaatgaagcaacaaatgagaattcatgggagtaaaagagaacatgtagtaaaatacatgagtaaaattattactatgaggacatgagtaaaaatattactatgagaacatacgagtaaaaatattactacgaggaaaatatatccgagtaaaaatattactatgacaactcgcaaaatatatgcaagtagaagaattaatgtgagaactatatgggagtaaaaattttactaactttggagagatttttaccaaataagt

SEQ ID NO: 4851 - DNA, 1501 bp, Oryza sativa
gaggtacacaaactgacaatttaatattcaaatccatcataataataataacgttacatacttacaaaagaaaagaaaacagcagcggaattaacggtttagcaatggcttcagctccactcccacaggcagctcaactggggtataagccaaacgtcttctacttctggatccttttttttcaactgaggtttgatgattattgcaaggtgagcatatgacatactcaacaagccacacagcaaatatgcaagtgcacaaggataccaaaggatggcataatataggctcatttgcaaaagcagcatttagcaaagatttaagagtaaaccagtagagtaattaatcagaaatattaatcaacactgaacagcacacccatgctgctcaggcccaaccatccagaacaaccatacccggctgtacagatctaactccaaaccaggagctaaacaaattattaccagttattgcatcaataattatttgtgagaggtatgagactaatcacgaaaaacattgctcaacccgcccatgaccgcgggcacggctattcgaatagttttactctagccagagatgtaccattatacccacaagacacgattccacacatattgccataccccgaagtaccaccacggcactgcaaagggactccacagcgacccccatggacttctcgccgcttctcagtctggcaccccgtaataaactatgctatacaaaaggtaaagccgttgcccacgctggcttgtggttggcacggttaatgtctcacaatagtagctcgcgaaccggtccttaattgccatgagcacgaccttcaaaaccatgtgctcacaacccaccatcgacaagttttaattatcatttaattatcataacacgattaaccatcgtgagctaccattaaatataaccataaataataatgtagtgtgattcatcccattagtaagctaatgtttctaagcatggctaagcaatcatatatatatatatatatatatatatatatatatatatatatatatatatatatatatagcatttagctgaaccaaaccaatatataaggttctagctaatcaaattataacccatagaaaaataaagtcatcttcggccattaattaattgggaaaggctcaccacccgatgacattcgaaaataatgcataaattgaaataaaacattagctttaaacgggttcaacatgctcaaagggttgtttgggatctgtgtgacttgccttgcaataattagtcttcaattagtctttttaacacttccgacgcactcacgaaccttcgcaacgacggaaacgacaagctaacacgcaaaacgaagaaaaagactaataaaaaccaaataaacagtacatataatgtaaacaaacatgtagatcatgattttagatgaatttagagacttgaacggcctcattctgatttcatataaattaattgtgaattttaaaagatttaactctaatta

SEQ ID NO: 4852 - DNA, 1501 bp, Oryza sativa
aagcatgcattagatgagatcatcatggttaataatcgattaattcaataacatccacttcttcatctacagtttcatttggctcaaggaaaatctttaagcgttgatcatttaccttgaatatatttcctgagtcgtcgcggggtgtgattgccccgtgcgaagaggtgtcgattacgacgagctgtccttcccatttactacccaattttccgtggccgaagaggcttaaccctgtagttgaacatcagtattttgtctcctagcttgaattgcttgatctttatccttttatcatgctagtgctttgtcctttctttatatatctttgcgttggggtaagccttctctctccattcttcaagtttagcaatttgcatttttctccattctcctgctccttcaaagttcatattccagttcctgatggcccaacatgctctgtgctcaagttctacagggagtcagcaagattttccgtagactatctgtaggggcacattccaatgggtgtcttgtatgctatccggtatgcccacagtgcgtctggcaatctatccttccatcctattcccattctgttgaccgtcttttgtagaatattcttgatcttggtatacccacaggaatacttctctaggatagcaggggtaaaggtagaatagaaaagtaaaaaggatacgaggatgagcaaggtttgggaatgatcagcaactgttccccagcaacagcgccagaaatgcttgttggtatttcttacgatcatagatagaatccgcaagcgcacggatataccgatgtagcacttcccctacggagtattccaggggtatcgaatccaagggaacgtgtgtggtcagatcttcctccggttcatccaaggacaccaagcagatgataggctaggatagagaggatttactagtgagaaacagtgtctagggaaagcttaactttaatcctaatgcaatacttcaggcactggcaacccgctgttcctaaatatcgctctactacgtacacggacagggaggacttaagtactcttgagggctgtcaccacctctacacctaccttaaacgtgctatgggatacgcagcaaccactagaaattaattacccagacaccgcgtctacgcaattaataactactctagtgcagatcaaacactaaagcaatcactataaataaatgacaatgatcccgtatgctatttaggaactaaccaagagataattctcacgagataaatctaactcaagaagaatattatattgaatttagactaatgaacagaataaaagaaatgagagaagattaccgacaactctggaattcttccgaattcttctactctactctcttcctattttagatacaatatagtacaatagagcctcttataattcagctgaaacttggaagtgtgtatgtgaagtaaaagagtaatgtcgttatatagaggtaggtatgacgtttggtgaaggggaaaggtccga

SEQ ID NO: 4853 - DNA, 1501 bp, Oryza sativa
cgtgattccctctccctttccccctattttcccctccccctcccacattcaaacggccggatttgctcctgcaaatcacaccggcgccattgatgccgaccataacccccgcgccggtttccttcccctccggtcgccctctttcactcccaaccctatataaaccctcctcgtacctccctcgtccatttccgccgtttgccgcccctcctccttgtcggattcgcgcccgcgccgttgtcctctctctccgccgtcgccttcgactttcggccgggcctagtcgcttcccgggaccgtcccccgcctcggcgtcatctcctccagcttcgccgcaccaccaccaaccccgtccatcgcctcgccgagctcgccgaccgccggaacgccgccgtccccgcgaacccgagccgcgccaccgtctccctccactccgatcgcctcctccgtcgctgtcgtcgcccggggtgagccgtggaccgctgcctcctttcacccttcccttcctctctctcggccgccgctccgccatgcctatggctgccgccggcgaccatagggacgcgggcgccgcctccctgcacgccgtgtggctactgcgtggggccccgccgtcagccgcccgtgccctcgggtgcggctgacgcgtggggcccacggcgccggctggtgagcccgcgggtgcacccggttcaccgtgaaccgaggggctgccgcgtggggcccaccactcctgtgaacccagcctgcgcgccccctcccctcggctgacgcaataaatcgttttaactaaaaaattaaatgaagaaattcacaaatattgacttaaagagcaataaacttcaagtggccataacttggtcgtttgtactcggaattggactgttcaagtctctaatttttccttaagaagtcaaggacccatttttgtgctttgtttttgtttgttatatggagtttattagagtaaaagcctttttccatttcattggtcgtgtagacgctgcagcttcagaagatccgctctacgtggaggttgaagccgacttttgggaaagcgagcaaggcaagtcacatcatccttgagcatattgaatcccagtttataaaattatttaggtttaaattattgcattattgctttatttaaattcccgcgttatcactgtttatttagccatgcctatttacctttgttatgacctcctcattattgctaatgttattattaccttgttcaccctaggataaacaaaaccccaactaataggtactctattcatggttccactagtatgaatttaggtagatgcttcgctgataaattaggcaacattaggtggttttattactttagacttttgaaatgcacatatcatttggacaatatggaatggttggcttatgtggaaatggacacaccccttctcctccattcaaaaccccaaaaatggttttaggctgggctcgaggtgtattgttttgatagtagcacctcggc

SEQ ID NO: 4854 - DNA, 1501 bp, Oryza sativa
ggaggatgttaggccagttttgactgcaccgtgtaatgcattttcagtttttcacccaagaaaaaaaattcagttggatggccaaggtttgaaaaatggatggtttatagggaaaaaaataataatgagatttagatttgactatttgagagtacaattttgggcctaaaggccatatcaggaattaatgactggacctgtcattaggctttcttagaccatcatggagggatgtactcacgaactaagaaggtggtgatgtgcacggtagagtccaaaacaacaaactaaacaattaacttatgcacatgtggattattacgaaaataatcttctgagaaaacaagaatttgcttcgcaaacggtggattatgaacatatatgtttctaaaatataaaagattctatatctttttcatagaaaaaaaagtctaagaaatgtcattgacaatcattcaatttcaagaaatgatatcgacgagtgtgagtgtcatgaaatgtcatcgtacaaacaacttgttctataaataccatcatcattaggattccgttggtagccctccgttaagtgctataggatgaatgatgtatttaacaacgcggatggtcgacgatgacatttctgagaaaagtcgcttatacaatgatattttacagaactcatacttatcgattacattttcttgaaattgggtgcttatcactaacatttcttggattttctctttttataaatcaaactattataagtgctaccaggttttgttgagaaaaatattatcatatgctatataaaaaagtaaattatgaaatatatttcacaataattattttcatttaataacataaatattattgttattttctaaatttaatcaaacttaaaatagtttaacttaaacaaacataaaaacccttatatgaaacggacgaattatattataataaacctgcactagagtgagtagtttgggcagtcaattttatcaaatcccaatacaacatgttctcattttacctattttcaattttaataacttcatactttcctaaactccaatgcaatagttattttaaaaataaatttattttgaaataaatgtaacgaacaataattactttaaaataagtttattttaaataaatgtaaagagcaataattgctttaaaaataaatttattttaaataaacataggagctaaaaataaacttattacaggtaggaaagggagtaaggaaggagagtaaaaacggtccatccagctagagagccatccaacccaattccgtcccccttccatttccgcttcctccccacaattcaatcccgccgccgacgccccctcctccgaaatggcgtgacgacctccgccccatcccccaaatccctcacctccgcacttcaaaattccccacctccactgccgctatcctcccgcaacctcaccaaatccggcgaattcccccatcgaccaaaccctaaccctaggtggccggcca

SEQ ID NO: 4855 - DNA, 1501 bp, Oryza sativa
taattaggagagaaaaaaaagaacgatcgatttttttttagaataagaacgatcgaattttggggtgttagtgttaataatccacattccacaagaggtgtagtagtaaagcagtgaagtaggccggtggctgtagctaaggcaaaagctagcagcagcagccgcagccgccgccgacgtcgccgtcgtcgtcgtcgtcgacgacgacgagctgacccggccacgagggcacgcacgcctcgatcccctccccttgcttccagtaacttccaccgctataaatacccctctccgctctcactcccacatcttcctccccaatcacctcctccctacctctcgccattattaaatcctctcctctcctctcttctccacatccacaagaaatttcgtagcggaatcacgagccctcgtctcgatcgtagcttgagcttgagctgagttgctggtttggtgtgtggagagatcagtggggtgggtgggggtgggtgatgtacggcgcgccggtgtccaaggacctgagcctgcagccagccggggtgcggacgccgccgcagatgagctcgccgggcttgctgcggtacaggtcagcgccgagcacgctgctcggggaggtctgcggcgacttcgtcctccccggtggtggtggtggtggtgggcagctgcagctgcagctgcagcagcagcggcctgggagcccggaccacgccgcggacaccgtcctcgcgcgcttcctcgccggccatggcggccacgacaacaagcctccccgccccgccgcccacttcgccccaccggaagactccatggcctcgcatcagcagcagctcatgtaccagtcgcatcagcagcagcagcagatggcttccgccatggagggactctaccgcaccgtcagctccggcggcacggagtccaccgccgccgccgccggcaacagcctcctccggcagagcagctcccccgccggcttcctcaaccatcttaccatggacaacggttggtgcacctccctctccactccaccttgatcttgcaagaagtagtagcaatcatgaggtggctgctagcctttccatttctggaattcgagaggcgccattaatatccttaccaattataggatacgggaatatgctaagagcgggcatgggcggcggcggcggtggcggcgacccgcggctcaaggggcagctcagcttctcgtcgcggcaggggtcggtgatgtcccagatctcggagatgggcagcgaggacgaggagctcgccggcggcggcggcagcccggaggctggcagcaacggcggtggcgccgcacgcggcggctacggcggcgggtacgcgatggggtcctccgcctgggaggagccctcgccgccggcgacgtcgctcctcccggacagcagcctcccgtccaagcgcccccgcgacgacctgccgcggcagctcagcctcccggcggcgtccaagaacagcagcaagcccccctcctccgcct

SEQ ID NO: 4856 - DNA, 1501 bp, Oryza sativa
tatggcatatacaaactttgtatacgtgtatactccctccgtactcgtaaaggaagacgtttaggacaatgtttaagtcaaaccttgggaatataaatcatgaataactctcaagttgttgagtttgaaaatgtaaaaattatatgaatagatttgtcttgaaaaatactttcataaaagtatacatatatcacttttcaataaacatttttatagaaacaagaagtcaaagttgtgttttggagaccgtgtcgctgtccaaaacgacttcctttacaagtacggagggagtacatacatacatatacaaagtttgcatacacatatacaaactttgtattcgtacgtataaaaaactaaaggaaaaaaaaccaaaaaagcaaaagaaataaagaaaaacataaaatagaaaaaaccgaacggggacacgtgtaccatctaccgtgctcatcccgccccgcccccctctgcatccgccacatgccgcgctgttgatgaaaaaatcgaacacaccggcctgggagatctgcttagctcctgtgcaggtccaaagattgatgagatgcggacgtgccagtcaatttaatcctgtaactgacaagatttgcaaataatagatcaaacagccgatcggctgacaagccgatggagtagttccagccgatagccgataatagccgatgccgatacaagccgatagcgatagggtttaagcaatcggctatatgtcaaatgtagatactgatataaaggcaatcggctgatgatgatgtaatatagcaatataatcctgtataaaccaatcggctaacaatatgatatagtagaacaagtattgatccgaaggttaaagcacccatcggctggaggtccgatgtcatgaaatccacaagattagattaaacaatgaaacctttgttgccatcggctaaatccaacttatatgtatatgcaatccttatgagccgatgcaacgtccatgtaactcaccagctgaaaccccgatgaaacccttactggcaatcaataagcagtctagagattatggttctaagcacgacttagtagatcaaacttaactgatgcaacactaagtatgaaaagaaacacaatatctagacaatcaagccgttgactgattttcagggtggtagatgcctaggctaattgtcggagcccaaaactaacaacttggatccgactgagattattgtatcaatccctggatcagtaaaaattgatacatacaatataactggttctttattgcatatgttaaagtcttacaatactaagggttttacaataataggtactcacctatctaattagtacacagcggaagtttctatacattctgactagtgaggtaaaaccctcagggattttctaagttatcggggtcttcgtagtaatagtcatatgggtcctcctcttgacccagatctgaaaaaggggttataagagcaaggatgagtattcacaatactcagcaagttat

SEQ ID NO: 4857 - DNA, 1501 bp, Oryza sativa
agcattctttcatctatatcagaatttttagcataagttcaataccacatccaaagtaccctttagaacagtaaagttcagtagtatacaaaggtatatcaaaccaaggaggtgcatttgatacaagtaagtcattattcatgaggctacaagtaaatcatggatgcttgtgttggaagagcaaaacttctagaccatgcaatgcctagtttgaagttatgaacaatccactctttgcttgcgatggggaagtttatttattcttgtaaggtaacacttactttcatctctcttaatcctccactcctttagtctattattatgtttagttgttgattacttgatttcatactccagtttgttgacagcgatggtcctgttaattaaggcatgatcatatctttttaaatcaggtctagaggctaagattctttccattgtgttatagtagtggctcagcgagattgtgtcatactagtaactactattttgaatgcacaagggcaagccaaccgaagtcctagtgatagatgaatattctgtgattggttggcattataccaaggagtagtgggaatgtaaaggtggaaaaatgtctgaatagcgtcagaaaggttacataattcgaatagtatggtagtggatccctgaatcagcttgtgctggattgcttcttttgctttcttttaccaccctggtttccaaaatttgaattgacctgacttttgatcataatgatctttcaaagaaaaaaaaaaacttttgatcataatgcaaccagctggtgatcttgcctatcagcctatgccacaagtgctctctgaaattcacagttcatgaacctcatttggaagtaacattattaccaaaagttcacttttaaaatcttctagaggcagggagccagctttgactgcttattgtccctattagtatctgctttgcatagtactctcgctttcgtgttgtaccgtcaaaaggtttatcgttactgtttatgccattgtgatagatcatagatggcctctttggctttgtcatgatgcaggtgcaagtgctgagtcgccccctatcatagatggcaccaaagcaggttcttcccagactttgataactctggagtctggaccttcacacatggagaatccccaaggtggaggaattattgaggattttgctggcactgcatctcctgcgtcgtatgtctgaaccaccacaatgcattgcatcgtattcattcagaggatgagccagccattctccattgccagatccacgcgacagtacatttttccatcccaatcaagacctgacaaacctgaaggtaccgtcatgtggccagctcttctcctcccttgtgccgttcaagttgtcacagactcacagtgctttgcattgtaggatccgggacatgatttctctgtggtggccatggcaacaaacaactttgctgctcggttgcagcacgaggtgtggtgtagtgcagtgttagttgctgccc

SEQ ID NO: 4858 - DNA, 1501 bp, Oryza sativa
attaaatgggaaaaaattcaaaacaaagtataagaagaaattaaataaaatatggttctgatcaactaaaatgtgagaatagatgaataaatcattatattgtaaaataatttttgaattctagttatatttaaaaccgagtaagtaggaaatatatatagtactactctttccgtgtttgaaaatataactacttctagtatttaactttgccttaaaatatagctgctcaacttatctcgtcatattaaacaattacaatattctaccatttaatttatccacctacttagcatgtacaatacatcacctatacatcacctatgtactaactctagagcattgccgtcaacaatttcattgtttttgttttttaaaaaaatagagataatttaaaccgtagatcaatcatttaagaattagaaataattgagaccatgtgacttaacgagagaaaagagaaatatcattaactatatttagtgggatgaactttatagatatataggatttgcattggatttagactcctatgcctgttaattgtatctccacaggaacggggggatggaggatcatccccgtcccgccaccgccagacccaacacggacgtgttttcctccatttgattactcgtaaccatctccattctttcatcctcatctctaatggagaatttcccgtggagaatcgggaaacaagccccattcccatcctagatgtgttgtatggtcttggtttacacgcaccacaaattaagtgtagtttaacttattagacttttttttttggaaccagtcaactcgggttcaagtcatagtggtaggcgacacacacatcgataatgatatgaccatggtgatttcgtcaatctcaatacatgtcggtctgatgtatatgcttctatgtttgaattgtgttttgagaaaaaaagggagcattttgtaagttcatgcccttattgcattattcagtagaatttatattagatagagacatgttagcacgcgcctcatgtgtttaataaacaattcctcgtgtggatttcggcagcgcctgttccatcttcttcctcatcgatcgctattgtgatgaagtgagatcctaattacgccagcttaccatgtctgcagagaaaacactacactgaattgatggagtgtctcctgccagcacgcagtatggtccttagtactccctccatactaaaggagtcgtttagtataatgtttaagtcaaaccttgaaaatataaatcataaatagctcttaatttcttgagtttgaaaatgtaaaaattatatgaatgtatttgtcttgaaaaatactttcataaaagtatacatatatcacttttcaataaatatttttatagaaataaagagttaaagttgtgttttgaagaccgtgtcgctgtcctaaacatcgggagtactccactactacccctcccgttcatcactctataaatacccgttagagctgcagctactggaggcaa

SEQ ID NO: 4859 - DNA, 1501 bp, Oryza sativa
cgccatcgacgcgcgcccccaccttcgtcgtcccgcgcccaatgtagctgcagctgcagctgctggtgtggacgtagcgggagcggaggcaggagcgggttggctccatcgtcacatcgatgtgagtcgtcagctactgtggcccagcgtccgtccagcgcggcagcgggatgcacagcgtactgctggcctctgtgcttgctgctgctcttgtcactcgctctcgcccgtggccgtggccgtggccgtgctcctgttctctgccgtctcctctaccgcagtactccctcccagattttaatatttttaaccatctattttatttaaaaattttaaaattattatttattttttataatttactttattatctaaagtattttatgtataactttttttatatctgcataaattttttaataagacgagtgatcaaacagtgtaaataaaatattaaaatctcttatattacgggacggagggagtactaattagagcaagtttaatagtatagccaactactagctccaatttatctatagtcaatctaatagctcattcatgcctccatcggttgactttttttttctaataagccaaaacggcttattagggaataaaaataaatttgtaggtaaaacttttatatatgtgttctttgtaacttaaaagccaatgttgaaaaaaaattacgttgaaaatatttcaaaattaagtttgaaaattcaaaatttggcttattttttggtttattggaccattggatggaagcctcatacaatagttacatactacaaaattaatacctggtctcatctgtcatacacactgcgtcttaaattctgtgttatagctgactagaaatctgtagcccgctgcttttctctctcttcatttatcttcttaaaatatgtttacagctggcttatagactgctattgtccttgctcttagaagtaagagtatagtcgatacgcgagattcccccatcggcgacaccgccgcggccgagcccccgacacggcacaaaatttccacgagagcatgcgcgcgccgctgttccacaccggcctgtggcgcctatatatggggtggagccgccaacccaagtttcactttcacccccagaaaccccgcaacacacgagttaaaccgctactcctcctcctcctcctactaccactagtaggcagctttgagctttgaaggtggtagctactcggagtagtagtactagcagtagcatctgggagtgtgaagcggtagtagtagtagtgcactagtgcgtcacactcacacacacacacaagcagcagcagcagcagctgagcttttattttactactccttttaaaagaggggtgtgccaccactgttgtcgcctcctcagctcagctcagctcgccttccttttcactcacacgcgcacgctcgctagctagagagagagagagtgagggagcggcaataaaaagaagagagagagagagagagagagagg

SEQ ID NO: 4860 - DNA, 1501 bp, Oryza sativa
tcggtgccgtgccgtctcggcgtcgcgaccacctcgccgcgacaccgaccgcgacgccaacgctgcttcctcttcgttggtgagatccccaccataatactcctcctgccgcgcgatgcgccgcgcccgccgccgctcgccatagctcgccacgcgctcttgctctgccccggaggtcgctcgctgtcgccatgactccctaggctagctcgtcgccgcccgtggcttgaaacgagttcccggagccgtgtagaagctccttccccggtgaattggactcccgttgccccggcgagattttccccttctctccgccggcgaaggccgccgccgcaatctgccgccgtcggcccttctctcgccgattccttgcgccgtgacccaccccgtgtcctcttgaacctccccggcgcgccaccgcggccgcccgcctcgctgactgcggccgcgccgtgccacccatcccgccgccgcacggccgccgtcgtcagccgccgtgtcgccgcctctccctcatccgcaccgttgaatcatcccaccttgaccccctctcacttccggtgcccgccgcccactccggttcgccgccgctcgccggaactcgccacacgccgtgagccgtcggattggccgcccggcctcctctctcgccgtgccaacgtggctgtccacgaggacgccacatctacctgcccggccccgcggagaccggtcaaaggtctcccggtccaccgatccaacgcgccgccttgcgtgcaccccgctcgcgtgagccgtgtcatcgccttgtgggtcccgccttgcgcccgactcggtggaccgcgtccatcggcttgcgtcgcgtgggccgcgcctcgttcggccttgggccgcctccctcccacgcgccggcccgctcgcctcggccgcgcccgcgcatctcttcgggccgcgccccttcgctcggcccaagtccaattaacatccctccatccttttctttttccagggatttgataaatcctttttcctttgtcccataaatcaattccctattccaaaattccataaaacatttcctttggtcccgcatgacagtgactgtcaataatattcttgagaatattatttctataaattccataaaccatttctcctattccagaaactccaattaaacttccaaaattcatatctccccaaccgctcgtccgattgactccgtttcacttccagtaattccgtgaaattgagatctatttaatggcactactaattagtctaaataggatctttcttttggtcctttgtttaggttttcgattgtttgcgtatagtggcggttatcggattttcgtcgatcgcgggttttctcgaagattcgtgaagcttcgtgaagaccttgagcaaggcaagtcaccctttgatcaattgctcctataattggaaagtcattattattttgtttgcaacttgcatcattagaatcactcacgtttaacttgcttggcctcggtttgca

SEQ ID NO: 4861 - DNA, 1501 bp, Oryza sativa; identical to SEQ ID NO: 4854

SEQ ID NO: 4862 - DNA, 831 bp, Oryza sativa
gccgccgccacgcccttccccttcttgccgcctccgcccgacgacgtcgacgacgactccaccgccgccgccgacgccgacgccgccgcgtcctgctcgaagtagatcttcttgccgaacttgagcccgtggacatcgtcaccaccacctccacctccgccgccgccgccgctgccgccggtcgccattgcggcaggcggtggtcggtcccttcctcctcctgctagctgcctagcctctctctctctctctctctctcttctttttattgccgctccctcactctctctctctctagctagcgagcgtgcgcgtgtgagtgaaaaggaaggcgagctgagctgagctgaggaggcgacaacagtggtggcacacccctcttttaaaaggagtagtaaaataaaagctcagctgctgctgctgctgcttgtgtgtgtgtgtgagtgtgacgcactagtgcactactactactaccgcttcacactcccagatgctactgctagtactactactccgagtagctaccaccttcaaagctcaaagctgcctactagtggtagtaggaggaggaggaggagtagcggtttaactcgtgtgttgcggggtttctgggggtgaaagtgaaacttgggttggcggctccaccccatatataggcgccacaggccggtgtggaacagcggcgcgcgcatgctctcgtggaaattttgtgccgtgtcgggggctcggccgcggcggtgtcgccgatgggggaatctcgcgtatcgactatactcttacttctaagagcaaggacaatagcagtctataagccagctgtaaacatatttt

SEQ ID NO: 4863 - DNA, 1501 bp, Oryza sativa
ggagacggaggaggcgctgacgcagggcctcgacgcgctctaccagtcgctctccgacaccgtcgtctccgacgccctcagctgcccttccaacgtcgccaactacatgggccagatggccgtcgccatcaacaagctctccaccctcgagggcttcgtccgccaggtaccctaccttgcgtgattctcacacactgtctgcatcttcttctctcatgatttgatcgagctcagtaaccaaaccataccaaattaccaacccttcttgcaatcagttcagtcatgcattgcatgcactcttcatcatcagttagttggtttctcttcagttccatcagttgtaggcccatttgtacttcctcctcttacagattaattactccctccgtcctataatataatggattttaagtttttgcttgcaacgtttgaccactcgtcttattcaaatttttttggaattattatttattttatttgtgacttactttattatctacagtactttaagcacaacttttcgttttttatatttgcaaaaaaaatttgaataagacgagtggtcaaacgttgcaaacaaaaactcaaaatcccttatattgtgggacggagggagtattgattatcgcactacactttccaagctgctgaacaatacgatttttttttcaagaaattatatatagattgcctagaatttttttttaataaaagccacattttaactttataatagttaattcattcgtttgtacgtcgagtatctcaagaatagtcagataatataccatctgttcatttaattattcggaacaataaaactgggttgtactacatgtttatgactttattatagtttatttgttagttaatctcctgtcacttcgatggattagttagagctggagccaatgggagaagatcacatatatttgttagtagttgagaaggttcaatggatagttcacctaattgaaatcgacactgcaatactgaatatgttcatgattaaattagataattgctgtcgcctagctaggtgttgtgtcgatcgatcgacagagaagcatatgtggattaggtttttcagcttttgaaaagcacccgactgtctccatcccagaaacgggagagagcagaggttggatttgatataaaaaccctgaaaaggctgtgtaacaaacaccacaaacatgtataatttatgagggtttattgcttgactaattgttagtttgttcatcggtctttccatgttgggtagatgtgcctggctgctcggtttttataggccgcccttcacctgctcatggatgccacaaacagatcgaccacacatttcatttcatatcacactttgcaacttgcttaattggttactgtttgtgcttagtataattaatcagccaactaattaatgatgtccacgtatgtgtaaagtaatattcctacaatgcgtgtaactagttgttgctttttttttacaattaaaatatatagg

SEQ ID NO: 4864 - DNA, 1501 bp, Oryza sativa
tatataagtagatattctaatatgtatatacacatgtataatgtatgtatatggcatatacaaagtttgtatacgatgtatataaagtttatatatgtatgcatacaaaatataccaactttatatacgtatatatatacaaagtttgtacatctatatataaaaaagtacacatatacgaagtttatatacacgtatacaaattttgtatacgtatacaaaatttatatacgcatatacaaaatttgtatatgtttgtattaaaaaaaccgaaaaacaaaaaaatacggaaagaaaaaaaaacagaaaaaaagccatgcgccaaaaaaaaagtaacgatactgaaagaagaaaagaaaaaaaaaaaaagaaaccgcgcgtataaaaagagaaaaaaaaaagaaaccgcgtgccgcctagaaaccgtgcgaaaaaaacaaaaaaaaaaggaaagaaactgcacgccgcccacgcccccctctccacgcatgacacgtgtccagtcgcacgccccgcgcgactgatcgtctattagcgatttcgagcgcgaacatgcgcgcaataaatccacctcatgaaaatttatcaaaaatatcgtgcctttaaatgacttatctagaatgaatcttgatcttatagtgttttccatgtttgtatatagatgacgactgtgatgtcggttttatatcattaccttacgtgtaaggatcaaatgtctctcccttaatccacataggaggtatattattagtatccaagtgagatataaaaaaaggaatagttgtattgattataatataagtatagtgtgtacttatattataatcaatacaactatttttttttaataatcaccagagaccagaggggagaggtttcccaactaaatttccattgccatttgaagaggtttacaagtacagaggtcagttgtaaccagcggcacgccattacatgtgaagagaattaattgcggtgttgaaaatacatttccagttatagcaactaggcgatcgtcgtgcgtaagtcgttatagcaactattccttttattgcaacgtacattatatatttatacaccattcgtaccaatcacaaaatactttaactaaaaattataggtggtgcgtcctcttcagaagaatgagaacgaaatcagccgctatcatatatacattctatatatataaaaaaaaactgtacttacatgtctcaagccttgagcagttgccctctcgtgcccctcatgctgaactaaacaaatcaatttcaacgtcttcttgctactgtagatgacaaattcaaccggttaaaatcaaatataatacgatatctcttctcgaaagtcttgaggaactcgatctcggaatagtgagaattgccaatcagggaagcaacgccaacacatctgctggcctatgatctgatccgtttatctgcatcgccaactcttctctataaatacccttctgaattatgcttcctgcagagccactgcccag

SEQ ID NO: 4865 - DNA, 1501 bp, Oryza sativa
aattactgtagaaaaggcttctacagtgtgtaaatatatattccaaagactgcgttaataccgaacaatgtgtttccttgaatgcatttcaagagcaagaactcctgctttacttaaaagaaaaactagaatctaccttgtagcgatgatagaagtcatctgccacatcgccggtgtcaccatttaagatttttcctgcaggcatgaaaatagtttcccttaatcacctattttaaattttacatgccagctatatatataatagtgggaggttaacacttaataataataataacctgggatgtgcgagaaagtgtcccacacgctaggacgctaggacccctacctccttccttagcagctccctcatactgcaagtaattaagcaatgcaaggatacatctctgaatttgttcaggaactaaccaagaaccatgtgcattgcacttgattcaaaccattcttgcagatgtaagagttttggacaaatttatctctgtatggatcacctgatacgctgcagagccggtgccgaagatgaaatccttggggaagctgtacctgttgaacgatgcatcaacaccgctgcagagtacagcaacgaaaacaagaacaggaacaatctgccttcccattccgattccgagccaggccatctcgaaactggaactgatcaagccaagcagcttagctgggcagtggctctgcaggaagcataattcagaagggtatttatagagaagagttggcgatgcagataaacggatcagatcataggccagcagatgtgttggcgttgcttccctgattggcaattctcactattccgagatcgagttcctcaagactttcgagaagagatatcgtattatatttgattttaaccggttgaatttgtcatctacagtagcaagaagacgttgaaattgatttgtttagttcagcatgaggggcacgagagggcaactgctcaaggcttgagacatgtaagtacagtttttttttatatatatagaatgtatatatgatagcggctgatttcgttctcattcttctgaagaggacgcaccacctataatttttagttaaagtattttgtgattggtacgaatggtgtataaatatataatgtacgttgcaataaaaggaatagttgctataacgacttacgcacgacgatcgcctagttgctataactggaaatgtattttcaacaccgcaattaattctcttcacatgtaatggcgtgccgctggttacaactgacctctgtacttgtaaacctcttcaaatggcaatggaaatttagttgggaaacctctcccctctggtctctggtgattattaaaaaaaaatagttgtattgattataatataagtacacactatacttatattataatcaatacaactattcctttttttatatctcacttggatactaataatatacctcctatgtggattaagggagagacatttgatccttacacgtaaggta

SEQ ID NO: 4866 - DNA, 1501 bp, Oryza sativa
caaaatataggtatatgaatcttatatcgttgatttgattataaacagagcaatagttagattagaaatcagacgtggagcttataattaattatagattatttctcttttagtcatacaaagtaggaaggggagaggaatgacacatagaagggatagtttagagtactctcactaaattataagtctaggctaactagagaagaataaagaaaagcatcatttctatatttttaatatatagttattttagtatatgcttgctaatgtacaactatgcctactggtatatcgagaaaccaccccaaattgtcgagtttcttacgacaatccgtcatgactatccaaccggttaaagatatggagaagtacccgcacccggaacctttcttagccctatctacgcacgtgaacgaatacacgtattgagttgtcagcatcagcggcctatctttacgtatgcgtggcatatagcaccacttaatgatatctaataatctaatcaccgcgcttacattactaaatattaccaaataaatgaacactaagccaataccattgcatatctccagtaagctagctacataataaatacgagtcaagtataaaccgaagttggtactcgaataattatgcaagtatagtaaaggaccaaaactatataaaaaacaatatttaattattgaataaagtcttacaagagaggaagagctactagaaccatacccgacttctctgcaagacatgaagaactaaggaagaatatttaattctaactctactagcactagagcaaaatatgtaaactagggttgcgctcgttacctcctgttcccaacttcccttcctcgttttccacgcgcacgcttttcaaactgctaaatggtgtattttttgctaatccatactaatccatttttgaaaaaacaagcaaatacttagttaattaccccctaatcgctgctccgttttccgtgccagggagtgagggttcccaaacctcattcccgaactcagcctaagagagcttcttcacttgatttccttcttggtgtgtattgaagtgaagttggggaggtccttttatagattgagtatgatgattggagcgccaataccagtacaaccgtcattagaagatcggtatgtaaccgccttcggcttgggcctgggcgatcggagccaggcatgggtcagcggaacccaaggttggccgaaccgtggttggcctccctgggccagtccttcgtcctagacgtctcctgacagatcctcggcccagtggcatagtggttgggcccatttgtaggtgtttcaatgagattctgggcacatccatccatatatctgccacatgtcgacctctgattggttaaacggttattttcaatcatttctcctccatttatgtgatgatctcttgtaaacaaatacttactttatcaagtacaagtggaactagattatttctaaataaatatgcatgcaagcattgctagtt

SEQ ID NO: 4867 - DNA, 1424 bp, Oryza sativa
aaaaccacctgccatgcgaagaaaaccacctccggccactcaaacgctagcagaagatccatgggccaactaatcatatgaagctaacataattgaagccaatttactatgcaccgtcatgaggacccataggacaatgactaaggcgaaaatgaggaagaaaggcggtgaaagtgattccctctgaaccatggttcggtcgaaccaagagtgtgactgatcactgccacagcttccacatgtcgcttcctcaggcctcccctatggcggttatgcttgattcccaggctacataaggaggagaagttcccactctcaaaacaccagaaagttgagtacaactcacttttatatttagcctactctatagtagagttagaatataggaagagaatgaggggaagctccgaaagaagtgcccaaaatatcggagttctctccgagttttggaggagtgctggagatgtcgacattctctccatggggtgtactggaggattgccggagatgtcggcactctctcctatcttgtacctcgacgattttgtcttttatataagtaagtattcatgattttctttggtatttacttttcttatttaagtatgatatatttttatctttgcgacaggttcatcgcttagtatttatactaagtgctctagtactaagattgtagataaagaagaaagttcttggccgagttgtaatcaatgttgtagaggtgttgtctaggttagaagttaccttcatttattgtgtgctccatggaatgcaaacgtaggcaacagccaacatgtggtgacaatcatgtccgtctttcttaatccttcacgttcgggtacatcatagagatacatgctggagtcccttggtagaccaggagtgaaccgttgctcgaagaaactaatagagttttaccttaacttaactaagattatttacatataggaatcctgatacgaacacactcgcgaggggtggcccgatcttcacagcagtaggttcaagacagagtgccggcgtaaaccgaaacacaagagggtaactagctacgagcagcaagaggataactatctttatacctaccaaggtcggatgcgatgaagtggtgagggtgagaacaatccgaagcctcccggactccgatccgtcacaccgagcaatcatagaaccacgatccggaataactagctttatacctaccaaggttggatgcgaccaagtggtgagggtgagaatgatccgaagccccctggactccgacccgtcaaaccgagcaatcacagaaccacaatccgggactaatccacacaatatggtgcagctgaactagaagccgtagagcacgaactagggggcaccagaggagccttctcgcaagtccaaaagaactcacaagaacaaaggggtaagacacttat

SEQ ID NO: 4868 - DNA, 1501 bp, Oryza sativa
aagaccaatatgtaggatttgggggggtgcctgcaaatcaggcgcccgattttttttccaaaatcggatgctgtttcaccaagtagataaaaaatgtttcactaaataggttaaaaatgtttcagtcttttaaaaagcaaaaacacaaccaaatcaccttatgaaacattttgctacagcgtatgaaataacggtttccaaaaaaatcggatgttgtttcaccctatataaaaataatgtttcaagtttcaacaaataacgaaacgatgtttcaaatcttaaaaaaatgtgaaacacggtcagatcgttagatgaaaaaatttggttcaacatatacaacaaacgatttaaagccattgcaacacttaaacccatgtatattaacaaaccacgtgtccatcaagatgaaattattaaacattatcaaaaatctgctgtaacatttgatccatacatagtgaaacatcataagaacactagctgaaacattgttggtaaaaaaatgaaacagatcctccttaatagggcgtttccgttatatctggatggctgttgcaaaagacgcgtggtggggcatgcgagcgtgggctgcgcggggcgcccaatctttttgggcacccgagcactggcaatttcgaagatttggtgagtggttattcattcaaaatcctaaggatcttgcaataacgaaatcatgtggaatagaaccctccaaaatctcataaatgtactccaattaacaataatagtacatcacagagtcaatcagtggtgctagtacagtaacattttcaataataaaaataatacaagaaaactcctgtaataaagcacacctatatcactacatgtaaccacttaagcaagcaggtgagcactgcaaaatcgccaatcccaaccgcgccactgtcggtgtcggcatcggcgctggaggacctcgagctcgaaatcttgcctcccatggcctccacctcgaggcggtggtggtggtggccgtgggcgacgccgccgcccttctcctcctccgcctcgcggcaccacaagggggaggggtgggggctgggcgggcccgcgctggtgaaggccgtcgggtggctcctcctcgccggcctcctcttccgtgtgctctgctccttcccctcctccacctcttcgccggagatcagcgaaggtgcgagctctctcgtttcctgatcttgaatgcggatgcagtgggaaaggggattgggagggtttaatgctgtcggtgggtttggggggcctgcgagattcggtgcatttcgacatattttgctgttgttggagcgaacattagtggttttcttgggtgttcttcggttccatgcctccacgagttagagattttgatgccacttgaatcttgctgcgggttggaccaaatgattagtctgaatttgttttgttccgttcatcctatctcgtggaatggcgtgcaaattttgttttgctgtgttagtaggaaaacatttcgaattggtga

SEQ ID NO: 4869 - DNA, 1501 bp, Oryza sativa
ccaacaagcaaacaacactgaaatattaaaaaattgacaacaagtattatgtcatgttaatcattctacataataaaaattaggaaagtacaaagtcaacttttataaccttttagagccatattaagttaccacgtatcactaatattattttcaactatcaaatctatttttataaaaatcttaatccatgacatgttacaactttaaaaaaaaatcttacaaatccaaggaaaataacatctaataattggctttcacttaaatcaattagaaaaattacaaaaaaaaatccactccacatcaccctcacatgcgtccatcactacacacccactctagctcgagctctacgcttttcattactctctcgttcctattttgtataactaaaagagaaataatcaataattataagctccacgtctgatttctaatctaactattactctgtttataatcaaaccaacaatatatataatatcaatatgccatattttgctatataacaaatacgacatttaacacaatcggtctattacttataagtatatatctgaaatacactacaatatatgcccgcgcgaatgcgcaggctaccctcctagttgctcaataatagagatatccggcatgatcgtgaatgtgatatagcatctttgctacatgacatatttttttattctgcataatccagtggggccaatgcaatgtattatttgttcgtcttcttcccgcttccctgatctataaatagctcccaaaagctatgaactgcttgtgctcagtttcactcttatcagtgaattagatcatatacttgtgtccttgacagctcgttaattagcatggctaggtctctcgctgctctccttctccttctggtgagcagacacacatatatatcgctctttgtatggtttagttgttttgagctagaagcctagaacagagataagttgggagagagatatatattatttagagattgaagattaagttaaaattacgtaccctaaccttttttttttgcggggaaccctagctaaaattttaaactaactggatcaacatgtttaccttaagatggttgatggatcaacatatggagttcattgaatttctgatgagaacgtaatacaattagtacttattccagttgcaacttttggctttgatagttttcaattcaactagtttctgacttcaggtatatatatatatatatatctatctatatatatatatatatctatctatatatatatatatatctatatatatatatatatatatatatatatatatatatatatatatatatatatatatatatatatctgaagttaaccgttttaaattcaacttgtttctgactgcatttcaggtcgcagccgcgggagccagccatgccgcgtcgccggcggagatgtactggaagatcgcgctcccgacctcgccgatgcccggcgccattcgcgacctcatcagcccggcgagc

SEQ ID NO: 4870 - DNA, 1501 bp, Oryza sativa
aaatcaatctaaagatttacacccgagcaatagttacgatttacaacgatacgatatttattatcaatcccataaatatttatgcacatgaaagccaggccaaataaagtacaagtcaattattaaaccctgtggtacaaatcacaaatcaaatattaaataatcaaaccatgttgatagcctgatttcatatttaacaaaaggaaacaacatagttgaatataattcacttgaatccaatctcacatgaaatataagtacacatgaaataatgatcacatcaatggccctatctataatagagtatctcactagaatatataattaatatttgaaacaccttatcaagctcctcatagcatgaaaatcactcatataaaataatggtcatataaataaattaggctttatacataaataagaatatgtgagtgtttaattaaacaattagattaatgttgtactaagtctcaatttatatttatagaatgagtagacccacgtaaaatgcattgttatacaaataagttcattcaatgtgctattgtaataataattgccacattaggatattttaaattaattttagaaccctcaaagcctccaaaattatctaggttaattttagatttaaacctcatttaaataatacaataggaaaatatataaaatatgggtaatattaaattttggtcaactttcatctaaaataaaacatatattgggtaaaactctaattgtgtgaaatctagaaattatgggacaagttttaataggaaatatgcctcaaaagtggataattaggaaaaagtcactgttcattatggcctaggtgtttgatgtggttccctagcccttccccccctccactgccgcgctccccctcgcgccccgtgcccctgcacgcgccgcgccgcgccgctgccgcccactgctgcgcgccgcctcgcgccccgcgccgccgtcgccgtcgtcgtcgcctcgctccgccgttgccgccgcacgccgtcgcgccgcctcgcgccccgcgcgccgtcgccgtcgccgtcacgtcgccatcatcaccgcgccgcgcgccgtcgtcatcgccgtcgcatcgtcatgatcgcctgtcaccgtcggctgcgccgcgccgagccccgcgccactcccgttgccgccgtcgcgtcgcccgtcgcgtcgccatcgccatgcgccgcgagccgtagccgtcggcctcgcaccccgagccgccgcacgcccgtcctctcgctgcctcgcgcctgcgccccgccgcgcggccgtcccgtcgccgtcgccctgagccgctgccgcgcctcgagccccgtgccgctaccacgccttcgcgtcaccgccgtcgccatcagcgcctcgagccccgcccgcgccgcgcactgtcgccgttgcgccgcgccgtcccgccgccgcgcgttgccgtcgccccgagccccacgccgccgcgccgtcccgtcgtcgtttaaagccggccacccctccccgc

SEQ ID NO: 4871 - DNA, 1501 bp, Oryza sativa
cattgggacaatggttgaggttgtataggagagaacaaaatggtcctcaacaccaaacaaaaaaatgtgtcttccatttttgggtgcttgtgtgcttatcataagtgtctatctttgcgaatgttaggtaagtgtctcaaaatgaagaattgtccttccattgatccttgatgcatgacaatatgtagtggagagaatatgacgatcatcttgtccaatccccgatccatatggaaccttctagaaatttccattatgctgtttccattctattgaaggcaacaataatttttgatcttggttacatgctcaaaattagactactgaagcatagttcttgcccaaatcagaaaaatacaatcccaatttcttatatcaacaaacaaaaatagcagtcgcacgtacctcgtaagtactaattctgcacatcggcacactgcacaaaatcataagctagctagctagccatatgtatccatggagctatttagatctagactaatttttatatatgggatgaaatctcgcatctgatgtcctcttacactcacacagataaaccgatatagagaattaatcataaacccatcagaaccatcaaacaattaacaatcgaaaattaaacatgcatacgagcaaagctagatatcttgaagtattattattgcagaaaaatattgctgcaataatgactagatcatggacataaggtagtagaacctcatccttcacttgagtcccgagcacctcctgctcatcatattatacctcctcatcacggagatacttggtggaaatggacacagcttgcaccatggccggcagggcattcacttatcaattttatttatagcattactgccagtttgtaataaaaactagcagtgatattgctgccggttttatttgtgagtggataaaaggatttgtcgagtcggtgtggatgtgtgattaagtattgatccctcaggctcttcctctagcatgtttctccctttcactgtcagccttccaccattgtcgtgtgttagatgtgtattagataggttgtatttattgttttatgtcttttggctttccatgttcctgtcttttggttttccctgtatctgtatatatatttgggctattgccctctgatgtatacaagtcgtattcataacatggtatcagagcatggtttagacttctcatcttcttagatttttctctctcggcttctccatgatttgatttgaggattatcggcctcttcatcttgaagccatgatgttcctcttgatctagtatggtgtcgctgagaatcatccatctctgctccccaacatcatcaatttcttcagaacagtgtagagggttggtggttgtcctcatcaccggctatcgtcgcttctcatcgccggccgccgtcgctcgtcgcgggcccccggccgccgtcgcccctcgtcgccggcctctggtggcgggactccggccgccgtcgcccctcgtcgcgggcctc

SEQ ID NO: 4872 - DNA, 1501 bp, Oryza sativa
gaagaccaatatgtaggatttgggggggtgcctgcaaatcaggcgcccgattttttttccaaaatcggatgctgtttcaccaagtagataaaaaatgtttcactaaataggttaaaaatgtttcagtcttttaaaaagcaaaaacacaaccaaatcaccttatgaaacattttgctacagcgtatgaaataacggtttccaaaaaaatcggatgttgtttcaccctatataaaaataatgtttcaagtttcaacaaataacgaaacgatgtttcaaatcttaaaaaaatgtgaaacacggtcagatcgttagatgaaaaaatttggttcaacatatacaacaaacgatttaaagccattgcaacacttaaacccatgtatattaacaaaccacgtgtccatcaagatgaaattattaaacattatcaaaaatctgctgtaacatttgatccatacatagtgaaacatcataagaacactagctgaaacattgttggtaaaaaaatgaaacagatcctccttaatagggcgtttccgttatatctggatggctgttgcaaaagacgcgtggtggggcatgcgagcgtgggctgcgcggggcgcccaatctttttgggcacccgagcactggcaatttcgaagatttggtgagtggttattcattcaaaatcctaaggatcttgcaataacgaaatcatgtggaatagaaccctccaaaatctcataaatgtactccaattaacaataatagtacatcacagagtcaatcagtggtgctagtacagtaacattttcaataataaaaataatacaagaaaactcctgtaataaagcacacctatatcactacatgtaaccacttaagcaagcaggtgagcactgcaaaatcgccaatcccaaccgcgccactgtcggtgtcggcatcggcgctggaggacctcgagctcgaaatcttgcctcccatggcctccacctcgaggcggtggtggtggtggccgtgggcgacgccgccgcccttctcctcctccgcctcgcggcaccacaagggggaggggtgggggctgggcgggcccgcgctggtgaaggccgtcgggtggctcctcctcgccggcctcctcttccgtgtgctctgctccttcccctcctccacctcttcgccggagatcagcgaaggtgcgagctctctcgtttcctgatcttgaatgcggatgcagtgggaaaggggattgggagggtttaatgctgtcggtgggtttggggggcctgcgagattcggtgcatttcgacatattttgctgttgttggagcgaacattagtggttttcttgggtgtcttcggttccatgcctccacgagttagagattttgatgccacttgaatcttgctgcgggttggaccaaatgattagtctgaatttgttttgttccgttcatcctatctcgtggaatggcgtgcaaattttgttttgctgtgttagtaggaaaacatttcgaattggtga

SEQ ID NO: 4873 - DNA, 1501 bp, Oryza sativa
ttgataaattttgcacggtttatcacggttaccacggttaccgtgcggtaaccgtgcttaccgccgggacgcggtaaccccggccccagcagtttgggaaaccctggtcctgactgagcggtgggttcagctcatacgtgtagtgtaggtgttacgagggaggaatgttcccagccttgtgatcatggatggacgcatcggatcttgtttaagatgagaactaccttgaaatgcaatctttgtatactggagtatatcagttgttttttcgaaacgtggcagagacacacaaacacatatcactacccgcaacatcatactcacaatcccattaacacatgctctaataaaaaaaatcagcagcacattcctgaactttagatggccttatggcccgcggcctagcccatggcacgccgctttggtacggcctaggcatagcacggcccgaatggtgtcgggcccgtgttggcccgacccaatagttgggtcatgtttgggctgccgccttggcatggcacaacatgaagttcagggaggacaaatagtcttattttcaaccatatattataaaatgggtgcgccaccaactaaaaatatcctgtgaatatttatatttttggtttagaatacataaatattatagagttatctatctaccctatagttcaacaaatggtttcactcatcacttatcactcattctttcatttgtcactcaacagtccagattatctcatctcaatctaacgtctcccgcgtacccatcgccttccctcacccagcagcgcccccgaatcacgcgcactttccttcctgttccgatcgcgaaattcctccgctcccctcccccggcaccgcatcgcgggccatcggtcccccacctctcgctccactgcgcctccaacccacgccccgccccctccacctctcgctcctcacgccgcctccatcactctccaaaccctaacgctgccagtccgccgtcgcgcgccactccgccgctcgtcgcccttctcgccagtttcaccgcctccgatctgattctttgaaactccattggctcctcggcttgctttcttacaggcatcaagtcaggtaagcaactaagtatgaattttctccaaacatatatctcagcagaattgctccttatcatatgaaactactccataataacaacgaaatatttaggctctgaaactagccaaaacaaaattgtcagggtggatagataatcttggtcagccttttattgtaactgaacctcattgtgtctttttatacgcaaatgtatatgcaggcatatatcatgagacgcccagcaagcaagcaaccatcagcagccagcccgcaagaaggtccgaaaagacctctactgcgcctttcacggacgctcttcgcacaccacggagcaatgccgaaacattaggcaatgtggcaacgcgtaagacccaaggctgcagcagggaacaactgtcgaagcaccccgcgaagcagt

SEQ ID NO: 4874 - DNA, 1501 bp, Oryza sativa
aggaggggcagcactcagattgaaggaggggacatgtacctataacagaaaagtttgttaatagtgctttagaagattcagaagaaaattagtaacgtcaactcaatagaaccaacttaatttagagagaatagagctaactagccgcatcagaatgaccacatgttaaaaaatatatacatagactgctttttcatcagaaaagttcatatatgaggttacaattgtagccatgacagcatcagatcttcaaggaaaaaaacaattgttctttaccagatatggatgaatcataaagaaccacaattgctacttcagtaaatgcactgcactctaattcttcaagagtcaaaaacattatgaaaaactcaaagttcttggcttcatgacctgtaaaactatttacaggtctaaaaagggttcatacttgaatctttcatctctctaatcatgagcatcttctcaaaagctggaagcaaaaccttagtgaagcttactcgttttagtgatgttcactaatgtcaccagaaaaagacacgttattcttgaagagtggcaagcaacagcatcagttctttcattggaataacggaactgttctatatgacggagtaatggagcatcatattaatggctgcttttcaaaattatgagcttaacttactgaaggaaaaatggataaaagagcaaagcaattgattgttttcatgtttgcttttcatcgtgcatcagaagtgccatccaagagcaacgattctaagctaatatttttgctaatgctgttccgcagggttcactatatcggtttagggcttttgatcgggggtctccgaaatcccgaaatttcggtccaaaatttctgaaattttgaacaaaatttagttgaatttgaacaaatattacccaaattcatgaaaaaattgaaaaattcaaaaatttcagccaaattaatatcgtttcggaggggaccgaaatgaccgaaatttccaaccctgctgttccgtatcttcgtagtcaattaaaatctagaagttgagtaccatattcacatctaactatgttgcaagtacaatagatactgattggctagttcgctagttcctactccagtgacggaccagattcaaaattaacatgaaacttatattattatcataggtacataggtgcaataaaatagttagatgctggtaataacatgaaagagaataccagcattactccatgtttgcaaaaaaactgtgttaaatctcatagcaacaaaaaaaaacagatattctaccttagtggtttgagcaatatctcgacattcccacattaaacagccattgcacattataaatagcctgcccatattgtaaacaatgaactatccaaaaatctagttccaggggcaacaaaatagcttcatcaatcagcacaaaagaatgtttcctgatatacgttttattgtgggaattataggtatttgcacccacaagctacttcgattaatttcttt

SEQ ID NO: 4875 - DNA, 1501 bp, Oryza sativa
aatctaattattccctactttatctactataaataaatttatcttctactttcacaaactttagtgcaatggctattcaagagtgaacttattttgagacaaacggaaaaaaaaggcaacaatgaacttactataggatggggaaagtagatttaagatgttatattacaaaactataaatttagcgataattttatcatgaaactataggtttaaggttaagtatcgaaaactacaaattttaatattgaaggtatcacaaaactataagttgtagagttttaatccctagcattaccgtcatgttggagctataaagttgtagttttgtgattaaattgatactaaaacttaagttttttttactcaagttactacttaatttatagttttatgaaactctatcttgaatatgtagttccgtgataattttattgctaaatatataattttgcgatatacagtcttaaatctatagttttgtgatagtttaatcattgtaacaaaatttactctatacttttttatatggtccattgtagcttagatttgttacaaaataggaaaaagttaatatgatcaataaaattctaatataagtctgtatatcacctagaatatgatataaagaacactttgaaatatgaatatattagtatatacttttatactaaatatacttataatttgacaaatcactaagtcataattactccatttgacattttaaaattagcatatgccttgtaaaatgataatttcaatatttaccattccaaaaaattccaaattaatcacacccaataaatatgatagtactaatctatctttttctaaatgaagctacaaaaggatctttttagaaaggtggcacattctgaatccaacttatgccactaggatatacacccatccaagttgacaccctaatactatatgcaaataaaaacaccactaccttggacattagtgctccccctcatggtgccaaagatattttccaagttacccaccgactaacctactacgaaaaacaaaaccaaaacaaacaactcaaaccccctattatttttctttaacagaaatatcatgggtgccctcgcggctaagcaaaccctttaaaaacgacccctccggtccatgcaccgggctcacgcacgcaccctccccacccctcccgccccctcggggtccgcgcatggataactcgtgggtgggccccaccaccccctcctcccctcccgcagatttttgtacccgcccgtgtgtgtgcgtgtgtaagcaaacccaacccaccgctaccctcttctcgccgcaagcgaggcgagccaagcaaacgcgaggccgacgacgacgacgaggaggaggaagcgcagccactagtcgcggcggcggcggcggcggcggcggcgggtgatcggaggagggatggtggggcttgtgggaggaggaggttggagggtcggggatgatgcggcgggtgggggtgggggaggagcgg

SEQ ID NO: 4876 - DNA, 1501 bp, Oryza sativa
ttaacttaaaaaatattccttttattaatattctttctattttttttacccttgtgcaaccatatttccatattataatgatcaagagtcgttgttaagccgttgttatgtataacaacgatgttttgtctctcctatttctctttcttccatgtcaaagtattcctaattagcaatgctaagagaccattattgacaaccattgtacatgcccttatcttcctaacagccgtacgcgctaatcacgcctcatcatctccaaaccaacgccactgatccaaccttcgcgcaatacgcagccgcacaaaacagccaagcgagagcacggcaaatttctgctcgcctgcatgtatgtgatcatcagcccggccagaagcttgtcgactatagcaaatttccacttgcaaccagctgcacgagtcttcacctctctgatctctatctgcatgctaatgcaaatagtactaaataacgcaaaaaccttccttgactatggttaagctcagctaatccataatatttccattctaagataaatgctaagcctccctagccatccacgcacacacatttaatcggctctcaaaccaaccacttcaaatcatgacagctaaactaaataatctggcttacccaaataaaataaactattagccaaattatgctacaaacaatatagatcataagcagtttaatcataagttttgctgaaagtcgtcggtgtcgtctgataccgacgctaacactatatatccgcccctgctggaaatccatttttatactgcatataaattgtaaatgctggtaactagccgaattgctaaaattggaatcaaactggctgttgttggattccatcaagagatagtgctccaaccaatctattgggtctttaatcatgactatatatatatatatatatatatatatatatatatatatatatatatataggactagatatgccgatcaccctaaacgataaaaataacggaaaccctaaacataggctgtgtttagatatagggatgtaaagttttgacgtgtcacatcggatatacggacacacatttgaagtattaaatataatctaataacaaaacaaattacaaaatccgcctgtaaactgcgagacgaatacattaaacctaattaatcattagcaaatgtttattgtagcaccatattatcaaatcatggcgcaattaggcttaaaagattcgtctcgtaatttatacgcaatctgtgtaattagttattttttttgtctatatttaatactccatacatatgtccaaacattcgatgtgacagtgtgtaaaattttacggggggccataataagtttttagttagtttcttagtccctctattcgtgtgagtgccagacgaccggttgaccatattagatagtagtagcagcaaatatattgagaaataattttaattgcataatataaatacaaatttttaattagtttctggttgaccgctattatta

SEQ ID NO: 4877 - DNA, 1501 bp, Oryza sativa
tgccgcgcgcgacgagcccgccttagctgttgccgctctcagagtagttggtcctcagacggcgacgatgactattcgatgttgcacccgcatccgctggtctatccgctattggggcctcttcttgccggtgtcgtctcgccataagtagtgtggcggtggtacggcgagccggtgtagggggcggtggcgcgtctcttggtccgtgcttgtggtgggatgaaggaggcctccgggttcccgatggggtcgttgtggtgcagcagcgacggcgatgacgactgctcgacgctgtacctgccaccactagtccgtctgctgttggggtctcttcttgccagctccatctcgctactagcggtgtggtggtggtatggtggccttgtgctccaacctcgaggcacggatgcggctttgtcgggtcgcacatgaagagaaacaagtcagttgcggaaaaagaactctacgggagtgacaaaccagcggcacaacgagccgaagcatgcggcctagctccatgactggtctggctcaagagtgacggtccggctcatcgcagcaaatggggacaagagagaacaaacacgagcacgggtgactcaaagtactgacaagtgggcccaaacatatgccatgtaagagaaaataaaggggggaatagggtatgtactgccgtgagaccaagttgtatgcttttttttttgtacagtttaagaatgaaaatttctgattttaggattagggatatcaatcaaactcgacgtaaagttgagggacttcaagtggacttactcctacttctattacttagtttcttcggttcttgggaatagaagatcgaacaagaaaatggttttgctagattttctgaaaggaaaccttccatttgtatactattagatctgcatttttgcagccaaaatggtagctcgctcatgcaaggattcgacctagcgacctcatgtacgctactagccaaccgagcaaagggttctttttttctatcagtaacatagacatagacataagttacaatactattatataatgtaataacatcgtaactatccccagaagattaaaaaaaataccactctcctcgataaccattcaaagattagaacttaatatatcttgatacggagcatggtacgtgatatcttggccaaataacaatcgtacatatggagttgatctcctcccttctttccctcctcaatataaagggactgtttggcatggatccaactccaactccatcccaaacacggatctagctccaactccacctttctattagctaaagcctaatcaagcggttttagctccacttaaaaagggagtgaagatagctggagtgttctcatataataaactagagaaatggatctgtgtttaggctgcttcacaatttcactctagatctaagtatctaaccacaggagttaaatttaagagttgaaactctacaaaacgcaaccgggccctttagtctatatgg

SEQ ID NO: 4878 - DNA, 1501 bp, Oryza sativa
ttgtaaacaatgaatgcaaatcatggattgtagagtaaaggatggtgaaaaaaggcataccaaaccaagcattgtcatgggtcgaagcaaatgttagatgtgataggagggattaattttttttcagcagagaataaccaagctggagatggctgcatatccagcagcatgccattggaggagcgcagatggctggacagccacacacctaaatcaagcttagacctaatccatgacggagatgatgggggagatcacagagtagaaccatatctagagacattggttagtggagctgactctgtcatgcacattggccatcacacttgctctattccatacccaaaccctaaccgcagatcgcaaccctaaccacagtggcaactcatattgtgtatgttttacaattaatctatacagattggccattagcaaaaacaaatagaaattaaggtttactgttccatgacccagaactgacgattttatagccaatcctggagatatgagagttcagtattttcgcaaacttgccattaattagcatcaatctattttatagccaccaataataaaaggaaaatagatccacggtttaaccttgatgaagagcatgccatatacagtaatgaagagcatgcatatcccacactattacaaataacaacatgtaatttgaacagaatgaaatagtctgtaatttcctaaagcatgctaagtaatatagcatcagcatataacagcatgagaaagttgaaattacccggactagtggtcatagaagcatcagtgaaagtggcatcacatattcatttatgttagctaaggtccaatgtttgcctcacattgtggtatctgccatgtgcccatgcctgaaaacgaaaatggatgaatgtagtcagtgagatgctgctaaatacaaatattgcctcatgcaaaaaaatatatgctatagtttaaccgaatactaatttatatgataaaaaatagagtagggaaggtcatttatcaaaacaactaaataatgatcatgcataggaatataacgactaaacaacaaataagacatcccaaggaactacccaaaaaactgaaataatatcaggcaataacagttaacaggtagagaaaccctgaagagcaattgccaaccagctggaagccttgaacctgaaatatgaagggcataggaattagcaaacgaagccactcaaagaagcaagaacactattagaaacctataaaggtgaagaagatgtaacaatgtaaaatacctttcatggctttgataataataactgcatgcagcacccaccaaaagtatggtccaacattgttaatattatgataggatactctgcattcagatcaattggagaacacatctcaataacatatggatttagaatataataaattaacatgtcaatataaataattttgatgttgaactcatagagtatcctataagaaactttgatgttgaactcatagagtatcc

SEQ ID NO: 4879 - DNA, 1501 bp, Oryza sativa
atgacctgtgggcggtgctaagcgtggagacgtcacgatgcgaggagccgaggtcctcgccgcccgccgcggcccgtcctcgcgccgccgcccgtcgtcaggccacggcttgtcggcgtcgccatcgccagaagaacctgtccgggtacgtgcgccgaccgtgctcggcttgctcgcgctcgtccgccacctcaacctgcacagcaacctgcgcaggcgagctctgcctcccgctgccggccgcccgcttcgcctccgtctcagctgcccaccgccctccgccgccggcagcgccgcctgcttccggctctcaccagcacggtggggtgagaagagagagagagggagagattgggatagagtagagagagatagagagtggtgagaactgagaggtggggcccactgattatttttttaaaaaaatactgactagactgccacgtggactcaaaaccactccggattgaatcggggggttatttgtccgatttcaatagttgaaggtgtagcatttctggttttcgagttcgggggtgtaattcggtcgacctcgatagttcaggggggtaattcgtactttttcctaaagttttacatgtcgtttaacttaaatcatgtcttaaaagtgagatatttatgatcggagttaatccactcttgcttgtagtaggaaactcaacagagtacataaaatagtcccaagaaatgcttcgtgttggtaacttgtatacaatgtcaaataaaagttgacatattgtttcaaagaaaaaataaagttgacctgttggggcacatgcagcacctgcaaggctcgacctttcaatacacgtgctcagagagaccaataccaggatcaaaatctttggaccttattcatttttttatcaaaaactgctcacttatggccgaaagtttaccctacacaactattatggttatcttaaaatacaaccaaattcttaaaactgttcattctatcgtcgaccgttcatttatttcctcttccaaaccaaactaatgaggaaaatattacaactattatggtaatcttaaaatacacccaaattcttaaaacaattcattctatcctcgaccgttcatttatttcctcttccaaaccaaactaatgaggaaaatattttttataaaaaaatttgttggctcaacatgtcatccactcatcctctttccctctctctccctatcgctctcttatatcttcttgtgcatcttgtaagttagagcgcaagttcctacgtcgaccggagctcttatccagtcttctgccggcgtcgcttagtccatatttgctagtgtttatacgtagcttgaatctcctcatactaccgttgttgctcagagcccttgtccatccacgccgctccttgcctcccatattcacagccatccaagcccacctatacgccatccaaagctcttttcccctgcatgtgacacttagaggcgattggctagagcttctctactcagatgctgg

SEQ ID NO: 4880 - DNA, 1501 bp, Oryza sativa
aataaaactaacatttatatttggttgtgaatttttttaatattaaatttggaccatgatatacttttgcacatttccattaaaatttttagtaagataaatgatcatatattacgttaaaaatcatcaccatcaaatatttaaaaactgagagagtagtttggaacacatgtttaagttacagttcatttaaacttgaaatgttggctattattattgatcccgcatcaaaaatcaaaggcgtgatgccacattttagattatccaatttacagtacattgctgatacaaccgtttttatggaccgccacttcgaaaaagcaaatactccatccgtcccaaaatataagtatttttagcacagtgccaagtcaattattttcaaatttgactattaatagcaaaaaaataaaaaaaaagattaatcatgtaaaattgatgttactagatttatcattaatcaaagtattacaatatgcaactctttttatttaaaacattttatatttatagatattgttggtcaaagtagcatctcgaagactttgtcggagtccaaaagctcatagtttgggacggagggagtaatacttatctcaatctctagaaacttatcaggactaaaaaaatcaattttcaaataagtaatgttttttttttgtttcggtaaagcaaagcaaatactggacccatggttttaaggctagctattcactcaatgattcttgccgataaaattcatcacaacaaaacaaattagagtctggaggtatagatttgttgagaaaaaaggaccgtgaataaagtattagacctaattaagtatatacatatgcaacatgtaatatacctacatgtattgaattcagacaacttttgagtatgtacttcaatacccaggagcctccctgtgcccaccccggaagcaagcaaacaaggaagaacaataccaacagcattttgcatgtaaaatgggtagatatgttagcattcctaaacatttctgtaaactctataattcaaatggccaggaagaccaagagcattttgactgtaagatggacagatatgttggcattcttacactacccattttctataactcaaactagaaatgggtcgaggccagttctgaattataaaattagtacaaaaactaaaataactaaaatatatatttctccaaaaacgatttggaaaaatcatacataaatttaattatgataaattgtgatttgttcagatttaagcatgacattgtgcttgtaagttatatgatattatatggagcatgtgatgattttttaggttttcttttaagtcatttactaatgcaaacatagttggggtctagcttgggccaggttgtcaaaaaactagtataaagccacacagccagaagctaaaatttccatccataaacacatcagactgccatctccctcaactagttgcaaaatcacacgtcttctacttccatcagccatgcctggagcagcta

SEQ ID NO: 4881 - DNA, 1501 bp, Oryza sativa
gacattatacaatcagaggatacggttgggatatggaagggtttgtgttcggctgcaacacagctagcaagcacaataatttatgtctgtggcaacggatatactggctagttgtgttgtgtatactatatcaaacagtcgaatagaccctctaaaagaaaagagatgtagatatgtttatattttgatcttatcgatttatcattaccaattttttaagggcacaaaataaacaaaatccgaccattattttcgtgctaaaatatgatagttttggaagctttctttcttaaaagtatactaaaattttgtgaacttttaaaccaaacagagccccatactaccaaaattcgaaaaacttgaaattatgtcatcgtaaaaataggtttaacctaaatatcattatgtaaatgggctttactcttataccatttgcaaaaagagctgcacactagaaatgcccttggaccttcacttcttttctagttctggctgaacctcatcatccatgtcttctcctcggggggtgtaggctgttgtggccacctcatcccctcactgccatggttcctccttatgtcctccatgtgaagaccctcctctaccatgcttgttgtctggatccgtcctttagtccttgatgtttcactaccgtcctaggcactttctcgcactgccaccagctcaaggcccaatgctcaatcacaagtcccgccaacctcctttagcttccacgttgtcgtcctcatccagctctcgcgttgtgatctcttcaagcccatgcatcattgtcctcgtcaagctcctatgtagccacaacctcctcaagttcctggtctcacggaactccagtgttggctgtcctttctcatcatgctcatgtaccaactgtcctttgtggagctccaatgtggtaggtggtagtgatagtgcatgccttatcactgaagaacacacatgatattgacttaagggatctaccatcatctcgttgaccctatcagctccatgactccgcctcccaccccaattgttgcaccgagcctggaggtggaagataagtagagggacaaatgacatttctatcattttaaattgcaaaaggtttagcgtgtagcttctatttgagaatgccattttagtgaagtctatttatggggataacatttagacgggttctattttatatgatggtgtaatcccaaatctctcccgaaagtcactagtgtaaaagtataccaaaatccactatattcctaatatttggtcaggtttaattgttttgataatgaaccaggcctgtcctatctataacattatatgatctatttatagactatatatagtgcaatttgcatataaggacaggtacctcttatccaccaactgtgagaagtcacataccaattacacctacaagagtacaagtacaatctctatatccaaatttatgtgcacagtgcgctccattaaaaatgttagggttctacttgcctagcga

SEQ ID NO: 4882 - DNA, 1501 bp, Oryza sativa
accaccaatacttactaaatttgttctcatttcatttggttctcgtggaatcttcatagaatttaaaagtcatcaagataaaaaaaacgctgtctcttctctcctctgaattccatcagttgcacgaacagaaactgtcagtcacactcgcatggcagctgacatttgatttcccaggctcgccgccggccggcggcgccggcacgctcgcctcgtccagccacgcaccgccgccgtggctgtcgtcgccaccgccggctggtgttctgctgcgcgccggcggccggtggacggcgctaggcacggggaacggccgcggtggcggtgtgccgccgttcgattgtctttgagcggtccagattgagtgatcggtgtttggtcagcgattttgtttgggccttcctgggtgttttctgggcttcaggcccaataccacacgtatcatttccaggcccacctctttaggagaggatataagaaaattgagatatttaaatcgaggttagatgttagcacatgattaatggatgagtattgattattttatatctagaaaattgattaatataaatttttaaagtaattttctatataacttttgatagaaaacgtacgtttaacggttcaagaagcgtatgtgcgtggaaacaaatcttccatctttctagttatctcgaacgctgtcttagtttaaattttagattagactgcagctgccggagttcatggcatggatgaagcacatcgtcgccggtcgccctcacccgccgctgcggccacaacgtccatcgctaggcaagtagaaccctaacatttttaatggagcgcactgtgcacataaatttggatatagagattgtacttgtactcttgtaggtgtaattggtatgtgacttctcacagttggtggataagaggtacctgtccttatatgcaaattgcactatatatagtctataaatagatcatataatgttatagataggacaggcctggttcattatcaaaacaattaaacctgaccaaatattaggaatatagtggattttggtatacttttacactagtgactttcgggagagatttgggattacaccatcatataaaatagaacccgtctaaatgttatccccataaatagacttcactaaaatggcattctcaaatagaagctacacgctaaaccttttgcaatttaaaatgatagaaatgtcatttgtccctctacttatcttccacctccaggctcggtgcaacaattggggtgggaggcggagtcatggagctgatagggtcaacgagatgatggtagatcccttaagtcaatatcatgtgtgttcttcagtgataaggcatgcactatcactaccacctaccacattggagctccacaaaggacagttggtacatgagcatgatgagaaaggacagccaacactggagttccgtgagaccaggaacttgaggaggttgtggctacataggagcttgacgaggacaa

SEQ ID NO: 4883 - DNA, 1501 bp, Oryza sativa
caagggcttgattgtctagatattgtgtttcatacttagtgctgcatcagtacattcgacctactaagtcgtatttagaaccataatctctagcctgcttcttgatcgctaataaaggtttcatcggggttttagccaatgagttatctggacgttgcatcggcttacaaggattgcatacaagttggatttagccgatagcaacaaaggtttcactgtttgtctaatcttgtggatttatgacattggaccttcaaccgatgtatgctttaactttcggatcaatatttgttctatcatatcattgttagctgattggttcctacaggattatattattgttatattacattatcatcagccgattgtctttatttacatcaagtgtcagattttacatcaaacatatggccgatagctcaaaatcctatcactatcgactgataccggtatcggctggaatcactccatcggcttgtcagccgatcggttatttgatctgctatttgtatatcttgtcaattgcaggatcaaattgactggcacgtccgcacctcatcaacctttggacctgcactggagctaagcagatctctcagaccgttgtgttcgactgttcgttgacttagttcgtgccaacacagacccggtaccatcggctgagcgcggattttccgtcaaaagccgcgcgctagctcaatcactgactgctgctgctttccacccgcatcttggtcctcccgcgcctccgcctcgccagtcgccaccgtagacgtccctgtgaccttgtccatggcgaacctcaccaggttgctgagcagcacaacaacgctcttctcctgctctaccacgaagctcagcaggctctgcagaacggcggccttccagttgcccccaccgccgccgaggaggaagggaaggagagaagatgacatgtgggtcccccaatttttttttttaatagcatatgggccctacacatatctatatatcctatatagttggcaccaaaaactaaacatgcattcagccgcatcactgacaaaacatgataaaacaagagccattggatcattttcatacgtaaccacaaccatccaatagacattaaatatcaacacttatcatttttcattgattaaaaggtaactcaacattcagtgaccacttagtgtagtatatgctataaaaaaaccactacaagaagtagccatcggatcatttttcatatgtcatcacaaccatccaatagacattaaatatcgatggttattatttttcattgatcatgaggtaactcaacattcagacccttagtgtagtatgctataaaaaccactacaagaagtatttcatttttcatatgtgaggtgcttttataggtatataatatttctcatgtctatacattaaaaatttatagctgcattgcacacatgaataatccgacgtaacgcgcagagcaacatctagttttttttaattctaataccatataagc

SEQ ID NO: 4884 - DNA, 1501 bp, Oryza sativa
gcgcgagcgcgagcacgagacggatgttaggagaaggctcgatcagctagatgaatagatagcttaattggtcgtttggtttggtatcttctcgatcgcttcccttccactaatgctagcatacgcaggggttccttgctttgtgctttgcaccttggtttgcttctcgcctccattgatttattccctcttttcctttactgaaaacatgaaaagaaaaaggtaaaggagaattagcctatgtatgtgctttgctttctctaaagatcgatgtatgttttcttcagcaatacaactgcacatctttatttgattttatgctaattaaagacgataaaccatagcatagctactcctcaaaatataagcatttttagcacagtgttaagtcaaacatttttaattttgactattaataaaaaaaataaaaaagatcaattatgtaaaattgatgttactggatttatcattaaataaactattataatatgcaactctttttatttaaaacatcttagttttatagatgttgttagtcaaagtagtatctcgaagactgtgttgaaatccaaaaatgattatatttttggacggatggagtagtaatatgctacaggtgcatgcaaaaatgtgctgctagctacctggggagagattctttattctttacttctttccaatttgtttaggtgatgatgatgtttttgcaaagtaaagcccacagtagaggtggtactcatggggcactgcatctgtaacctgccatgttttacaagaatgaaaaagtttgagttacactcctagacttttatggtagttcgatttacccccctcaattcaaatactaaacatttcacccccaccccgcccccctccaaaaacaaaaatagaactcttcaaactagacaaattaccctcctaacctcttctacagcgacaatagttctacttggtgtacgcgtggcagtttggtcacgtgccaatttggctagtcagcaatttgagaaaataatttctttaccgaaaacatgaaagataataaggtaaaggagaaattagcctatctatgtgctttgctttctctcaagatcgatgcatgcatgttttcttcagcaatacaactgcacatctttctttgtttttttgcgctaattaaagacgataaacaatagtaataactactagtactgtgctacaggtgcatacaaaaatgtgttgctagctacttgggggagagattctttattatttacttctttcacatttgtttaggtgatgaatatgtttttacaaagtaaagtccacggtagaggtggtactcgtgggggcactgcatctgcaacctgtcatgtttgacaagaaggaaaaagttcgagttacactcctaaactacttttgtagtagttcgatttaaccccccccccccctcccccaaagaaaaaaaagaactcttcaaaccagacaaattaccctcataacccccattttatagcgacagtag

SEQ ID NO: 4885 - DNA, 923 bp, Oryza sativa
taggaaaagaattaataattgcttaaattttttgaataagacgaacggtcaaacatatttaaaaaagtcaacggcgtcaaacatttaagaatagagcgagtagtaaattttcttgaatacccaaggaaaacctgatccagctttagggagattgatgcatgtttaccaagtctctaaacggtatgatttttgttaaaaataacttctactttgtgttatatactacaagtttctatcttgtgctcgttttctgaacggctaaacaatgtgatttttttccaaaaacaagttctattgaaaagttgtttttttaaattatttcaatttactagtacttaattgatgtcgttccgtttagcatgcgggaagaagatcccaattcatttttccttcaaaattccttgaaacgacctcgaggttggtgacggttcaaccatccataattctctcattttcctccacgagctccaaaattcctgtgtgttccaacatatttcaaccatccacaattctctcattttgcaatgatcaaaactctagtacttgactataagcggcacttcgtccagacggccactacaaccgtactacttgattaaactctaaaacaacatttgcaattgcaattagtattccactacttgactcacctacactatcgtagtcagataagagtagttctactcatcaattcaatagctgaaatttatttttccccgaacacgaagcgaacgagagctaattgaagagagaacaagatgaatcgatttggggattgctgaacatatttttttttccctttccgattgcacgaagcgaacgagagctatttgaattgaagagagagcaaaacggaatcgatttggggagagggaggggctatagacgtacggagatgtaggagcaggtggggaggacgcgca

SEQ ID NO: 4886 - DNA, 1501 bp, Oryza sativa
caatctattaacttattaaaataataaaaagaagctccacgttcgctgtctggcctataaattctcatataaatcagagaaaaagaataacagagtccatataaaaatacaattaaaaaaagcttaatttcgaaattaaaaaataaggaatatttggaggaggagattatggcccatacatatatacaatttagagctaagtgaaattcgaaatcaaaaaataagaaaaaaaataaatataaatgttagagtccatataaaatacaatttagaaataaaaaataaaattaaaagaataaggaatattagaaaaagtgcctatagtacatatatgaatataatttaaaaataactgaaattcagaattaaaaaaaatattgaaagatgagtttagagtccatatacaaatacaattacaaataataaaaattcaatattagaaataaggtatattagatgaagagcgagtccatatagaaatctagaactaatcaaagttcagaattaaaaaaagagtagattttagagttcatatagaaatacaatttagaaaaaaaaataaaattcgaaaataaaaaaaaatagaagattgggagaagaatctatagtacatataggaatataataatataatagtaacgaaaattaaaattttttaaaaaataaatattagaagaatattatagagccatataggaatacaacttaaagataaccgaaattcagaattaaaaataaaggaatattaaaagaatggtgtaaagtatatatagaaatacaatttagaaataattaaaattagaacttaaaagataactactatctatcgcgtatatacaatacaataagaatattacacattgctaagtttgaagtttgctcagctaacacagaatttaaaattatattattattttaatatatcttttaatagaataagtaaatatgtatgctatcatacgaggaaaatgaaaattcaacctctgtaaagaagaacgtatctggacatgaaattgggtttttacaattttggacggaagatgcacacgcacaaggaccttaccacgtgaatcgaacggttaaaataacaaaaccgcccaaaacaaacaaacaaacagataaataatcagaagcacgcaaaatcataccacgtcataatctaatcaagcaaaaaaaaaagaaaaagaaaaaagaattccaccccgatcctcactactgtgtcactgactcactgtagcagcaacagcagcagagtgtgagtgctcatcaatccagcccatccccctgctgctgctgctgctgcttcgctgagacgacgagaggaagaagacgagcccccaagccaagcagacgcctcctccttcttaagcttcccaattctttctctttccctcctcctccgcctccgcctacgccttccccgctagtcccacacatccggcgaagattccggaagtttcgtcgatcctccgatcgatcaagcggcgagcggcgggaggca

SEQ ID NO: 4887 - DNA, 1501 bp, Oryza sativa; identical to SEQ ID NO: 4881

SEQ ID NO: 4888 - DNA, 1501 bp, Oryza sativa; identical to SEQ ID NO: 4882

SEQ ID NO: 4889 - DNA, 1501 bp, Oryza sativa
  unsure (1)..(1501): unsure at all n locations
actaaatttgttgaaactcatgagatataaatgttaccatttctagctcctcaattattaacaagcgaataaagaatccattaataataataataataaccatattataaatcaattatcccctattttaacttaacccgattaacaaatcaacccatatgcttcccactctccatcgactcgacttgaatgctcgtagagcacgcaaccacactgtgtatgaacaaaccaccagcgcgcaaagccgagaagagcccatgggtcggcgatcgagccggctcccccgcccctaacgaaagccgcggacnncggctcngggncnttncgnggncnttncggggnncttnnccgngnngnaatttccccnaanaaaattttcccncccaccggtgtagaaaaggcaaaggcaccctcgttctcctttcacacctctccccccctcttcttctctctctccacatcacaagtcgccttcctcctccgcccccgaaatcccctcgcgaaccagagaaacctgaggcaccaccatcaccaccaccgcctccgcctccgcctccgcctcctgcgcgcgcggcgaattcgggggaccctcgcgctcgcgtggggtgtgggtggggggagatccgggcgtcgccgtcgccgggggggggagggtgctcggattcagccagcggcgggtgggggggcccgcctctttcttcttgggggggcgcggaggagaccccgcccgtcctggattccgtggccgcggcgccgattcgggcgcgggagccccagcacggtgagattttcccccgctgccttgctgcactgtgagaattgccgtatctatactgtactagtttgttgttgttgttgttgttgatgatgtggctgctcgctgttgcggaaacagtggaatggatgggggtttgggatggttggggtttgacgagctgggcgggttgaggcgggaggagggtttgcttagggtggaatctgattggccgcgatcggcacgggtgttttggctgtatcctatagcgtgaaaaagataggaaaattactggttgtatcactttttgctgggtcaggtttggatagaattcaatcgtgttttccctccatgtcttttatccgttgaaatggtgccatatgaaatgtcaggattagttataaattctggttgcacactttgtggacgatttctgttatttgagtgggttatttagcgattatgtgtccgcgaatataatctgtactgacgtaagagcagtgaattttttttatcactcatcacagtgtgtttttagctggatgataactgagagttttgttcctgttattctgagttcagcacccgattattcataagtccaaatgatattttgttgcttgtgtatttgtctaaaactgtgcttgtggcgtccagccagtcaattcttgtgagtattacgcatttttagtgctatatttggcctgatatatatactatcttgagtaggtattatggtgatgaaga

SEQ ID NO: 4890 - DNA, 1501 bp, Oryza sativa
gttatgcatagctacactgcacttaaagatcaggtattggttgcatttccatccaattctgaatggagaattggagatggagatagcactgcaggtaaaaagcatggagacaaggtagaagaacacacacctcatgttcgagagacttgcaggcgaactcgaggcacacctcgagcgccctgaactcgaacggcagagccttgtcacctcctcccagagcttctccatccttgccgttgccggcggcctcctcgccgccgcggctcgcctgcgatggcgagatgctcccgtccatccccaccgccatgccatgctttcaaaaaagaaaagaaaaggagtgagagatcagagcttttgcttaagaagaagacgtacgatgcaatgcaagaaggaaggtagggtggggggcatgcatgtgtcacctgcggcggcgacggcgacggcgcgggggttggggaggcggcgagggcgaggcgggcgcggagctcccggacgagcggcgcgacggcggggtcgcgcggggacgggacgagcacctcggacgcggtgatgacggcacgggcgcggtccaggttgacgacgacggcgcggtcccgccccgtgatggcggacgggcggcacgacgacgccgacgccgccgacgacagcgccgggtcgagcgcgcggaggtcccgcggcggcagccccgtccgccgcatcagctcctgcttcgtcccgacctcctccaccggcgacaacgcccacgcagccccgccaccggctgtcaccgccgcccactcccccgcagccggcgccgccgcccccgcccccgccgccacgtgcctccgccgcgccgccatagtggtggtgctacactggggacgcctccgcctcgtagctggtggcgcgtgggcgcgggcgtggcgggtgggtggtgctcgggagcgcggcggcgcggcggcatgtgggggagttggcgacgcggcgcggggcgaggcgaggcaggcggctacgtgacgtgacgtacgtacgtacgcgaggcgagcgcggcgagggggagagggagagggagagagagggggaaaccgacaaaaccgccaacgcacgagccggtgggggtcaacgagccgtcgacgtggagtagagactggagcctgggtcgctgccgcgtggggcccacctgggtcactcgatccaattcacttcatttacgaattacgatgctttacaatcatgggcggccctgtttagtcatagggatgtaaagtttctgcatataacatcgaatatacgggacacatattaaacatagtctaataacaaaataaattataaatttcgcctgtaaatcgttattagtaagggcatgctcaatgtataatgtctacttaggtaataaggtgggacccggcattagttatactgtttgctataatgtatatggtaagagaaggcattagcctgggtcccactcaattgtatgtcatgtgttgtatgtcatgtgagactgaggtaaaagaga

SEQ ID NO: 4891 - DNA, 345 bp, Oryza sativa
ggcgtcaaacatttagggaagaagggagtaatatttctgacatcaaattttagttcatgtccaagaggaccaagacagtaacaaactacatctgctgaaaagcaaatgctattctcaatataagttggcaactcaaggcctgaggcaaaaactgtcattgctctgacgtcttcgtttcaaaacctgcaggagacttacctccctcgcaacccggagtggaacgagctcgtgatcacggagaaagaacccaaacccagcagcatgtagaagaaatattcatgcaactctgctacaaattagccaccctaaataatcagctatatatacagctcatggaagtgtatc

SEQ ID NO: 4892 - DNA, 1501 bp, Oryza sativa
atgtttagttcccaaacaaaaacttttcaccctgtcacatcgaatgtttggacacatacatagaatattaaatatagacaaaaaaaactaattacacagattgcgtgtaaattgcaagacgaatcttttaagtctaattacgccatgatttgacaatgtgatgcttcagtaaacatttagggcaaccacaatgtggggtcttaagcctctaaagtggtccttatacattgtgaaagtagtccatatagtagtctttagtatgaactacccatatgcataatgcctacccataagaataaaataggaattgtcagggttatggataccacatacctaatagtagttgactaaatctcggcagggcccaccacatatcatgtcctatacggaaacaacctgcggatgtaggaggagttccggataaggaaagacaaccggagttctacgtggaaacgataaggactactcggattgtatccatattggtttccctaattctacttggacaaagggactcctatgagtataaatacaaggccccctaggaggagaggggggacagacaatcaatacccaacacaatcgacatagaagccacaacatacaagccaacatactccaagacaagacgccggattttgacttcagggataggcatggctattcccctacggtgtctccggataccgtcaggagagacgaaagcgctatctctgatctcgccggacacggattcgaggagcaaggctaccctgttgtcgactacgagtcagaccttcagaccgccatgtcgacaacagttagataggctaccccacatattgtactggtgtgattatggtgaataaaaagcaacatcggcttagggctacctgaccgctcagggacccaaacctgtataaaaatcttcgtctccatctcttttacctcagtctcacatgacatacaacacatgacatacaattgagtgggacccaggctaatgccttctcttaccatatacattatagcaaacagtataactaatgccgggtcccaccttattacctaagtagacattatacattgagcatgcccttactaataacgatttacaggcgaaatttataatttattttgttattagactatgtttaatatgtgtcccgtatattcgatgttatatgcagaaactttacatccctatgactaaacagggccgcccatgattgtaaagcatcgtaattcgtaaatgaagtgaattggatcgagtgacccaggtgggccccacgcggcagcgacccaggctccagtctctactccacgtcgacggctcgttgacccccaccggctcgtgcgttggcggttttgtcggtttccccctctctctccctctccctctccccctcgccgcgctcgcctcgcgtacgtacgtacgtcacgtcacgtagccgcctgcctcgcctcgccccgcgccgcgtcgccaactcccccacatgccgccgcgccgccgcgctcccga

SEQ ID NO: 4893 - DNA, 1501 bp, Oryza sativa
tgttttggctgtacaaacaaacaaaacagagttgtaagataactcctctatatttgaacgtaaaactaaacaacaaatgatgttatatgtcacaacagttgctacactcaagtaactacaaaagatgctaaatataaccctgacactatccgcttgctgagagtaacagttgctatccagcagccctatgctcatgtaacaaagttaggaaaattgaacatcttaaaatgtgttgtagctactagtatttacggaggtgaatatgagccgagttaattggtttgcctcaatggtgcagtttgcaggaacagaagcagcggccaatatcctggaaatgaacaactgaacggtagagctgccgaaaactaagagcagccaaagaaagaataattgaagaattgaagtttagtgatatttcactacagctccaggattttttttcgaacgaaccggcactacagctccaggatcaatcatactttactagtaacgtgtttatttcaagctttcgacatgtatcaaggtttcaacttttctgtggtactgaactggctgacccatttcttgtacggttacactacccgaaaaaatggtatacccctacattgcattctctagcaagtaaaattaagctgcttccttacggcttctcccttgaagagtgcatccatcataccactgttcaactacattagactactacatggaactggaagcaatgaacatgagaattgtcactaatttgtcaaccacacaacacaccaaagggggcaagggcagttactacacgacaccctaaaggcagcagaaatttttggcacaagcaaacggttagcttcagggggagggggggggggtggatcatcatcaaccagcgaggaggcacactccctttacctccgcgaggagaatacgcgcagctcaccgtgcggatccggtgcgccgcccagcggcgccggcagcccggccaccggcgtgcggcggaggaggaggcgccgtacccggccctccgtcggccgggcgccgcgagcgccacgccgcggtagaggctccgcggcggcggcggcgcggggcaagcggtggcggtggcggccatggttgttggtgttggttttgggtggagactcgtgcgtgcgtgcgtggcggaggatgcgcggtaggtaggaaaatttacgaggcaaatccgcacgcgacgcgagcgagcgagcctagcgcttatgatgatgaggacgacgctgacttggaggtgattttggagtgtgatgcaattcactcaaaccttattatttcctccgtttttattatatttatcaatagttttaactttttttacaaaaaaaatatattaaagttaatcgattttataaaaatatatgatagtgatttgaccacaaagcaaatatgttatccaaatttacattgtttaatgaaactaatttggtctatcttaacaaagtttgactaagataaaagttaaaaagcgatatattgcatccctgtg

SEQ ID NO: 4894 - DNA, 1501 bp, Oryza sativa
aagaacatgccgtaattgttttggctgtacaaacaaacaaaacagagttgtaagataactcctctatatttgaacgtaaaactaaacaacaaatgatgttatatgtcacaacagttgctacactcaagtaactacaaaagatgctaaatataaccctgacactatccgcttgctgagagtaacagttgctatccagcagccctatgctcatgtaacaaagttaggaaaattgaacatcttaaaatgtgttgtagctactagtatttacggaggtgaatatgagccgagttaattggtttgcctcaatggtgcagtttgcaggaacagaagcagcggccaatatcctggaaatgaacaactgaacggtagagctgccgaaaactaagagcagccaaagaaagaataattgaagaattgaagtttagtgatatttcactacagctccaggattttttttcgaacgaaccggcactacagctccaggatcaatcatactttactagtaacgtgtttatttcaagctttcgacatgtatcaaggtttcaacttttctgtggtactgaactggctgacccatttcttgtacggttacactacccgaaaaaatggtatacccctacattgcattctctagcaagtaaaattaagctgcttccttacggcttctcccttgaagagtgcatccatcataccactgttcaactacattagactactacatggaactggaagcaatgaacatgagaattgtcactaatttgtcaaccacacaacacaccaaagggggcaagggcagttactacacgacaccctaaaggcagcagaaatttttggcacaagcaaacggttagcttcagggggagggggggggggtggatcatcatcaaccagcgaggaggcacactccctttacctccgcgaggagaatacgcgcagctcaccgtgcggatccggtgcgccgcccagcggcgccggcagcccggccaccggcgtgcggcggaggaggaggcgccgtacccggccctccgtcggccgggcgccgcgagcgccacgccgcggtagaggctccgcggcggcggcggcgcggggcaagcggtggcggtggcggccatggttgttggtgttggttttgggtggagactcgtgcgtgcgtgcgtggcggaggatgcgcggtaggtaggaaaatttacgaggcaaatccgcacgcgacgcgagcgagcgagcctagcgcttatgatgatgaggacgacgctgacttggaggtgattttggagtgtgatgcaattcactcaaaccttattatttcctccgtttttattatatttatcaatagttttaactttttttacaaaaaaaatatattaaagttaatcgattttataaaaatatatgatagtgatttgaccacaaagcaaatatgttatccaaatttacattgtttaatgaaactaatttggtctatcttaacaaagtttgactaagataaaagttaaaaagcgat

SEQ ID NO: 4895 - DNA, 1501 bp, Oryza sativa
tgttggaataggggaaccagccccatgattttgaaattcaacagactaaatttgttgaaactcatgagatataaatgttaccatttctagctcctcaattattaacaagcgaataaagaatccattaataataataataataaccatattataaatcaattatcccctattttaacttaacccgattaacaaatcaacccatatgcttcccactctccatcgactcgacttgaatgctcgtagagcacgcaaccacactgtgtatgaacaaaccaccagcgcgcaaagccgagaagagcccatgggtcggcgatcgagccggctcccccgcccctaacgagccgcggaccggctcggctcggctcggctcgggatccaatcccaccggtgtagaaaaggcaaaggcaccctcgttctcctttcacacctctccccccctcttcttctctctctccacatcacaagtcgccttcctcctccgcccccgaaatcccctcgcgaaccagagaaacctgaggcaccaccatcaccaccaccgcctccgcctccgcctccgcctcctgcgcgcgcggcgaattcgggggaccctcgcgctcgcgtggggtgtgggtggggggagagccgggcgtcgccgtcgccgggggggggggagggtgctcggattcagccagcggcgggtgggggggcccgcctctttcttcttgggggggcgcggaggagaccccgcccgtcctggattccgtggccgcggcgccgattcgggcgcgggagccccagcacggtgagattttcccccgctgccttgctgcactgtgagaattgccgtatctatactgtactagtttgttgttgttgttgttgttgatgatgtggctgctcgctgttgcggaaacagtggaatggatgggggtttgggatggttggggtttgacgagctgggcgggttgaggcgggaggagggtttgcttagggtggaatctgattggccgcgatcggcacgggtgttttggctgtatcctatagcgtgaaaaagataggaaaattactggttgtatcactttttgctgggtcaggtttggatagaattcaatcgtgttttccctccatgtcttttatccgttgaaatggtgccatatgaaatgtcaggattagttataaattctggttgcacactttgtggacgatttctgttatttgagtgggttatttagcgattatgtgtccgcgaatataatctgtactgacgtaagagcagtgaattttttttatcactcatcacagtgtgtttttagctggatgataactgagagttttgttcctgttattctgagttcagcacccgattattcataagtccaaatgatattttgttgcttgtgtatttgtctaaaactgtgcttgtggcgtccagccagtcaattcttgtgagtattacgcatttttagtgctatatttggcctgatatatatactatcttgagtaggtattatggtgatgaaga

SEQ ID NO: 4896 - DNA, 1501 bp, Oryza sativa
aaaattttgaaccattataatttaacatataaatttcaaatcgattatgaatggatatgatatttatggcctgtttaagaagcttaaaattctgaaaagcagctagtagataataaacttctaagaatctagtaaaactgggtttctcagcttctggcttctagttcattttctggattctataactacatcttcaaagaatctggacaaaaactaaatttgtttagggaacttctgattctgggagaatctgtagcggcatagccgtgccaaaccgggcctacatgtacatggagatgagttagatctggagcaaatgacgaaaatgcccctcacccccgttgccctgctgctcccccccgtaatccatccgggagctccgtccctcgcttcggcatgaggcctccgcccttaaacccctgagaagagaggaggaggaagccatgccgcaactgccctcccctcttcgccggcttcttccgctcttccaaaccctagccgccgccaccccggccccgctccttcacctttccccccggcttttcttctcctccttctccccctcccccttccccttccctcgcgccgggtgcctccgcgccctcgcctaccgcggcggccaggcaggaggaggaggtcgccgcggccaccacaacaacctcctccgacgcgggaacagcacgctcgggaagaggagcaaggagaagatgggcggcggaggagggggagggggagggggaggggaggcggaggtggcgttcaacaagacgcgcgcggaggggaaggacgggaggaagggcaggagcatggagctcaagagccgcaagctcaaccccatcaacaccatctgctacgtacaggtgagggattttgccgatttctccccccacaccacgccacattcccgatggtctcgttattaagccgctctgctttgcgcctagctttcagttcagctcgattaaagcggggattgcctgctttttttatgctacatacattttgtttcctaagacgcgaacgatgtcgagcaacaaaatgataatatgattatatatatatgccttttagcacaaggttagtacctgctacaatcctttgatggcgattgtgcatgttggtttacttcatgacttagcaagcacatttaattcctgggcttacttgggatacaaaacatgccccattggagtatggcgcgatatcttttgccttgggtttcagcatgccggttataattttctttgctttgtaagaatgtgcatgtgtcgcctttctgctgacctaactgtgggcataggctaaaatgttatcccaaattgattgcgatagatgtcttacttaggtttaaagggggtatagcatctgaaccaaactttaaaccatcgttcgcttattacctgcgtgctaagaaaattataaaataataaattttgtcacgatgccaaagttcatcggaggatatacatattaatgccacccgctaccaaattggtagaaa

SEQ ID NO: 4897 - DNA, 1501 bp, Oryza sativa
ccgccgcagccggaggcgaggcagaagacggcgaggcggtggcccttgaggaagccggcgtgcgccggccgccccgcgctcgcctccttctcccacacgttgacgtacccgtcggaggagccggcgtagaggaagcaccggcgggtggcgcccgtggcggcggcggcgtggcagagcgtcagcgcgttcaccggcgacagctcggagcggagggcgatgatgagggcgtgcgtggtgccgccgtacacgcgccgccacatcttgacggtgccgtcggcggagccggtgaagatgcagccgtcggcctcgttgatgagcatggcgttgatggcgccgtcgtgggcgacgaacgagtcggcgcagctgccgtcggagagcttccacgccttcacggtgtggtcgtgcgacgccgtgtagaggaggcccgcgacggcgtggagcaccaggcacgacacggtgtcgcggtggtgcggcggccgccgcttggtgaaggagaggatgccgcccttcgccgggagcgtggcggccttcttggcgcggatgtggtcgcacacggcggaggcgcacaccgtccacacgcggacgtggtggtcgcggctgtgggaggtgaccagcgtgccgccgcacgcggcgatcgccgggacgcggccgcgcccgacgtcgaggtacccgcggttgaagcacccgggcgccgcccacgcccggacgcggccgctgtcggacgccgtgaacagcacccccctcgccacggcgagcgcgtgcacgtcgccgtcgagccggtgcagcgcggagaggcagtggtagatcgccgccggcgacggcgggaaccgaaccctcccgtgcagcggcgactgcacccacggcgagcacatccccccgacaccaccaccaccaccaccacctcccccaactccgaccaaccccggcagctccaccccatgcaccgacgagaggctcagcctcggcggcgtgtgcggcgccgcctccctcgccggcgaccgcgcgtagtggtggtgcaccggcgtccgcgccgccgccgttggccgcgccttccagtcctcctcaaagaagctaaagctcttcctcctcccaaactccatgactagctctacctccctgatcctctccctgcaccactaaacctccagctcagtactctaccacctaccaccacgatgacgacaacaatggcgacgacgacgacgacgacgacgaattgatcgcatccatgctagtagctagctatactgcccaccaacgccacgttaaatcgaggtataaatcgaggtcgatgaaacgaaggagtggtggatgggcgagctagtcgtctacgtggacggcgaggatatgcagcggcgcgcggtggtggtggtggggtaccacggcgggagcgccattactcgccggagttaaggggggcggagtaaatggcgcgtacggtacgaggtgggaagatatgggcaaagagagggtaaagatctcgatgtatatcgcgtgcaca

SEQ ID NO: 4898 - DNA, 1501 bp, Oryza sativa
tcaaaatataagcatgtttagttgtaaatttagacgaccgctagtccgatccagatcactactacaaaacccctcataggcaccgactcatcggcaccctattgatcttttcccacctttgcggaatgaaaaaaaaaatatagaaccgacacctttgaacaattaccggtgccagttctaattaaggaaaaaccgatatcaatatccggtttataaaaaagaaccggcacctatagatgatctaggtgtcggtttttattaaattagcacctattgtataatataggtgccggttcttttaaaaaagtgacaccaacaaaactgagccgaaccacccaacgaaagtgagccgagctgatctggtacttttattttagtccaccgacacacccaacaccttatccactcggtttctctatattagtctccgcctttctcgcgtgcttctctccgccaccccctatccttccatcctcccatgcttgcgcctctctctcgtatgccgccgcctccgcccccaccgcttacgcttgcgccttctctacccctctccccttctcatcctcttgaccccttccacggtcatggtgtgcttggcggccaagttgaggggggcatggttaattttaatttaacctgcacctatgaatcaatatctatgatatattttgtaatagtgtatgcgcgaagttaattgcacatggttctcgatctctcttatatgggctggggtacgtcaatatatagaaaaaaatattagcaaagacgtagcgtgattgtgctgggtagctgggctgacagtgtcccacacggctaagcctcatcaaattatttagcagagatcaaccaacataataatacactttggaaatataggaatttgctcatgttattttttgacatgaacagtggctcatgcgatactattttctagatccgacattaattactcactaaaaccatcacccatgtgtgttttcaattagtacattactgatgatacattttgatatccttgcgaaggggtagtacatatgtacaaggccaacacatttaacacaaggagacacagcaaggacacaaattaacagcgcacatttgctagctagctaccatgcacagaaacggaacgaggacataatccaaaactttagggttgcttctctgctccgccatgacgccaatgcataatataattgtgtcggctacctgcacagtgcgcatgtttaatctgtttcttcctttcttcttcttcttcctattaagactcgcttaggtggtgtttggatccggggactttactttagtctctatatttagacactaatttagagtattaaatatagactacttaaaaaataattacataaataaaagctaatttgtgagacaatttttaagcctaattaatccataattagagaatgtttactgtagtatcacataggctaatcatagattaattaggctcaatagattcgtctcgcgaattagtccaaga

SEQ ID NO: 4899 - DNA, 1501 bp, Oryza sativa
cacagtatgtaactctttttatttaaaatattttacttttataaatatcgtttgtcaaataagcatctttagaaccgtgtcgaagtctaaaaatacttatattttgatacggaggaaatattcctcatcgtattttcctacttatctctctcgtttttcacatgtgtgcttttgtcaaatggttaaacggtgtgtttttttttaaaaaaaaatatatgtatgaaagttatttgaaaaatcatgttaactcactttttatgaaataactaatacttaattaattatgtattaatgaaccgttttgttttacgtgctggagggttagtttctaacactaataatcgaacacggcctttgctacttagaggaattttaatagtatatagctaactactagctccaaatcatttatagctaatctaatagtaaattatacaatagttaactacagatatacactacatcattaattactggtcccacttgtcatacacacgtagagcccgttagaaactcatgaaaggggtgaattaaattttggattaaagtggcacgctttttaaactgctaaacggtgcgtttcgtgcgaaaactttctatatgaaagttgttctaaaataacatattaatccacttttcaagtttgtaataattaaaactcaattagtcacacgttattaccacctcgttttacgtgaaacacttaatcttcatctttatctttatcttcaggagattcaaacaccaccgtagcgtttaggagtccgtgctgcagctggttacaaatctgtagcccgcttctattctatctcctctcttatcttcaccacataagcttgtagctgacttatagtctattattgtacctgccattagagttttatatttgaacttggaatgtagtatccaaaataactttgggggtgtttagatccaagagtgtaaaattattgcgtgttatatcgggtattatatagggtgtcgcatggggtgttcgggcactaataataaaactaattgcagtatccgtcagtaaaccgcgagactaatttattaaacttaattaatccatcattagcaaatgtttactgtagcaccacattgtcaaatcatggagcaattaggtttaaaagattcgtctcacaaattattcgtaatctgtacaattagttatttttagcttatatttaatacttcaaacgtttgatgtgaaagggtgtaacatttttgtgtgggaaaccggacctttgtttttaagaccggatggagcactttgataggaggtttgggagtttggaacttgtgcaaaacggtgtgttttaaaaattaaaaccattgctctcgtacataccagatatttataactaaaggtcgagaagttcaaaatgtgtccaaaggtcgagaagtttaaaatgtatccaaatcaacatattttcaatatttgagggagtaacatgatataagaccatatatttataactaatggccgataaatttaaaa

SEQ ID NO: 4900 - DNA, 1009 bp, Oryza sativa
atttcaaaatcaagcagaatgtgagacaacagaatttgttccagatacatttatatggaactcaaacagacaaggccaatgaacaagagcatctccaagaacggtaaatgcaggtccgacaaatgcatatatacggatcatcagatcatatgcgttcaccttttttttaattcttttttttctttttacatttccccatgtctcctatagcatactgtccatcatgatagtttttcaatatcgagccaaacagggcatactatgtgtttagaatataatacaacatgcaggtatatataatataggtcgtgcaaatgtcttgaacgcatcacaaaatatacttttgaagctttataattgaaaaaaaaagaatcagctagaacaacaaaaggcacatctatacttgatccgttttgagtttctttgaacaaaacaacatgtgtgccatttcctaccaaaggtcaaaccagcacgtcgacatgatcacgatgcccaaaattgtaaattctaactaaacagatacaaacgaacatattaaatactccttccgttttttaatagatgacgtcgttgactttttctcacatgtttgaccattcgtcttattcaaaaaatttacgtaattataatttattttgttatgagttgttttatcactcatggtactttaagtgtgatttatatcttatacatttacataaaatttttgaaaaagacgaatggtcaaacatgtgagaaaaagtcaacggcgtaatctattaaaaaactgaggtaatataaaccaatcaaactgaagaactgaacctaaccgatcgatacccaattccctacctccccaatgcatgggagagaagaaaaaaaaagagaattcatcatccgcagaagaatctcccaccaatcacaacaaattcgagcaaagaatggtcacacaagcaaagaacgaaatttacggacctagcagtgaccgaaccaacggcggccttcaagctccacggcgagacatcgcggt

SEQ ID NO: 4901 - DNA, 1501 bp, Oryza sativa
attaaaaaatcaatggtgtcaaatattttgaaacggagggagtactccgtactaagatttccatagagatagggtctacttcctctattgtatattataaattctttaatttttttctagtcaaattttattaaatctgatcaagtttatattaaaatttagcaacatctaaaatatcaaattagttttattttaataatttataaataaatttttatgtatatatttttagcaatttagaaactaatgataagaaataaacttggatgaaaaattaaaaacggaaataaattttgatttcatgcaagggaaacaccggtgaggccgtggcgtggccgtagcggtcgtctgattgggggaaagcgccagacttccttttctgccgaacgagacgtcgcgtgccgatacggctggggccacactccggtacacgtacacgacgagacgacgtccgtgcgacgcagcggcggagagatactagtaggagtagtactacacttttgcttggttcttttcctcgcggggcacgcaagggtgcggtccaccccctcctcgcggccattgcgcctctctctctcgccgaagtggtagaggcaacgcagcagcagcagcagcagcaagtgtccctgtgtccgtctccgcttctcctcctgcctcctgcagtctcgtctccaccgactgcaactaaaaccctcctcctccggcccctctcaactgcagagcgcgaccaccacctcagacaaacccgaggttttcttcttcttcttcttcttgatcgatgcagccagcagccatcgttcttgcggggaaagggttcttttttcgttttcttttttttttgtggctgctgatcggggattatcaccaccttcgcgcgatctctcgtttttttctctgtggaattgggggtggtggatggatggttgatactcctgttcatagatggcgatggtccaagtttattccttttttatttttattttttttcggatttgttctgttgctgtagttgccgtttcttggcttcttgctttcaatgccttctctcttctccttttctctttctttcttttttttttattttttgttgttgttgttgttgttgttgttgttgttgttgttgttgttgttgtctgttcttgggggtaatggtgtcccgatcgtattggacaagccttcgtgtatgtcactgattggaattggagtgtggagttagacgccgacaggtgaggcagatgaacaagagttccaacccaaaagttcactcatgaagtgttgtgtaaatagaagtaaatataagggagaaaatactagttgcttgggggagttgggattctccaaaagattgtgttttttttcccttttcggttacgcttggtgagaagatgatttattttggagatggtggacgacgcctatatttctgttttctggctatctaattctgacgatggcgtctcatgtttttcaggtgcgtttcgcgtgaagcgggttttaagga

SEQ ID NO: 4902 - DNA, 1501 bp, Oryza sativa
tagcgacgagggtctcggatctgatcggggtggggcgggctttgcttaccggtggaagccgagcttggtggcgacgtggaaggagatgtcgtcggagggggcggacatccagacggtgtcgcggtagcggcgcacctcgaagtcggactcggcgtgcaccgtcgtgtactgcggcgtctcctccgtgccgcgcgcggccggcgggagcagcgcgagggggaggaggagggcgaggacgaggtgcgcgagccccgccatggtcgccgccgcctcagtcttcgctccgagcggctgcttgcttgcttggggaggcgatcggcggtggatcggagtaaaatatacgtacaacagtcggtatatgattggagaattgtgtttcgacaagtttcagttctggacatcactgttttgttttttagaaagagagtaaattatttttgttaataatgaaaaagagtaaattctagtagtacgagtttaaccaaactatcactgaccttgtttagagaattagccaagatttattttgagagctattttttaacacaaggaaatagccatccaataaaatagccctaagttgtttgaattcaaaggttattttgagagttatttggcttttaatgtacatttccatagagggagatagaggaaaaaagacactttttcagtggccccacttgaaatagctccaattaacacttcttgggtgggatagttttttgggtgggttatttccaaataaccctaaaatagcttaacttttagatctttttgagctatttgaggaaaggctaaaaaatatctcttggatctaaacagggccacagtagatttaaaagtgttgtataaaaaaatatagatttaccaataaagtaagataaaatattacaaaactacatatttagtattgaagttatcacaatcctagtttaaatctctatcattacgttatgttagagctataaacatttgtagttttctaattaaattgataccaaacctgtagttttgtgacactcaatctttatttttgacactccatcttaaatatgtattttttgagaaattttgtgttaaatctatatagttttgtgatagaacatcgtaaatatgtagttttgtgataattttatcaaagtatttgcagttttaagatgtgctctttctctatttttttttgacaagtcacatgtctgtgcaagatactttgtttaatttgatatatgaaacaagtttatttttttttacctttttttggttgatttaagctgatttttattttgaagttttttttacatggaatagcagaggttaaggaaggagtagatgtaattagagaaagtgataataaagatgtgtcgttgatgttaataaagagtactaaaaagtagaacatgcatggtgggaaatttaagctcaattggtcctaaggtttgttctccgttcggtatggtggcttgggggttccaaacttagaaaaatttaccatagcttttca

SEQ ID NO: 4903 - DNA, 1501 bp, Oryza sativa
gtcaagcatatgtatcacctacgttgtactcccctcaaaccccaaatcacttcagattccatctcaaaattgcacaacaaatcggttatgagcaaactaactagtttaatgcaacattcgactcaagtagatgcttcaaccaatcgagaaaaatgagcaacttgtgctggacactaaccagacttaaacgaggagatatttgtgcaactagctacagacaataaattagccacgaaaaataagatgagaaataaggagatataggaactaatgcataattttaatgacaaagctttgactactaaaatctatgatattattaaaacaactttgaaaggagacaccacataagaagtttcaacataagaacccaatacgagattaatcaaaattcaaaataaaaataaaataaaatctaaaatttaaaaaagaaaaggatagtccaaataggaatacaatttttaaataggtgaaattcggaattaaaaataaggaatattaaaagaagagtccatataagaacccaatacgagattaattaaaattgaggataaaaataaaaataaaacccgaaattaggaaaaaaaagaagagttcaagtaggaatacaatttaaaattagctaaaatttgaaattaaaaataagcaatattaaaagaagaatccatataagaacccaatacgagattaattaaaattcagaataaaaaaatataataatatctaaaattagaaaaactaaaagagagttcaagtaggaataaaattttaaaacaactgaaattgaaaataaaaaataaaaaaattaaaagaacacaatacgatattaattaaaatttgaaaaaaataaattctgaattagaaaaagaaaaataagatttcagttaggaatacaatttataaataacaaaaatttgtgataaaaataaagactattgaaagaaaagaccatctaaaacacatgacgagataaattaagtaacaggcctataaaggagtagcgtggtggtggttgatacgacatataaaaactgttaataaaacaccaaataaaatcctaatgatgattaaaaggagggacgacaggcaggccgtgaagcaaacgagtaaggcggttgacgggacttccaaaaagtaaaaaaaataaaccccatcgataatcatatttaatttttaaaatctcaatgacaataaaaaggagaagcagcgggtggggtatataggagtatagttacaaagccgccgatggttgatgagacttctagaaaataaaaaataaattccaacgatagttatgttcgatttttagaatcacaatgaaaataaagaatagacggcggatgggccgtagaggtgtatagtggcatcgtttgacgggacttctgaaactataaaaaatgaaacccaacaagacaataaactctaaaaactacaaggtccaatttttaaaggttcggaacttctaaaaagtaaaaataaaacaatgataatcatgatgcat

SEQ ID NO: 4904 - DNA, 1501 bp, Oryza sativa
taaaaaccattacggcttattagtgataaaaaagatttatgagtaaaacttttatatatgtgtacttagcgtgtcggtgatatggctcggggtatgcgaagtgcgggggagttacctcctgatccagccacgtggccctacagcttggccctccccccgcgcctcggaagacccagaggcagccagggagcctcgggtgccacgtcacacccctcgggccctcgcgctgcctcgccctgaggccctcgctcaactgccatgtggcgaggggagcgagcggggaggagactcagactgaaccaccatcaatgcgcgccgccccaactgtccctcaccgcatttaatgcggtaagggcggacgtgcggtggggcccgtttgactcacgtcaatcaggcgtgaccaaactgtgactggcctgtcgccggtcacgtccgatcggacgggcggccgtgcccccacactcgcccctgtacccagcggagtggaggcaggtatgccccgtcccatcgaagtatcatccggagctccctccacgtgagaaggaccgccacaagtcttcatccatttaagacggaatgacacggctgtcccccgtgtcaggtggggggcggcgctgtgtcccactcaaggacggactgccgcttagcttccgggcgaagacacggatcgtggtccggtcaaggtaaagtggatccccctcccgtgaaagagtaggtagaagcggtgcatgtggtatccccttgaactataaaaggaggaccttgcccaccgagaaaagggacgacgctcagtaggcctgaactctaggaggagaagagcgagagtactctccggagtttaggaacctttgtaacactcaaccataaatcccacacacaggagtagggtattacgctccacaacggcccgaacctgtataatcttggcgcccgtacgcgatctagaaaccctcagggcggatacacgatctcgacaagcgagccttttcccccggccgaactcacaaaaggggatctcacgatctcccgctagagaggatcactcctcgacatagcgacttaaaagctaaagctaaaaaagaaaatctttgaaaaaacatcaaaatcaaatattaaaattcaaattttagcattggcttataactttatatgctataaggcaaacgatgaggctcaaacatcatcatataccttagcagaactgaattacaaatagtgtttttattccttcaaatttcagaacggtatggcatcccagcgcgctcacgctgccgatcgcgcccgtcgtgcctctctccatctctcatgcgcttcctcggtgcacgctaagccaattttgttatatatttgttgataagtgtttttctaaaaatttaacaaatgaaattatagtataatcgtaatataattacattggaacttgcatataaccgtaatataacctacacgtaactttcatataattttaaactattagatttgtttcaagattcatgtaagt

SEQ ID NO: 4905 - DNA, 1501 bp, Oryza sativa
tatcacctacgttgtactcccctcaaaccccaaatcacttcagattccatctcaaaattgcacaacaaatcggttatgagcaaactaactagtttaatgcaacattcgactcaagtagatgcttcaaccaatcgagaaaaatgagcaacttgtgctggacactaaccagacttaaacgaggagatatttgtgcaactagctacagacaataaattagccacgaaaaataagatgagaaataaggagatataggaactaatgcataattttaatgacaaagctttgactactaaaatctatgatattattaaaacaactttgaaaggagacaccacataagaagtttcaacataagaacccaatacgagattaatcaaaattcaaaataaaaataaaataaaatctaaaatttaaaaaagaaaaggatagtccaaataggaatacaatttttaaataggtgaaattcggaattaaaaataaggaatattaaaagaagagtccatataagaacccaatacgagattaattaaaattgaggataaaaataaaaataaaacccgaaattaggaaaaaaaagaagagttcaagtaggaatacaatttaaaattagctaaaatttgaaattaaaaataagcaatattaaaagaagaatccatataagaacccaatacgagattaattaaaattcagaataaaaaaatataataatatctaaaattagaaaaactaaaagagagttcaagtaggaataaaattttaaaacaactgaaattgaaaataaaaaataaaaaaattaaaagaacacaatacgatattaattaaaatttgaaaaaaataaattctgaattagaaaaagaaaaataagatttcagttaggaatacaatttataaataacaaaaatttgtgataaaaataaagactattgaaagaaaagaccatctaaaacacatgacgagataaattaagtaacaggcctataaaggagtagcgtggtggtggttgatacgacatataaaaactgttaataaaacaccaaataaaatcctaatgatgattaaaaggagggacgacaggcaggccgtgaagcaaacgagtaaggcggttgacgggacttccaaaaagtaaaaaaaataaaccccatcgataatcatatttaatttttaaaatctcaatgacaataaaaaggagaagcagcgggtggggtatataggagtatagttacaaagccgccgatggttgatgagacttctagaaaataaaaaatgaatcccaacgatagttatgttcgatttttagaatcacaatgacaataaagagtagacggcggacatgccatagaggagcatagtggcatcgtttgacgagacttctaaaaattataaaaaataaaacccaacaagacaataaactctaaaaactataatgttcaatttttaaaggttcagaacttctaaaaagtaaaaaaaataatgataatcatgttcgattttaaaatctcaa

SEQ ID NO: 4906 - DNA, 1501 bp, Oryza sativa
tgccaccctcccatcctccgccccctcactggatctcgcccacgacggcctccgctcgctgactcaagggagcatccaccttcgccgcacctcctcgccctaacgccagggagcagcgtcggccacctccccgcgcctcgtcgccccgacgtaaggaagaagcgccgacacctctcttgcccttgtcaggtgaggagcaccatccccgcgcggccgcgcccctcgtcgtctggctttggccggatccactctcccttcatcttatgtccgttcgggcgggcaagcgtgaacccaccgagtatgcggcgcagctcggacgcatcagatctggcagcccctggcacaggcggtgccagatccgtctacgagggccgaggagagtgggcgatgcctccttccccctcctcgatgtccattgcctcatcctcatcttgaaagataagcttttttttttctccaaattcttgttatcctgccatggcttcagatccgtgctccccaccgtagtggctacagattgggaataggctttccgatctagtgactagagatattgggttcgacttgctaagatccggtgatgcctttgctttattataactagccgggtggcccgcgcaattgcgcggctagcacccaaacaaatcatatattttttaatatgattttacttataatttattaaatagccatctcattgtcttaagactttgaaagaccaaatcttatcatccccgtgtttctaattatatagttttttaaaagtcacaccagttgctaccccttatgtcatcttcttctttatttgcttgctcgatctaccactatttctattcattctccttggaacctttaaaaattggatcttatagtttttagagtttattatcacgttgggtttcgtttttataatttctagacatccagttaaacattgccattatactcctctatggctcgtccactgtctcttctatttattgtcattgagatttttaaaatcgaatataattatcgtttagattcatttttactttctagaagtcccgccaaaccgtcagcggctttgccattgtacttctctacggctcgcccgttgcctcccttttttattgtcattgagattttaaaatcgaacatgattatcattattttttttactttttagaagttctgaacctttaaaaattgaacattatagtttttagagtttattgtcttgttgggttttattttttataatttttagaagtctcgtcaaacgatgccactatgctcctctatggcatgtccgccgtctactctttattgtcattgtgattctaaaaatcgaacataactatcgttgggattcattttttattttctagaagtctcatcaaccatcggcggctttgtaactatactcctatataccccacccgctgcttctcctttttattgtcattgagattttaaaaattaaatatgattatcgatggggtttattttttttactttt

SEQ ID NO: 4907 - DNA, 1501 bp, Oryza sativa
tggctagcttagatgtgtgtgatattatgacttttcggatgtattttggggccaataatttggtttgctttgtgaatctgagatggttgtatcctgcattattggagctacctagtgtgctgataaattatttgtgaaaattgctctttgtcgatcgatcttctggtgaaaacttctatttgtccctctctaggtcttgtcgtcattttagaacatgtgagttcatgcatacctttaaaaaacttcgatcacaacatatacataacaaaaatatttgtgttgtcactttgaaatgatatcgatagctttgccataagaaaatacagtggaatatttacttatttaactacttttatttgtaatccctccgtacttgtaaaggaagtcgtttaagacaatatttaagtcaaaccttgagaatataaatcatgaatagctctcaagttgttgagtttgaaaatgtaaaaattatatgaatagatttgtcttgaaaaatactttcataaaagtatgcatatatcattttcaataaatatttttatagaaacaagaagtcaaagttgagttttggagaccatatcgctgtccaaaacgacttcctttggcacatggtacttgcattcaaatatatcaaaaatctcttatccaccaaatctgactttatactggccatgcatgtaaggcaccagtatacagttagatgtgggaaggtatatatattatataaaaaaaattccattaaccatccgctccatcatagttatattgttgatgacttatcatggttaaatattgcgattttaaggatcaaccttgctcatttcaaaacagagcattgtatctgtaccataaaaatttgaattaacaccacaaacaaattgtgtctaaaaaataaaaatatatatactttttatggaaagaactattctcatcacatttatcttttcttgctttcccctgaagggcatcaagcatggatgatagtgcttgttgcgttaccatgagtatagcatggggcatatatatggttgagttgaggcagtcctagtggagggtaccattgacaatagtgctcaacttcctacttagcgatacaatcgtctttgaagatattgacagtgaactaagtcttaaaagtgtgctccatgctggccttgagaggcacgagtatatcgatacggaacctatgtatgaaggcaaaagagaaataaagccttggtagcttcacccgttagagggggcattcatatctaattgttaacggtgctatccattaaccaatagaagcaatattttcagattacttatttatagattaaaaattaagtgttgacataaacatttaggtatgcagcgaagatgaatgtttttatgtattaatgatgcattagacttattttggtggtacatatgcagttccatttattcaaaaggcatttagcgataatgctaataagtaacggcgacaatagatgagtttaaatgtatcctgatcaacagt

SEQ ID NO: 4908 - DNA, 1501 bp, Oryza sativa
ccctgagggtttctagatcgcgtacgggcgccaagattatacaggttcgggccgttgtggagcgtaataccctactcctgtgtgtgggatttatggttgagtgttacaaaggttcctaaactccggagagtactctcgctcttctcctcctagagttcaggcctactgagcgtcgtcccttttctcggtgggcaaggtcctccttttatagttcaaggggataccacatgcaccgcttctacctactctttcacgggagggggatccactttaccttgaccggaccacgatccgtgtcttcgcccggaagctaagcggcagtccgtccttgagtgggacacagcgccgccccccacctgacacgggggacagccgtgtcattccgtcttaaatggatgaagacttgtggcggtccttctcacgtggagggagctccggatgatacttcgatgggacggggcatacctgcctccactccgctgggtacaggggcgagtgtgggggcacggccgcccgtccgatcggacgtgaccggcgacaggccagtcacagtttggtcacgcctgattgacgtgagtcaaacgggccccaccgcacgtccgcccttaccgcattaaatgcggtgagggacagttggggcggcgcgcattgatggtggttcagtctgagtctcctccccgctcgctcccctcgccacatggcagttgagcgagggcctcagggcgaggcagcgcgagggcccgaggggtgtgacgtggcacccgaggctccctggctgcctctgggtcttccgaggcgcggggggagggccaagctgtagggccacgtggctggatcaggaggtaactcccccgcacttcgcataccccgagccatatcaccgacacgctaagtacacatatataaaagttttactcataaatcttttttatcactaataagccgtaatggtttttaatcagccgtatgcaaccgatgggacctttgtttcaaagaattctgggagtgcttttcttttttttttcttttttttttcagtcaactgattgcttaatatttggggaggagctcaatactgactatagtacttctactgagtatactcgatttgaagtcttaactacaatttttcggaatttcataatccttaaatttgaaattcaagtgctgaattaaactcacagctgactgctgctctaagctgaactatgctaacggttagcctggtgatgatcatgaccggtaagcggggtgttcgtcctcgtcatcgaacgccgtgagagccttggcgatgtcgtccatggtcggcctgctgttcctgtcctccatacacgccagagaaatcctcaccatctccatggcctgacgagggttgaactgcccctgcagcctggcatcaactagagacctcacatcgccactgtccagcacatgcctcagcgcctgcgcgatctgcggcagctgcagccgctcgccggcttccgtcctctggtccgccacc

SEQ ID NO: 4909 - DNA, 820 bp, Oryza sativa
ttatagcggagggaagcgagccgagcacgggagagggcggaacggcgacgggaatggtggccggcggcaaaggaaggcggccggacttggcgcggccgttcccggcgattgggggcaccattcaaggggaaattaagggggaaatagagagaagggaaaggggattaattcccctcaatcaatttgggaatcccatgcttgattcgcgcggatttgagggaggaagggagtagggttcgcacgggagggagagagaggaagggccgggcggctggaggttgggggcgacggcggcctgacgcgtgggccccacgcggtcgggcggcgtcagcgcgcgcgcggcgcgcggtcagcgcacgtgcgcgggagggggggggcggctcagctgggccgggacacggcccaggaggagaggagggggagaaggtgggccgggaaggagaggagggaggggcggcccagaaggaggaggagaggagggagtgggctgcccgggaggggaagagaggcccgggagagagagggagagaaggggagggagagaaagagagggaggagagaaggacttcgggctgggcttggcccaaaggaggaggagaattatttttagattttctttttaataaactttgttaattgtttttgttgcttaataattatttccggtgctctgaaaattcaagtaaaatttgagggctccttttagaccaaggagaatttaacaaaaattctctgggccacatttgaatttttcttgcacgtattttagtgtttgccaatttcttttcgaattttaattaattctattattccttttagc

SEQ ID NO: 4910 - DNA, 1501 bp, Oryza sativa
gagctcctcggggagctgctggagagccccggccatcttcgagaggtgctgagcgaggcctccctggttggtggagtacttcattgtctggcctttccagaggcccacttgccgaccggcgcgatccagacgggagactgcatcccaaagcatgccgggccctatctcgctcgccaagcggagggcctcggcttccccggcggatgagtctagcgcgcgctgcatgtcggcgatggtgagttcggtagctgcgaggcgggtggctaagtcactttcgcccgcagccgccccgccgctgcgtgccctcgagtccagctccttttcccgcgcctcgaggtcagcggcccgctggtccagtgcggccctctcggcgcggacacattctagattgcggcgtgcctgctccgccagcgctgcctcacggagggacaggctgtcatccaaccgttgcgccgcggcctcggcctcttcgagagctcgctcccgctcggtaagcgcgtcctcgcggaggcggagtgcggactcctcttcggcgcaggcagactcgtgcgccgccagcgttgcctcccggatggcgacggcggcctcgcggtccgccaggtccttctccacgacgcaggcgcgctcttccagcgccatggcgcgcgcctcaagggtctcttcgcgctgtcgggacgccgcttcggtctccgccgcccgctgctcttgggcagcggcagtgtcaagcaccctttgggcggcgtcgagctttttccctagtgtcacgtcctgataaattcatcccgaaataaaaatcattcgctaaaaggaataatagaattaattaaaattcgaaaagaaattggcaaacactaaaatacgtgcaagaaaaattcaaatgtggcccagagaatttttgttaaattctccttggtctaaaaggagccctcaaattttacttgaattttcagagcaccggaaataattattaagcaacaaaaacaattaacaaagtttattaaaaagaaaatctaaaaataattctcctcctcctttgggccaagcccagcccgaagtccttctctcctccctctctttctctccctccccttctctccctctctctcccgggcctctcttcccctcccgggcagcccactccctcctctcctcctccttctgggccgcccctccctcctctccttcccggcccaccttctccccctcctctcctcctgggccgtgtcccggcccagctgagccgccccccccctcccgcgcacgtgcgctgaccgcgcgccgcgcgcgcgctgacgccgcccgaccgcgtggggcccacgcgtcaggccgccgtcgcccccaacctccagccgcccggccccttcctctctctccctcccgtgcgaaccctactcccttcctccctcaaatccgcgcgaatcaagcatgggattcccaaattgattgaggggaattaatcccctttcccttctctctatttcccccttaatttccccttgaa

SEQ ID NO: 4911 - DNA, 939 bp, Oryza sativa
aaaaattcatccgttgttcttaaaaaaaatccaccgcctccacctcgccaccgccgctacagagccgtgccgcagcctccatcgtggcccgtgcgccagatctgagagagagagtgtgtggtggtggcagagagagacctgggaggtgcgccgcctcgatccgtgtgctcctccgctccggatctggtcccgtcgccggatccgccgcgagccgcctcgggcaccgccgccgtgagctgcacgagcgccgccgcatcgcgacgcacgggcgccgcctcgatccgcgtgctgctgctgctgggctcgtcgccgctgctagtggggagtgaagggggaggagagggagaggtgggtggagagaagaggagagggagaggtgggtggagaggactgttgcgcccgttccgtcttggcgcctagcgggaaaattatctcttaaaaaccctaattgcgaaatttgtttctttgcttgttgtctagtgtccgtgccatctcaagatctcaatccccgatctatcgtcgagttcaattccgaatccaatccctccaaatcaaattcctccgcaaaagtccattttgcctcccccagggtcgatgggccgattttccctcggcccatcttcccctctctctcccggctctctctctcgctttccccggcgcgcccccgctctctccctctctccctccgctccgccccgcgccgcgcgcgcgagcgcgtgtcgccgcgccgagcgcccctccctcgcgcgccgcgcgcgagcgcgagagccgcgccctgcgcccctccgctcggccccgcgagccagcacgcgtaagccgcccgcgccgagccaagtcctccctcaccgctccctcgctgccgcttcccgcgcgccgtgttcgcgtgcgcgcgcccgcgcggacgccgcccgttgcaagccgcgcgcgcgtgccgaa

SEQ ID NO: 4912 - DNA, 1501 bp, Oryza sativa
cgcgccgcgcgcgcgagcgcgtgtcgccgcgccgagcgcccctccctcgcgcgccgcgcgcgagcgcgagagccgcgccctgcgcccctccgctcggccccgcgagccagcacgcgtaagccgcccgcgccgagccaagtcctccctcaccgctccctcgctgccgcttcccgcgcgccgtgttcgcgtgcgcgcgcccgcgcggacgccgcccgttgcaagccgcgcgcgcgtgccgaatggtcgaccgcccggtcgccgccgccgtcagcctctgcacgcgcctgtcgccaatgtcgccgctccgctccaagccgccccccgtcatcgtcgtcgtcatcgcccggcccccgccactccgcgcgcaagccgccaagggacggagccgcgcccctcctccctctgccgcgacgctcccgctccccttcccctttttcccgaatcggcaaaggggcaagcccctttctccccctcctttttccctttttcctcctcgccggcgtcatcctcctgccgccgctttggctgcaagcgccgagcgccagctcgcgccttgaccgttcaatgtcggtttccctcgcccaaaccgacattgccgcccatttaagcccaagccctccccctccaaactctctcattttcgcctccgcgccattgccgccctctgtttcgccgtcgccgatcgtcgttgcgcgtgtcggaggagccggcacgagcaaggacgcggaagaggactccggccgcgccctctccttcctcttccccggcccgaggccggagagattactcccgcgccgtcggcctctcgtcacagcgccccgtcccgcacggtagtgcctccctccgttcttcctcctcgctccatctcctccccttagatttcggtagtagctcgagtagcctccccgtagttagccggcgccgccccgactgttgccgtcgctcgccgtgtgctcgccgccgtcgccgcccgagctccgtagcacccgctcgtcgccggcctcgctcggcgtagttccgcccaatccgacgctagcgtcgagttcccgacgccgcgtagatgctctcaccgccgggaatcgacctctcgtgacctcgtcgccgtttccctcttctcccgccgccggttgccgccgccgcaatccgccgccgtcgagcaacctccgacgaatccgagccgttggctcgtctccccttgtcacgtgcagccgcccggtgtgctcgcttttgcctgtatcaccgtggttcgctccgctgctcgccgccgccacccgccgtccattcgcggccgggtcgtcgtctacctcccgccggcccgcgtggcagccacgtaggcgccacgtcggcgccagctcagcctagaccgggtcgagcccaccccggtcggtccctccccgtgcgcgcgttccaccgcgagccgtgaggctgcgcgtgggcccgccgcatccgcgtccaccgcgagccgcgcgcgtgcaccgcgtcccaaccccgcccgcgcgcg

SEQ ID NO: 4913 - DNA, 1501 bp, Oryza sativa
ctcaaatgcaacaacacacgatcggacatacacgaaattaatgaaaaacgcaaggacgatcgacatgtatataccctagtgtggatgttacaaatactaagcggctacgcatgattgacatatatgaagcaaggtcatcaaattggaaacgaccagtaaaactttatatcaaaatagggaattttaaactgagaatcaaccaagcaagaaaatgttttgtcaggagtacttccgtgacggacagcacctatagtttccacgtcccgtccagatctgatcatctttgcaattgctatagctgatggcacaatgtaattaagcatgcaagctagctgatcgagacaaatgcacttatgtagatcatgaactgatgaaactaaaactgattcgatatatgtcgatgagtcgtaggaaaagcatgcatgtaagtatattatacgtgcctggaagcctctcgggatgggtgtagcagatgccgttctcgccctcgatggtggggatgaactcgtcgatgagggggtggagcttccgcgcgtcaggcctcgccttcccttccaggtgctccagcagctcctggtccgtcgggtcgaacttcaccccggccggcagccccggcaggtcctggatcgtcgccgccgccgctgcctgcaactgactctacaccatgctcaatgccatccaacatgtacacaggagaccgatcgatcgatcgagcagggaggaagctctagctagctacctgctcatactgcgcgcggtggccgcaggaggggcaggtcttgatgaggttgacgtgctgggagacctgctgctgctgctgctgcttcttggccgcggccacggcggcggcggtggccaggttgttctccacggcgcgcacgtcgttgaagctgttgcaccatgtcatggctgtataatccaacaagacgagagatcgtgcagagagagcgagccagaaagcctctctctctctctctccctgtccctccctccggcctacgctttgctcgtcgcccccatatgcggcaaacgttaaggcgagaccccgcgcgcgggaggagggagagagaaaggaggagaggagggaacaaagcggcctgatcgacgagagggagaacaaagagaaaagagaggggagctataggaagcttgtccctgttaaaagctactcctactagctgctaatcgcctaatcctccctgcctgccttcccggcccagctgctgcgcgcggctactgattttctatctccatctggtacagaccaaggaggagaatgaaggtggattctaaacactaatcagagtttgatttgttatttttgttacaacttatagaagttgaatttgaacttgcatatttgtggggtgatatattacatatgaatctatcttgtcaaatttttttgaatttttttcatacacatttagttgacatacaacaaatgggtgtatctacctaggtgattaaaagtgtttccggaggagaatacatcaattct

SEQ ID NO: 4914 - DNA, 1501 bp, Oryza sativa
tggcatcctagttagcaaaaaaaaataaaaaaaattatagggccacatgtaagtgagaagaaaaaaatgtgggacccacacttctttttggttttcttttctcttttctttctcctcttctcttctcttctccggaagccgccggcggtagagggagcctgggagagagggggcaggggtgggcgaagtggccactggcgagcgcggcagtgggcggctggagaggggggaagaggtggccggtgagcctgcgagggaggagaggggggcggcggtgggtggagcagcagcgggagagaagagagagggggtcgcgccggccgagcttcacttgcgagctcgtcggcggcaatggcgtccctccgcgcgctcccccttctcgtcctgggcatggcgttgtgcgcactcgcgttgttccccttcgtcgcctctgcgtcccgtgacctccgccaccatcccgcgggcttcgtcatcggcgggagagggtagagagggggtcgagccacccgagcttcactcatcggcgacaatggcgtccctctagccaactgttgttggtgttgctgatgctaatgcggcttcctccgccgcctccccgcctgcaccaccatctcgggcagctccacgccgtggtcccgcacccacagcgacgtcgtccgcagcgccctcgctgcgcactgccccagctcctctcccttcccttccccgtctttcccgccgtcaaagcagcacaagaggcacccaaggcggcgacgtcgcctccctccgagcggcagcggcgaccttgtctccctccgttcttgcccgtcgccaccctgcccgccggcctctcaggctcgggggaagaagagaagaggagaagagagaacaaagaaaagagaagaagaaaaaaaaagaaaaagaaaagaggagaaaagggcgctgatatgtgggttccaccatatgccacgtcagctaaacgggggaaaattagatcagtactgtttagggacttttttttgcacggttttgtatagtttaggaatggagatttctgattttgtggttaagggatctcaaaaatctcgctgttaagttgataaaccttcggtgaacttattccttctcgacctggtaaaagaaataaaagcccgtaactttcggccacctaaagtaccggagaatatattcaatacccttcctgttcgggagaaaaaattggtagaaataacttatcggagcaatttgggacttcgaagtagacaaatagatagataaaaaaactatgatgaataatcaaaaataacatcaaactcaccaacagatgttcatgtaatgttccacatgttttcacgtaaatcttcattgtagttcgtaaagcaatgtctcggtgcttcttcgtttgtacttatatttcaccggtaattaggaatgcagtttttataggcgatatataccgagaacaaaatggatatccttaaaaaaacaaatggaactgatagatctcgatataaaaagtcac

SEQ ID NO: 4915 - DNA, 1501 bp, Oryza sativa
ggcttggggcaccagcagttggcttgtcgaaaggatctccgccctggtctggagtgccctcgccgccgcagctgccttcgccatgtcagctgcgttcggcacctgcacagaggtagcaagggctgaaggcggtagtgatggcgcaggtgcggaagcagatggcgctcctccatcttcagcgacaggcgccgaaggctctgctccctcttcggtggccatatccgccccggcgtcgctttcctttcgccttgtaaccttttcctttacgaccttcttcggtggcattcactctcagtggtttcgctcggaggtccccacggtcggcaccagctgttgtcgaaacgacaactgcatacgtcgaaagacgtggttactcaacagtggttgagaaaaaaagtaaagtgtattgattagagaatttttcttggatccccctattacatggccctatggggctatttatagcccccattacaggtcttactactagggctttggttatgcaggggaatttacatggttgcccttatgaaagggatatttacatgggtacatagcgtaattgaggttcatgggcccttagcgggccgactggttatagtcgacccaattaacccctgggcttgatgggccaggatagcttcttcggccttcccggggccgaacctgctacggcgaagtcgtcccccttcggcgtacgctcttcgccttgcgcccttcggccaggaggcctccagctcggctgcgattccctgcctctcgtcgtccttgctccatagtcttcgacatggggagggttcgccttgactaaccttgatgtctcgggcttgaatcctcatcgggtgcatgctttcagcatgtttggtcgaagggcctcatgccatatcgccaacaattaccaaaattaacaccggaggcctagatgcttcagcggacgagcaccgagctcatggtgtagagcgccagccccagcccgcaacctgcgccgggggaggcaaacgtgggcgactactgtggcggcggtgcgaagtgcgccgccatggcgtggacgtggcggccggaggacctgttcctagagacgctgaaggacagcctggcgcggcagcgagcttggcggcatcggggaattgcctggagatggcctggcatgcgcggccaaagtgggcgtggtgtagcgacggggcgaggaggcacgacatggcggtgagcacggtgcggtgcgagccccggagcgaagcgagcattagggagacggctttaagtatgtcgagtgtcttaacggtgtggtcgaggaggtcaccagtgaggcaggcggcctgcagagcgcgcggcgacggggccgatgccgaggatgtcgcggaaggcgtcggatgaggagagcaccacgtcgagcagcttggagaggaaggcgagggagaggagcggtggctgatgggagaccgctgttgacagaaaacacgtggcctgggagatctacttaactccagtgtaggtccaaagc

SEQ ID NO: 4916 - DNA, 1501 bp, Oryza sativa
cagcccatcgttttacaatttaatatgttgatgaagtacaatactctctcaatcctaatataaatataactttgtattgatgtgactgtatgctcagatttataactatagaatataccatatttgtacaaggtaaggtttcacttgtattgagacggagggagttggagggagtagagttcaactactttagtaggtaaaactataagaataatatgtaggcctagaatgagataagttcatggggaaggattgggatcctttgcattagagtacaaaaatttgcaccatccattcacaatcaattcactaaacgaagcattttcgagacttccgcgaaagtcttcttttagcttgagttcatcggcctgttggcgtcccattttttttccgcttattactatcttctgaattaggtagagtgggagcactcgacgaggcatctacgacagtagaggctcttcctcgtttttggccggacaattctataaatagaatcaaaaaccagaagaattgtgagaaataaatcaatttattaagttgagacacatcgagggataaaacatttcatactatcataagttgattccatttacaattgaatttttttttctttttatgtgagtaaattttattttgggccatgtatttttacccatgttgcagcttgggctaggttttagctgagtttttcaccttggatcacttaatataaccatttgtttcatcctggaccatagccgctcatcttctccgagtccaacaggcgataacccatcaccaacgtgcccatccgaacaagcgttggcggcagcggcggttactgatgcgcttatttgatttgatcacaacacattagcttggttgctccatgctccacaatcccagccggccagccaagttacacctacaaccaaatgggcaatggaacatggcttccgttcactgaagcaacaaaaattgatgcaacatcattaaaattagaacaactcaaaccatgcatttgtgttgcctctgtccctaatgtaagcatcaacaaattactagttgctatttgaatcgattcccttgcctcgcctcgctgttgtcgccgatccgccatgagctcgccggcctcgccctcgtcgacggctggcgtagtgcatctcgacaacacggcagctgagagggacgtgatctagcaagccaaaatggccctcatggcctagagctaacctgccgtcggctgaacggagaagtgcgccgcagtgcgaatcagctgtgcgttgctgctaaactcccctcggataggactaggagctattggcattaatcaagcacttatccccttgtgctcaccacatcctcctcccatcgatggcccaaaatgctattcatgatgatagtgatagcaactcaagcagtactaacgcactgcccctggtccaaactgctatattttgataaagttagatggtgttaagtgaaaagattggtaaatccctggtgcattgtacaacta

SEQ ID NO: 4917 - DNA, 1501 bp, Oryza sativa
cgtgacttgtttttttaattttttttcatattttttttcaaataagacggacggtcaaacgtttgatacggaaacctaagtttgtctttttttttttgacagagggagtattgaacagttctcatttccatacttgttatcgtgcaaaagaacttttcgcacttctaatcactagtttagtattcagaagtttggaataaattgaatttaagcttattaataaatatgaaaattagaattcttagacgtatgtactttgcttctaagttacacacaaaatatatcttaatgttttttattatattatattttgtggatttgatttttttggaattactcaatacaagattgtcatgtggagtcttaataactattattgttttattggctgtttttaaaatactccctctatttcaaaatacaagcatgtctaatttgtttaatagaaattaaggtttaatacaaaatactttgatgcccctcatgaatggttggggtgagagggtatttaaaggtaagctgggaagaaatttaaatgatagatgattgatggaataaatagtaatccgaacagtattagaattgtttatatttgataaatttaaaatgtgataagtgtttatatttttgaacagatgatgttagaaccaatatatacataaaaaaagtttctaggatatgattttaacaaatgattcattttaagaagtttgttttttcttggatgaaggggtagttaccatttactagagtttggattttctttttcatgttcaatatttacattactgatagtgtgagatggaatcttcatttatttttatgttgtgttcgaatgtgtcggttcggaacatatttctccaacatgaaaaatgagataggttgttagcacatgattaattgtattaaaacaacttaaatataatttttcaaaacaaatttcctaaaagatgtataaaaacacatcgtttagctggaaagtgtacagccaaaaacttgagagcagaagttgagaaaggagacatttgaacgcagccttggtctccttggacaaatggccagatttactcaattttattcgattaacgtggacgttttaggaaatataagcatggatattatgcatataatgattggaatcagtccgctggctggcaggctgatggtggaacagtgactggattcatctacagaaagaaaattcaagatttaacaatcaccaattttattctaaataacattcattttatgagacggagaagaaatatcccgcagatgcacacctgggcaccaccggaatctccgtcccccgctccggggcgcttcactcccgtgccgcactggcccagccgcctgagacgacgtgaaccgtcgcccgagttccacacgcccaccccatccacaataatatatccaatccacccatccatcctgggagaaaattggagttgggacgcgagattctcaggcgagcacacgatctcgcggcgcgctcacgtcc

SEQ ID NO: 4918 - DNA, 1501 bp, Oryza sativa
cgaagaatttcctacagcctagccatgtttttgcttcactgcctcatactccagccttgggaccgatgttgtttaaaccgtgctaggcatcactcactggtcctcaacttcgtcgccccctgaagcctacatgcctgagcctaaagactctcaggctgagcttcgacgggaaccccttggacttcagctttggcaccatcttcggcgtcaccttcggtagttcctgcgatgctctgtggaaccgttttcctcctagtcaaccttctcttgggtggcattgacttttgctcggttcccgacgacggcgctagctgttgtccaaagacgaacacttgtcctaatggaaagtacgaaaacaatgaggtatgtatcattttttttggaattcgtcttacagttaaaagcttcttcaatagtagtggatgaaattcatctgcacactaataattcaccaaaaacaatagtttctgtttccctatcttacttgccgccactagatttcgtatccattccgtgatctggatctttaattgttggaaacttctcaagctcttctgccaagccttgattaatgaactacaaaatccctcgaattcattctctcgtttccattttagagcatcttaatcttaagtttcctatttatcaaagaaaaattcctcttacgggctatttatagatttacaagcctaacaacaaaccctggggtttggcttagataggcttttacattcctgtcccattgatatggatgtttatagggatattcttgtctttagcccaccttctcaacctactgagcggatacgggtcaactattgggctggccctttctcaggggtctttttaggtagcttttattgtcctctccacaggtgtccactattaggttgtcggccttggactccgcgggttttcccaactccatagtgtttcactatgctttgtcgtgctccaccgttcttcgttaccatctgcttcggcgtgtcggctgaagggcctcatggcctacctccaacacaccatgtacttaattctaagcaaattttaaaaatcttgactattatacttcaatcctattatgtgtatgaaataggatgagcttataaatatctgttgaactggacccatattaagcaccttattagattaacatctttggtgtgaacacgttatcatctagcgagtaatgcctattggctgttgctagctcatccttgcaatgaagtttccaaagacagacacgattaaaggtcgacaagtatgctagccagctgcatattaaccaggcatttttatcaggaaaacattaactcgcattgattcatttgatattcttggatctgtaaataatttctttccacaacttgctgattgttgcgatctgatcttccactataaaagcaccatattcctctttctttgatctcatatcaatctaaccatttctcatcaatctacaggtgcattcttgcaagaaagtggtgaatcgtgaaggcca

SEQ ID NO: 4919 - DNA, 1501 bp, Oryza sativa
agatacacaaatgagatttcgttaactaacccaaaatttcatttgtataagtgccaggcgctaaccattcctctcgtaccacaagagggggcttgaaggagcaatgtttctggcaggacaactcgaaacatgtctaggaatgccgtcgcgaagtagcagcaacaacagttgcaatacccgctcttagattggagccagcctgggtatacacttggctggaaccaaccgctgccaacatatggagtagggagctcggcgtgggcaagtgcgagtagtggtcagtgggaacatcccatcaacagactctagggaaatattcccaatgaagaccagtccaccagctccagtggaatgcccccacagtccaatgcacgtgactttttcatgtcccaaaattttcgtgacttcgggttgaggtgcagatgtcactcggcaactgggagagttgaatctccggaccagcgagatgcacaacatgctaaaccagcatgtccaggagacccacacatgacagtagcacatcaacgaccaattagcgaacatcaacaccaccatgcagcaaggttgggcttccaccatatagctacacactttgcacacttgatcaagattgtatgatttgctttctcctagcttggatcctctctttgattttgcaatatatgtgatacgtattaccaacatcttttgtctctactttgagctccacatagaaacctttagaagtaggatgataaagaggcaacaccatgccttggtgaggagtatcatacacattgaatgatcgagagtatcatttgaggaactttggctttaattgcaaaagttcttgaaaacctccagaaagaaaagttgaacaaaagagtaagtgattgatgctctacgattcgctctatctctcaaccacccaagatgaggagaagctacaagtcccataggtaataaaggtaaaagtattattgccaacttattcaaattctaggtagaaggatacgttgtatgcattgtactaatgagaaataaaacatgatagcaacacatgatcaacaacctaagttttatctttactcaggaggagcaaagttcagcttgaggctattgttgatgaccgttaagtaccaattttgaccaccaattatcataataaataaagggagaactagcacttcttacacgtagttcaataataaataatgtagttccactatacttggagaattaacatagatgcagagaataaacatgcaaagaaacacacctgtggtgaatcacgtgcaagcacacggattaatgggcccagaagtcagctcaaactgacttaattggaggctaatccaccatgcaccgtgcaagcctatgggagatggtcagtagcaagaggcggtgccactagttcggctgaatcaggccaagcccacctcgccatctccttacacgtttcaactctccattggctcctaatgatgatatgggtgtttaaccaacattgcaaccatcatta

SEQ ID NO: 4920 - DNA, 1501 bp, Oryza sativa
tactatatagattacatgaaaaatccaattattatcgggtgcattttcgaatcaatcgaagttccgccttcactgaaactttttgatttgtttttggctataactttagtcaggtgactaataatctggacaagtccccaagctagaaagagctactcctttcgtttccgttttatattgtatgacgttttgactttattttaagtcaaacttttataaatttaactaaatttaaagaaaatatagcaactcctatggaaccaaattagttccactaaatttaacgtttaatatattttgatattatgcatgtttgatgttattgctatgtttctataaatttaactaaactttaaactttaagttagaaaaatatcgcgtaagtcttgtaatgaaatggtgggagtaaatttttttaaataggacagacggtcaaacgttggacaccgaaacatacaactgcacttagaacaagtttaataatatagccaactactaactccaaatcatctctaatcaatttaaaaattagttaattcatacaatagttacctataaacatatactacactgttaatacctggtcctacctatcatacacacattggatcttgtagtctgtgctacatctagctacaaatctgtagcccactgctcttctctatactcttttatcttatcgaaatatatttatagttggttagtctattattatacctgttgttacattgagatagagatagggcctgtttagttccaaaaacttttccaaaaacatcacatcgaatctttagacatatgtatggagcattaaatatagataaaacgaaaaactaattgcacagtttacatgtaaatcgcgagacaaatcttttgagcctaattagtcaataattagccataagtgctagagtaacccacatgtgctaatgacggattaattaggctcaaaagattcgtctcgtggtttccagacaagttatgaaattagttttttcattcgtgtctgaaaactattttcgacatccggtcaaacgtccaatgtgacacccaaaaattttcatttcatcaactaaacaggtccatagtactccctccatctcataatacaaggcgtgcacgtattcaagattcaacttttaaaacatttgaccaacatttaatgtaatatgaaatgaattttatttgttaaaaattatatcattagattgacatttaaatttacttttatatgattataattttgttgctacaaaccttatagcatatgaaaaattataagttaaagattagttttggagaccgtgtaacttttaccatatcttatattatactctctctccatctaatctattttttatagtcatatttcatcttggcgtacagaccaaggataagtgattctacttatcatccatttaaacatgctactagtcattcctcgtaaacaagcgattcattaatatttacatttctcgatgaccatgtagccaatcttgtg

SEQ ID NO: 4921 - DNA, 1248 bp, Oryza sativa
ttcgagagcttcaatgaggagtagcttggtctcactttcatcggcatcacgcctcaccttgtctaactgctcttggaacttgttgatgcgctcctggatgaagccctccaggtcggtcatcttcttatatttgtccagctgtggcaaggtcttgaagcgctcgagaactctcatcacctccgactccgacggccaaaccaccgttgcttgcgcctcaccctcaccatacaccatgaggcatgtgtccacattgcatagtgttgccagctcgcttgccttcttcatcaagcccttgagccgcttcttgaatgttgcccgccgcttcgcatcattgatgatccgctgcagcttcaccttgttgcgagccatggccttcacgattcaccactttcttgcaagaatgcacctgtagattgatgagaaatggttagattgatatgagatcaaagaaagaggaatatggtgcttttatagtggaagatcagatcgcaacaatcagcaagttgtggaaagaaattatttacagatccaagaatatcaaatgaatcaatgcgagttaatgttttcctgataaaaatgcctggttaatatgcagctggctagcatacttgtcgacctttaatcgtgtctgtctttggaaacttcattgcaaggatgagctagcaacagccaataggcattactcgctagatgataacgtgttcacaccaaagatgttaatctaataaggtgcttaatatgggtccagttcaacagatatttataagctcatcctatttcatacacataataggattgaagtataatagtcaagatttttaaaatttgcttagaattaagtacatggtgtgttggaggtaggccatgaggcccttcagccgacacgccgaagcagatggtaacgaagaacggtggagcacgacaaagcatagtgaaacactatggagttgggaaaacccgcggagtccaaggccgacaacctaatagtggacacctgtggagaggacaataaaagctacctaaaaagacccctgagaaagggccagcccaatagttgacccgtatccgctcagtaggttgagaaggtgggctaaagacaagaatatccctataaacatccatatcaatgggacaggaatgtaaaagcctatctaagccaaaccccagggtttgttgttaggcttgtaaatctataaatagcccgtaagaggaatttttctttgataaataggaaacttaagattaaga

SEQ ID NO: 4922 - DNA, 1501 bp, Oryza sativa
aattgaatttaagcttattaatagatatgaaaattagaattcttagacgtatgtactttgcttctaagttacacacaaaatatatcttaatgttttttattatattatatattgtggatttgatttttttggaattactcaatacaagattgtcatgtggagtcttaataactattattgttttattggctgtttttaaaatactccctctatttcaaaatacaagcatgtctaatttgtttaatagaaattaaggtttaatacaaaatactttgatgcccctcatgaatggttggggtgagagggtatttaaaggtaagctggaaagaaatttaaatgatagatgattgatggaataaatagtaatccgaacagtattagaattgtttatatttgataaatttaaaatgtgataagtgtttatatttttgaacagatgatgttagaaccaatatatacataaaaaaagtttctaggatatgattttaacaaatgattcattttaagaagtttgttttttcttggatgaaggggtagttaccatttactagagtttggattttctttttcatgttcaatatttacattactgatagtgtgagatggaatcttcatttatttttatgttgtgttcgaatgtgtcggttcggaacctatttctccaacatgaaaaatgagataggttgttagcacatgattaattgtattaaaacaacttaaatataatttttcaaaacaactttcctaaaagatgtataaaaacacatcgtttagctggaaagtgtacagccaaaaacttgagagcagaagttgagaaaggagacatttgaacgcagccttggtctccttggacaaatggccagatttactcaattttattcgattaacgtggacgttttaggaaatataagcatggatattatgcatataatgattggaatcagtccgctggctggcaggctgatgtgcttatctgcgctataagaggaggatggagcacaggtggaacagtgactggattcatctacagaaagaaaattcaagatttaacaatcaccaattttattctaaataacattcattttatgagacggagaagaaataatcccgcagatgcacacctgggcaccaccggaatctccgtcccccgctccgcggcgcttcagaagtctcgtccccactcccgtgccgcactggcccagccgcctgagacgacgtgaacatgtggcgctgagccgtcgcccgagttccacacgcccaccccatccacaataatatatccaatccacccatccatccgatcaaaatactgggagaaaattggagttgggacgcgagattctcaggcgagcacacgatctcgcggcgcgctcacgtccacgccctcgcatccacaagcgccgcggttaaaaaaccacgaggcaccgtgtgtgtttgtgttgctgtggtggttgccttggctgctttggagagttgggaggagcagcgagagagtgggggt

SEQ ID NO: 4923 - DNA, 1501 bp, Oryza sativa
atcttgtaagtgaagatttaattcctgagtaatatatccctttcccccaaaaaaaattcacctcccttatttttcgtttacatgttttttaatatgtaaaatagtgtattttttgcaaaactttatatatataagttgtttttttaaaaggtaaatgagtccactttataagtttataatagttaatgttcaattaatcatgtattaatgttttttcgcatgcgctaaaaatcatgaacacagccttagcttttaagtactactagaataaatagaattggggataagaaaagtcgtactagttcgtcgtataacggaatccaaacaagataagaacgacataaaacaaagcaattatcatccacggcataatagcttgaagatgtactttcgtgtttagtttgtatggtatatgattttctgaagtgttgatggaatttataggtaaattataaattagtaaagatggcttgattactattttgcttatgacagatatgactctataaaagttaatcgcacggctataataaaataagaaaagtaaaaattagatctaatagactctttgtaaccctcaataaaaaaggctaaggcagccatggctatggtattggtgtggaatcatgttgatcaatgaaaggtgacgaaaacctattgaaaaattttgttagcaacaagagatctaagaatggtgcaggagtttaactggatcaaaccgattacttaatataactttttatgttaaaacggattcatggtgtgataataaaatgcctcaaaagttctattcatatgaacattgaataatgtttcacaatttatttaaaaaattcaaacaaataaaaggtacccttcccaaaaggtttaggcccctttgattcaaaggaaatttataggaattttagaggatttcattcttataggaattttttctacaaagccctttgaatcaaaggaatgaaccatatggaatcctatgaaattcctatggaatgcctcttcacataaaagttttggaggaattttaacaagaggtagaacctcatggaagaaatcctttgagtctttatctctcctcaaattcctgtgtttttcctgtggtccaatcaaacggtcattattatgtcttttctgtgttttgcaatcctctgttttacactttcattcatatcagaatcctatgtttttcctattcctcagttttttcattcttatgattcaaaggggcccttaacagtggcatatctacatgttgagaataaaaggcaatagctattaatccgatcagatatgcaatacacattttttatcagtacatacgttagctcattcctttatttgttttgtttatagccataaaaacaaacttcgtgcatgaaacagtcttaaactctctagaattttattaagaaaaacctccatttcgggcccctttaaattttaggaatgaaaaaacggaggaatagaaaaaacataggattctgataagaatataagt

SEQ ID NO: 4924 - DNA, 1501 bp, Oryza sativa
ccaactcaatgcgagaaaaaaaaccgccgtttataaaaagaaccgctccgagaaaccgtccgactcaaagcgagataaaattgatggacgcttgggtcggataagatccatcgatatttttccatctcctacacatcatttgtttcctcatctaatccctgcactttttgtatgcaattatcattatcagactttttttaataacatattatatgaaaatagtattaaaaataaacatatttttaattgttatttagagaagagtgcacggtgactattttgtgtagacttgatcctgagtgtaggatttgattaacctattattggttgcaagaataatattgaaagaatatttttttattatatgtatattgttatatgaataatccaattattttagttaaagcaagcattggtaaaaagattgccatcatcgagtttgggtcattacataaagatgctctaattttctaattgtgttagctacaacgatccatagaaacattatcattgatatgggtacgcttgaaaaatgtctattgtcattggattattttttttacccgttgcaacgcacgggcatttttgctagtatttataaaaggaaactttgttgtatgataattcggaaaataaaaaagtagttaaaaatatattttggtgcattaattattaaatcatctttagtatgcggtctgaagtctgaaagcgcgatttgtttgccgtaaaagaataggaaactaacgaaaaggacgcaaaaatcacccaattccacttttcaattttgcggacttggcgttttccttcttcgtctttccttgtcctgtagcgccgcctctatcatgccctagcctacctccaccaccaccatcaccaccgtctcgctcgcggtctcgtcccctatatatacctcgccgccggatccgcctcgcctcgtcccgcgctctctcctcccctcctcgacgaacagcaagcgcgcgcgctctcatctcggtacgcgtgcgaaattcgcgaatgagattctgaaattccctcccgattctcgcattccttttgctgctgttgccgccggcgtcgccgtgccgcgggttcatatgcattgccgtttttcttggggggattttacgacggcggccgcggcgcggcaacgtgtagccctagcgcggctagcgcgggcgcaggacggcggcgagttgagcggaggggacgcggctgcacgcgcggcgcggggcggcacgcgtcgctcgcgtgcggtgatcccgcgcgcgcgcggcggcgccggctggcgtgaacgcaagcttacgcatgatcgccatcaaataaaagtcgctttttcctttttgtcatgcatctcatgaggcgtggaattattccctgtctgttgctaatgtgtgcaatcacctctgcatattcagagatcgtagctgaagattacacattgggaaactggtgtactgcctgcctctgcgatcgatcgatcgatcgatcgccatggctgacg

SEQ ID NO: 4925 - DNA, 1501 bp, Oryza sativa
ggagacgcggcgcaggaactcgccggaggtgccagggatgccgccgtccatccccatcgccctctccacctcctcctcctcctcaccaccaccatcacccccctcccgcgatggcgggggcgggggccgggacgaggccgcggcgaccaccgccctgcggtgcgagacggcgaggcggggcagcggcgggggcagggagaggagggacgaggtcaggttccccgccagcgcggtcgtcgccgccggcaccggcgcctgatgcggcggcggtgagagggatggcaagcaagctgccatttctacgttcttccctggaagcgtggagcagtggagatgagaaaatcgagagagagagagagaggaaaaaaaaagttgggagtaaaatcgggagaagagaagagtggaacgtggacacggcaactcgtggcagatctttctaccgcggtgggtaataggagtagctgagttcggcacgcttcgcagtcaggttcggtcggtcggcctcgcgccgtgtcacgttttggaccagctttttttgttggaggagaaatgggctagttagaatttggcccaacttatcagggggcacggcccatcataaaatgtacaacttcggccccacaatggaatctgggctgatacggactgaacgaaccgggccgtcctacttccccctagcccagcggaataagttcacttgaactacttccatatcaataccgaaaatcttaaccccaattatttcgatagttaggaactaggaagtcaagatatcaactactctctttttcatattataagtcattttgaatatttttcctaatcaaacttatgttaaatttactcaaatttatagaaaatttagcaatatttttgacacaaaacaaacatattataaaaaagattaaatattaaatgttagtttgaacgaaactaattttgtgttgtagatattactaaattttttcataaacttaatcatacttgaagaagttgaacttaagaaaattcaaagcgatttataatataaaacaaataaaatattaaaataattaagattaagatatctaatattacgatttacgatcgagtgatacgaatcacttttctagcctggtgccgtgatgtgctgacgatgctccatgacgacaaacatgcttcaacatgctccatttctttactactaccataccatctccctgcgtgcgttggcaaccaaaggagataccaaaccaaaaccatcacaccatcggacaccggccgacccaaaatcggaccacacgtgctgcctcctccgcgacacgcaacgtcaaaggggtcgagccgaaacgcctagaaccctcttcatcatccaaattccaagttgcccaacccaaaaaagcttctactcgcgctgcgtacgtgccagcccgcggcggacgacgtgccacccgagacggacacccgtcgcgcggccacccgcctcgccatcgccaacctctccacgcgtcctcacccatct

SEQ ID NO: 4926 - DNA, 1501 bp, Oryza sativa
gggctttccgctccttcatccgccacatcgacgcctcagccgccacgagcccgcgactaatgcggtggagattgggaggagatgcggcgctttggagatgggggaggggaggaggatgcgcgacggcggcgggaggggggagtggaggaagccgcggcggcggggaagatgagggcggcgccggagggagggacggtgggagcacgcggcgtcgcggcctgcggcccagtaaaacttctcaggtgatcagtgtggcccagacaatagcccagcccaatcagaaacgggaaactattttgatctcccgagggatgtctcctctatttgcacgtgactcaaatggttatgaaaaaaattaaaaagatgtattaatatgtgatatatcactccacaaagatgtaagtttatatttaatttctacattttgcaacaaaaaataaattaaactacagctagttagcgtatattcacactcaaatttgtttttttttgcgagatgtagatgatgaatttgaacttacatatttgtgagtgataaatcacatgttaatatattttcttaaaattttacagagatatttaagagacatgtaaataacaaagtaacgtccctcaagggattaagatctgctcccatcggaaaccttccttttcgccattttatcaatcacccagccggcgcgcccagcacgcggctgcgccaccacgatgctccctctgcgtcgtcgtcgccgccgccgccgccgccaaggcgaacggcgggtggtgccgtggtggggtgtgtatagccataggagatgatcaacagcagtatgatattttttttcggcatatttggtaaaagaatcgagctctgaacaacagaaaatcttcagaaacggataatggagtaactcaaacagattgctgaaaatacaaatttccaaccactgcagttgacaccatttttagcttaatgcaattccttaattccttccaaaaaaaagcacaaaaaaaaacatctgtaacaatggccaaggtcacatggcagattttgaccttttgcaagtaaattcagagttgtgccgtgcagttatatgatttgtaaactgtagtgccattttcttttcctttggtcattgtagcgaaatttcctcacttgtttgctttcttcttatctaaacggacgctggtaatgctgctcttctaatctctactgggttacgttacgtgtgatctcgccgttgtgaagtctaggcctatcgctttcatctattgtctccgatattgtttggtactgctattcctgtagcaataaccgtggtactgcaagtcctgtggcaatagtggagtgcacaaattttctttgggatcttccattgaaatatggcagttcacctactattactgtcaagacttaggccatcacatggggatgtctgaagtctgatatgatcgcttgaactaagctcgttttttttaaggttatggaaatttttattgaatccaatcaattacttaa

SEQ ID NO: 4927 - DNA, 1501 bp, Oryza sativa
gggccacactgatcacctgagaagttttactgggccgcaggccgcgacgccgcgtgctcccaccgtccctccctccggcgccgccctcatcttccccgccgccgcggcttcctccactcccccctcccgccgccgtcgcgcatcctcctcccctcccccatctccaaagcgccgcatctcctcccaatctccaccgcattagtcgcgggctcgtggcggctgaggcgtcgatgtggcggatgaaggagcggaaagccccgtgagtcggggtctcgccggcggaataccccgtgagttgcctgcgtgggatgattaatccgataatttagatgggcatcccctgctactgctctctcgattaagcaacttagtttttctcttcctcaaaattttcaattatcttagattgattgattggtacaaacgtcagactgcataatcgtgtccatttttatccaggatactgtgatttccaaccagtttagaacttccctgaagtacctaattttactcttaagcaatagaaaaaaatgttatgcatcagtgtcaacaaaaaatggtttgtatagcagtttcaatagatgaactttcaatttttcatccaacatttgtaagtctgttgtacgtagtaccttggtaattgacgttatacagatatactgaacgtgtagagccagttgcgttatacagaattttcttcctctgaactctattaagtagtcatatctttagataggattcttctaaacatagaagggtgtagttcataatgtgatctagattctattaagaaataattaatcatgttgaattcaagttgtggcatgttaattgcttctgcatgttgtcactaggtacagtatatcgcaaggtttactgcttcttataataggatgatgaaatgaaggattcagtggtttggcaaaagtattgcacgctacagcaaatagcatagtattgaaaggtgatcaaatgcttctactcaaaattactgctgtagtgttgtattttactactaccagttgcttttgaccaaatttaagtaatgaagaatccaggattggttgacgatttactcaaagtttagagcaagttcaatagtatagcccactgctagctccaatttatctatagccaatctaatagtcaattcatacaatagttgcttactatattattaatatatggtcccacatgtcatacatacattgcgtcttggagtccgtgctgcagctggctacagatctgtagcccgctgctcttctctcttatcgtttatctcattaaaatatgtttatagctggctagtagtctgctattgtacctgctcttatgatagtatgcccatctctgaattttatctgctgattaaaataaccttccattagacagaagagaggacaactgtgttttttagctaatctgacgctatgttggctggcatagctgcttatgctgctgagttaattttctgcataactgtcagattgtattagagata

SEQ ID NO: 4928 - DNA, 1501 bp, Oryza sativa
acagacatgtgcaatgtagcctagccaagtcctggatgaacaacaacaatctgtccctgattcagagtcaatgcaagggcatggacagggtagatcaggtcatgatgccttcttcatggccagtacttgaatgtagtgattgatcattcatgcatgttaaaaatttggtccctttggtgaggttaagttgctgatatgcttgtatatttcagggaatgtggtccttgatgagaacatggtgagtacagatcggagcagatttctgaagaaccccatgtggatattaggaacatcgccgcatgaaaatctactgcttattatcaaagttcagttcaccgccagacagcagcaacaagtggtaccatattcatctagattcaacaagctggaaaatgcatggacctaaccccttatccgtttcagatgaagatgctctatgatcaatactccctttcaaaacaaaactatttctaccacttaagccttgtctcaaaataaagctatttcttcacctacttttgtatctcaaccaatcataataattctctatttaatttctctatttactttctcttctcaaccaaccgaccaatcaaaacattttccctagttacccgtatctagttcaaaaaatgcttatattttactccctccgtcccataatataagggattttggtgggatgtgatgtgacacatcctccttagagagagtagcatgcaatagttagttacatgtacagttggaagtgcgagttagaatactgcaaaagttaacaatggacaggacaaattaaacaagtggttaacagtcttcacagattggtgcaaactctgcgcattttgccgatgcatatgcagctgaagaagacaagaggcatccatgaacaggccacacccaatgtgacctccaactttttgtgacgtgatcgcactagaaacatgagcaagtgctgatgccacaccacaagggacacatgttcaggacagggagatgcaaacaaagaagttgcagactttttacagtgatgagggcaaatgcaatgcacacctgtaaattgcaaagcttctgcaacgggaaaaaaaacaaacagcttgctagtgttgctcatttgcagacattgtcaagtggcatacatgttcaagaaccatgctgaacaacttccaatttccaaagttgccactggtttctgctaggcatgcatatgaataacactgtttatgtactagcacgcatagcatctccatgcagatcacataccaaggcagaaaacaacatacaagttacaaaaagcagcacatgatttcagtcttgcctagagcttctgcagaagtagctacaaagtttcagacaaatgcaactcacatgtagtagtatatacttccaagaagacaggaagattaagattgtcaaaaacacttcgcaataacctagagacatgtagtaaggctaagcaggtatctacaatctgtgcaaagtcagttcagtagtttttatcttc

SEQ ID NO: 4929 - DNA, 207 bp, Oryza sativa
ccctcccgtccagtactctgatactctctctctctctctccctacctccagtgtctacagtttctctctcttctcttctcttctctctctcagtctcactctctcaatccgcctcggccggagcgcgcgcgcgctttccccccctcgccgccggcgacgagctcgagccggcggtgcgctcgcctacctccggagggcggagcgggg

SEQ ID NO: 4930 - DNA, 1501 bp, Oryza sativa
tggctctcatacaagagctagcttatcacaagctccaatataaatgcattaaatgtgtaagtgagagataaagagaaaaagaaaattgtagctaaccttacagctaatttattatatatattggctttaagatggtctaatagtaggaagtgagctctattattatccttgctcgagcaagtttaatagtgcagcccgttgccggctctaatttcacacacatcatctgcatgtgatataagagccaataaatacaataagcgttggcccatctgctataaaacaaatttactttattatatgtagggcccactatttcagccttttactctcagcaagcctgtgttacccacgtgcatgtaggtttggagtttatgccaagcctgcgataaaactagcgcccgttttacactctctctacttttccatcttccacgtatgatatagccagcgtatgggtaactattgtacctgctcttacctagctaggcgttacagcgtagccggcgacggcgcccgcgtccaggtgcactgcgcgcagttgcacatgcgcgggcgggtgggcgcgcggcggtgcccggtgcacgaggtggcgaaaaccaggggagccgagacgagccagggggcggggatccaaccgcgcaacaagtccgggcccggcttgtcggctggactgaatgaccgatcacactgtgtgggaaaacataggcttaattcactatcagcaattcagcagatggattattgaattactagcacgataatgaattggagcgtatacgcgtcgtgtagcggtgtagggtgttcgagttgattgttaaattaaaaaaaaaacggcgcctttttcccagttgatcaagaacgcctattctctactcggatacaaaatgaaatctttacgtagagtagcataatactcctccaaaaaggtatatgcatacgtatataccagactaagagtcatgaggtctagttagaacttagaggcgtgttgatcaaatgtggcactaataaaatgctaaattaacttcacatcgacaacaagggtttaatttcgcattgcttatttagattgagagtagtatgtccacatcgcatatcttcttagtacgatttgttaatgaaaagatggacgatgattcgatgaatgcattctagactggaggttccagttccagaccggttgacggtatacaccaatgcatgacgcacaaggtttggccagccaaaccacggcgaatggagcacgcgaaacaagtcagccgattcccagtttgccacccatctcaccagactacaattctgcaagcagcaacggcgccaaagacggttttttctccttcctctatataagccccacaatgcccaccaccagcttgtcacaactcacagccaaaacctcgtacattttcagctagccacaagcaacacaagtccaagacaagtcaagcgttcgcaccaagtcaaaccgcgcctcactgccaccttcgtttgcgcacca

SEQ ID NO: 4931 - DNA, 1501 bp, Oryza sativa
aaatgtgaggccgacatgtgtattactggtcaatggcagaactgaaattcgaaaatgtattgatgtattattcctcttttttttttgttcaaattaagatgacacgtaggctccagcaaccatccacgtggcggcaggttgtgcacgtcactccatctccaacacatcagcattttcagcaaagaaagaaaaaactgtagtggactttgcagaaaacgctgacgacgagtacgtacgaattaatgccttaatcatatgatatctccaaagattaattaataagtggcttgcttaattttgctactaatcgctatctcgacgtagccagagagccatgcatgcatcacagcgagcccacggccgcacgagcactcgccaacgaattcgctaggcgtacaccgtgaatgatttgatgcgttgattacgggtattcatattcctttatgaaaggttattgtcagactttttttattccacaagatcgatcatactacaaagttattctacaatagtttagaacacttatccagttgtgttagaatataataatgatggatggatatgtatgccatattaaacaatctaaattccccacaaaacatataaaagaacactataataaactatggtttatccaacatggacatatatttaaatgaagtgcgatctccggtgctctttactggtaggatgaatgatgatagagataaaagcgtttaacaaatatggcctcaagcgaaattcgttatattaattaaatcaatgaaaacatttactggattaataaaactccatgctactccattataaatgaacgcacacctatatatagcaaaattcctatttgccagtaggtccaatacttcggatctgtttttttttcttttaaatatccaaaattgattttggataactactcgacagtacaaacgaattaaaccagctattacaacgtcgagtggatttaaaacactcctctattaaattcacctacagaaagtcgttcccgctgaaataatcgcaccgtctagaagctcggcaagcgtgtcgctaatccgatactaactccattaattccattttcatttcaataattgttgaagttattactgcactggaaataataaaggcaggggggtgtaactgggtgtgtacaaagtgttggtgagcatagcagttggcaggtgcaccaccctttattatattcctcctttctctctctctctctctctctctctctctctctctctctctccccctcttcctccctttaaatgcttcgcctctctcgctcgtctctccaaacacaaacccaccacctcctcctcctcctcccatccagcacgcgcctcctctctcgcgcggctttccatttccatctccccctcctcctcgtacgtctccgccgctcctcacttcctccactcgatttcctttcttggcctctcctcctctgacacaggggtgtgcaggtttgtgtttgtgcgtggcgcgtccgcca

SEQ ID NO: 4932 - DNA, 1501 bp, Oryza sativa
tctcacttgaacacacctcttgctcctccattgggaagatttacatataaaccctcacaatattcaatattcagttattttatatactagctgtagacccgtgcgtcgtaacggtctttttattcagtttagtggaagaatttgagccgattatgctgtttgggttttatactagtctttttaaaaagaatcagtttttttaagagtgaatggtttttatgggagagaaaatgtttctatggaagtggagaacgagatagaaatagttagtttttagggctgtgtttagttcacgttaaaattgtaagtttggttaaaattggaacgatgtgacggaaaagttgaaagtttatgtgtgtaggaaagttttgatgtgatggaaaagttgaaagtttaaagaaatattttgaaaactaaacacggcgtagatgtaagtgaggaatggagagaatgaagaaggccgactttctcttctagtttttttaagtagtagagagaagagatactcatatttagtcaataatccatcaaatactcttttactgcgcccgctactagcgtgagcttataacaattattttagggtagaaacgaattagttaaagatttaaaagaaattttaattttaaagttttttcaggaatactaatgaagaatttttttaaaaaaatgtattatgatattttatatatactcctgcttggttaataatctagcggattctcttggctcggtccagtaataatgtgccgatggatgatacatggaattgagtgtataatacttcttgcgtcctaaaatataataatttttagcctctaatatctatcccaaaatatgataaattattctcttctcaaccaatcacaatatttcacctcttaatttcctcccatactttctcttctcaactaatcacaaccttcacacatttaatttcacttatttttttaatacatgtgtccaacccaaaacttcttatattttgggatggatgtagtaataatttataggcgaaaattgaaaaatctaatttaaatatgttatctaagaaatacagataaaggaagttttatttagaaatcatattatttaggagcttaagaatcgtgcctgtgacaatccgtcaccccttagcataaaaagaatgggtgcttactagtgaacatttcatggttgccgaagcaaggtggtgttctctttttgcgaaatcaagcaatcagcaaatgtgtccccttggctcttagtattatatttcaccatgattatcatcaaaaaagtttactattgtactatcctaaacttttaaaatgcagacttgcactcggaattagtgagctagaagtactaaaacacaagaaagagatgagcaatgaccaaacaatcacgctgaaacctatgttagctggttaagcaagagaaataagaagttgctccagtgagcagattcctgcacttgtagcaagtagacgtggacttcatggtttcttatccctccttg

SEQ ID NO: 4933 - DNA, 1501 bp, Oryza sativa
aaaataggtttctcctagtgaccatgtgtcacttcagcactctagtgcaacctttgcgttacttgcctttgatgggaaagtgcactcacaaaagtttattattaaagctattgtccttaaggtttctgttgccactggtgactggtgtgtagacaccaaaaagggaactgcttattgggtttgaccttcaaatgtcaaaaggggtcatttcatttgtttcatgccactgccgaaagtcacaagggtagagatgatacatacccaatacttgaaaaatacgattaattactttcctgtcacgttctatcatatatgagatatttctcgacatgcatagttgcatacttaacatgccctcacaccattagaaggctgctcaaataggaataaaggtcagagattaatcatcataagtatgcttagtcagaaaatctttaatcatattttttccttcaaatttttattacgtgtccccaagttttcattttgtttcttttttcccgagggagttggtgacaaaaaaaaaggtgccctggcaatatatagactagaaataaggtgcacattggaattttgatttaaggtcaaacatgctggcttagtaagttggctggccaatggtgtaggtggaagttccgttcaaaaaaccgtgtaagtggaagtggcactaccagatgtcaatgagtgaaaggcaggtcgaatggtggtaataatgcatgtattgaaaacgtttcaaagcttagatgttttctgtaatgcatgtgagactttattttaggagtatctaccagtaatatgtttcttgatatgattggtagagcttctcgtccatttccatccataatatgtttatataagcaataataaataatgtaaacaaatttgtatatgttacagacacatgtctagctgaaccaattactgcatgctagcttttccatattttgatactgtttattcgaagtttaatgttttatggagaatggaatttttatcatttttgttcttaattattctatggtaattatcacattttgcttaatcagaaactattgttcttttgtcagaacataatgtttctttttctgatcgcatgctgagtactgaagtgcaccaatcagataatcacatggaaatttgcacggacctaaaactttattttttgtgttcgtcttctcttattggttagattttttctgcgggacagtcggcagtatgtgtgaaggagataacatatattccgctctcacatttaaggtcagtgggacatccagtagttgtctatcgctttcttgctttctttcgtgccttccctactttttgcatcactttcacgatccaattatctcaattgaaaagtagaaagaaacacaggaaaagagagagagaaacaaaaggatatatagataaagggaacaaagaaaatttggatactgtttctgctgtctctgccaatcctgataccgaaagaaatagacaaataggaaacaagatgaatata

SEQ ID NO: 4934 - DNA, 1501 bp, Oryza sativa
gaagagtcagcagccctgagaaggagatcacatcccgagcaggcatttcgtcgaacaccctgcgtgcgtccccaacagcagcccgagacgagtagccatggagcagcgcgttgtggacatgcacgtgagagctgcccgcgccaaggcagccgtgtttgatcgcctgggcgtggaggtcggaaggcaaccgccgctgagacacgcatcgcgagcaagacttgagggcgaacgtgaaggtgaaggcgtcgggggcggcgcccgcgcggcgcatcgcggagaagagctcgatggcggcggcgggcgaggaggacgcggcgaggccgcgcatgagggtgttgtagaagaaggcgaggtgggaggaggccgaggagaggaacgggaggtggagggagagcaacgcggcggcatggcggaggtcgccggcgggggagacggcggcgaagcggaggagcttggcgagtgccgcgacggcgtcggcggtcgggaggaggtggcggcggcggaggagggcgccgtggaggaggcggagcttgcgcttcgtcgagcacttgccggcgaaggatacgagatcacctggcgagatcgacggcgacggcggcgtcatcgcggagtctggctgcgctccatcggttcagagctttgaactgtcggagctgatgaagtgctgaacaatcgctgaaaaattccacacaaatggttaagttaggcggttagcatcacacattcagaatttcatgctgaaactttataaaccaaaactgcaaagttttacacattcttatttcttcaaacttctaacttttccatcatattaaaacttttctacacacacaaacttccaacttttccgtcacatcgttccaatttcaaccaaacttccaattttagcgtgaactaaacacacccaaagtttagtcgccgaaatgaggagcctagtggcatttgagtttttctattagtgaatataccacttcaactcctttttcttccatgttttttaaaatctaagacacaacttaggggctagggcaagtactataagaaagggcatccacaatatcaatcaaaagcgggcattatacaataaaaacacctatatgggctgcctctatacaatgtagatgtggcctttaaagcattaatggctaaagtagtccatatggctatgggtttgcccacaagagaatacaatatattactttttgagttcactgtttggaaatgaatataaaaacaaaagcagttgatccatgaccctgcagcagatatatgctggttgaaggttggacgttgaagttaccgttgccttgagctctatgttggctacaaaacttgctcgacagcttgagctccatgttgcctataaaaacaaaatagacagagcttcatagtacacctcctcatttcatcatggattcatccaacagaagtttcaaaaatctcctaaatcaagaatctccaagcctagaaaattctaggcactacaactctcctccccaac

SEQ ID NO: 4935 - DNA, 1501 bp, Oryza sativa
gacaccatatcattattatctaaaatgtcaagatgtataaaaaagggaatacacttgtattgtcgtgcatacgtgtaccggtgtacgtgctctagttttcaaaagaaaagaacaaaaaaaaaaagactagcagattaattacagttgtaagccgcaatgtgctttggtaaaatgttgtcgtagcattcgtacgatgagccttgcgccttccccggtattttgatagacatgaacatcagaacgtgatttattattttcatgaacactgaaaaattgagctaatactaagaaaattccgtaatctaattgacaaatgataattgaatttctttctggtgaaactgataactgggaatttatacctgacttacgggataagagccacgtatgaacaaggccattatacggagtatgagaaaaggactcaatgagtcctcaattgcaaacatgtctcggaaattctcaacctttgtggataacctattttaatgactagctccattctagggtgtacctttcacaacctcgactatcatcttgatccgactcgaaatgtgcatctcgattattgagagttaatgaatttcatttaaaacttgtcaaaattcattcgaaattaaccaaaaatagtttatcgatattatgaaccatgcttcctaggattagcgtaaatatctttaaatctggataaccaaacaatctctatttagtagcgtaaatatcttttaaatcatttttagcgtctatttggtaaattttgacctaatataagcagcggcggagccagcgtgggggcgggagggggggaaagagggagaggatgaagaaaatagggggagagagaggggggggctgaaagaggaagaagaaggctgagcccctcctctcctccaaacctagctccgtcactgaatataagagaatatgataatctatttgataattaagttatttatacgataccgatatgattaagactttacgtctcatatgacactagcttatattccagcaaggcgtgaaaccacaaaatcctcaattataccaataggaagatcgtaaaattctcaatgcttcatggatagtatgtattaatgacttccacgttaattctggataaccaaacaatctctaattaagagtagcataaatatcttttaaatcattttatgtatctatttggtatatttccaaatccaaagataatttaactagatctaaaattactttcataagttttggatgaaccatgctgtctctatttagagaaaaaaaatagtaaaactttattaaatctaaatccataatgaatcttggatctaaaagcgtgccaaaaatgaaccaaaaaatctcatatccaagtatgtgatgatgaagcgagttagcgaaaccgcctaaccacgaggttttcgcaacttaaccacgcagacgcggagaagacgacacccaaaaccctcgcccatctcccctcctcccgccgccgccgccatggacgccgccg

SEQ ID NO: 4936 - DNA, 1501 bp, Oryza sativa
taacagtggagtaaaattaagtgacgagcggtggacgctagcgagagctgatgtatatatgacaatgacaatgatttgagttgacttaagcgaaactaaacgatttgagttgaactatatctttgtccccaacttcaattaccggattgattaattaattatatgtgtaatactgtagagagctagctaatatactactactaggctactagctagttgataaatgcattagctgctatataaattatctagaataatgttagctacgtatacgtgctatatatatagccaatatgctattcaaacagtatctgaaaattgtaaaaatgaataaatttatgatagtagcagctatagctgagtagttgtgtgaacagaatgaagatcgacggtgcacatatatacttgcgttatttcactatcatgaccgctgtttcgcagtgaagaaaaagtaccgcgcgccagctataaccaattcaccttcgtcccttcttaaatatttagatatttttaagttgtttagcaaatattaattataagattggaaattccatctaaattatcttacttgttaaattttaaattttgtaattcctctcctaaacatctgattagctaaaagtgtttaattagatttccatgcattgaaattattttaattgaaaatatagggtatatataattgtagagatgacgtcgtctgcttgattttattaaccgcaataaaaaatttaaattagatagagatttattttatcatagtttattttcaagccttatcttttaattgaaccgtgctaataatatagatataaaagttctaattatatttttttcgttggttgtatattttactaatatacggttactcaaccaattgaaccagactatataaagaggctggattaactttcatcataaggaaatagagacaataatatgaataagtatttcttccgttctgaaacgatcaaacttaatacggaacgtaacacattctatattctagtattataaatctagacggtgtgtctatccatattaaaaatataaaatataccatatcatatattagatttatttattttacgacggagagaacgtatgagagaggagtgaaataaatgcagagaccacagctagctagctagcagctcactaacgacacaagggaggacactggagttgctactactacaaaataaaaaggctcatggggagcaaagcaagccaagcggtgttgattaaaatccagagaaattaattaagccaagcaagtgaagtgacctctctctctctctctctctctctctctctctctgctgcactactagctagctgctgctcctccggctggccggccggccggagtgtgccatggccatggcgggcgccggcgactggccgttcgccgccgacgaagcgtacgccgactcgtcggccatattcgccgagctcggctgggccaacgggctcgccgtcgtcgacgccgtgggggagc

SEQ ID NO: 4937 - DNA, 891 bp, Oryza sativa
gggaggagagcggcggcgccggccaccggccaccggaaggttcgtctcctctctctccgccttctgctccccccggatgttcggttgctttgttggcccccacgcggttctcgctgattcgtgtacgctcttggattgttgctgttagggttcgggagtggtggtgttgggtagtgaagtcggctgcggcgatgttgtccaggatctcgcagctcggggcgcggcttctgcgcgagaacagagctggtacgcacccttttcgtgtctctcttgttttttattggttaatcctctggaagcagctgagaaatacttccaaaccatgacgaatctatacattatcacgaatgattaaagaggagagagcgatcgatttgtatgaacgatatgcatgcttccactatccattctatggccggtttaggctgagccactattgttgagtaaatcttggtgctataccattggctttttattgttctccctcttgtgcagtagggaatttggcaagcagtacaaccagctattatcgaggtcaactcagccgacgttttgtcccaacggttagtccaatctgtatcttgttgttgtgatgcctagtggtgagtttggacgaaaattttgcataccctttgtatgtgttttcaccgagagcttaacttggccaagtcaactgtatcttatataccctttatgatgtttgcattctgaaatttgtatagctgttactgacaatccctacaaaaagagcaatcataaatgttttctagatatgacatggattttctgaaatgaccaatatgaattgtgcattctgaaactgagagacaaaagattttatctatctgcacattctccaccaccatctttatcttgggattatgttctgta

SEQ ID NO: 4938 - DNA, 1501 bp, Oryza sativa
ctttttcttcaaacttccacttttttatcacatcaaaactttcctacacacataaacttccaactttttcatcatatcgttccaatttcaaccaaactttcaattttagtgtgaactaacacaaccttgatttcttgtttgtatgttttccaagctactagtactactttaaaagtcaaatggctatcacaaaaatcacattatccatcaacctatcaatttcagctatctcagacgaggccttagagagcaaaatctggaatatgtgaatgcaagaacctgtatgtagcatagagaattttcacacaaactttattgaaatttcgtagaaaacaacgaagatatatgaactgaaaacaaagataccataccagtactaacaacatgactgtacagcacacaagggtcaatcaaggttcgcacaactttacttgaaatttgaagggtaaaggtgtgttctaccatgcaaacgcaaacgaatttcagcagcaccacgcaaacatgttatatacctgcaccagttacactttcattaacccaaccatctcaagaaaaaagaagaggatatgcaacccgagcaggtcaattttcttcttcttctttttcctcttctctttttataaaagattatcacaagctacaacagtcggaaatagattgtctgagaaggattatagaaaatgcagctgatggagagagtgatgagattaacagcaggccggcatagtctgcttcaggagtaaaagggaatgaggatttaacaaaataatttcttttttttttgtcgggacggccaaagattgaccggtcaatttcattaaaattgggggaaataaagttttaattacatcgacatgaagaatggtgagccggtctcaagcaaacttaaacccgggcaagccccgcctctaaccaggattactgtcacaccctgaagttctttcccaagcctaaattgaatttataatccaccagagaaaatatcggtgtaaaagcaagagaaaaccctaataaattaatgcaaataataatcggatttagcatgtggaatttttcttgagttctacatgtcgaaatattctaacaagatttttagtggaattttcagagctctagaaataattttaaccaattaaaattgagcacaagcaatatttaatcccaggaaaatctattttccttctttttcctttttcttttctctttttccttcaattgggccgccggcccattctcctttcccccccccttcccgctgggccggccgacaggccgaggcctagccgagccagccgcctccctcctctctctcccggggtcgccgacaggtggggcccacctgtcgggcccgtccccttcctctagccggcgccgccgcgccccgcaaccaccgccgcgcccacgtttcccgcctcctccgggccacgtcggccacgcccgcgcatgcgccgcatcccccgcacccactccccctccctctcgcccgcgcccgcgcccgaga

SEQ ID NO: 4939 - DNA, 1501 bp, Oryza sativa
gtggtgtctcctgccatttcgtttagatgaaaaagctttgagtttgcatcccctattttgtgtcaattgatcttgaaggctggtgcatatgcagtttttcaactggtgatgaaagaattgcaacgcgtaagaaatgtggctatttacattattactacaattgactcttttagatattgtaggaggtaatggttgcgctaatatatgataaattatttgttgttacgatgatattcttaatgacaaatcaagatatataaatccattaatgttatagctacacttcttaaaaaaaatgttaaaaacatatttattattaattattattaaacattatgtccattaacacaaacaatattttaatagatggagaggtcataaccgtgtgaacacacgacttaagatgctagtttattggcaaattgaatagtttgtgtgttagtttgaattgagaccaaatatttggtagcgcccctattctatttggttatattctagaagtttctttactatactataagaatttggctttttattggcagcaattcaaatgttaactaaataattttatcttaccaatattttggtagtgccaaagtttgcctagactttagcactgccaatgaattagtagggtaaagaaccaaacaagctcttaatataaatactaagtgtcgaatctgcaatggtgagaatatatctcacttaagtatgctaattaaataccataagaaatctcaaacacttactttattaaatgaagcatccaccgaggtacaagtgaggagagagcaccgacaactccggcattcctccagaccttcccctcactctctatctattttttccacactaataaagtgatgcctaaaatatgaaagtgagttttgtttttgttgttgtgtgttgtgcaacggctggagctcatccttttatataaccatatgacggttggaatggcggttgtggaggtcggtgtacccacaactatcattgtggaaggtggaggtggggcctgtgagccccaccactctccactgccttcctctaggggatgacatgtgggcccctaagacggtgcattgtggtttagtcccatataggtatatttctttgcatgacgggtgtaaattcatccaaaaaatcacttgcgtataaatacttaccaaaactagaggaaacggttagtaaaccctaccacttaatttgatattatattttgcattcctttatgcaggaattaacggtcaaagatgatacttaacgactgtcccaggttttacaactctgggatgagactcagatgatgagttaacccctgacagtcaattcacatgttcctcagcatcaccagcggatccaaagggtggtcccctgaccacccaaaaaatttctggcccaaagcccagttaaaatagatattggcaaaaaaaaaaaggaaaaatgcaccgatggtccctcaacttgtcatcgaattacaaaatcgtcctccaaccacaaa

SEQ ID NO: 4940 - DNA, 1501 bp, Oryza sativa
cactgcggccggtggcgattcccatttttcattcatcatcatacgtggagctcgatccaactgcagtttttcaaggtccattgtatggtaaatgatggcatcacacacctctgaacccgtgagcttcttgtcatccgcattggccttattccctgcataccaccactcaagaggatttttcattgtactcaaaactgaacctttttagttttgttcagtttatccaattactgctagtagtttatttctccgagggggtgtaccataatgtaataatctgttcgatcattgaatgcaaactaattaagcatttacaaattagtataactaacttttttatgacataaacgatttacatctgttagtataactgaatatatatcatatttgtagtcgatcgtgtatatgaccatatatatatctaactaaaaaatacggaaggattcggtacttttttggtttgtctttttttcgttggtttctttttgcccgatcgcttccaggttttctgtccatctggtttttctcaaccgatccgttgcacgcacgcatagcgcgcctcccgtcatgggctcatggccacgtcaatatgtcttcacgtgtgttttctcctttaattgactacaaaaatcgattctcactttcccttatcattttcctcatgatttaccctaatagcgatcatagtgcttcactttatcgctaagctcctaccaactattgtatcactgaaaaaatatctttaactgttgcaacgcatgggtatttttttctagtgtatttaaaaggattgtatttgttctttctgaagtatttaaaatggatgatgtaatcttatcttcttcatgtagctggtgttgagtagtttctttgtcgagggataactatgtctagtcaattctaacatttatcttccccgcaaaaaaaaaattctaacatttatcttagcaatatgttattatgatttgtctgtgcagaactgcagatatgggttcatttgcactaaagaaaaattaaaccactcctgcatgacattaggtagcagcatcttcttgttggaagacgactgctaatacagtagtcaagatgcgagtattaagtttatgacctcagaaggtcaagatgcaaatgttactaaacaattaaagaaagcagttgagcaatgggatgttccaagattaaagaaaggtgattactactcctttgaagagcatcttatattaactttgtgttgtaaaaaaatgatgagcaggtaaggcatctctgactctacatgagagcacatactttggtcattaatggtgattataatgatatattctgtatttattgtttgctgcattcagtttgattggttgctttgttcagagctgtttctaccaaatccattcaagttgaaacatctccaaaaaaaaatcaattttaaacggactgggagctgtccatgctgacccatgttgctctgtacaagctttatttaaatgtgctgcaaatttgattg

SEQ ID NO: 4941 - DNA, 1501 bp, Oryza sativa
tgttcaaccattttctattgacaaaaatgaattctagaccttgtgctagcgtttcgtattttccagtacaaaacatgagtaaaaaactaagaacttcctcgcattccagattttactctaactgttgtactagtagccccatttggagaacaaagtttaactaaaaactgtatgaagcaattaaactctcacacaatcaaatcaagatagatatacaattgtaaaaaaaaacatatctttaacctggaagtgaggaggagatccaaggtcaatgaaagaagacaggtagggagggccatgtgaggagatgcctctccatttgcccctttatttccgacaatgccactcaagttgatcagtatcttcttcatggcaccagtagctgtgtactccatgagtgtaattaactttcttcttctctccaactgcttcagctaactttcttattaatgagcaccatttttctgctctcattatatcatgtggtttgcttctgttacctgctgacctgtgtttgtgtgtgatctactatctgcagactgcagctaccacttgggcttgctttgtcacatgcagttttacaccttttatttctccttaatacaaggtaagtgttggatcagtagcttgctcaatgctcactcatcctgccaaagagagactacagacttgttctgaactgtaaagtctgttgtttggatcctctgcatattgttcagtcttgtccttttgctttacagcccttttgcaaatgcaggaaccgtgtgataaaacagtagtagaagtttcatcaggctcatggttgaagtaacagtgaggatggagccagggcgaagccatgattcttcgagtgcatggctagaaaataataaaatgcatttttttcatttagatattcttagcttaaaatcgcttactctgcattggaaaattctgctgccacatgtagtgttactctgcattagccaaaaaaaaagaagcaaaagcaaaaattaacaggtgcctcaagatttgtgttaagtgatatcacagtaatgttaacctatccaatgtagtattagttagtcatattctaactggatgattggattgattatggacagatttaaatttgctcgtatggatgaataaagcaagggacgtgtgaaaattgtacaaaattttgatgggcctgatctgggccactttgggccttgacactctaggcggactagtgcaacatatgccccggcccatttacaccgccccgcgataaaaactgggtgagggcgaccaagaaccctaggctgtcgcggatccatcccatcccatctcttcctcgtctcccactcctccggtgagccttgcctccctttttcctcgattcagttcatcagatctttcggtaaatccaatcgagttgatagggtttgatgtcctaatctatctatctctctctgtgctgctgctgttgttgggggtggcaggattctttctgttcttggttgattgccggagatgt

SEQ ID NO: 4942 - DNA, 1501 bp, Oryza sativa
attacatactccatccatcccttatattttaggatggagagtgccaaggcttttgcagcttctaacattatgtggtctgcctttctcttaatctttttcacgccatcgtgagaatttcatagtacagttttgtgtgtatttgagtttacttttattagtacagttttgtgtgtatttgagtttacttttatttttttgtatgattatttcttagtatatttgataggttgatgttaggagaactgtgcataaataaaccaagcaatctcctcacctgcaaagctcaagattaatatttcttgcacgcataagtttatcttgagagatttggcacaataagtgtctccatgtatgataagattataaacagatcaagaaacgaagatactttatgatatgtttcataacttaaataggacagatgacaactaaaaattgacttttgggtgccaaactagtataacataaataaaatctaattaacataaagtgcagaagatcttagtcttcgcagagcataagatatagtggtttgatgtcatgtcaataacagataactcgatagagttgtttaaacactaacagcattctaaccgcaaaacttgataaacacaaattattttcatccaatctctcaatatgttgtataagtttctaaacattgacatcggcaccaaagtgcagaagatcttagtcttcaaagcagagcataggatatagtggtttggtgtcatgtcaataacagataactcgacagagttgtttaaacactaacggcattgtaaccgcaaaacttgataaacacaaattattttcatctaatctctcaatatgttgtataagtttctaaacattgacattggcatatgttgtataagtttcaaacattgacattggcaccactagcaggcttcacatatttttgattaactctctctatatatatacccgttgttatgaattcatcaaattgatgtgctagaggttttgggagtagttaagcatgaaacaagcatttctccatcatggtaccatccacaatcacaagttattaggggtattaggttctggctccggcatgcatatgttgtttttgtttgtttggaaagggctaagagcctaagatgttccggatcaatgaaagctttccagattaccacgagataattctatttgtacttaagtacaaatccactctatagtgttaatgtagatggtgactctatagagaaggaaacaagtcaccatctacggtctgtcctttagacaaacttgctttactgtactcagggagcctgtttcagatttttcctgaccgcatttgcggtaatatatgtgcattgaaggcatatatatatatatgtactactataagtaagaaaatcaagctgtatcattcaaagaataattctaagtaagcatctttatacaatttcatgcaccaggtgccaaaaaactaatataaaaacatctatgtgaaataacttgaaacaaaacacca

SEQ ID NO: 4943 - DNA, 1501 bp, Oryza sativa
tatgcgcccaagtaataaacagtacgcgtacttacgtcgaggttaaattaatttcagtacgagagatcgagcaggcgccggatatatatatacatattacatgcgttgcctgccattgaagagcatgcgtaccgtacgtacatgcacgtacgcacatacgtatgtacgtactgtgtacgtaagaatcaataaacatctactgtgcaaacatatagtctgaatatgagctatattaaaacaaatgccagtgcgttgcaacgggtgaaggctattataatcttattattgtttactgtgagaatttgcttggatatatacttttctagaaaatcatgtcatgcaagtttttcttttcaagagattaaatcatgttaagttagcacgcgagttttttttcaagagatttcttatacgacttcttatgtattttcaaaagcgaacgaaattaaaacccgactcaaatatagatctatattttcaaaagcgaacgaactgtatttttcaatacggttaaaaatcaacttatacacgaatgacgtaccagagtactggtaaaattatcttcaatttttataatagtagaaaagttttggtgattttggtgtcagcaatttctactacttaaaaaatttcaaaacgtttccttcgtccgtcaaaataaaaaaaatagcaaaaaaaacaacaaaaaaaaagtccgactcccctaaaaaggtggtgaaaaaaaaccgtagatccgattccccctaaaaaggaaaaaatctgagaaaaaaaatagcgaaaaacaactaaaaaaattctggttccactaagtggcaaaaaaaaacgtagatccgaaccgaaaaagaaatctgattcctataaaggtgaaaaaaagttttaaaaaaaagctagatccgattcccataaaaatggaaaaaagtctgattttgtaaaaggcgaaaaataaaaaaaccacaaaaacatgtaaaaaaaagtttgtccgatttcctaagaaagtgacgaaaaaatggctcgtataaactaaaaaatcacgtgtgaaaaaaggtggaaaaaaaagtgtggaaaagaagtccgatttctattcgtttttgtagacagtatatatctttctctatctctaatctaatataactactcaaaagagaagttttcattctacaacttaaaaaaagcatgagaaaataaaaacggttaaaaaatacgtaagaaaaaaagtcagaaaaagcgttaaaataatgttttctgtcttctataaataataaaaaaatatgcgagaaaaaaaatatttccatcgtaggtaaaaaaaattaaataaaaacatgcgagattacattgaagatgttctaatttttttattgtctcagctgcaaacgatccatacaaacattgttattgacatggttatgcatgaaaaacgtatattatgattaaatattttttcacccgttataactcacgagtcttttcgctagtagaaaataataattaaagagaacaacac

SEQ ID NO: 4944 - DNA, 1501 bp, Oryza sativa
tcaaatctgcaagcacgcgatttcaaaagaaccgtatgtgcaatccaatgattgcagcatagtgaactcctgcacttccaatactcggtgcaatttaacaattacaattgcagtatagtacctcaatactcaaacatatcgaacatacgaggatatacctgcagaggggatctgacatgattcgagccacggtggtaggatgcatggcacaactgaactagagttgacgtcatcaggagaactcctcccaatcacctcgcccttggccatgtccacggcaagaacctcgtggaggaatatcaggtacacaacgttggcgttcagtggatcgatggcgccgatccgcggcttctcgggcaccttgagctcacccttccagcttggggtgatctccatcctgtgctccagcgtccagctgctgccctcatcgtcgagcgagaatgcgctgaccacgaacggcttcttcgcattggacacctcgacgtaccggagcttcccctcgctgacccccatccgccgatacaagccaagaatccgtctccccccaattccggtcaggtccggcagtacgctgcccttgggcagctcgacgaagcgctcctccggccggtcgctgaacgggtcgacggagagggcgccccagctcacgtccacccaccacagccggccgccgaaggccaccacctggtggtccaggtgcatcacccgctcggccgccgccgccctctccgagcccgaggaggaccgcaccgtcgccacatcgtcccactcctcggtctccgacatgaaccggcgcagcacgctgctcccggactcccccctggtgagctccgcgaccacgtacctgtcgggcggcccgtgccgggactcggatcgggtgaggaggccgcgccccgtgctgtacttggtggtctcgatggcgggcgggaggcggtacatctggccgctgagcgggttgcagacgaagtgcgcgacgtccgggtcgaggacgccctcgctcgtcgtcctggacagctggagcgccacggcgaggcggacgttggcgacgacgggggcgtggtagcgggtgtcgtagaacttgaggaggaggagcccgtcgccgctgccgccgatgacccagccgacgaagccgacggcgtccccttcggcgtccgggagggggccggggttgacgaagtgggcggggacggagaggcgggaggagcgcgggggctcgacgaggtccaaggacgcccgcgcgctccgcgacggcgcccctgacctgtccagctccgcctcggttaggatcatgcgccacggagggcgtgacgcggccgtggagagcgcgcggcggagatggcggcccgctgcggcgccggcgaggcggcggagcagcagcgacattttcccaaagccggcgaggaggagtcgaggagagggaggagggtgggaaactatttaacagctcgagtgatgtccacccgtttatttcatctcatctaaatagttatgaaaaaaatta

SEQ ID NO: 4945 - DNA, 1501 bp, Oryza sativa
cagtgaaacatctcattccaacccaaatgaaataaaggccaaagtgacaatcattatccacacttcgcaatcagggtagcttagttagcgtgctgtccactccacgcttgcaggatcccaaatttcgccaactccaaaatgttcagagtttagtttcagacaaggaggagcagcaggagaaaccgaccttgcgtggagacggagtgcgacggcggcggcagccagacgtgcgtgacgccggcggcgacgatgtcgtcgaccttccccatcagcaggttgtaccaccctccgctctgcctccacgactcccagttgaacccctgaagagaacgcaacagcttgttcagaaactgaactgaaatcggtcacaacttcagttcagtccgtggctggctgcgtacctggaagagaatcttgtcgccggaagccaagccgagaaggaggaggaggaggatcatggagaggcgtcgtccggtcgccatggcagcagccaggctagctctatagctcgatctctctcctctgcacagaagcagggacactctgctctgaactctgaattgatgaattcagaagatgattacaggtgttttgatgattgcagaagatggctacgcgtgtagggtatttataggacgcagctgcggcagggcagaattgatgaattctttccttttcttttagaaaatggaggattgatgaattcttttttagattccgcgatgtgatgtgatggagagttgcttccttggggacaactgctgtatacaggatacccaactctgttacgtgctattactctgcttcctgatgaacctactcaatcaacactgtgctgatatcttgtatcctgatgaaccgtgtttaggtgggactaaaacttgagttttaactccctatcacattaaatgtttggatactaattataaatattaaacgtaggctattaataaaacacatccatattcttggactaattcgtgagacgaatctattgagcctaattaatccatgattagcctatgtgatgctacagtaaacattctctaattatggattaattaggtttaaaaaatttgcctcccgaattagctttcatttatgtaattagttttgtaagtagattatatttaatactctaaataatgtttaaagacagggactaaaattaagtccctaatccaaacaccaccgaaatcagatgagatgagatgaattcatggcggtcgtcaagtcaatgaaggatggcgccaatgtcacggacgccttggagaagaaatgcctgcaatgcaaacgtaccattcgttgcccctgcctttaggttttcagggtactagccacttatttctctcaagtttgacaaaacatgagcaaaacacacagagaggaaaacaattggttgcatctgaaaatgtatcagctatgtcgaatttattggtttcggatgataacccgtagaaaaataaatgagacaacaaaaaagtaatcttagggcgcagac

SEQ ID NO: 4946 - DNA, 1501 bp, Oryza sativa
aaaaatgcttgcttgttggcttaaaaaaacgcaagcaacatttgaatttttcatattgattttaaacaatccaaagcattttttttctttttttcagccttagcttttaaaccactaagaatagaaacacaagttgtaaccccgtaaaatctttggcttctcatatttacgcaattatgagattacttattttgataaagatttatagcatcattcaagtaaatacaaagtgagatttaagaaacataagctgcttgtgatatagctgcacctaattaagaccggttaatgctatgactataaatagggaccaagatgtcctatgaaataaaaaaaatagaaatagcataatccaagcaaacccactttctaaattatgattggccatcatattagcaaaaaaaaagtatttttttaggttaatgcacaaaaacaattcgagattaactcatcgaggagtacttaaaaaaaaggtgctaatgtctgcgccctaagattacttttttgttgtctcatttatttttctacgggttatcatccgaaaccaataaattcgacatagctgatacattttcagatgcaaccaattgttttcctctctgtgtgttttgctcatgttttgtcaaacttgagagaaataagtggctagtaccctgaaaacctaaaggcaggggcaacgaatggtacgtttgcattgcaggcatttcttctccaaggcgtccgtgacattggcgccatccttcattgacttgacgaccgccatgaattcatctcatctcatctgatttcggtggtgtttggattagggacttaattttagtccctgtctttaaacattatttagagtattaaatataatctacttacaaaactaattacataaatgaaagctaattcgggaggcaaattttttaaacctaattaatccataattagagaatgtttactgtagcatcacataggctaatcatggattaattaggctcaatagattcgtctcacgaattagtccaagaatatggatgtgttttattaatagcctacgtttaatatttataattagtatccaaacatttaatgtgatagggagttaaaactcaagttttagtcccacctaaacacggttcatcaggatacaagatatcagcacagtgttgattgagtaggttcatcaggaagcagagtaatagcacgtaacagagttgggtatcctgtatacagcagttgtccccaaggaagcaactctccatcacatcacatcgcggaatctaaaaaagaattcatcaatcctccattttctaaaagaaaaggaaagaattcatcaattctgccctgccgcagctgcgtcctataaataccctacacgcgtagccatcttctgcaatcatcaaaacacctgtaatcatcttctgaattcatcaattcagagttcagagcagagtgtccctgcttctgtgcagaggagagagatcgagctatagagctagcctggctgctgcca

SEQ ID NO: 4947 - DNA, 1165 bp, Oryza sativa
taggagaagtcgtgatctgtataatgcccctaaacaggagcaatgtggattcccatcactgaaaattttcacttgtggattgcgtttttctcctgagagtcgcacgcccacagtcctgcacctgtggaaaatcatttcagtggactatatcatttgcgatatacttcatcgtttggtcatagcgagtagatggggttgattttctagctcaagcacctgaaaagtttgtcactgtactcactgtttccataaaggagtatagtgtacgcgtttattggacccttgtgtttgtatcatgctcctactatttaagttgttttgtggagggagtgaaagcttcacctgaaaagtatgtaataggaggttgaaatcgaccaaggcttttgttcccacagagctaagcaacgtacttgcaattgatgctacatggttttcttccgaggaaatttgaatgctaggataaatcccccttatctttgaggggggggggggggataaatccttttgtataaatcctaaactaaaatctaacaaatgaaactcctgttagacattttccacctttagccctttaattctcttctttagcacccctgatgattgcagaatctgttttcaggaccatgcatgtggtggataattgtactgtacagttaatacaaaaaagccatggagaaggtaggtgctaaaaccttttaagtgttctcttctttgacactatgttattacatgcttctttggctttgtgctctctgttcttttctttgcatgaagctaacagctctgtaatttcagatgttgtagtcagagacttggaaactccgttatctcttcagccctgcccaccagcggttattcttgtctgtacacttctcatctctgtttggtactatttttgttttcatattgtctgacagtaggataccatgtagttgtcagctataaggctatatgactaactgtcatggtcaagtaatgtccttagtttttgagggtggtcatttatcagaaagatcaacttgtgtgaagtgtcaagggttttgaccaaagtttttacaaccactgtcatctgagtctgactgatgctaacatagaactatgcaattttaacatgctatcgattttgttagccaaactgagctcatgtatattacttacatgattc

SEQ ID NO: 4948 - DNA, 1501 bp, Oryza sativa
atcccgcgccacccaaaccccatcgtcttccttccagagcctcacctcgccatcgtcgccatggagcacctcctgctccctctcctcccccaccgcccctcccaacccctcctcctcctcctccgccatcgccgccgcccatccatcccccgggcatcatccggcgacccctcccccaccgcggccgatgctccgacggacgctcagtccgccacgcctccctcctccggcgccaagcccaccggcgtcaagaaccgcctccgcgcgaggaaccaagctcgccgcgtccaggagttcactccgccggcgccgttggggatcaccatgaaatccaagtcgtcgtcgtcgtcgaggccggctgcgtcgaagtcgtcggcgtcggcttcggcttcggcggcgacgcgcagggagaagcagacgaggaggaaggagtgggaggagatgagcatggcggagaaggccggcgagctgtacgtcggggagaaggggctcctcttctggctcaacaagttcgcctacgcctccatcttcatcatggtcggcgcctggatcctcttccgcttcgtcggcccctccattggcctctaccagctcgacgcgccgccgctcgcgcccaccgatgtcttcgccggctcgccgtgagcgcgtcgccgggggcgtgttcttgattaccatcgagatcgagtactctactagattctaggtacctagtgtatagcagatgattaaggaaaatgtggatcatttggtcgaggaagcagaggatgtaaactagtgttgctgtgttggcgaagattggtcgaggaatcagaatgtataaattgcactgcacaattttggagttaaaatgtttgagatattttgctgcgaattgtgggtgtgagtattcctgctatcttgctacaattattaaccaggaaattgttgtgttcctccctggttatcttcactttttgcatgttcttagttacctagtgtagcgtatgattaaggaaatgtggatcatttggtcgaggatgcagaggatgtaaactactgttgctgtgctggcgaagattgatcgaggaatcagaatgtataaattgcagtgcacaattcggagttagaaagttcagatcttctgctgggaattgtgtgggtgcgagaactcctgcatgctgaattccttgttaatctcatctcaccgtgcaggttccaaccatgcttcgttctttttatttttcttcagtcaattgaacttgggatatatgtaacatcttaagtgtaacagagagaactgaatgtgctaaaatgattcagagttcaatgatagtataatgagcaccaattgaacaaacaaaagtagtttctaatgattatttttgttagtaagtataagtactagtacagtactaattacccttttcacatacagatcaccgacttcttcgatccatgatacaacatcctccctaccatttcttcatcagtttgagccagcatttgcatgccatctaatgag

SEQ ID NO: 4949 - DNA, 1501 bp, Oryza sativa
ttgatgctggaattatttcttgaccattttttgttgctgatgcatcgtatcctctctctctctctctctctcggccgtacgatctgcatccgacggttgaggtgagatggtcagcatcaatcaaatcgccctgaaagattttctgaatttccgttttaccgtttttgttttcacgggatatatcaggcggtatgttggtgaagcaagtaaacaacagagctggtgaatatttacacaattctgaaaaatagaatgtaaaacagttattaaaaagatatatttacacatggtccaagataaaatgtttgcactcttttataagtgtcctttatgagggtaatggatctggtcttggttgacttgacattttgtgttcttcttttttggagatgatgaacgtgcacggtcggtagaaggtgccaatccaacctagcatgagctaacatcacatcaagcaaccccggaaattctgctgttttagctgaccatcgtgtctaaactaactaatcacttagtactaatcaggtactagaactctagaaacataattcccctagttcaaactactccaaataaaaaagaggatataacttactactatggagtatatgttaaaggtgaggaaaccagcataacattgagatgaataaacaatatttcgctttttcttcttgctaccaaaccatgtctttacaattgtggcatccacatgcaatgctttcatattatcttttagataatgataacgtcttgaaaatatatcattaactatattttttataatatatataataaatatatttatagttttattatagtattatattttaagacaaaacaatatatgttattatagcgcttctaactaaatattagttattgccagttaaagctagaattaagttttacctcaaccttatataaaacatcaagaattataaaaccggaggaaaaattttgagaaactttctcaagcggaactgagaacatgtcatatgacaattaacacgcgcgaagaacctaacctaaggatgaaaatcgatcttttgatccttcctgcacactctccgctttaaacgcacacgcgcacatctatccgtatgagtacatttgaaagactagcccagtatatattggaattaacgaagtcaccacaagcatattattgcctatattagtttacagtgataagtacgcgctcatgtctgcattatacgggtgtctagtttgtaacttttgaataatggaaatggaatatattttcaagttgtgtcgtgagatataatataaccataagtttgtaaaataagaaaaaagaaagataaaaataaatgaaaataggacaaatcccctttattactttctagtttgtagtatttggaattgaaaaaaaaagtattttattcatcagataaaataggttacgattttccataccagtggattaatccgaaccgttgaattgaccatcggacggtccacagctcgtgcagttgatcat

SEQ ID NO: 4950 - DNA, 1501 bp, Oryza sativa
gcgtggcgatggtcttcaccctgcggcagaggtgatccagctccttcctcgagtcctcctcggagcacttcatcccgaccttgacctccacgagcctctcccgcagtgcgtcgacctgcgactgctgctgccgcagctcctccctccattcgctctccccctcctccgcgccactccgatcagcagcggcacgctccatgaaaccctacggaattcaaaccccccttaaaattgcatgtaaaatcggctagaaatggatctattcgtccccccaaattcgaccggataataaacgcgtaatcagacggatttgcgagcgagacggtggggatattggggagccatgtaccttcggtataggaggcaaggagcgcgtcgccggcggcgaactcccgctgcggcggcgctcctcgctttcttcgccgcgggttgggttgggttgggttgcgctctcgcgtcgcgtctcgcgaactagtcgctcgcctttcccctttcttcccccaacccaaactaatgaaatgaaatcattttgtttgcttacttatttcctaatccgatgattagattaggtgagtacgctaatggcaaaaagaaagattaataaatgcggacgcgctaaagcatccgtatgggccttgggcctcttctgggctttttttccaaaaaattgagcacatttgtaacacaaaaatcaaccattgtttttgtgcccgagaagcattgtaaggcagcacaacaatagcaactgtaaaagagaacgtcaatatttgtaggaagagtttttctcgtatccttgaagagatatatactttctcacaatttaagaggtaaaaactgtactaccagttgaactgattagaaaatatttaataaatgtgtagtcgagtggtaatgtaaagggtaggtgaagtaaagcatacccttggattccacttccccacgtacccaagttactggactatcaataatgagggcattatggctaccgacatctaaaaatgacatgcattaatttggcaaacagaaaatttaaacctgttttttttttctcaaaagtgttttggtttggtaatgtacgtctcctgaacaattgagatttgagagtcggtggttaaaactaaaccgtgagataaaccaaccggtgctttaattaattttgcacccccaatataagcaacaacgaactcctacgtggcggatggtcgagacggtcatggcgagcctctaactccccaccaactgccgcctctcgtcgcctcgcctcgccggcgccacctccgcattccgttccgaccagccgatcggtttcttcctcgccgttgcaaccttcgagcgcgatcgatcgaggcggttgaccgccgattcgccgcgcggcgttgcattgcacgcggctttccagttgataaatcaatcatcatccccttgatcgatgcgagtggcgttcttgttcgatcgagaggaggagatcgtgatcgcgagcgatccgggcggggcggcgcgc

SEQ ID NO: 4951 - DNA, 1501 bp, Oryza sativa
gtacttatcactgtaaactaatataggcaataatatgcttgtggtgacttcgttaattccaatatatactgggctagtctttcaaatgtactcatacggatagatgtgcgcgtgtgcgtttaaagcggagagtgtgcaggaaggatcaaaagatcgattttcatccttaggttaggttcttcgcgcgtgttaattgtcatatgacatgttctcagttccgcttgagaaagtttctcaaaatttttcctccggttttataattcttgatgttttatataaggttgaggtaaaacttaattctagctttaactggcaataactaatatttagttagaagcgctataataacatatattgttttgtcttaaaatataatactataataaaactataaatatatttattatatatattataaaaaatatagttaatgatatattttcaagacgttatcattatctaaaagataatatgaaagcattgcatgtggatgccacaattgtaaagacatggtttggtagcaagaagaaaaagcgaaatattgtttattcatctcaatgttatgctggtttcctcacctttaacatatactccatagtagtaagttatatcctcttttttatttggagtagtttgaactaggggaattatgtttctagagttctagtacctgattagtactaagtgattagttagtttagacacgatggtcagctaaaacagcagaatttccggggttgcttgatgtgatgttagctcatgctaggttggattggcaccttctaccgaccgtgcacgttcatcatctccaaaaaagaagaacacaaaatgtcaagtcaaccaagaccagatccattaccctcataaaggacacttataaaagagtgcaaacattttatcttggaccatgtgtaaatatatctttttaataactgttttacattctatttttcagaattgtgtaaatattcaccagctctgttgtttacttgcttcaccaacataccgcctgatatatcccgtgaaaacaaaaacggtaaaacggaaattcagaaaatctttcagggcgatttgattgatgctgaccatctcacctcaaccgtcggatgcagatcgtacggccgagagagagagagagagagaggatacgatgcatcagcaacaaaaaatggtcaagaaataattccagcatcaacgagctagatactagtggtagtagtaaagcgaaagcgaacaaaaaggggaaaaaaaaaagaaaaacaagagcgctgtgtcggagaccaccgccggaccaccaccgcgacccctcgatcccggcgatcccacagcattggtcggtccccgtcgatccggccgccgtggggtttggtctggtactctctggtggtggtggtggtggtcgccgtcgtgaacgattcctttttctgcttggattttttttgttgcttttggttgttgtgatccctgtggggctcgggttccggccggtgtaggggagggg

SEQ ID NO: 4952 - DNA, 1501 bp, Oryza sativa
tggctgcatatgtaacacttacatcatggtgttatacagaggatcacacatatattttctgtacattggatccatgtaccatctcatgagacggacttaagcctagtaaccttatcaaccagtattcttagacactcacgattaggagtaacgtgctcataagttgtaataggtcagtctcatgtaagtagagatgggctataagtgtgatagattgggagataaaacattggatctggtgattacgtacatatgttacacgtgtgcacggtggaaggaggggagagaaggaagacgacttcgctattaaggtagtagagatattgtgtatatattctagtagtttttaataaaattttgggcttgccatatcaccgcctatgttgaggatacacacactacacgttgagtgttaggtgtaatatatgacgataacactcatgaaatcttatctttcttccatcatctataacctgtaaatatctttgtaagtttattgatgatttgtctaccaacacatagagataatataatggatatataaaatgaatattcatattacttagaattaaccatgcaaagcaaataaaaatagtatctacctaccacaacaaaataatgttacatatttttctttggataacatatgagtccatataacaaggcaatatagtaaattacacacgggtatgagcttttggttgcatgtaacatgtatatataccatgggttatgcagattgcaagcaatatgtataccacatgtattctatcgccttggatagatttaaggcctgcgaccttggtcatcggcgtctagagacttccattgcgtattttgctaggctttaaatttttttatgcttgccagatcactacttatgtcgtttgtgagagactgcacagatacaatgagcgagcgtttggtgtaatatgtgacagtagcatacacgaaattctatctttcctatgtcgtttataggaaccacagatgtctcctaaagttgaccggcaacatctctagtgagagatagagatatccgttactaccaggccgaggtaggtgtaggtgggtataataaatgtatgaattacttcgaattaacgaagctataagatatagatattacctacagtaaaaaaagatataaatattttgctttgaataatagagttaatatacaacatggtaaattgattctaactaattctaatatgtatggtaccacattctcaaatctcaaacacatggtgttctcactgacacttgtaagcacacaaagcctaggcaacaccagggcatactggccagctacactctacggagggatcagatgccctctccgctgtagctaatacaaagctgtagagttagtgccttgctctatctccaacagctagctacacacaaaaaaaaaacacatttcttttaaacatcccaaagagaaagctaagataaataattatttctggattaattaatatcactcctgaaatggtgg

SEQ ID NO: 4953 - DNA, 1501 bp, Oryza sativa
ccatacataagcggcaatgcttttgccgattcttaaaggaaaaaatgtgaagggtggtttcttgtacaaaggtctgttcctttgataatttttgtggcttccgtgctctttcactgtagtttcacatctgctgaatttggtttctctctcacggttttactttctactgtttcttctttagggtgtgtttagttcgcgaaaaaaaaattttgggtgtcacattggatgtttgaccggatattagaatgggtttttggacacgaatgaaaaaactaatttcataactcgcctgaaaactgcgagacgaatttatgaagcctaattaatccgtcattagcacatgtgggttactatagcacttatagctaatcatggactaattaggctcaaaagattcgtctcgcgatttccatgcctgtgcaattagttttttaatctatattcaatgctctatgcatgtgtccaaagattcgatgtgatgtttttgggaaaaaaaaattgtgggaactaaacaaggccttatttcccagcttctgaccttcatgtcatgtcacgatatttcatttttcactgttaatgaacagattgcagagaagcaccctgtgcttacatgttaactgggtccttttggatgaaacagtggctactaaagaacttgaggagatgcaaggggtggcgctgcacgctaaattttgacacaaaagttgaaatggatctaaaaacccatatgtggattgttcatgaagtaatcagttagcttgagagcttgggttgttagaagcttactagattgtcagtggaggaagttcatgttgtgtggttaaagtgtacccatctggagaggttaactcactgttcgaacagtcgtgcctctagtcatgggctttacctcatagatttgtttgcatgtgctttgtgaaaagttgttgtggatgggggaatcattaccagaattagccaatgttgtaaatggataacctggtgttgacggtcgttaagtacaaactttaaccgtcaaatcttgcataaaagatatcaaatataatatcaaaacttagtggtaggtgtttactactaacattttccattaaatttggtaaatatatgtttataggtcatttatggatgaaaatacacccgccatgcgacaaaatgaaccttcaaccaatcgcaagcgagtacaaagattggagggttcacatgacaatcaaaaccgacctaaagttggaccaaaccaaccgacctaagttggtggtcagaggcggtgggaatggtttggccgaaccagacttcgcccccggcttaattccccccttgcacgtggtagcgtcctattggatggtgatgacggttataggtgaaccgacattggaacccaattctctaatctcaactcagtggtacggataggtggaatggagaaaaatagggaaacacagagggccaaggcccccactatttatatgtcttcaaattatattagtgcaaatatcattagggt

SEQ ID NO: 4954 - DNA, 1501 bp, Oryza sativa
tcaattataaagccccattcaccacatttgctagatagtcgaaaagcaccatcaatattgagcttcaggtatttttggttgtgttgtggttggattgattctaatatataccaaatcaatataattcactaccaaaatataccatagccatcacaactttattaattttggtagcttaagatggtatatataataaccaattaacaactgattctaattttactacggcccagtatgtaccaatacaaaacaacgagtatgttttcttccatcgtaatcgtacacagtacaaaaaaacctggccagcctttcttgggctggggctctctttcgaaaggtcacaaaacgtacacggcagtaacgccgcttcgctgcgtgttaacggccaccaaccccgccgtgagcaaacggcatcagctttccacctcctcgatatctccgcggcgccgtctggacccgccccctttccgttcctttctttccttctcgcgtttgcgtggtggggacggactccccaaaccgcctctccctctctcctttctttatttgtctatattctcactgggccccacccaccgcacccctgggcccactcacgagtccccccctccccacctataaataccccaccccctcctcgcctcttcctccgtcaatcgaaccccaaaatcgcagagaaaaaaaaatctcccctcgaagcgaagcgtcgaatcgccttctcaaggtatgcgattttctgatcctctccgttcctcgcgtttgatttgatttcccggcctgttcgtgattgtgagatgttgtggttagtctccgttttgcgatctgtggtagatttgaacaggtttagatggggttcgcgtggtatgctggatctgtgattatgagcgatgctgttcgtggtccaagtattgattggttcggatctagaagtagaactgtgctagggttgtgatttgttccgatctgttcaattagtaggatttagtctctgtttttctcgttgatccaagtagcagcttcaggtatattttgcttaggttgtttttgattcagtccctctagttgcatagattctactctgttcatgtttaatctaagggctgcgtcttgttgattagtgattacatagcatagctttcaggatattttacttgcttatgcctatcttatcaactgttgcacctgtaaattctagcctatgttaattaacctgccttatgtgctctcgggatagtgctagtagttattgaatcagtttgccgatggaattctagtagttcatagacctgcagattatttttgtgaactcgagcacggtgcgtctctctattttgttaggtcactgttggtgttgataggtacactgatgttattgtggtttaggtcgtgtatctaacatattggaataatttgattgactgatttctgctgtacttgcttggtattgttataatttcatgttcatagttgctgaccatgcttcggtaattgtgtgtgcaga

SEQ ID NO: 4955 - DNA, 1501 bp, Oryza sativa
tggagtaactatatatacaaagctaaaaaaattaattgttgttttctgtgtgtatatacgtagactatgatatggaaaattataaacttccggcagttgttactcccttcctatcccttttggcggctctaacaggcctttagatcaagtttaatagtagagtcaggccatgtttagttcccaaaataaaaattttcacgctatcagataaaatgttaatttggacacatgtattgaatattaaatgtaggaaaaaaaccaattacaccgattgcgtgtaaattgtgagacgaatcttttaagtctaattgcgccatgatctgacaatgtgatgctacagtaaacatttgctaatgatgaattaattagccttaataaatttgtctcgttgttttctggcggaatctataatttgttttgttattagactatgtttaatacttcaaatgtgtgtccgtatatccgatgtgataaccaaacccaaaaaaattccccaactaataaggtctcaactgtgagcttatgttaacatgtaccagtagaagagttacatggttattaactactagtataattttcttctcttctctctatctctcacttccttcggttccattattcttaatgttgtggacaaagttaatgtcaaacttcgtaactttgattatcaataactataaaaatatttaatttaaagtaattaaaacaacacatatagatttatctttcaaagtacaataagaaaagtaaacatgcatttgtttattatatatattataatagaaaaataaagtcaaagttatattttggagaccgtgtcattatccaaaacgtcaaaaagctatggtaccggaggaagtatgcatttaggttgtgtttagatccaaagtctgaatccaaactttagtcattttccatcagagcaacatgtcatacacacacaacttttcagtcacatcatctccaatttcaaccaaaatttaaactttgtgctgatctaaacacagccttaatgtgttcttgaagtactccttcctcccatactccctccggtactgtatatacctcatgttgatgcatgttgaggaagcgagcatgggagtacttcacatgaggtgagtacttcctatactttatattgaatgtattcttgacgttttggataatggcacgtcacatgagcttggatcagatgaaattagcgagtacttcatgttgaggagtatgcgttatatcttggtactgtggtacgaatatgtgaggaatataaaatgaactttaggtgcaacctgtcaaattaaaccttgcacgcagaaaggccacgatccggcacggaagctagtgggccgggctgcaaattccatcttattttatgtgggcctaaacgggcccatctactagccgcacgggagaagaaaccctagaaacgcttacctcctctataaatccctgcgagagccgccaagccgtcgacgcatagcgcccatctcctctccgcccg

SEQ ID NO: 4956 - DNA, 1501 bp, Oryza sativa
aaaaagctatggtaccggaggaagtatgcatttaggttgtgtttagatccaaagtctgaatccaaactttagtcattttccatcagagcaacatgtcatacacacacaacttttcagtcacatcatctccaatttcaaccaaaatttaaactttgtgctgatctaaacacagccttaatgtgttcttgaagtactccttcctcccatactccctccggtactgtatatacctcatgttgatgcatgttgaggaagcgagcatgggagtacttcacatgaggtgagtacttcctatactttatattgaatgtattcttgacgttttggataatggcacgtcacatgagcttggatcagatgaaattagcgagtacttcatgttgaggagtatgcgttatatcttggtactgtggtacgaatatgtgaggaatataaaatgaactttaggtgcaacctgtcaaattaaaccttgcacgcagaaaggccacgatccggcacggaagctagtgggccgggctgcaaattccatcttattttatgtgggcctaaacgggcccatctactagccgcacgggagaagaaaccctagaaacgcttacctcctctataaatccctgcgagagccgccaagccgtcgacgcatagcgcccatctcctctccgcccgtcgcctgtttcctccgtaatctcttcccgttttgatctcgttttcgtctgattgctctcgaatttggtttgatttctattgtattttcgtttcgctggtagacaaatagatgttggagcggtgatgagcaattttttgtggactagagtttctgatactacttttgtagtatttgaagaccaaacccttggctgtctgagctcctcattctatccatcgctacgaccattctgaattagatttagattgttttatatttctgtttgcggcagctgatttgagatcttggtagcggtgatgagcaatttttatttggactagagtttctgatactgctactttgtggtagttgaagaccaaacctttggctgtctagttccagatctcacaaaacatactgttgcttttagattattaggctgttgtttatccttcgattaggttttagatctcttgattagatgcgtccattaccaattccggaggattattcagttcttcacggtataatggctcggacgccagatgatattcttctgatgtgtggtcatatcctgattgttggcgttcttggtgccagtctaatcctggaaacgccacatatatttacatagtatttttttcgtttatgtgaattttgtcttttggggatctaaatgatgcgaaactctgaaaggaaagcgtccaatctgcggattgtggcgttccatgacatttctttcatattgaataggaagatctgatagattcctcaattgatatgattttgtttaaggttatttgctttgtgatttttgttaaattctttgtgcttttttttcagatgtggatgatg

SEQ ID NO: 4957 - DNA, 1501 bp, Oryza sativa
cgcggcgtagggcggcgggtggtgcgggtactgcggcggcggcggcggcgcctgagggtggaagccgtactgcggttgctgctgctgcgcctgcgcgtacgccatggccgcggccgcgtagtcctgggcttgccggtccatgagacagccgggttgggaggggaggggaggggagggaggtagggctcggagcgccggtgatggcggcggcggcggcggtggaggggagaggattcccgagactccgagagagagcgagagcttgtaccctcttctttgtgtgaaattacagaaacatccctcgtaaatagctgattttcgaaaagaggccctgttcttttcttgaacaaaagttggatgaaaatttgaatatttgcgctttttaaactactaaacggtgtgtttcgtgcgaaaattttctatataaaagttgctctaaaatatcaaataaatatatttttcaagtttgtaataattaaaactcaattaatcatacgtaataccatctcattttacgtaaaaacacttaatctttatattcatctttcaaacaccacattgacttgatagcaactgttggtttgtagccgaactcaaccaaatcagaatttagaaatatcttaatattagccatatgtctggtcaataacaaaaaaaaaaatggcattaccaaattacaaccgatgcgaagaacaacattattaaggggttgaagaaatagaattcctacaaaaagcctctaaaatactgtatgcacaaaggctcacgcgggattgaaacattctaatttaagcgcctatcgtttcctctatacaacatctgctgtcatatggtgcatttagccaaactagggatgaaaacggtcagaaacgatcggaaaacagcctcaaccatttccgtaatcatattcttctcagaaacaaaatcgaaaacggtaaaatcggaaatgaaaatggtatcggaaatattggaaaaccggaaacagaataatacggacgaaaacatgtcggtacagatcggaaaccggtaacaaatacggaaacattaaactataaaaacatatatttaactttacataaattagggttgtactatataactatattttagccatgcactcaagttagggatttgattgaagagtcaatcaatctttaacctgtgggtcaagtagatacatgccctataaatatcgacatatttagaaatacggtaattaccatattataagaaacggtaattttcgcaagaatacggtaaatacgaaaatgatcggtacaacagcaaaaccatttccgtttctgtttccatattttttaccatttccatatttttttggtcgattaccatttccatatagttcggccggttaaaagtcaaaaacgaacgccagtcggccgggaattaccgttaccattttcacctctaagccaaacgatggtggccttagcatccacagttcaacttccatctcaaagaaaaaagaaaaaggattgaagct

SEQ ID NO: 4958 - DNA, 1501 bp, Oryza sativa
aaagctatggtaccggaggaagtatgcatttaggttgtgtttagatccaaagtctgaatccaaactttagtcattttccatcagagcaacatgtcatacacacacaacttttcagtcacatcatctccaatttcaaccaaaatttaaactttgtgctgatctaaacacagccttaatgtgttcttgaagtactccttcctcccatactccctccggtactgtatatacctcatgttgatgcatgttgaggaagcgagcatgggagtacttcacatgaggtgagtacttcctatactttatattgaatgtattcttgacgttttggataatggcacgtcacatgagcttggatcagatgaaattagcgagtacttcatgttgaggagtatgcgttatatcttggtactgtggtacgaatatgtgaggaatataaaatgaactttaggtgcaacctgtcaaattaaaccttgcacgcagaaaggccacgatccggcacggaagctagtgggccgggctgcaaattccatcttattttatgtgggcctaaacgggcccatctactagccgcacgggagaagaaaccctagaaacgcttacctcctctataaatccctgcgagagccgccaagccgtcgacgcatagcgcccatctcctctccgcccgtcgcctgtttcctccgtaatctcttcccgttttgatctcgttttcgtctgattgctctcgaatttggtttgatttctattgtattttcgtttcgctggtagacaaatagatgttggagcggtgatgagcaattttttgtggactagagtttctgatactacttttgtagtatttgaagaccaaacccttggctgtctgagctcctcattctatccatcgctacgaccattctgaattagatttagattgttttatatttctgtttgcggcagctgatttgagatcttggtagcggtgatgagcaatttttatttggactagagtttctgatactgctactttgtggtagttgaagaccaaacccttggctgtctgagcttccagatctcacaaaacatactgttgcttttagattattaggctgttgtttatccttcgattaggttttagatctcttgattagatgcgtccattaccaattccggaggattattcagttcttcacggtataatggctcggacgccagatgatattcttctgatgtgtggtcatatcctgattgttggcgttcttggtgccagtctaatcctggaaacgccacatatatttacatagtatttttttcgtttatgtgaattttgtcttttggggatctaaatgatgcgaaactctgaaaggaaagcgtccaatctgcggattgtggcgttccatgacatttctttcatattgaataggaagatctgatagattcctcaattgatatgattttgtttaaggttatttgctttgtgatttttgttaaattctttgtgcttttttttcagatgtggatgatg

SEQ ID NO: 4959 - DNA, 1501 bp, Oryza sativa; identical to SEQ ID NO: 4955

SEQ ID NO: 4960 - DNA, 1501 bp, Oryza sativa
gctcctcatctattggactacatcggagctgctgctgtgttggtcggttttgctggcatcaacatacctgtaggcactccacagggttctcagcaagagcaggaaactcctatcgtcagtatggttgatgatccagtccatttaccaagtgatagaaatgctactagcatggttgatgatccagtctatttaccaagtgatagaaatgctactggtgctgttcaataaggaccggcttggctttggagtttgtcacaatgtatatttttttcgaggaaaattttcataatgtatattatcaagtaatgtataaggatgcgagatcagtacagttactgtaattgttcccccttgccatgaaaatcatagagaaggggatagacagggattgaaattagattaacatgctttccttgctcataattttgagcaactagccagttgtgttcgtttttgagttaagcatgattatgaaaacattcaagagattgaatagaacatgtgtgtactaaacattcaaaccactcgtgttcttttttcttttttttgtcgggagcttagatcacactcactttcaagagattgaataaaacatgtaccttttgagtcgggttctatctattattttgagtcgttccgcccatagggtggtgtcgtagatgcaccttggtaaatgcgatcatcttctagcaatgagccaatgagaagttgagaacgctaaccaagaagccacttgaattaggaggcaatgctaataatcctgatggtgaggagtgatgctttaggaaaacaagggaaacaaagcaacaagcattatgcttgtctttttcgcaatccctctcgctgatactcccttccaaatatccctcgctgacgggtgattctttttagtgaaacacttgcattgtgctagttctagattaaaaaaaaaaaaggttagaataactttcgctggctgtcgtccgctgccgcgccatcgtctccccccccccccccccccatctcgtgcagccgtccgccgccttgaagccaccggcgtcgcctcgtcggcgcgctacatgatcgagcacgcctcggcgtcggaggctgcgccgaagctttcgttgccgccgccgccgtagaggtcgtcgttgccgccgatgtcgccgccattggtcccgatgctgctgctgccgtcgagtccgccgccgccattggcgctgtgcccgccaccgccgttggcgccatagtgatggtgatgatggtgtacggtgacgtcgggtcgaccgtctccagccggcggcggacgcggacgatacagaggaagcggcggcggtggcttcttcttcttcttcaagctcttccagcactggctccggtagatgtaggcgccaccgcacgccgagaagagagacgcgatcatcgtaacgaacacttgaacccatgaccatgacttgcagttgcagacgaacacgcgacgctcatccccgccggaatggccgtcgccgccagaaccatcatt

SEQ ID NO: 4961 - DNA, 1501 bp, Oryza sativa
tgtggtaagcaatgacatggcctttaacctaacctgaattttttcatgggcacactgatagattaggtacagacactgccattgtaacagaagagaccggagcaggaaacttcttgagctgggacagtttcaccaattagagctggagttgagtttcgtccatccttgcaacccaatcagatagatagatattcagattccaactaggcctcgcatgcatgccctacccattatgaattgtgatagatacaatgtgagccatgcatcgtctactgttatactagctttgtgtccttgttgctactgctattcagttttaaattgtaacaggtagaatatcctactgatcaccaaatctgctgcgatttgctgcttcttctccaatactgaatgtttggagtggtatactgaatgtgagacaatttgttcagtacaaaatgtacagctgtacatgatgctgcaatctgaacttctgaagtactggagggtgtagcaactactaagtactagtactagcaagtgccaaaggaaagtgcagagatggacatgttcatcacagttgttcatgcattgcacattgggtggccatttaatctgcgttcatgtggaccatccattcttctccccttttcttcacattggagtactgaatacggattatggatggagctggatcatatgctagatacagacagagaggagagctaggaagtgttgtaaagaagcttgcaggttgtgataaggcctatcttggcatgtattgccatcttgaccaatgttacaggcttacagcaccagattgttgtgaatatgaaattctgaatgtactgtcattttttcagataatatctgaaactgagtaccccatcgtttagcctcgagcttataagtataagcgcaaatttgaattttaaaacttaattttagagtagtttattttccatcattcgtatttaaatcgctaagaacatacatgatgcatataaaagttttattcataaattattttttaatcattaataagacgtttcgcttataattaataatatgtataagagggacaatggatacacaatacattcatcgtttcgcttataaaagttagaacatactagttcagagtgtaattttttttcagatgaatcagtacatggtctatttttcagagtgtaattctttgattggcagtatcgtctcagatgccattggtgacttgatcacctactagatgctaacgaagctgtccattaccaaacttgtgtgtgtatatagtattagtacgttctcctctacctaccaaactcgtctgattattttcagttgcgtaactcccctaattataatggcgcctaaaccaaaccccaagtaaatacaaatacaaacaccaaaactgaacaacacactgaacatcactgtatttctcactgtctctctctatatatagccgagtgcactgccactcagagattgtcagagaaagcagctttgagcttagctatgg

SEQ ID NO: 4962 - DNA, 1501 bp, Oryza sativa
gttgttttaattactttaaattaaatatttttatagttattgataatcaaagttacgaagtttgacattaactttgtccacaacattaagaataatggaaccgaaggaagtgagagatagagagaagagaagaaaattatactagtagttaataaccatgtaactcttctactggtacatgttaacataagctcacagttgagaccttattagttggggaatttttttgggtttggttatcacatcggatatacggacacacatttgaagtattaaacatagtctaataacaaaacaaattatagattccgccagaaaacaacgagacaaatttattaaggctaattaattcatcattagcaaatgtttactgtagcatcacattgtcagatcatggcgcaattagacttaaaagattcgtctcacaatttacacgcaatcggtgtaattggtttttttcctacatttaatattcaatacatgtgtccaaattaacattttatctgatagcgtgaaaatttttattttgggaactaaacatggcctgactctactattaaacttgatctaaaggcctgttagagccgccaaaagggataggaagggagtaacaactgccggaagtttataattttccatatcatagtctacgtatatacacacagaaaacaacaattaatttttttagctttgtatatatagttactccagcaatattagacgattaataaggaagtaaggccagtttgcgtgctattttttccgtataaaaatgctatatatgtggaaaaaaattgataatataccttcctttggaatgatttgcatttatatatatgcataagaagaattagcacaaatatacccgtacagcacgatgggaatgcgggagtgctacgtaaccgccagccgggttgttcacgcatgttgaacgagcggcaccactgcggtccctgcggcaccgcgtcggtgccgtggtctgggagagcgggaacgtggtggcgaggcggtgccgcggctgtgtcctgcgggaccgtcgcgtccccgcagattggtgatgcgggatggcgcatgctcctccaatacatgcatgcttacgtgcatatgctttgcacgagccagccaatggaatgccggctcacaggatgctacactacgcacgtaatctaacttactgctaatgcatgcatgccactaatcccgcgcaaccaatccgcggaactgcgtcggttccgcacaactgtatcgcggcaccgctagactgacacggtcccgcgtcttcaagctgcgccgccggtgcggtggcgcgttcccgttcagcgggaaaagtatattttcacaacaacgttagaaacatgtatatatgtgtaaaactacgaaaaataatgcatatttcaaaatataattcatatatgtgagcttcgatcagcatcaaaggaaacatatattctttcttaaaacataccttccatatagaaaaacatatatatatatatatata

SEQ ID NO: 4963 - DNA, 1501 bp, Oryza sativa
tgatcagatacccagtactctgcaattaatgggagaaaacgagagatgtactggatatctgtttttctggaccatgcaactatgcgcaagtactacaagatattcagctcctgcaatggcttgcacgtagtattgtcatctagctaggaacctcaagtatgtggacggtagctaagctaggaatatcttaagtgatatgtatgcagtgttaattaagaatgcaacgttagacctactacggagtactatactacaacttcagaaaacatcaaaacatccatttaacgctgacatctacgtgactacatcaacacgagggtgtaattagctgtggcatgcagatgcatgtctacatcacaactatcattgctcactggtactacatagtatctatctactccatccatcccataatataaggattttgaagagatcgatgtgaggaggagggggtatatttgtatgaaaattttgagaatcaatgacgcaaactactagctagtgttggaattaatgaatgggccttagcccactcgaagattaattctttggaaaatcacaaaagcccacctcataggatggcatgcatgtggagtttagtaccaccttgcttattctaggagagggggacctccttaaaagggaggatgccctcctagccacttgaagcatgtgtggtggagagaagaggggaaacacacgcgcgctcgctcgcctcgcctggcagggcagggcagggggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgtttttctacgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 4964 - DNA, 1501 bp, Oryza sativa
  unsure (1)..(1501): unsure at all n locations
atttttatcctaatttatttttcagcattagcttataaaaaccactaataacatagatatgaaaactagctgggtggcccgcgcaattgcgcggctagcacccaaacaaaatcatatatttttcagtatgattttacttaaaatttattaaatagctatctcgttgtcttaagactttgaaagactaaatcttatcatccccgtatttctaatgagaaataatatagtttttaaaagtcacaccaactactacccctcacttctgtcatatgcttctttatttgcttgcttgatctaccactatttctattcattctccttgaaatatttaaaaatcagatcttatagtttttataatttctagaagccccgtcaaacgctgtcattatactcttctacgggcgtcaactatcttttctctatattgtcattgggattttaaaaatcgaacataattatcgttcgggttcattttttactttctaaagtcccgctaaaccgtcagcggctttgccattgttttcctttatggcacgcccgctgcctcccttctttatcgtcattgagattttaaaatcgaacatgattatcattgtgtttttttttactttttagaagttccaaacctttaaaaattagacctcgtagtttttagagtttatagtcttgttggtttcattttttataatttttagaagtctcgttaaacgatgtcactatactcctctacggcccatccgccgcctactctttattgtcattgggattctaaaaatcgaacataactatcattggaattcatttttttattttctagaagtcctgccaaaccgtcagcggctttgccattgttttcctttatggcatgcccgctgcctcctttctttatcgtcattgagattttaaaatcgaacatgattatcatttttttttactttttagaggttccaaacctttagaaattggacctcatagtttttagagtttatggtcttgttggttttattttttataatttttagaagtcctattaaacaatgtcactatattcctctacggcccatccgccgtctactctttattgtcattgggattctaaaaatcgaacataactatcgtgggaattcattttttattttctagaagtcccgccaaccgtcggtggctatcatatacaccccacccgctgcttctcctttttattatcattaagattttaaaaatcgaatatgattagcattgttttttttttactttttagaagtcccggcaaccgccttgattgattgcttcacagcctacccgttattaggattctatttggtgttttattaacagtttttatatgttgtatcaaccgccaccactctacttctttatagtcatgttacttaattaatctcgctatgtgttttagatggtattttctttcaatagtcttgatttcctatcaccaatnttagttatttataaatggtattcctagtatttttctttttct

SEQ ID NO: 4965 - DNA, 1501 bp, Oryza sativa
  unsure (1)..(1501): unsure at all n locations
aaaaaaaggaaaacctaatcatactactggaatcggacaatccgtctacctaatgtactggaaagagaatgtacaatcagtaaaaaagaaaagaaaagaaaagaaaaacctaatcatactatacactggaaacggacaatattttgggaatacgcgtgttcacaccacttttagaaacattgaaagacaacaatcctaatcaaactctgccgttttcgaattgtatcagtattgtcatgccaataaatacataaccaagccaaaaatacataaccacgttcgctgtggaggctagaaattcccgcattaatcggagaaaaagaaaagaagagtccaaataaaaatacaataaaaaatagctgaaattcggaataaaaaatatgcaatattgaaagagaagtccatataggaacccaatacgcgggtaattaaaactcggaattaaaagtgaataaatttcgaaattaaaaaagaaaaaaagagggagtgagttggaattccatttaaaaattactaaaattccaaattaaaaattagaaattttggaattagaggccttataaaattccattccagaattattaaaatttggaatggaaaaataaaaaaattcaaatttagaaaaaaagaaaagaaaaagttcaggtaggaatacaatttaaaattaacttaaattctaaattaaatataagcaggtgttgaaaataagagtacatataacaaccttagtagattaattaaaattcgaaataaaaaataaaataaaatccgaaattaggcaaattaaaaagagaggttaaaataggaatacaattttgaaacaactgaaattaaaaataaaaaataaaaatatcgaaagaacacaatatgaaaaataaaataaattttgaaattagaaaaagaaaaatactaggaataccatttataaataactaanattggtgataggaaatcaagactattgaaagaaaataccatctaaaacacatagcgagattaattaagtaacatgactataaagaagtagagtggtggcggttgatacaacatataaaaactgttaataaaacaccaaatagaatcctaataacgggtaggctgtgaagcaatcaatcaaggcggttgccgggacttctaaaaagtaaaaaaaaaacaatgctaatcatattcgatttttaaaatcttaatgataataaaaaggagaagcagcgggtggggtgtatatgatagccaccgacggttggcgggacttctagaaaataaaaaatgaattcccacgatagttatgttcgatttttagaatcccaatgacaataaagagtagacggcggatgggccgtagaggaatatagtgacattgtttaataggacttctaaaaattataaaaaataaaaccaacaagaccataaactctaaaaactatgaggtccaatttctaaaggtttggaacctctaaaaagtaaaaaaaaatgataatcatgttcgattttaaaatctcaa

SEQ ID NO: 4966 - DNA, 1501 bp, Oryza sativa
acgccggcttgcgcggcgtggcggcgtcggcgtcggcgtcgacgcagcagacgagcccccggtgcggcgagacggcctcgacgcggacgtgcggggaggggaggaagtcgagggacacgaggtcggccggcggcggcgaggggtgcatggaggagacgaaggtggcgtggtagcggttgcgcgcgacggtctggacgaggtagccggagacggcgtcggcgcggcggcagtggagcggcgcgaaggcgggctcgtaggtgaggcggcgccagcgggtggagacctggcggcaggcggcgaggtcgtcgagcgagacgcgtgtgagcatctcgaacacctggtcctccggcaggctgatgacgtcgcactgctccgacgaagacgaagacatcatggagaagagaagagaagacaagttggggcagaggcaggtactaggtgaggatctagctaattcagaactcgatgtgtgctagctgcattgcattgcaggcttgcagggcaagaaatgttggaattaatgaatgggccttagcccactcgaagattaattctttggaaaatcacaaaagcccacctcatgggatggcatgcatgtggagtttagtaccatcttgcttattctaggagagggggacctccttaaaagggaggatgtcctcctagccacttgaagcatgtgtggtggagagaagaggggaaacacacgcgcgcgctcgctcgcctggcctggcaggcggcgcgcgtgcacgacgtacgcgtcgaatggtccgaaaaattggctcctcacccttgcgcagatgcagcctccttttgcagttttgttttgctgcaaattcggattcgtttttgtgttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcatgcaatatatacgcaaaatcaatctagggtttgcctcctactctgtactgcgccgtcgctcgtagcctactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 4967 - DNA, 1501 bp, Oryza sativa
aaaagggagcgtgaaaaccaaataaatcgaaagtgttgtgttcggaaagagatcataaagttataaacttaataggaaagtaaatattatcatggttacaacgtgatatctctctgtatttaaaacaatagactaggttagacagttgacgccacttttacctataccataaatataactttattccaccaataatcaaataaagctcatatattcaatttaacacgtgtctgctaaaacagatacaatcaacgtttacactttcgatttcgatggaaatttcggtgattgtcggcagttctcgtaccatttttttgaaattttgacagattttgaccggagttaaataaactttgaccaacttcaacaaaaagaaattgagagaatccgaaaattttggtcgatgcattgatttgccggtgaggtcttcccaaatttagaaccgaaattgcaatcaccggatgcaattgtgactattccacgaactcttcgtggctaaggcctggtttagttgaggaaatttttttaagtttgattatcacattggatacagagacatatttaaagtattaaacgtaatctaataacaaaacaaattacagattctaccaagaaactacgagacgaatttattaagtctaaataatccgtcattagcaaatatttactgtagcaccatattgtcaaatcatggcataattaggcttaaaagattcatctcgtaatttacacacaaactatataattgtttttttatatttaatactccatatgtgtgtctaaacattcgaggtgaccgcgtgattttttttaactaaacagggcctaagcagcagcagctagttagagcatgtacagtagtagactgtaacccactataaatatattttagagaaataaaagaagatagagaaaagcagtggactatagatctatagccagctgtaacacaaactccaaaacgtaatatgtgtatgataggtgggatcagctattaataatatagcaagtactattatatgaattggttattacattagttatagaagatttgaagctactagttagctatattattaaacttgctcttacaatcagttacgagtagtatagtagcccatagctaagctaggtgtcaggcgaggcgcgcaggattttattacagcggcgagcgagcgcgacggcggcggcgggtaggtcgctcgccccgccgccgccacatgtgtggccaccgcacgcgccgccgccgcccccgcttccgctttgcacctacctaatccacctctcttcccatcccacgggcgcgccgacgtggcggcacccaccgcctctcccgcgcgcgccaacgccaacgcgagaccaacaccaaccaacccaacctaaccaaaaactaagttggcgcctttcccttccctccccgcctatataatcccctcctcatccacccgccgtgcgccacccacgacgacgacgactcgccgccggccgagaccaacagcga

SEQ ID NO: 4968 - DNA, 1501 bp, Oryza sativa
ggacatgtcatgcaaggaaggaaggacgagcaaggagggcggtggcgagcgcgcgtgaaagaaaccaaaggcttggtggtggcgctgctgctactcctaaagaaggaggtggtggtggaaggagtggccgcgcgggaacgaagggcatccgtccgtacggccatggccgctgtcaaaacggcgcgcggtcgcacgcggatttggcgcgcggtggtgcaagatcgagaggagcctaattttggaaggaactgacagggatgccatgcaactgcagcaaattagtgctcgttcaaatatgatcaagttagatttaactatgaatctgtatgaatggtttgtgagcacaaaccaaatcagtttggaagatgaacaggtaaggcagttgctggattgcagcggtccagtaatctgtactccctccgtattttaatgtatgacaccgttaactttttaacaaacgtttgatctttcgtcttattcaaaaaatttatgtaattattatttattttatttgtgatttgatttatcatcaaatgttctttaagcatgacataagtatttttgtatttgcataaaaaatttgaataagacgaatggttaaacgttggttaaaaagtcaacgacgtcatatattaaaatacggagggagtagtaatttggattgccattgataagattttttttttggttttgcacacttgagtccaaaataagtattgcatggaatatttaaatccaaccatgaatcgacgatacaattcaagtaaatgatctgcgaacaaaaatcaaatcagtttaaagagatcctcttattcagagtatatacctcggtgttaaaagtgaagaagaaaagcgaaaggatatgtagcctaatgtttaccagagcctcagtggcatcttaggtcctgggtttgacgtacccgttgacagcgagacacctgtagtgacttcattaatctccatgatgaatttgctggcccaatcttcaaagatgatcataggggtagagtttgcgtgcgtgtcagcgtgtgtttataggagtgagtgtgtgtgttgtgagtgtctatgttgtactgtgtaattctaaaaaaagtgaagaagaaaaggtgtaagacataaaacaaaacaaaacaaaacaatatttttttatttcaaacaaacaaaaagagaaaataatatttgagagaaaataaaaggggacgtgtcaaaaaagtaaataaagaaggtgaaggaaaaaaaaattgacaatgagggcccacacgccttaatacagtcatggcagtaggtgtaaaactacagtaacagcagacgacgactcgagggggcggagcaaccaatcgctgcctccccgcgttatctcttctcccccacacgcacagtagccagtgagtactagtcacaccacacgcttggcttgacgccgcacgcctccgctccgctccgccgccgcggccgatctctctagggcttccaacctcgccggcgacgcgacgccacgcca

SEQ ID NO: 4969 - DNA, 1501 bp, Oryza sativa
ggcggaaacgacagaagaacctccttggtggctggtgccttcttcgtgtgcctcaagatctttgccatgccttcttgatgctcaacagccttgtccttctcgcagatccagtcgtcagggatgtggaactcgagggagatggaggagggactgaaggtagcagagcagtgggttgtcggccttgtcgaggcgggcaatctccgggcggtcatggagcgtgcgaggggaggggcagcggcgtcggggcagggggcagcggtgtcgacgacgcacgccgggcagggggagcggcgccggcgacggtgcgctgcaaggtggcggcgctcaaggctaggtcatgttcgctccgctccgcctccgtatcggtaacgcgtaacgcccgatctggagcgtaatcaactttgtattgggctgggattcgtttgcgggctaaccgattacggtccatctaaaacaaacagatgtaagggaatcaattcacgctggtatctgatacgggccgaaaacagcccaaccaaacagctccttactttttgagcaagcttgaaggatgttgcgtaatagaatcttcagttgattacttgcaggaaagtgcatgcatgttttcttggcctgcctcacgaaaacggtatgtccgacaatatgagccacatctatcaacatcatccatgcctcttcagtcttagctcgcaaaaaaaaaaatcacaaacaaaatggaaaaaaaagcattgcacactagtgaaaaacaatactaagattgttatacaaagtagccgatataacgaaacgactaattttcttgatcgggttcaatcattgcttacttaaaacatgtcagatgatgatgatatatagaaacacacgatatttataatgaagtttagtgaaagcctacatcttcggagctctgattataggtgctcctccctaatcaacatactaacatttaaccgctacgagtccatggcctcgtctctattatctctctgagtatttacgctacattatagttatcatctgacacgttttgggtgattgatggataaaacgatcgagaatgctagttatcgttccgctatatcgattaacttttataacaaggacgatgaaggatgaacgtatcaggttatcttattattttcttttcgaagagggaattcctctgtgtcccttaaatcagcatgggccggagaagacaaatggaccgtcgtatcttacactccggaaaagagaagagaaatggaccgtcgtactgacaagttactactcagcccaccaacacctcgggccggaagcaaaacggcccatccgcgaggtcggcccgcgccggacagctggccgccacgtgggccccaccgtcgatacactcgatgcggcggcgtcgccagctgtataaataccccgcggcctcgccgagccggccatcctctctcctcctcccagtcgctgtcacgcgcttcgtgctcgccgccttccaccttcgtgctaccccccgccatgg

SEQ ID NO: 4970 - DNA, 1501 bp, Oryza sativa
gtactcggcgtccacgaccggggcggccatggcgtggcgtcgcgtcgccggcgaggttggaagccctagagagatcggccgcggcggcggagcggagcggaggcgtgcggcgtcaagccaagcgtgtggtgtgactagtactcactggctactgtgcgtgtgggggagaagagataacgcggggaggcagcgattggttgctccgccccctcgagtcgtcgtctgctgttactgtagttttacacctactgccatgactgtattaaggcgtgtgggccctcattgtcaatttttttttccttcaccttctttatttacttttttgacacgtccccttttattttctctcaaatattattttctctttttgtttgtttgaaataaaaaaatattgttttgttttgttttgttttatgtcttacaccttttcttcttcactttttttagaattacacagtacaacatagacactcacaacacacacactcactcctataaacacacgctgacacgcacgcaaactctacccctatgatcatctttgaagattgggccagcaaattcatcatggagattaatgaagtcactacaggtgtctcgctgtcaacgggtacgtcaaacccaggacctaagatgccactgaggctctggtaaacattaggctacatatcctttcgcttttcttcttcacttttaacaccgaggtatatactctgaataagaggatctctttaaactgatttgatttttgttcgcagatcatttacttgaattgtatcgtcgattcatggttggatttaaatattccatgcaatacttattttggactcaagtgtgcaaaaccaaaaaaaaaatcttatcaatggcaatccaaattactactccctccgtattttaatatatgacgtcgttgactttttaaccaacgtttaaccattcgtcttattcaaattttttatgcaaatacaaaaatacttatgtcatgcttaaagaacatttgatgataaatcaaatcacaaataaaataaataataattacataaattttttgaataagacgaaagatcaaacgtttgttaaaaagttaacggtgtcatacattaaaatacggagggagtacagattactggaccgctgcaatccagcaactgccttacctgttcatcttccaaactgatttggtttgtgctcacaaaccattcatacagattcatagttaaatctaacttgatcatatttgaacgagcactaatttgctgcagttgcatggcatccctgtcagttccttccaaaattaggctcctctcgatcttgcaccaccgcgcgccaaatccgcgtgcgaccgcgcgccgttttgacagcggccatggccgtacggacggatgcccttcgttcccgcgcggccactccttccaccaccacctccttctttaggagtagcagcagcgccaccaccaagcctttggtttctttcacgcgcgctcgccaccgccctccttgc

SEQ ID NO: 4971 - DNA, 1501 bp, Oryza sativa
ttctactgttctagtatcacattagctgtatgtcttgaatttgtctcagtagccagtatggggtgttgaaatgagtaaagatgatttcgatgagaaataatctccaatgcatagttgcaaactcatcagagtttttttttctttactttctgtaagagattttattacaatttccctatataccatgaacataagaattttgcgaagccgtatgacaaaaatccaggctagtaagccggatggtgacggggcgaaacaaaaatcccttttcgtgccaagggaaaacaagatacgcccgttctttattaggtggtagtacaacatatcaatactagaaccaacttttttatggagaacccaaaggaccaatagttttgttaccatccaagtagaatcagtaaatcccagtaacgactaacgaattcatcatcactatgcggaaatctactcgtagcctaacaaggcggaaatttcatacggatacaagtatattgcagccttttcaacctacacaaaaggcagatctgctcggatctgctatacaaaatggatcagtaaacgcacacaaaagcacttgtgccacccacccgaaagcgaaaagggtaaaaaaaaaaagaaagaaaacttttcgccgttctcccatctgaatcgctccaccaaagggcacgaagctaaacccacagatcggccaaagaaacaggcccgagatcaagccgaaagctcaaaaaaaaaaaaagaacccccagcacccagaaaccagtcaggcacacggatcgatgaatcgatggatcgatgtacggcagaacaaggtggcgggtggggggatctgaccttgacgggggtggcgaaggagagggcggatccggcgagggaggaagccatggcggggggtagcacgaaggtggaaggcggcgagcacgaagcgcgtgacagcgactgggaggaggagagaggatggccggctcggcgaggccgcggggtatttatacagctggcgacgccgccgcatcgagtgtatcgacggtggggcccacgtggcggccagctgtccggcgcgggccgacctcgcggatgggccgttttgcttccggcccgaggtgttggtgggctgagtagtaacttgtcagtacgacggtccatttctcttctcttttccggagtgtaagatacgacggtccatttgtcttctccggcccatgctgatttaagggacacagaggaattccctcttcgaaaagaaaataataagataacctgatacgttcatccttcatcgtccttgttataaaagttaatcgatatagcggaacgataactagcattctcgatcgttttatccatcaatcacccaaaacgtgtcagatgataactataatgtagcgtaaatactcagagagataatagagacgaggccatggactcgtagcggttaaatgttagtatgttgattagggaggagcacctataatcagagctccgaagatgtaggctttcactaaac

SEQ ID NO: 4972 - DNA, 1501 bp, Oryza sativa
gggacaccctggctaagtaactagtcggttcagggaaacctcgcatgccaatagttgggaacgccggggcggggtcggacaaaccgggttcctggtaatgcaagaacgagaagcttgctgaattaccgatcgaggtggttggagtttgatttgtgaacgcctaaaatggcctatatttatgtgaggatttgatccttctatgtggcatgaggtatccctgggtcggcttgggaaaggctttgttgcgaacctccgataccgacgggtgttcggaataagttcgtatcttgtgggtaaagtgtacccctctgcagaggattaactaactgttcgaacagccgtgcccatggtcatgggcggatgtgaggtggttctcgttgcgtagatttgtttgcatgtgctttgtgaaaagttgttgtggtgtgggaatcgtaaccagaatcagcctatgtggcagatggatgacctgagtggtcaagaaacgaatctgtgtgattcgggatgtctatgggcatcatagtctaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaaatgagctgttgaaaaacatctctgaaagtcgaatcgagacgcaagtctcttttcggcccaaacttagaaagaaataaatcacttagtgatttcaaaatgtcttcaaataaaagatttgcaaaacaacattgcctctcttccaagcttgcattaaacacctaaattcccgtgacttgctgagtacgaaagtactcacccttgctctatataaatatatatagttcctccgccctgaagttgaagatgaggtgaagtgaagattagggtttcgtcctggttcccagccgtcgcctgtggtgttgggtgttagaccgttggttccgctgctgctgttgttgttggtgttcgcctcgtccgtgtcgtcggttgtattctcgggctgtctgagctgcaacctaagttaaggtaaataagtcctctatttattttaaggatttgcaatgattcatatttgtcaccgtgggtaccagcactatgtcctgggactggtaccgagatcgcggtttcgtaggaagcggtttgcgccgtttttcctacgacatgccccctatcaggtgccgttgtgcggcggtgccggattggggtgtgacactatttgcatatcttttcaattgcaggatcaaactgactggcacgcccgcatctcattaatctttagacctgcacaggagttaagcagatctcccaggccggtgtattcgatttttttcgtcaacactgttcattcaaaaagagagagagagctttatttctacgtacggactgaagctgcctccaagtcaagtcgttgcatgtgttccttggatctgatttggatcatgg

SEQ ID NO: 4973 - DNA, 1501 bp, Oryza sativa
tagatgactttgtggcgactgctgagattgctcgtactgctgctatctttctcgtctttccatggactgagtccagtccaaggacaaaggccgagacagacaccaatgtgctttgccaggagtagagtatatggtgatttgactggtttcttcctttcatggcgatgcacaaaggaaaagctcacgcctatttgcatcgagctgctttgctgttattagccttttggagataataacaactcctgtaaataaaagtttagggcccctttgaatcaaaggatttatgtaggaatttcataggattcaaatcctataggaaattttcctatttggccctttgattcaaaggattgaaactttccaaatcctatgaaattcctatggaatgacacattgtatgtagattttggaggaaatttagcaagagctccaacctcttggaaaatttcctttgagtctatctctctcatccgattcctgcgtttttcctgcgctccaatcaaacgaccatttttgtgtttttcctgtgttttgcaatcctctgttttacacttcaattcctgtcagaatcctatgtttttcctattcctccgttttttctaccctgcgattcaaaggggcccttaggggttagccagagctaagctagtgtaggagtactaattaaccactatacaggagtactgtcttttcttttctttagttgtttaaaggttgtcacctcatgtggagtaattatttgtatgtatcgctacctcctagcaaagctaataatacaggcaactgcttactgtataaatcattatagcttatctcagctgactcatatagtggttagctcttcactataaatatatggtccacttatccgtcttacagatttttttttcctatgcctaagccgactgtaagtttacatcttacttttcatctctcatccacctcagcattaagcgttcttacagcccactattatattttctctcgtgacatcagtaatccgtagtcctatcgtctatcgacactaccatattcatcgtacacgctgtttctagcaacagaatcatgagttacagaaacaagctttattcaaagagaaccttttgcttaaaatctgaaaatttccacaacatataggtagcaaccataactatacagtaacaaagttgcagagattaacttcctcttaggggaaaaaaagaaatccttctaattaatctctgcacagagtattcagataagtgaccatgctgagatatccaaatgacaagttgccttttgaaaaaaaaaatcagaaaagaaacctcaacttcaatacggctcatttagacattcaggcccaacaagcgggctccggcctctgggcctgatctgagctgtatttgggccttacaaatgagctgttaactcggatgggcctaggcccacaccgtgtgggctgcttgcagagaaaccagaagcagaagcagacacagacctcgtcgcctccagatcgacggcg

SEQ ID NO: 4974 - DNA, 1501 bp, Oryza sativa
aagatttccccatatatcttataagtgaaaacgctcctcacaagtttaaggaaaaccaagtaaaaaccaataactttttatccgtataaataccatctaaaaatcccctaaaagaacaagctactcccattgatttttacagacggtctcggtggttttgtaaacattagaggatctccaaatcaccaaatgtacgtaccagctgctgcgtgcatcggtccaccgaggtggtcacgtcgccgtcgtcgttcgtcgtcaaatttttgtggtagtgtcgtagtagctgccacacgagaaccatgtcgtgattaaacaataaatactgacagtccttgctatatctagctacttctctaattaattaatcagcctgcgccgatattgttcttttcaaaattcgattttaaattcagtcatcaacagcgctccagctggttttaatttcaagtaggtgaagttgtacttgacgtgttgtatataatactctcgtttggtaatcgaacagtacgtacatagcaaacgtgatatctgacaatgacagtcgcaactatataattaacgattactcctcgatcgaattattcacaaattaaatcgatcaacgcaatattgataagagatcgcgacgaccgtggcaactggcaagtggcaacccacttatatattgaccgtgtgctagatacgcactattaacgatcacactattgtgatgcgaccagagtttatagaaccatataattatcacgtagttatatttacgataaccttctcggttttaaaattatggtatacctcataataatcgcatatttttcacggtaaccaccaaatcgtgaggtgataaacatgtttttttttcttattaagttatttttagataattaatggataaaatctgacattggcttcaacaaaagctacaactactcgttacaaaattgtcgctcatcatgaccaataacaaaagaaagtggagtacgtagctaacaaagggtaaagagaagacaaatataaatccatattggtcacagttcagcaatcctcctagctaatgaatctctatccaaaataatatattaattcatattagtcataactaataactttgccttacacgtgtgcaatataactagtatgtgtatgaagtggtcatatacatcgatcttctaatgaaaaagaaatgtagattaatttgcattatttaaaaaaaataattatgaaaaatgaatcgggcaagatgcaatggtccattgtatgtattaagtttgagagttattgcaccagtgtcttctagacccagttgctatatagtaggagccaactcatatcgatcgtcgcgtcaaacctctccatcggtcgattcagagagagatcgagatcagcgtgagagagagagagagaatgagcagtacgagtggatctgcatgggatcacagcaacaatggaggcggcgggtcgccggagttgagggaggcgctgctgctgggtgacggcgggtcgt

SEQ ID NO: 4975 - DNA, 1501 bp, Oryza sativa
ctccagcgccggcggccatcgattcccctgcacctccggcaagattggcacaaaaaggtgagaatttcccctacctctgtcgcccatcatccgcaagggtctccggccgccgccctcacgagtccgccgtccacatggtgtcgcacgacctcccgccgtcggtctgcacgttgctatccacacaccaccccgcacagccatggtcctcccgctgcagagccatcgtccctaccgctgtccacccgtatgccgctatccgctcgccggcaggagagccaacggctgcccgcccccacgctgccccattggcccaccggatggagggccgccgcctgcgcactgccggagggccactactccaagccagcccacacgccgccctctgctcgccgccctttgccccctagagttttctggattgatctaatctgtgtggtaggagtactactagcagagaagtagtagtattatacttgaccactttttgtgctggatattgatttgttttatatattttttagaactgtaggagtagtagacttcttcggtggtagagaagaatctcaaacactgtgcttgtactagtagcactgcactgaactgtcgttgctatggatcagtagagttatcggttagtatgtagcacttctttttataggctttgattattatgaatataattgtctagtttgttatttgagatagtggaaattaaattttcttatggaacatttgtgggcgcttcatggtgctcgatagtttgtttcgttgcattttttgtcaactatgggtcgtgttcaatattttcttgtaggacatgtcattctcatgttaaaaaatttgaattcaaatttgaatcatggtgtttaaaattgtaaatttcaatatggttgaatttcatgcgctagaattatttatgtttaaattattatggtgttaaggtagacacaaacatacaatttatactaaaataaaagagaaaaagaaataggggctaaaatatagggggctactgctagagttaatgctatttttagagtcataaagaattggtggcagcccccatttgatctttaggagctctaaagtaggggttactgctggagatgttcttagatgtcttttcacatctcgaaaggccacaatgctgtgcacttaaaaaaggccacagattctatgacccaccggcccacatgtcagcgtcctaaaccaacacgagacgcagcgctcgcaaccgtatcagaaaagaagaggcgtcctccaatcagagctcgagacgaacccaattactagcagcaccaaaatataatcagatccgaaacaaaaagaaaaacaaaaaaaaacacgacgacatctatttaaggcaggatccacctcacccccgccccgcccaaatcgctccctccccttccctccccgaccagatcgcgacaccgccaccgccgatccgaaggtcggcgacgacgaccaccaccgccgccgccctcgtcctcgccgccgg

SEQ ID NO: 4976 - DNA, 1501 bp, Oryza sativa
gttcgccattggacgtgatgagatgaaccaagtcggcgtatgatacacctctttctttagatcggcgggatgttcgaaaacgagaagcccttgtaccctttgtaagcatagtaggcaattcttgtgtagtagaacccagggatgaacatcacaatacccagaatcatgaagaagattcctgttccaacaaaagggaaatggcttcaggtaaagaaagaataaagtttcaacagcaaaggttctatcttctatgcaaggggaaccctacctattgtatgctaaacaaatgttatgttaccaaacataaaacttgatgactgaatcactttgtgcccacccacttaaaaatgttaaaagtttttttagcctataaagttgtcaaactagagaacccattcgaatcttaaacactactccagcagtcaagccctgttgcttccagtgattgctatctggagcttttggatataaaatgccagtatattacaaaaacttgatacatgaatgaatgtaattgacaacaaactagtagcattaaaataaatgtatgttctacgaactgtcaccaaattgcaatgcatacataaagtacattatttcccccaattgccacccagctgtagtaaaatgcatgtggttgaccaagtcaaaatcaaatgagaataccagaagtaaattactaataataataaatttcctctgagaaattaccaaaatggatgattgcgcagtcaaacaataacccccttaatttcatcctcacaacccaatgcactgaagccaaaccacaccccccaagctagaatcccgcaagatctctactaccacagcatcaattggggggaaattgtatggaagcccaggccctagacgcgcgaattaagaggagggcgctcaccgtgcgcgcggtcgccgccgacgttgttggcggccatgaggacgccaccgatggcgccgagcgcgccgaacgcgaggagcgcggccgcgaaggcgatctccttgacgggcgcgccgcgggggccccccacggcgccgccgacgaggtcgtcctcgtcggagatggagaaggcgtggtccacgtacgccatagctcccccccaccaccacacctccgctccgccccccggatccgatccgcccgcacctggcgcttgccaacgcggcggctgctacgcctcctcctcgcctcctcgccgccgccgccgccgcgccgagggtttggtcgcgtgggtgtgggtagggttggatggatgtggagagagagagattgatgagagagaaaaagggtgaggaggtggatgcgggtacaagcaaggtggaggagaagacgagaggaggagggcgagaaaacaagcggcggctttggtgttggtggacgtcgtgtgtgtacgggtcaacctgcctggttgggctgtggccagtggatgctgggcctatatttttcggcccatgaaggaatatatttgggccctggttgggctagattgttcggcctacgagg

SEQ ID NO: 4977 - DNA, 1501 bp, Oryza sativa
tgaatgtttcggatcggtttttttggcttttgtaataaacagatcgaatgtggattaccgattgatgcaatggtcgaatggtaggagccttactaacgagagtcacaactcaggagattacagtgactaactagacgacgatgatgcttctaaaattgatggcttgtggctggtgtgggatgtgacgtgccttgtgaacttaatgtataggtctggacatgaattagtgaggctaaggtggaattacaattaagtacggtattttccgggtttcaatatccttcgcctacaaaccaaactaactagtcaacaatttagcattgagatttagtaaaaaaaaaaaagaaaaacccgacacaacgctttagttgacaggttttcaagaaatttccgcccccctattcttatagaactagaatgtaaatatgatagagacaaaaagacaaagtaaaaaaaaaaagaaacggaaaacacccacagtcccagccacagcacatttttggtagcttgtcttttggctagttggcctggctctggccgatcgagaggatcaggaaaacaatcggacttgaaaacaaaaaccagctacagccgacagggtcgtcgctccgttccaccgttggttcgcaaccgaaccaacgcgtgcccgcacgacgccgtgcgccccagatacaaagtcgccaacgcgcaatttatttagcccagcccagccaagaccgtcgcgcgtgccacgcacccagcacgtacgcgtgacggagacaccgagccaatcgcgccggttcgatcgagcagttgggctcgttaggtcaggtcaggtcacccccgcgtcgtccgaccgcgacaccattcatcacacaagtcacggtctcgaactcgactcggccgcgacgtcgacgacgagttcaccactagcccaccaccaccacgactacactctcccggctccgagacccgccggaaaatcccccgggaacttcggcgcgattcctctccgagttaaagcaaaaaaaagcggaagccgaagcgcccccgcctccgcgtcgtctgcgtgaagcactccccctcttcaagcgggaaaagcgggggagggaagcaacgcggaaattaaagagcagagcagagcagagccctgagccctcgattcgcttcgtttcctacggcggacgcccattcctcccccaccccctccccccactccgactccgccgccgccgccgccgccgccgcctccggctccggctacagctcgccgccccccaggttgctctggatttttgcgcgtgtcgctgttggttttggggggcgaggggtcgggggatgggttgggatttgtgcttgttttttttttttgtgcgtgtgtttatgctgttgctgatgagggtggtgtgggaatgtgcgtgcagatcgggggcggccgccgcctggtggtgtccgtgtcatctctcctgaggaatcatgccggtgggagtgcaggcgcccgaggcgtcgccgggaaggtacc

SEQ ID NO: 4978 - DNA, 1501 bp, Oryza sativa
ataccaactatattgcagccttgccgtgacagaccaaactgctcctggcaggctagcatagcaggccatgctagacatggttgaaaaggaaaaggaataagttcacattaggtctcttatcttgacgtcgagtttgaatcacatgcttgaattgtaacaccagatgtaacgtttacctcaacttataaaatcggatcactcgaggtcctaggacagtattttgtcaggttttagctaacatggtgagttgaatacagtcaacccagccgagttagcatgggacccacatgtcagtggctaagtcttcttccatctctcttcacctatcctccccatcttctccaaagcgacaaccgatacagtaaagggtagcacgtggcgggaagaagggcatcggccgatgggagaggagctagggggctccgcttgttcgtccctgagctcgatttaatgatagccgaccttctcaccttcttccgcttcatcaagttacgggcggagcacgtgaaagccgttaggcttcttgtttggggagtccatgggcggggccatctaccttctcattcacctctgcacatcgtcggaggagtgggccggccagcacgtcctggtggtgccccatgtgcgagttcttcaccttcgttgcatggttcgcgccgacactccccatcatgcccattttcgacctcaccgagaagtccgccaaggcaccgaccaagtgccttagctgtatgcaacccaatgtactacaacaactggccatggattgggtctttggtgcagaccgcagggcacccccttggagaatatggggaaaagagaggggagatgggaagagaggaagaggaaagcgccggccgtttacatgtggggtttgttgttggctccgccaggttaaacatggtcaattatccatgttaaccacaatctagtacaatactgctctagaacctcaattacaccagttttacaagttgaggagcacgttataactgatattgtcgttcaagaacaccattcaaacttaacgtcatgaggagccaagaaatgaacttagaaaaaaaagaacacaacgcccaaatattttcctcgtaggccgaacaatctagcccaaccagggcccaaatatattccttcatgggccgaaaaatataggcccagcatccactggccacagcccaaccaggcaggttgacccgtacacacacgacgtccaccaacaccaaagccgccgcttgttttctcgccctcctcctctcgtcttctcctccaccttgcttgtacccgcatccacctcctcaccctttttctctctcatcaatctctctctctccacatccatccaaccctacccacacccacgcgaccaaaccctcggcgcggcggcggcggcggcgaggaggcgaggaggaggcgtagcagccgccgcgttggcaagcgccaggtgcgggcggatcggatccggggggcggagcggaggtgtggtggtgggggggagcta

SEQ ID NO: 4979 - DNA, 1501 bp, Oryza sativa
ccagtctaaaggttgtgatttgtgacaagtcggtccatctgcattattgttgttgtagagtagaaaaatatacaaaaagaaaaaaaaacgtgctaaaatatatttataggattaaaaggacatctagtcatgatcctgaatgagttgtttgctagccctagaaattcctcccagaaacatataattaattataacaaatcgctcactaattcgtttcagtgatagacaggcttgagtatttcgccaaatgatatgattgccctatcaatcacaaccccacaagtagtcgtaaagttcaacagaaagttgtttttgatttcttgatttcgacgccttagggtgacaacatagaaaacacaatatatatatttttgtttccataataaaaaaaagtcttacagttacatgtacagcatagtttatatagacagggtcacataacataacataataggcaataatctaccaatacaatttacatcatgaacgtagcaaagacggaattaattagtatttaagcacaaatgattccgagcaagatgcaacgagttaagctaggctattggtacaccatacacaggtagaaaaaagtgtacaacgatcaacaacataaaaaaaaaagaaagaaattatatcgcccaatgatgaagtacgagagggacatttcaaccaaaagtatgatgttgcatgtaacaaccaatagaaatggacctaggtttttcggtattgcacaaggcaggcaggcagcagggggcgtgtgcccacaccaaaggtaccaacctgaacttgcagacaagcgaaagattccaatacgcataaaaaagttgctttcaaacaaatctgtaaaatcattcaccccttgaaacttttgcaatgcagaaagcaaagaattattgatggggagttcacattattcaatctccatctttacatttttcctttgacaccatcgtacaaaagtcgggcatacttggttgttctgagacgacatgatagctgctaactatttttagcatgttgttgagatgtatcactatgcctttgaatctaaaacagaaggaagttggctgacatctagaacatatatactgtacataccatatggaattggcaacatagaactgtatcaagaaatgattaatctatctgtattgctgtctattattagggttccattttattacgatgtggtactgattaggagggaaaagactttatttagatttagggacacaagaatgagagcacaagctacactgagcttgccaaataacaaaaggttatttgagacactgacaatgaaacaagctgcaaaccacagaacagaacacaaggcaaacatggaaatctcagtttataagcatatgccactggcaaaattgacttgttgctccaactccatatcgtactataattcgctcgcaccttgttttcctcttctggaaaggagagcatctgtagcccctggttagaaaaactcaacaaagcgttcatagggcat

SEQ ID NO: 4980 - DNA, 1501 bp, Oryza sativa
gtgtcacccttgtcgcattgacctccgccatcgccggcgcacctcctcacaccgcgtcagccttcaccgccacctgtcgcgcctcctcgtgcatgctgtattggcatctgtcgccgccgtcgccgtgagctccgccgctatcggaaccacccttcgccgcgacgtcggcctcctactccactggtcacaaccaccgtgccaccccgcgcctcactgggttgcgccataggtctgcctcagggaaggggggatccaccccgttgactactccagccattgcctcccgtcggatctagccattgccaccgccgaccactcccgctaccgccacctctccaactcgatctggccaggggggaccagatccgccatcgggcgaggcggatctacctccgacgtggctggatccgccgcgcttaccacctgaccactgcctcccgcgacctgccgctactgggattactcgtggggagagcgtcccgccaccaccgtccttgcggtcagcaacgtgacgaaggacgaacggtcaaacatatgctaaaaagtcaacggcgtcaaatatttcgggacggagcgagtatcatgttctacaaaatggcttagaggctattgttcgctaagagtactgctgcatgtattgtttacttagataccggtcataaaattactgaacacataatttattatatctctaaatacatgaattaaaaaattatcgtgaagaaaaactatttgcgtaactgctcctcgactcctcgtttgatagatccgcatatttcgcaaaaaatgaagaaaacatcccgtataatacgctcgcttccacaggaaaaacggaaggagcagtaacttccccgcaaaacaattgaccgtggggtaaaaaagtaaaaaccgatgtgagcgtcgtctcgtgtcgctccaggaagacaaccaccaaaggctcctccgtccgcggcgatcctacttcgccgccggtatgcgatcgccggagtcgccgtgctcggccccgaccctggcgccaccctctccatcatctgcttccgccgccttgcccgtcgcttcgcgcttgcgtagcggcggcggcggccgcggcggcgatggtgatgtgccgacgacgtcgtcggcgtgccatggccgccgcacctgcgaggaggagtcgatcccactgaggagcgtggaggcggcacggtttcgtgctccgcagccggcgaatctggcgaccccgagtcgatcgatggtttacacccatgtgagccccccccccccccccccacaaacccccatttcagatccattttattgatagcagttgtgcatcggagtcattccaatctattttgcacagtcggatccattttaggcctagttatccatccccatgaggaagggattggaggggattagttaggaaattaatccccttcgaatccttttcaatccccttgggtgagggattaaatgaacaaggccttactgaaagcaattaagcattgttttgtttagt

SEQ ID NO: 4981 - DNA, 1501 bp, Oryza sativa
atttcaatgtttttttttgttggcacccatgactccgcgcaaagactcctctaccgttctttcctcaactgaaaaacattacgcaattcacatatagaataaggttgacaactacaaggaaagaaaagagaaaggttgagaggagagaaaagaacaaaaaggaaaacaaaagaaaagaaaagaaaagaaagagagaggggaggttgctgcaggtggtgcgtgtgatgtgagattagattctgctcctgcaaaattttattttctctgctcttctcctcttctcttctctgtgggttgctgcaacgcagtttcagcacgcgtcggcgtcactgatgtcaccccctcccgtttcttcttcttttttctcctccttttcgttgttgctgtttgttccttccgatcccattctatgccttttgtgctgcgtctgcgttggtttgtcatgaaaccgtgcacttggctgcctctccaacggcaaaacgattgccggccttttgttcttgtgtggcgcacgcgtgtgccaaatgtttattctcttgttcttgatctttgtttctcttaatctgctcagctgatcaatttctcgaatgtaaaataccggcccaggtaacaggattgcttaaaaaatatattagtatatgattcaaagttttggagaacaccatggtttaatagactgtaacataggctaaattcgatgctgttgattggctgattagcacatggttaattaagtattaactattataaacttgaaatatatatatttttatttttgcaaaacagttttttgaaaaaaaatcgtttagtagcttgaaaagcatgatcacgataaacagtggcggacgcaggattaaaataaagatgaggcgaagatgctcgtctcaataagaacaactaaacgcaaaaaataccatatttatgttgtaatcatattaacatatagtataatcaataaattaaggcaaacaaaaaacaaaaatgatattaaaataaagtaataatttttgcgccgtacataattcgtcatacataaaaagataccagtaaacatatcaatttacaaatatgagtccattcataaagcatggttgatagatatcttttaaaaaataaatatataagaagatatcgcataccagaataaaatgattattattttgcttagaagggagagaaagaaaaacagtaggcacttactatagtaagggacgggggtgaacgatgttgaggaattgaccgaggaaaccatcacatacgcaggattaaaattggacacttgggctgcttatttatgggccaattgtgaattggatgtggtggtagacggtccaagaaggatatggagggtcggggcggcacgggccgtagctgggccggccgcctaaccccgcctaatgggtggtaccgcccctgacgataaacgagagaataactctttccaatcgcacagacaaacacagcgttacttacaggatgtaagataagtaagacaacgagc

SEQ ID NO: 4982 - DNA, 1501 bp, Oryza sativa
accacctgcagcaacctcccctctctctttcttttcttttcttttcttttgttttcctttttgttcttttctctcctctcaacctttctcttttctttccttgtagttgtcaaccttattctatatgtgaattgcgtaatgtttttcagttgaggaaagaacggtagaggagtctttgcgcggagtcatgggtgccaacaaaaaaaaacattgaaatatctcgtcggcgcactagcgagttaggctgaattgttttgttagctttcccaacttatctccctcaatttttgcacgcacacttcttaaactactagattgtgtgttttttcacataaaattctatatgaaagttgatttaaaaaaaatcatatcgatctatttttcaaaaaaaaatgctaatacttaattaatcataccctaatggatcgttctgttttgcatgtttggcggagagttcctaactcccactaatgtgtggttcgagctgcatgattgaaacaagagagcctgcgaagcttgtaccatggattattaatgttacatcatttttttctttttttacttttatttgggaacacgcaggagatccgtgcatcattttattaagcaatttctctttttatttgttgtcatttagtatgaataagatgtgcaacatatatagttatgtttatttttgttcatctgttactcagcttacaccaatgccttttatgacaaatccacaaatgctatttctccgcaacgaagtattatgttgcaaagcgtaattaaaggagtgcacttagaacatcagttttgaaaagatgtggctatacattaagctccaacatcatacatgaatatgtgtacatgaagatcataggaccagacactttctctagaagaattgaatctatatctcacatcacacaacctgtacgcaacctgcacagctagctagcccccatctcgctctcttcccttctttttgttcttttctcatttatctcattctattatctttagttttcttttaccagttgtcgaccttgttttttaaactgcatagcatttccagatgaggaaagaacggtacagaagtttttgggcattttaggcccaaactaatgagaaacattgaggtatatctaagctttgtttgggggctcgagattccgaaaaatagagaaactggaaaagctggtcttcatgaactatatctgacctatatcttctaattaattttttattctataactacacgaattcttatattttagttttttatttaaattctcataatttagttgagaatctgaattgtttatgaaagttagagcattcgacaaaaacttagctgatagaaactccaccaaacaaagatgctactggtaacaatataacagtaccacaatgctatttttagaatctgattggctgacatttttttttctgcggtttataagtgtttgaagtaacagaaaataattttaggacaatactttactcatctacaatt

SEQ ID NO: 4983 - DNA, 1501 bp, Oryza sativa
ttatccatgttacttatgagaatgtcagctaagtacattacgggcagttttggattgctaccaaaatttgccctaccaatattttggtagcctaaataatatccaccatttgtttggattgatgccaacattttttaatacccatcccaaatttggtagcaatctagaacttttttttattatggtatcacaatttagctatattttggtagcaaaccaaataagatgaatacaaatttattctaccaaataattggcagtgccaaaacttgcctatgttttggcactaccaaagaattggtagggcattgatccaaacaagccctacaattctaatataagttgtcatttgctagtgagagcacaactggagtacttcacgtctttttatttatttaatatactccctccatttcaaattatagggcgtcactttttaaggaaaatcaaactcggtagcttttgactaataatcatactacctatatttatactaagtattatgcatgttatatcactagatttatattttaaaatacattcatctgatgctaatttcatatttattgggatcatagaatgaaataaaatactgatcaaagtatgttattgaaaaccgtgtaaaaaaatataggccttataatttgggacagaggaagtatatgatttgtaacttgtgggcagtcacctccttgttgtagtgccaaagaagggtacctcaatgatttagatcaccactgataacttcatgcaccatgtaaatcaatatgctccctagtttgtgagataaagataaattgcatctcttctttataattgaatctatagtacgtctatacgtttcactggtatagatctttccatctgtgacggcccataacaaaattggaatttgccggccgtcacaaggaagtaatctcaatcgggcgaacttcggcccaattgagatatggtcacacagccatggtatatcggcataaaactaaaagcccgtcacggatgccacttatctgtgacgggctatagttgaggcctgattgagataagggttccatatctcaatcgggccctaaaagaagcccgtcacagatgagggtcatctgtgacgggctccaactagaggcccgattgagataagtttagtgcccgtcacagatgacactcttttttgacggccttttattaaggcccgatagagattacttgtatgcccgtcacggttgattgttttagggccgttacagatatttgttgcacagtataaataccccccaccacctagtgtaactgtatcccattgttcactattttggtggaaggctgtagggggcgattttttgtccttttttcaaggaaaacagaaattaaattcctgtaggtgatcaaaatggatcaatcaagtgagtaatattaatcattaattgagcaatttcatcacgtcttacttttgcaataatgatcttataatatgtgcctctaatttgtttttttattttgtagc

SEQ ID NO: 4984 - DNA, 1501 bp, Oryza sativa
  unsure (1)..(1501): unsure at all n locations
aaaaaaaactagtaaaaagaacctttaccatacacctcaaatgaacaccacagcactttactacacatctaacgtctatttaatctagtattttctttaagatatgcatttcaagctgtacaaatctataggtccaaaattttgattatattcataacatttggataatttattttattcatagagaaaatataaaattttatactattataatttaaccaacacacactctagatcaatgtgcatctggggatctggagttcagccgaacaacgcagaacctcaaaaagaaatccacattagcaaagaggccaaaaaaaaaacaaggagagacaaatgataatggcaattagggtaaatcaaaccccaacaaagaaccctaaataatcaattactccatccatttcatattatgagccatttgacatttttcttagttaatgttctttaggatcgaccaagttcatagaaaaaattagcggcatttataacatttagtttcattaattttaacattgaatataatttgataatatatttattttgtattgaaaattttagtatatttttctacaaacttaatcaaaattaaacaaatttaactaagaaaaaaaatcaaacgacttatgatatactccctccgtcccacaatataagggattttgagtttttgattgcnannnnngnncanttgtcttattttttttttgcaaatataaaaaacaaaaagttgtgtttaaagtactgtagataataaagtaagtcacaaataaaataaataataatttcaaaattttttgaataagacgagtggtcaaacgttgcaaacaaaaactcaaaataccttagggcccctttgaatcgcagggtagaaaaaaatagatgaataggaaaaacacaggattttgacaggaattgaagtgtaaaacagagaattgcaaaacacaggaaaaacacaggaatggtcgtttgattggagcgtaggaaaaacgcaggaatcggatgagagagatagactcaaaggaaattttccaagaggttggatctcttgctaaatttcctctaaaattcacatgcaatgtgccattccataggaatttcataggatttggaaagcttcaatcctttgaatcaaaggaccaaatataaaaaaatcctataggatttaaatcctatgaaattcctatataaaccctttgattcaaaggggcccttatattatgggacggagggagtaaaacagatagcatataaagtactattagttccaattgcaggagtagggactattggggggccctactcgtcgtcctccacttgtaagcatggcatggggttgccccccacaagttggtccttgatgcattgcatccagccccccttcccctctcttgtgttcttcctccacctcccatgatttgaagccaagccaaaccccaccccactcataaaatcggctccaccttccctgtcaccatgctaatctttcctcctcctcatc

SEQ ID NO: 4985 - DNA, 1501 bp, Oryza sativa
atacatggattagaagacaattaccacaaaagatgccgcaatgcttttaaactcaagttccactcctttttatccttgcatccatctcaacaaagagcattagtgaacctctaattgtgttgatattaacaccaaaataaatgaggggtcctagatgcactttcaggttttatgtttttaattggattcatttaattcttttttgattcattgtgtaattccccttagttgaatttgtttatgtgattggttttctcttaggttagatcgaaagaggctagagataagagggtgaatggaagaatttagaggtgagtactgatttagcctataaaaagtctaggctttttctcttttcttttcttaataaactctctcttcaccattaatttggctaaaatttacaccgttacaattacttcatcttaggtagatatttcactaaataaactactacaacaacgtgcaattctataaaaaaaactcaaatattatccgtctctcccgtcatatacttatattgatttagaatccacggatggaagcacgtatttcacaagctcagttaccgataaagttatagccaagagaatcatcatgtaatatattatataaatctttctaaaacatctacttcaatgctaaatcaaaaaccatagttttcaccaaaacatataaaacatcttcccaaaaatttacttacattttaattcgaaaaccaaaattttaaaaatgaagggaaaaaaatagaatagaaatgacttgaaattgctggcacatgtccccctcctccttccctccatccttctctctcctcctctccacctctcctctttttacctacacaccctcttctctccaccccctctctctctctcctctcctctcccctcccctctctctcctcgcgctgcgctccccggccgaggcgcggcgagccagcgagccagccagccacctcctccgcgcgcgcgcgcctcgccggcgtgcaaggcccgagctcgagcgccccctctcccgcggcctggccctcctcgtcgcgcgacacgcgcgcgcgcgctctctcacggccggcgagcagtgtcggagccagcgccatccagccagcgcgtgggtgggttgggggcgcgtcgcggtgtgctcgccggccggcctcgttcccgccgcccgtccatccgtctcggggtcgaatcgaatttgaaggtgactctcgcttctttcttccggttcttgatttctttctttcttggtttctttgatttcttgaattggagggagatccattgggggtctcgggttgattccttctcccgcaccgattaacggagattagcccatccgggtttgatttgatgcgtgtgggggtggtgctgttctaatcggagtttgttggcgaaccaaaaatgatttctcccttttttttttcttcttttaattttttttggggggttcaggatgccccacgttaggtccgccgccgtgaagctgatggaggagcagc

SEQ ID NO: 4986 - DNA, 1501 bp, Oryza sativa
taaccactcggattccttttaattatggctaaaaagcagtcggctaagaatgcctctttaggcgccgtgtatgcttttgtcatatgatgcacgattgtgctattattttgttctcaactatatgtttagtttgttaactaatcacatagttgggaggtacacctaattaggtgcatctattcgatgcaccatattctttatcttttcgccctttacagtcttcgtcttcactactcggcaggccttggcatgaaaagtttgaagcattcggattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattatccccaaatcatacaatcaataagatactcggcggattcatccccggacaggagtagggtattacttcttgaataagaaggcctgaacctatataaatcctttgtctccaaacccattcacttctccagcttgatagccaccccttttcttattgccgaaatctagtttcgacagtatctctctacttttgacttgttgcatgtgtgtgctgtgctgtgctgtggcagttactaatacggtcgccgtacagtgcacgtacgacgtcacgtgcatgcatgcaacttgtagtactactatgtactatacgacacgagtacgagtgctgtgtgtgcggtctgccttatccacaggatggggaggagatgaggctaaaatcgatcgatttggccggacccgcgcgtatctaccgcaagaaaatatattatcgcaccctcatacatggtggtaccacccaaaccaaaccagatattttacgcctaccccctaccgccatcaagtccttttttgcaaagcaatattttgcaagttgtgtatctattgatacatgtgtttatcggttatgaattttcatcagttgaatatgagatattcaatccggttttaatatatggtgtcattgatttttattatatcctttgattgttcttcctgctttaaaattataagtaatgcttaaagtttctatagtgacaaaaaaaattatttactttaaatttctaaaataaaacgaataatcttaaaaagtcaatggtataatatattattaaaaagcacatatagtatattagataaagataaaaggttaacacgggaggcaatcagcagatcatatcgattgagagctacgaaagataacaatttggtgataaatacaacctctgttctgaaagataagtatttatatatata

SEQ ID NO: 4987 - DNA, 1501 bp, Oryza sativa
atactcctcatgtccttaaaaaaagtaaagttaaattctaattaccaatataggcatattactccctccattcctaaatgctcgacgccattgactttttaaaacatgtttgatcgttcgtcttatttaaaaaatttaagtaattatcaattctttttctatcatttgattcattgttaaatatacttgtatgtatacatataattttacatatttcacaaaagtttttgaatgagacgaattgtcaaacatgtttaaaaaagtcaacggcgtcaaacatttagggaaggagggagtatatgtctagatcagaagttggtttttttgaaagacagatgatgtagtttggttcaagtttaacgatcgatagtgttttttaatctataaaattatttttttagtactccatctgtatttttttaatgtatgacgccgttgattttttaatcaacgtttgaccattcgtcttattcataaaatacttatgtcatgattaaagaacatttgatgataaatcaagtcacaataaaataaatgataatgacataaattttttaaataagacgaggtcaaacgtttattaaaaagtcaacggcgtcgtacattaaaatacggagtattactaacatgatcaaataatcactcgattcaatgagttaccgtagaaaggtacccgaaaaaaaggaaaaagggaaaccgataatgcaaaatcacaaagtgcgatatcgcgaaacaaagaacgatcaacgggacagtgatccacgtacgggaaaaccacccatctccggcgacagtgatccacgtatgggaaaaccacccatctccggtgaaccatcggccaatccgcggccccgctggcccacacgcatgcgtccaaacagcccacccccccccccctccccctcctctcccagtcgctacccaaggtttctagaacctacaggaatatgtccaatccctgacggaccccaaacctaccacagtctagagagcctcacgtactagcgttacccaaaacaaatccgtagggcacccctaccccccaccgcgcgacgtgtcctacccccgctgccctctcgctccacctcgccccccgcatgcctgccaccctcctcccctcaccggcacgtgtccccacctcctgcttgacgcccccgtctcgctggaagtgggcccgactacgcgtggggcccgtgctgtcagtgagacgtggcgctgcgcccaccgggatgtggggagcgagagacggcgtcagttaccggatgcgtggtactactacgacccctccgcccacggcggaaccgtggttggggtttaacgcaaccatggttcgactctatcccgaggtgggagaccgtggttagtggagcagtttataagcgcgcaccgcttcggcttcgtcctcctcgccttacacatcgcaccactctctcttactcgtccatacgccgagtccacgagatctcgccgtagtccatacaccggttgatcggaggtcgtg

SEQ ID NO: 4988 - DNA, 1501 bp, Oryza sativa
gtaggccccctgcacatgctgaaagagtacttgtgttgattaattaacaactcaaatggttggagatataaagtgatgggagaagaagagatcaaaagaaaatttagataaagttggtgttctgtgatcttatctttgattattttagttcagggagggttgggtaaggataatgagcttttcttcgggtcttttttttttctttatctttgcagatcaaagctaattctatcttgttgaaattattggactgaccccatagcgattattgatggtggggaaacacgtttgaaatagagaacacttgtgaaactaacatttttataaggagattgacagagacacacttcggttatttctcccattagattatgggatatcacataatagagacgacaataccttatatacttggtccatggtgcagcggtccggcctacaagtgtgtttatgcctagttctagctaacagattataaattatgagtagagtgtaaattatcattgacacttctcttaaattactaaacggcacatgatatttataaaaactttttcctcatcggtatttcttactaaacttctttagatcgacttatcaactttctaatgtttgattcattcgttcacaccattatcataatgccttgaatcgcaaggtctgcttagtttggtcgcgagtctgcacactaacgggtttggcagccttgggggtcctcaatcttcatatgatgggcaccaacctgtgtgcaagatgggtctagagtcgttgtgtgtagtttgttgtaactgtgtagagcatctaccctttctaatcttattaaaagatacgagtatgtactttaatttgtgtattaaaaaatttaattctgtgaatcggtatatcatattagttgacactttttggaccaacacgtacgctcagccttcaccgccgtaaaatcagctgcaaatcaacgacgggtgaagtggacgaacaccggccaaacacgtacgtatgcaacgacatgaaatcaatcaagccggccaccgaaggcgaagggtcgaggccatgatgcatggcacctgtcagttccccatttgtcgccttcaatctcccctgcacacgtggcacacacgtaccagacgatgtacgactgaaaccaaattaaatggacaaagattatatctggtccaattattcagatacatcgatcctctcgtaacgtgcacacttatcacatacaaaacgatggctgaatctgaattgctggtaaaaagtactaccaagagatcgaataattagggctacttagctcttgatacatcgctttctctggccatggatatcgtatgtatggtctgcaagacttcgctgctgctgctgctgtatgatgaattgatgatgatggatgcatggatggtctcgactggagatgtgatcggaaacctaattctgggcgagcaaagtcttgtgccgtgatggagccatcagaggcggcagagacgatgagatccatttc

SEQ ID NO: 4989 - DNA, 1501 bp, Oryza sativa
acataaattttattaaagagattttttttcttttctttcagtcataagtatctgatgtttaagttaaaatttggttattgacattatgtgtaaaccacgttatatttatgaatggaaggtttacccaggacattgataatccaaataaatacatcatcaagatatagttgatgattggttttaaataaattaatttagtgttgtcgatattacttgacctatgataaagttgaagaagtttaacttacgataaaactaaaacaccttgtaatacataactaataatggtcctaaataattcaaaatatatatagcaaacaggattttggactgaaaaaagattgtgaatatatatcgcggtgcaacatgcaatgattcggcaacggatgtactatcatagtactttcgtggatcatgaggtgcataatcaaatggctggtctcgtaatcggtgagcagaggccatccttatatatgttgattcttaattcgagggagagatggttgattggcatctcaacagagtattgctgatcggtttgtttaaatatgagattaatttcagtgcaatccttagccccgcgtacagctcgagatagctagctagacaagtcgtccatggttacagggttgaataaccttgtttaatcgctggcatttggaggtcaaacacattataaaatatttaaatgccttcgttacctttactccgagtgacattcataaccatcaaacctgcagacgataaattaaaacttaatatggtaacagagctatagtcataaatttttttcttagctggttttgttaagacgatgaagaggacgatgacgacgtgggcattagcctggattaaacaaagggttgggttaaaggagaagataaggcgtaacacctgtagacacgatcgcacgggcttgacggcttgagctgctgctgctgctgcatctgttgaatttcttcgatcagccggagaatggcgacaacggaagctgccttaatttgcagacgacgatctgaatttctgattacagctgtactacgctacactgtctgtattgctaacttcctcctttactgaaaggtcagtcagggagaaagagagagagagtgagcaatcaatcattgggcaaaaagaatcatcaagcttagtagttagtataggttggtcaagctcgagctccaattctttaatcctctgaaagctaaaaaagtccggtcatctctcaacagtgaaccctcctatatgcatacagctatgagcagcctctgacatctcaatcacatgatcatgagtggttttcacataggtatatatacttccatttgcctatatatacccctcccacacttggaaccttggatcatctcatctcacacacccaaaaaccttaatttgcttgattgcctcttgtactgcagtgttgcttcctacactgccattgcatataaattttgcactgcaagattaattcagtctgagagaacgagagagaacatca

SEQ ID NO: 4990 - DNA, 1501 bp, Oryza sativa
gttttgtagattttactctaagacttttctttttagctgccatctagtaatgctgatgtcattgctaccgtcaagcaatttttttccccgagacatgtcattgattatgtcactgtaatggtcacacattgtagtatactcctatatgctgtactcccatgaaaagtcatgagacggcctgtgattggatctttcattatactttgtcaaataggcgagaggaaattcaatcctttcttcttcggacaatctacattggatatacatgttcatatccgtacattcgaaattcagggccaatttggattgctaccctactaaaatttgcagtagtaaaccaaacacctctactaaaactctacctatgccataaatttggcttggcctataaacttgtctcttatgggcaaattttggcttcaatccaaataaacattttcaactctaccctaccaaaattttggtagtaccaaaacttgcccaagatttggtactaccaaaattttggtagggcatcaatccaaacatgccctcattttgtactttgcatctagatgtctcatctcaggagtagaagattccaagtttcacagataagaatgtcgttgtgaactgctgaagcatccatgactatactgtatatgcaataactgtgtcacaataatttgatagtaatctgtatattgatatctggttgtaaaatattccaagttgcaacgatagatgctgtcacttcctgctgccaattcttgaggcatagatgactgtgcatggttactgtgtcacaattatttgacaataatctgcatgaaagcgcattacagccacagaatatatcctgtgttaactctgacgaaccaatcttcttttgtgcaacctacactatgcgtcctaccttttgctattcaacaacgatcacttatgaaacaacatgcagtagtgtgtctcaatctttgaaaattctccatgtttagtgcagaatcaaactatttactgatatattgatcctaaaaagatgggggtgtttgctgaactgtcgccgtcaaatttcttgtctccacagaagtcttcactgatttatcatcttcctttatccaaaaaaagaggagccatcttttcttctctttcgtggcatcactttgcaataatttgggctccctgtttagatagatagatagtatactgtagtgctacgcaaactagcgaaaattgatcacgaaagagacacgaatggttgccctatacgtttcttctattggagcacatacttgagcttcagttatgtcaaccattttcaaggttgcgttctatccatctcatctgaattaactttagggtcaacctaatttttttttgggttatctgtaccaacatatgatgaacaaaaaaagggagaaagataacacaagttggggttcaccaaagtcaaaacctgactccaattgtagacgcaactaacacatgatttccctgaacaacaagtacagagaggataaacaag

SEQ ID NO: 4991 - DNA, 1501 bp, Oryza sativa
cgcaggcacggcacgccggcgcgcgccagcccggccaccacgtgctcgtgccgctcccggagccggcggcggttggtgcggatgtactccccggcgaacgcctcgtcggacagcatcgccgccagcgtcttctgcgtctgcgacgacaccagcgtgaagctcgacatccgccgcgccgccgtcacgacggcgtcgttgtaggagtagaccacgccgacgcggaaccccgggaggcccaggtccttggagaggctgtagacgatgtggacgcggccggcgatgccgtcgccgccgcgcgcctcgacgagctccgccacgctgacgaggtccggcgcggcgaagacggagccggagtagatctcgtcggagatgaggtggatgtcgttgcgcgacacgaagtcgaggatgtcgtcgagcatcttgcgcctgaccgtggtgccgagcgggttggaggggttggtgatcaggacggcgcgggcgcgcatccccaccgcggcggcctcgtcgtacgccgcctggagcgcggcgaccgtgacctggaacccgttcgcgctgtcgcaccgcaccggcacgatgttcacccccgtcctccacctcaagtccctgtcaaacctgcacgccatggatgtcagctcagcctgccactctgctcgatcgatcccaagctagctagatgcatggcaatggcaatggcaatggaacagtggcttacccggggtagtaaggggtagggatgagcagggcgtcgccggggttggcgaggatgaaggtgaggagctcgttggcggcggtggcgccggcggtgagcacgatgtggtcggggtcaaacctcgccttgccgccgcgtatcttccccatgaagctcgccatcgcctgcaagcaacaatggtggccaagcaagccgccgccatctcgatcagtccaccatgcatggcgttcgagccaagcaaagcaagaattgcaaactctctctctctctctctctctctctcacgtaccttcctgaagctcttgaggccatggtaatcctggaacagcgcgttgtccctgaagctaccggcgccggcgccgccggtgctccagccggcggcctccgggtggtcacggaggtaggcctcgaggaggtcgaaggagacctggttctcggcgaggcccatctgtatgacgccgtcggggttatcgacggcgtggtaggggtcctcgtcgtaggccttccacccggcgaagtacggcgagtcctcgccgtgcgccgccgacgttgccacctgcgacagcggcggcgccgacccggcgaacgccgcagcaggcaacagcttgccacccatgatgttctctctcgttctctcagactgaattaatcttgcagtgcaaaatttatatgcaatggcagtgtaggaagcaacactgcagtacaagaggcaatcaagcaaattaaggtttttgggtgtgtgagatgagatgatccaaggttccaagtgtgggaggggtatatataggcaaa

SEQ ID NO: 4992 - DNA, 1501 bp, Oryza sativa
tatcggactttgtcagttgggcaggagcatatctgtacgagttgatgcctctccttccttgtgtttcatggcgtgccctgcgactccagactagctctacagtagtagtactgccctccctcttgtctgtctcccggcccagcacgttcagatcatttcagttaccactcgagtaagagcaagtttaatagtatccagccacatgctctaaatcatctatagttaatttaatagctaataaatacaatagttacctataacatatagtacacaattaatacatagtttttcttatcatacgcacatgtatcttggagcccatgctacagctggctataaatctatagcccgctgctcttctctctcttcttttatctttttaaaatatatttataactggtttgtagtctgctattaattgtacctgctctaataatcatagatcaacgttccttctatacgccgcttttaacaatacacagcgtacactacaggagtattactcatgtactccagttcaccattctgcatttgtcttctcctgctctggtgcccggttaactggcctaatgtattcctatggaaactaaacgacatgcactgctaaatcaatcgtggcatatctaatggagttcaattacttccacggactaaggccataatattttctgattgagacgtagatttcatcttgatattttagcatatgttttttagactcctatatatacaatgagttttagtaaaaacattctatataaaagatggaataaaaaattttaaagtctaatcatacattaataagttatctcgttttagtcacgctaaaattctactattatctttatcgaaacgtacgcttgcggagtacgcgcgggatgaatgtgggcaaaacacgcgattcacggtacacgtaatagccactcctcatggttgatgtatgtctattcgatcactttgagtactgacccctgatcactacttcgattctgacccggcaccccttccaatcgcatactacaccctacccaccgtgtactaatcgcggttgctctattaattcaaaacgagttttacacggtgctctgcaatatttcccatgtgattatatatatagcattttggcaagtgaataaaattgttctcttctcaaacacgtaaaaggtttgtacgtcaattcattaccaatagtaaaaagcaccatcagacccatcatttcggcgtacttgtaaacggaaaataatttgtgaataaaacttttatatacgtgtcttagcgatctaaaagcaaaaactgaaaataaatttcgatgaaaaaaaccccgaaatcaactctggatttaacgatcaaatattcaaattttagctgataaatataagcataagcaaaaagataaacccacaattctatagaaagagtagtaggagactaaaaataatgtggtattacttgtaatacacccatcatgttgttgtgatgggcttagttagcactaaactaa

SEQ ID NO: 4993 - DNA, 1501 bp, Oryza sativa
ctcaaagaatagtgatgacttgccttgctcaaagtcttgcgggtcttgaccttcgctcggatccgcaactccctcgggctctacaagtacgtgcgaagaattgatttgaattccattagaattcaaataaaatccaataaagaccaaattgaaaaacgagcgcgagaggcgaattctatatcaactatattattcgtgaaataggactattcctcaacctatgatattttgtgtctcctaagtaaattcctaagaattcaacgtatttatttagcgcttaaataaatctaatttcttacctaaaattaattactcatagagattaccaaaatataatttaattttgcaattttacgactataattaatctatacttaaataattaattattttaaattttctatttttattaacctccctatcctatttctcttttttatttctttctttttctctcctctctttctttttctttctttttctctcctctctttttccttccccttttcttttctttcttcctcctctccctaccggcttctccctttctctctctctcggctttttgcccacccgggcggcggcggcattggacgcgaggggggggggggaaagacggctcaccggcggcggcggcgcaaggcggcaacgctcggcaccacacctggcgcggcgcggtggcttcgaggcgacggcgcggcgcatgaaggcggcggcgcggcggcacgacggcggcggcgcatggagaaggaggagaagggggaaaatggagaggatgggtgtggggtggagaaggggaggggccgggttttataagggcgtgggggaggggcgggcggcctcatggcgacgcgacaggcggcgcgcggtgcggctggcggcgatggcgacgggcgggcggcgcggcgcggggctcggcgcgacggcgacggcgatgcgacgacgacgcggcgcggcatcagcgcggggcgcgaggcggcgacgcgacgggcgagcggcgacggggcgtggggcgcgaggcggcgacgcgacgggcgagcggcgacgggacggccgacggcgacggcgcgacatcggcggcacggggcgcgagatgacgcgacggcgacggcgacgggcggcgatgatgacggcacgcggcgacgcgacggcggcgcggggctcgaggcgatggaacggcggcatggcggcgcggggctcggggcggccacgcgcggggcagagggggggggttagggctagtgacctcaagcgaacacctatggggcaatgaacagtgacttttcctatttttccaatttggttgtttttcctattcaaatcttgtcctaatatttctaatttttgcacaaatcaagtttacacaatatttgtgttgctctaacttagattatcactacccatattttatttttatttttatatttaatttattcgaatttaattagggttaattcttattccatcgcacctaaattcaattgttaccaatatggtcgcg

SEQ ID NO: 4994 - DNA, 957 bp, Oryza sativa
attataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttatgaaacattaaccgtaccaaccacaagccagcatgggcaacggctttaccttctgtatagcatgattcattgcggggcaccagactgagaagcggcgagaagtccgtgggggtcgctggggagtccatgcctctagttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggctagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagt

SEQ ID NO: 4995 - DNA, 410 bp, Oryza sativa
attataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttatgaaacattaaccgtaccaaccacaagccagcatgggcaacggctttaccttctgtatagcatgattcattgcggggcaccagactgagaagcggcgagaagtccgtgggggtcgctggggagtccatgcctctagttatatttataga

SEQ ID NO: 4996 - DNA, 1113 bp, Oryza sativa
aggactcggcgggcgggttgatctgcctgacgatgacgccaagctcgtcgaacggcgtcccggtgctgggtagctgggcgctgctggacacgctcgtgctctacgacctcgccaagaatgtcgtctcgttccagccgctcgactgcgcggcctttctcgccgccacaggataacgtacgacgacttctatacggaattaatccaagtatttgtactatgattttgtgtcattgtgtgtgattttgcagctagatttttagtacgttatgatcgatgtaactgtatgcatgcaagcttggccatctagatggcacgtttgtatagttccatagtttgtatgaaccttttttgtgtcgttaaattttctttttatcttatattatatttgagtaatatatctggtggcttaacttacagattcgagatatcattttatttcgatgtttttttctcgtcatacattgttaaacaaagtgcatcttaaactggcacatctccattctccacgcatccgaaaagaggtccccatcagttgctcacggctgattatatgccgcaacgacttattactgataacaaaataatttataggtaaaacttttaatatgagttctttgcgacttagtagtaaaagccattgttaaaaaaacatcaaaaatcaagttttaaaatttaaattttggcaagccgttgcttaccatagggtgaaaagccagatgagccgtgtgagtgacaggcccaattggaagttcttccgcctaccatggacctgcaggcccaaactgttctcatcacgggccgttcaatgcgctagcccacctgcaggcgtacagccgtgctcctctgtgacgtgctgcgaccaatcagcggctgccaactcagccggcccacgctctccgacacgtgggtccccaacccgtcacgcgacttcagttcgtcttccccaacgctaaaaataaacaaatcttctgagaaaaagaaaaaagagagagagagagagagagagggaggagagctgaactgaagtcgccggcgccgccgcggagaagcgaagcccggcgatctacccgaccgtggagagggagcagctcgtcggggaggagagggggagga

SEQ ID NO: 4997 - DNA, 1501 bp, Oryza sativa
acaatatgtcaccatatcatcatgtgcccatgctgaacatgtcaccatttgtgtagttgtgacaagacccctcgcataacttaacccaaagcagtgcaccgttcctggattgtagtcaccccctcaaaaaccagaggcatggactccccagcgacccccgtgggcttatctccgccacttctcagtctggtgctccgcaatgagccttgttatacaaagtgtccagctgttgcccattctggcttgtggttggcacggttaatgtttcacaaccgaaactcgtgaaccggtccttaattgtcatgagcacgaccatcaaaaccatgtgctcacaacacaccattatcaagttttagttggcacattaattaattaaccaatcacgattgatcatcgtgagctatcattaaatatccatcattaagtaatagtgaaacattagttatcccaattgtgtgctaatgtttctaagcatggctaagtaattatgtctaacatctagctgaacaaatatataaagctcaactagtcaaattataataacccaaggtatcaaggaatagagtaatcaatgcaaacagaccataacaaaggaataagttcacaccacccgattgtaacactagaaatatgggccttcaaaaactttttaataaattgcatcatgccgattttatttgcctattttattggaatttggtttcaaagtttaccgatcgcgaataaggaataattaattaggaataaacactaaaattaaattggcaaaataactaattaaaataaagattaggtgagtttggaaataaataaaatattatcgcgaccatattggtaacaattgaatttaggtgcgatggaataagaattaaccctaattaaattcgaataaattaaatataaaaataaaaataaaatatgggtagtgataatctaagttagagcaacacaaatattgtgtaaacttgatttgtgcaaaaattagaaatattaggacaagatttgaataggaaaaacaaccaaattggaaaaataggaaaagtcactgttcattgccccataggtgttcgcttgaggtcactagccctaaccccccccctctgccccgcgcgtggccgccccgagccccgcgccgccatgccgccgttccatcgcctcgagccccgcgccgccgtcgcgtcgccgcgtgccgtcatcatcgccgcccgtcgccgtcgccgtcgcgtcatctcgcgccccgtgccgccgatgtcgcgccgtcgccgtcggccgtcccgtcgccgctcgcccgtcgcgtcgccgcctcgcgccccacgccccgtcgccgctcgcccgtcgcgtcgccgcctcgcgccccgcgctgatgccgcgccgcgtcgtcgtcgcatcgccgtcgccgtcgcgccgagccccgcgccgcgccgcccgcccgtcgccatcgccgccagccgcaccgcgcgccgcctgtcgcgtcgccatgaggccgcccgcccctccccca

SEQ ID NO: 4998 - DNA, 1501 bp, Oryza sativa
cggtaagattgggtggtatctgggaaaggctagtaccgtccccggtcaattaaagaccgagccatgaagttaagcatgaaacgaccccatacaatcacacttctcgcatggggatagacctagcggagtaaatagctgagcgaaggcagtatccatgcatagtggtttcttgatgcgtaaggcaagggctctacagtggtgttgccattggtaggactaccatgtgttaatttaaacataattataacttaatgcatgtgtgtgagtcttcccttcccggatacgccagaactcctctcactactagaaactgtgtacgcctagagtgcatgaggatgaaaagttcatggagcgggtactgtcaatgtgaggttatcgaaaagctttgccgtgatacgtctcatgtgttgggacgaggctcatgtgttgggcagtcgcggagtgtgggtaaagtgtacatccactgcagtgtgagtaaaacgaatctattcgaatagccgtgctcgcggttattgagcaccgggacatgtattacacttggctagactctaaattcttaacttgtgtgggaagggttattgcatgatgaattttatgctgttggagccacttcctgagaagggggaaggtggacgtcctcagaaaactatgacgactcaatggcgggaagctatccttgggatcacaatggatgatggacagaaccgtcgttgtttaaatataaacactggtactaaaatttgatcagtcaatgctaggtcttaggcttgtgaaaagaattacaaaacttgctttgcgcaaaagaaccatagccatcctttgaaatacccctatcatgtgcattgttgatgtggtggcttgctgagtacggttggtactcacccttgcaaatataaacttaatcagaggccggagatgaagcttcggaggatccctatgcctattaccaggagggtgatgaagacgatgacgctcaataggtcttagttacggtcattgcctatggcaatggcatgccgctgccttaattccgctgccttatctatttctgcttttgggatgtattccggaccgctcggtccgatgatttaagactacgcctgcgggcttatgttgtaataatttgcactagactctcgtgtatgtgcgtttggtatctcggctatgaactcgtgtgtaccagactacttgatccaaggaaatggtactgtttacacgattgattcctgttataaaaacgggggtctacagagctggtatcagagccatacgactgtaggaaaagaccaaaaggcgccccacccccttttctaagttggccaagggagaaattcccatttagtaatactttcaaaaataaaaatgctatgttcacaaaactctatacgattttcatcttactcttaactattttcttcacaaaacaagttttactctcagctgactttgggtttttcttaaacttagatggcagatcaggattcacccgctacctggatga

SEQ ID NO: 4999 - DNA, 1501 bp, Oryza sativa
tcatcccgcggcgattgttgtactgatgagataactgctggaactggtcgccgtggacctggagctgtgccttcagtgagtctatctcactgccccaagcctggtgcacctcccctagctgaagctgttgcactgtgaggtcagtcacctcggtctccaactctcccacaggcctctgctagtcgtcgatctctaacagagcctcctcgtagaagtcgtctactgcctcagcccatcgtgacagtcgagtcactatcgggttgtagcagcaaggtgtgtcctgaactgtgcagacggagttactctcctctcgaaacgggtggtgagcaaactcagtactcgccaactcagctcggtggatagagctaagtcggagaaaggcctcccgggctgcatcctacatcgcggtctctggtaagtcacgacggtggcatgtcggaaagctatagtctgactctgaaggaactcgtgtgtgaacctcgactcgggcctcccaaacggatccacactgtctcactcggtagatcggaaatctggggtaccgtagacgcctcatcaaccgatgcagctcaatgacgtatccctctgagcggggtacgcccatcatccaggtagcgggtgaatcctgatctgccatctaagtttaagaaaaacccaaagtcagctgagagtaaaacttgttttgtgaagaaaatagttaagagtaagatgaaaatcgtatagagttttgtgaacatagcatttttatttttgaaagtattactaaatgggaatttctcccttggccaacttagaaaagggggtggggcgccttttggtcttttcctacagtcgtatggctctgataccagctctgtagacccccgtttttataacaggaatcaatcgtgtaaacagtaccatttccttggatcaagtagtctggtacacacgagttcatagccgagataccaaacgcacatacacgagagtctagtgcaaattattacaacataagcccgcaggcgtagtcttaaatcatcggaccgagcggtccggaatacatcccaaaagcagaaatagataaggcagcggaattaaggcagcggcatgccattgccataggcaatgaccgtaactaagacctattgagcgtcatcgtcttcatcaccctcctggtaataggcatagggatcctccgaagcttcatctccggcctctgattaagtttatatttgcaagggtgagtaccaaccgtactcagcaagccaccacatcaacaatgcacatgataggggtatttcaaaggatggctatggttcttttgcgcaaagcaagttttgtaattcttttcacaagcctaagacctagcattgactgatcaaattttagtaccagtgtttatatttaaacaacgacggttctgtccatcatccattgtgatcccaaggatagcttcccgccattgagtcgtcatagttttctgaggacgtccaccttcccccttctcaggaagtggctc

SEQ ID NO: 5000 - DNA, 1501 bp, Oryza sativa
gtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacaaaagccaaccattccaaagtatccaagtgatatgaatattcccaaagtctaaagttataaaaccacctaatgttgcctaattaatcagcgaagcatctacctaaattcatactagtggaaccatgaatagagtacccactagttggggttttgtttaatctagggtgaacaaggtaataatatcaatagcaataatattaaggtcataacaaaggtaaataggcatggccaaataaaacagtgataacgcgggaatttaaataaagcgataatgcaataatttaaatcaaaataattttataaactgggattcaatatgttcaaggatgatgtgacttgccttgctccgggagaacggccttccgaaccttcggcgacgaccacgaaccacgcttcgggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaatgaggttttgcaactataaaacatgtggaagcgctagcctggaaaagacaggaaggctgcgttgttgacatgcggaccccacatgtcaacctaaaggaccacggtagaccgagtacacagagacggtccacgggtcgacggaagcggaccccatgtgtcaaccgaggcgagtggccaacaaacggactccactagacaccacacgggctgcacatgtggaaaccatgctgctactgagcggacacactaacacggacaccacacggtcaccacccgcacacgtgaacgactaccgacacggtacacgggtaccggggtcgacaaccgcacaacgggtacggggcgacaccgaaaggacgagggcggggcagcgagaggagagaccttaccaccacgcgacgaggcgtgagaacgacaacgacgaacgggcgcggcggagacggacggcgagggaacgacttcggcggcgatccttgaacgaaggcgagacacggccggcacgaggcttgacgacgcggaggcgaggacgaagacgacgacggctacagcgaccttgacgaaacaccgaggacggacgagaacggcttgacagagggacgaacgccacgacggccgggaacgacgggaggacgacgacgacgacgaccgggaccggcgaggagacgacgagggcagccgg

SEQ ID NO: 5001 - DNA, 1501 bp, Oryza sativa
actctatacaccattaggtttcatgtcacatcatagttagggaataatacatggctaacgattttcagcacttacggcctgttcgataggtatgtagtccggatcatcatcgcggggggcgacttgtgttatttccattggaaacgggtcacttggtgtgcgccacgtttattcactagaagcgtctggctgcttattgctaccgaaattttgaggagcgttaccttcttgaggcgctattggtgcgttcgatggaaccttttcgttcgacatcttccaacttgacgtaaaaaaatttgacataagtcccaattttacgtaagtcccaattttacgcaatttcacataagtctcaatttgacataagtcccaatttaacataagtcccaattatacataaatctcaatttaacataagtcccaattatacataaatctcaatttaacataagtcccaattatacataaatctcaaattaacataggtcacaatttaacttattttcacataagtcccaataacttaatttcacataagtcacaatttaacatatgtcccaatttagcatcagtcacaattaaacagaaatctccatttgacataggtgccaatttaacaaaagtcccaattatacataaatctcagtttaacaatgtcacgccccgaactagtcccgaccggaactagcccgagacgctccaatttagcctgttaatcgataccagtcccaggaaacagtgctggtatcacagggagacagaatatcacagcaacagaggtctctttattatagagtagaggtacagtcatgttgggctgcggacagatcccgagctcacaactgcattacaaaagggaaacggaagccaggacttgggccaaacatcacaggcgcgacttgggaactaggccgaaaccctaaaactcatcgtagccggcttgctcctggaagaactcctcatcagcaggatccgcttcatcttcttcagcaactgggggggatatttatatagagcaagggtgagtacgggggtactcagcaagccaggggaaataagtgtttaatgcaggcttcaagggaaggctgtagtttttgcaattgattttatttgaactcttttctgaaaacaactaagtgagtgcttctcaaacgacacggatgagacagtgcgtctcgtccggtcggagtatgtgcaatgtgtcaatctttaggattgcaacaaggttggcacccggccaacagctttttaaacggccacccgggccaacaactttttaaacggccacccgggccaacaactttccaaacggccacccgggcctagctgatcccatcagctgcagatttttcaaacatcgaaccccttttcacaacagcaatttcacaagcagtagacaaacaaaactacgctaggaatcacctcacatccgcccatgtccgtgggcacggctgttcgaacagtttgttaacctctgcagagggggtacactttacccaca

SEQ ID NO: 5002 - DNA, 1501 bp, Oryza sativa
aaatcgaatggaccattataatgggtgtgcacgatagtgattatggacaaaatagtctaagctagcaaaaggtaacattaatgcgaaagatgggattggctagacataatgagaagtccaaagtgagaaccctatcccattgctagtatcaactatcaagtactgtcgagaaactcaacatgagacaactaacggtgacaacttgtgttgttatcgccgttattgccgaggaaagggggaacgaatggatatgattgcatgggtacgaccgatgtcgatgcacatgtgaagatgttgaggtcatagtcttccctacacagtatcgagaggcatatctcgtgttttattgtagtcctcggtaccacgcaaaaatattataataattgttaccagtgcaaataatatcaagtacgcttacttaacacttttttaaagacgactttgtcattttggcattatctttttttcttgtctaccagtcatttgaacttgaatagtataaatagctataactttgatacaaacaaattacaacgtttagtttattttgttgtttcatttccaagattaatttatatacatttctatgattacatattagatcttttttttttgtgcaggaatcaagatccagttataattttctttcgttagaacattcataatttctttggcaaaaaaaagtttatgtaattggatattcatctagtgcttgacaagcgagtaaataatcatttacatgacatataattcctttattctaaaatgtaagtattttgaggatttataatgtgtacctctctgtataaacattgttggggcactgattccaatgcacggaaatctatacattttttagctaataagaagcttgtgaagggaaataggaaatctaggcaatggcgccacattttttttacttaatttcaggttgctctctctcccatacatatactagtattcttctatctctcctatctcttctttcaagtagataatgaactattcttaatcagaactctctaataaattgtgtattatatatagaaaaattacaatgtgaaaaattgaaacttctaatgtaataagcataagttatttatagtgtaacaatgatttaaatattttttttgaaaaatatagcgccatatatatagctataatcatttaaaatttgaccactgaagtgactaaaagagaaattttctctctaccttaattttactaaaaagcatagaaatgtttgtattttaaaatggatggagtatatatatatatatatatatatatatatatatatatatatatatatatatatatatatatatatatatataccccgaagaaatgataatgttacaatgtaggtgaaaattatttactaattcatgatttttgagttaggaatagtcaagtgtacaaagtaacctcatctgtagtccctcaagcttctatttaagcaacccatgctcattgttcttcttcatacacgctcactagc

SEQ ID NO: 5003 - DNA, 1501 bp, Oryza sativa
ccgctgacatgtggggctatctttttttcccttatgactaatatatggatccccttgtttatttattaaaaaattctgcctataatgccatgcaagcgccacgtgggatgaagatctactctaactagccacgtaggtgtcatataagccaaaaccaccatccaaaccgccttaggacctcgtgcgcactagtttcgtaagttaggggatgcgttgtatccaaccgtactccgtactcatccccgcagcccatcgtgtgacccatcttaaattgcctcaaacttattttggatgagccggtaagaatgcaacatttttcaggtatgcatgtaaaaaattctaatacacaaacgtattataaaactgtttaattatttaattggttgatagtcatggaaaatcaaagatatatcaccatgtggcattcatatcaggtattttgtaaaaaaaaattgtaagaatctttttacatgtatcactttacttttcagcagtatctccgaaatgcaaaagtctactccttgtagtggaaaaactaattctgcacgacgcagccgagccaggacgccgagaatttcatgtaccggccgcgtttttcattttgaccatgtcgatcgagcagtactccgaagttgatacagattacgcagaggtgacaacatatggcgcatttaattaccgcaactagggtgaaaacggtcagaatcagtaaatgacactcgatcgactaataattgatcatatttatcatttaaactggtaagtatcaacattaatacgatacagaaagaaattagtaaaatcaaaattcataaatagccaaaaatggtacgatcgaaaacggtaccccttatacaaatacgaaaacgatatttagtcgaccagaaatttctgtgaccgttttcacccctaaccgcaaccactggatcagcttcatgcaatcttcattaaccgtacacctgccactagccctatgaatattggagaaggccgagaccgctgcgaacttgcgagcccctatcatttgttaaggtcttgtttgattcagtttaagattatgataatctgaattattaggagtaagctgaaataaacagatagctaattatgataaatcattataatctataagccagattactataataatccactctaaaggtgctttttctaggggcctgttcatttttataccattttcaaccttaccaaattttggtaaagttgccaaaaaagtggctacatttagtttgctgccgaattttggtaactatataagaaatcctgccaaaattttggcaagttaccaaaattttggtaaggttttttttttgcatcaaagtgaacaggccctagattattgggtgtctaacagctaataatacagagaattaaacagctaacagcttagcttattttatgttggcttattataatccaggttatagtaatctgatttaataatctagattataataattttaagctgaaataggacctt

SEQ ID NO: 5004 - DNA, 1501 bp, Oryza sativa
gtcagaggttggcagatgaactattgtttttcttcatgtcttggacaggcttatacattaattgatgggttgttttggtagtagagacgatatcaatcgtgctatttcagttccacatgtacatcattcagttatattaagcaattttcactgttataatcttttgacaaaagaacttgataaatatttatgtgtacagcgaaacccagcaaatggcagcacgtaagacaaattaagaggggatgctaattgatgggtgattgatagtaacgaaatccagtactcgctccctttcatcatcgttatggaagaaaaataccacaaaatagtcactttttgatatagatgtttatttattgatgtaaaacaatcacatgatcaagatgtcatcatttaataatgtgtttcaagatggagttttctgtattaattatcattccgagctatattaattaggtgttcttagctatattaacatccacatattgctgcggaaatttgtatgaagcaaataaacagtttgagcaaatgactataaatagcatgcggcaattatcaaattcaaatctattagctcaacttcttgaagaagcgttctcatgcatgtgcttctttataggagtaattgtaattagtatatgttgtaaccgtataaaattagagaataagtaaataaatctggctatataacggttcaagagtcccagacagttacaactttataattattatcaattctcaatgtaagaattactaaataaaaaaataaaaactacaactttggactcaagtacaccttgtttttaataagaggcccaaagcaaaatttactctttgtttcatcatggaaaattgaaattatgaccacactaagaaatgaataaatatagccatatatcgatgtgggatcgaatcataatggcttaaatttaagcaagggtctatcaacttcaatttgctaattattaattttcgaattttagtattaaattaataaaatgctaaagcgagagcccccaagaccaatacaacattatatttattaattcagaattttaaagttattaaatcataagaaatacaattaatgactccccaaactgagttatctttgaattattccaaatttaggaactattttatcatgaaaactagcaaatttgaaggcttgtaccttcttcttctttttttgaccgaagaggcttgtacgtacttttgaatgtctcaacattttaataacagtaccctatagtacttaaaaaacgattttgaaaatttcttgatgctattcatttcgtcttgtacatattcttatgcctcaattgattgcttactgtctaaaattacgtggacatcgatcttatcagcttagatgggagaaactacgatagaataacaattcaaatgcacttttgaccgtataatccaattgtcagttaaaatttatcaaaagtcaattgtacgaagcgatcgatcttatctgtaaggcgcaatgcgaagc

SEQ ID NO: 5005 - DNA, 1501 bp, Oryza sativa
ccaaaagtctaaaggggtattaatcaagtctgacatatgtctacatgatgtaaacccttatgttatcctttccattttcatatatataattaattgaaaagtttatgattggtttattaggaaactaggggatacacagtacgctttagttactattgattatcccctccataaaaaaaatggaattgtacataacattcagattttattcaaaataatacaattatagagtactattttctctgcaattacatctcatttaaatttctcccaaccttactctaaccacctctcacttctcatttagtgagggacatctaagttatttacctttcatactaagtatattatcttttcaatgctacaattgtattccttttggatggagggagtacttgttagaaaacgataggcaaataaacgacaaagaataatagatcaatcacagaagacacgagatttaacgtggaaaaccctcccaaagcaggagagaaaaaaccacgagcactagccagcaaaatatcttcactatatcagggtgaggttacaacgccgaacggtggcttacaaaggtatgtatgaaggtgaaaccctaaaagataacgagcatttacgggcctccgtttcgctccagcagaagctggcctttattatgtgcaaatgaatttgaatcacaactcaacggtactcaccggttcacataaatttcaagagaaataattcctaaaacaaataaaattgtactcctagctagttgccgaactttgacgtgacgcctatgtactccatgtttccatgttaacggcggctgaagaaatcaattgaagatgatatgatgcttatgcttcacattctttcctactattatactgaagttatggtgagatcaatgtctctatcagcattaatatatgctcgcaaggacaacatagaccgttataattattctttcacgttgattgaaaggttagttcaagccgtatgtcattatgaaatttcgccccaactcaactacgacgccgtgaacgtcgtctactcttacttttcctcgcacagtacttaatcgatattattttgaatatgatatatttgctttctagggacacttattccaaatacttccaagaacctgtatttttctttcaccgtgcctaaatttcgtgtagatttctttggcggacggcctgaagtctgaaatcaatcgcaccgttacaaatttaactggggttgtattccacaacccgctgcaggtttttgcaagttagctagctaggaaaagatgcacgaatagatgacataatttatgcacgttgaatatattgcatgtcgatcgtgtgcgttaattcgctacattaacgtgtgacattctgcgcgtacgtacgatttatagtcttcctagtcagtccatggagtctacaagtcactacttaaaaaaaacaatctacgcctaggattttgtttccacgtgcggcttaaaaaaaaacaatcaattgtgttgagg

SEQ ID NO: 5006 - DNA, 1501 bp, Oryza sativa
tatttccctttactatcctccagcaaatcacactacacgtctttttaccgttggtgttctaaactctcgaagggttatcctcccgttatttgcatgacatccaaatggttatgaatttttttaaaaaaaaatcaacaaaacatattagtatatgataattcactcaacaaacacgcaagttaaaatttaacttctacaagtttcaacgaaaaaacaaattaaactatggctagttaacgtatattcgcaataaaatttgtttttttcgttgcaacttgcacaagttaaatttggtcttatatgtttgtggagttatttaacacttattaaccaagtatcttgttgattttttttcaattttttcataaccatcagaatgacatgcaaacaacgaggtgatagatgtcccctcgcgaatttaaaataggttcctgtgtccataattatatatgcccaagcttgtccaacacacctaagtgccaagttgcaaactatttgtgttctttgaagatattatatttatttttctattatatgaaagacatgatctcaaatgaaatggttccatcgcaatatcgatcagaaatcgtgaaaaccacaccatttttatgaaactgtttgggatcggttttggctgattctcttacagagttaaccaaaaatcatcggattttgcttagttttaagcaaactgacaacgaccggttttcacaccttaaaagaaggcattgcaaaaccctgcgcatgagtgtgcccctaggcccttattctatgcttaactgaggttgaaccagtggcgaatccaggatgcaaaatgagctggggctatgaaaaactcagtatgattgagacaaacaagaactatatcaacaaaaatattttgtaaatataacccaaatatgcaaatgcatgaatgaataagaacacacttctctctatatttcaacttgctgtggctatataaaatatctaaagaaatttatttattaataaataggtacttcatggtctactaagaatgatctataaataaaatatatctgtctttgccagtttggccttggctgcaagaagtagggaagtagcttgccttgccgccggccaatttttcactaattaatgattaattataattgctaatagctgattggatgcagggattggaggtggggctggcgcactaaccagccccaacagtggatccgccactgggttgaacacaagtggattctaatctctcgagtggatgtccactcgtgtatctttttctttaaaattcaatgcaaataattatgaaaaattctgaaaaaaattgacaatatagagtacagtgatatctactagtccaccgaaaatcaagttcaaattcgatctacacatcgagaaaaaaaaagagacaaattcagatataaacagtacgctactattcatacgctgaatttgtcttttttatatctcgacgtgtgagttgaatttggacttaattaagattttgtgaagt

SEQ ID NO: 5007 - DNA, 1501 bp, Oryza sativa
actttgaccaaagtcaaaaaaacttataatttaaaatggggagtattaaattaataaaaagttagctacacgtacgtgtatatcaaacacaaatttcatttcaaacttttttatggtcgttgttcacaaatgtagtactagatcatttcatatcacaatataaattaataattaatcacaatggagtcggcgttttagtcatgctttcctaatgtttttgccgaacaacaagttaaccaccaataaaatcttgggtaggactcctgtgaggctgtgactactgtccccgcccatatgagaatatgactgcacttttctggtcccccaacccatgaccgggaacaaaggaaacaattcgatcgtagcaatagtgcgtttcgcactatcttgataaatgaaacttatcttggcctcgaaagatcacgacaagtagtccatctgattcctcgtgatatgccctgtatcaaaccatatcactacttcaactatttatttcgattattagtaacttgattatataaatataaaaggctacaaagctatataaagattggcccaggcaaaccggccatactagccgatcccattctcaacttgaaggaatatctctgaaacatcaacttggagaacttttttcttttgcaaccatcaacttggacaacttgcctgcaggagtgtcgcaatactggaagagccagctcgcactgtcacacagcttagaaatagcatccaggaactttctccaggaaagaaacaaaatgccaaagcaagcacgggtacggtctattcgggagccaggaacagcactggacaggtacgtacgtacagcttctgaatttctgacgacacacggcccatatgcatgcagacatccatgttacttttgagggtgcaaacgagcttagccaacgacagcacacatctcatcggtgcggtgcatccggtgcagggatcgtgcaagtagacgagcgagacgacgtcgatcgacgatcgagattgtcggtgacatgggaccggaagtatcatgactagaggcttgggcaacagcaatcacccacgagacctgaccccctcgggggggtcgggcccgagggtgatgtggccgcccccctctttgtctccccgaggggtcggaccgctcccgtttcggccccgagggttgaggcgccccgaccccttgggggttttgcgccgcgtgtctgggttaggcgagcgcagcggggctcacctaaccgcatttattgcggtttggtcaagcgcgtcacgccgcatgtaacgcagtgcagcgcgctcgtttatccggtctgtgaccagtcacagaccgatcagatcgtggattaggtggcgacaggcggtctgacacacgcctcgctccatcccgtcaagatgagagcctccaagcactcgtccctagccggagccggcgtgttacctcctggagatggcacgttagtcccggtcagatatatgccaggcttcatcctaaccattacaagcaaga

SEQ ID NO: 5008 - DNA, 1501 bp, Oryza sativa
aacgacgacatcgttcgatcctaacgaatctaaggttttcacccggagaaatcccttgatgtggagtttgaacgagggctccaatagcaacgccttcaaaaaggtaaacgtcacccaagggagtcgtcgttggtagcatcggcaagccgagcaaggctttcacctcagagtcccatccaaatatagcgtctgcgtcggaagccaccaaatgccacctgcacacggggtacctgtactatgcacacaaccacctgcacaatggccggacaaacgtcattgatgacctgctcagccacctcgccggactgatggagcaccactaaactgcagagctcgtcggcaccaccggaccatcggcgccacacaggcccacccgtcgtcaccaccgccattgaggtccggtcctcgcccaaccccagcttggacacgtcagatctggacctagagggccagatctagccgttccccatcttgcagcgctgccaccagccagtctctcacgctaggacacgcgggaaactgcggagctcgcccacgtgtagccctcacagtcgtcgctaggcccctcaaagtccggatcacaccagagtcgcgtcagatttggaccttgggaggtcagatctggccgtccccctcaccacctgcccaggagatgttggtggtcgccggcgtgagacgtggaggaggaggaaccaagcccggggccgacgcctccgggaagcctcaaacctagagaagaagggagggaggaaggagaaaggaagaaagagacagggagaaagaggggagagggaggagggcggccctgccgtcgccggccaccaccgcagacggtggcgttgccggcggcggtgaggcagacggggcgtggcggggttggagctgggcgtcggcctttcgcctcccgggtcaccagagaggcgacacgggagtcatgatccaattattccaattctccgtatttcttagttagcacatgacaggaggctttctacaatctaaatttccaatattattcccacacctataagaaaaaatcccattcacacctcacacgattgaataggatttgaaaaccttaaaatgcttataataaagagaatatgacatttaaccaaacacaagacacataccatatgagaaaatttggtgcttgttaacttattagcaatagccaacatgtgattttgactttggatttttttcatcggtctgtttttcagttgtggttttaaaacaataataatataaatatattacccatagatgtttttttcttgctatgtttatttcctcatggttcattagcctgcccagaagcaggaggatgcaaaatggaaggcatcgaatgaaatatgtcatagatgagggtgttccatgcaaaattcccattcccctttttaaatcggtgctgggcttccgccggccgccgccaccaaagtcacgccgaagaagaaccgcgttagggcttcctcccccgccgccggcgagagtgggcttt

SEQ ID NO: 5009 - DNA, 1501 bp, Oryza sativa
accaaggcgcgcgcgcgcgcgggcggcgcggcgatttgggcggcatcggcgggaacggcagcgagagcgggagggagggctcggcgcggctcacggcagagcgggcagagagagagagagagagagccggggagggagggggagatgggcctagagggattcggcccatcgaacccgagggaggcaaaatagacttttgcggaggaatttgatttgggaaggatttggattcgggattgaacttgacgatagatcggggatttgagatctgagatggcacggacactagacaacaagcaaagaaacggatttcgcaaataggatttttaagagatagttttcccgctaggcgccacgacggaacgggcgctacagggcgcaagcggagaggcagccttaagcctaaaaaaaataatttagggaccctgccccataatatacatcagtataaatattagttatggtccaataaaaattaggagctactgtacagtatacactacagtttttttaataaaagacttttaaatataatgtagtataatttgagattatattgtaattataatatgattatagtgtaacttatatgtagttgaataaaacgttcatgcaaccggttggctagcagcacgacatccacctcacatgttgcatgttcaacttgtacgtattgcacagattttttttcccctctccgcatgaatatcaaggtgatctgacaatcataaatctgaaggttttggttgaaaaattgtcgaacatttttaatttaattatcaattccggtaaaaatcatagtaaggtattcttgctcaaatcctagaaggtgtagccatctagtattttttttcttctgcgcatgttccccagctaattcaggggacgttgtgtttgtgtccgtggcggtgcataccacatgtgtctcgctgcccggggcaaatctaatgtggattaagcccccccccccccccgccccaatttcccaccctgttggatccctatggggaggagagaaggggaggaagaagatcaacccccctccaaaacctaactagacccaccataatgatttcattgccattttttaatattaaaaaaaagcatgctgcttttataataaataaaatatgcttctctagcttaatttagtcttgtccattgaccaaacgtcgcctcaagtcacctgcacgtcaagggaccaaacaaaccatttccgtgcatagatgaccgactctatagtagtgatatgagtcactatgtgcaactagtgaggttgccaatgcgcattcaaccatcaagattgtcaatattgctccctccaaaaaaagatcgtcaaagtagtatgttttcacaacaagaaaaaaaaacagatacacactaccatataagtgtttattctttttttaataaagaaaacagtggcagagttcactacttcttggtctaataatacatatgcaaattccacagtacgtaattggttgcttctcgacatgta

SEQ ID NO: 5010 - DNA, 1501 bp, Oryza sativa
ttaaaaaataatgaatattagaagaggatactagagtccatatagaaataaaatttagaaatagttgaaattcggaatttaaaaataaagaatattagaataggagactagagtccatatagaaatacaattaggaaataactgaaattcggaataaaaaataaggaatattagaagtagagtatagagttcatatagaaatacaattaggaaataatagaaattcggaattaaaaataaggaatattagaagtagagtatagaatccatatagaaatacaattaagaaaaaaaaagaaattcggaattaaaaaataaggaatattagaagtagagtatagagtccatataggaatttaaaactaactaaaatttgaaataaacataataaaattaaagtagagtttagagtccgtataaaaatataatttacaaataactaaaatttgaaattaagaaaaacatgggaagaagagtttaaagttaatataggaatacaatttagaagtaactgaaattcaaaattcaaaattaaagaatattaaaagatgagtatagagtccacatagaaatacaattagaaataataaaaaatcagaaataaaaataaataatattggaagaagagcctagagtctatatatagaaatacaatttacagaaaatttaaaattaaaaaaaagaaatattaatagacgagtctagagtcaatgtaggaatatatataatttacaaataattaaaatttgatattaaaaataattaagaactaacacatatataaaatactatatgaatattacacattaacattagtagtttcgtaaagttattgcaaaatttaaaattatgttattattttaatatatttgaataatataataagaaaatatatatgctattatatgagagaaaatataatgatactatcatgctagtttagatttatagaattaaattatatcaaatctaatactagtttaatatattttagaatgtttgcctttaggggttgtatttttctcctgctatatttaatgaaaaagcgtaatctcgtgtggtttctgttaaaaaaatatattttagaatggagagtacatgacaacagactttaattcctcgtgcgtgtgcctagctataaggaattatgtcatttaaattttttttaaagaagtagcaaaaggatatgccatagtataaaaggtgataggtggaaggataaaataagacaaaagttgataggtaaagaataaactattacacaagttgatagatgggaaaataaaatactatcttaagattacaaaatcccaaaaaaataaaagggtaaaattatttatatacatggacgaaagtatcatatcgggaatgatcaataatcaaccaccagcttttattaatcacatactgcagggcaagctgcccagggacagtaaagcggatatctctatttaacacacaccgcgtcacgccccagcaaagcacacactctcctgtctcc

SEQ ID NO: 5011 - DNA, 1501 bp, Oryza sativa
gtagagtgtagagctaggcaatgacaaattacaacactgagaaggcacgtgcctatggcagcattggtcaactaccttctttaactaaatagttactaatccagagtactaaacgcaatcttaaaataaaacagtatcagcttaattgggaatctgtactcccagaagatcgtatgagacaaaaatgattagagtgaaaatcacatgtaatggcttgtcgactaaaactacagacagaagtacaaatcttatccacttaatcaccacaaacttcagccggacgcctagtttgcgtatgcgcaaaccagagaaaccgttgagtttgcttcgcatctcagcaatcaaacgcacaagcaaactagggaaaaatcatctagaatcgaagaaagaacatgcacccatttggaacttcaacaaacctcgaaccgaagcgccatggagaacaaataaaaattaaactccagccaccgagctggaacctgcgcgtccgtattaacaaaatcagctcagagattagctcgaagcaacggaaagaacagccgagacgcgcttcccgtttggcgccaaatacgatattgaacgcgatacggaaggggaatctggcgcgaccaaccaacctgcggtgcggcgctaaggctcgtagaaggggatgaacaaggccgcggggagatgagacgaagaggaggcggctccgaggggagtcaaagcccactctcgccggcggcgggggaggaagccctaacgcggttcttcttcggcgtgactttggtggcggcggccggcggaagcccagcaccgatttaaaaaggggaatgggaattttgcatggaacaccctcatctatgacatatttcattcgatgccttccattttgcatcctcctgcttctgggcaggctaatgaaccatgaggaaataaacatagcaagaaaaaaacatctatgggtaatatatttatattattattgttttaaaaccacaactgaaaaacagaccgatgaaaaaaatccaaagtcaaaatcacatgttggctattgctaataagttaacaagcaccaaattttctcatatggtatgtgtcttgtgtttggttaaatgtcatattctctttattataagcattttaaggttttcaaatcctattcaatcgtgtgaggtgtgaatgggattttttcttataggtgtgggaataatattggaaatttagattgtagaaagcctcctgtcatgtgctaactaagaaatacggagaattggaataattggatcatgactcccgtgtcgcctctctggtgacccgggaggcgaaaggccgacgcccagctccaaccccgccacgccccgtctgcctcaccgccgccggcaacgccaccgtctgcggtggtggccggcgacggcagggccgccctcctccctctcccctctttctccctgtctctttcttcctttctccttcctccctcccttcttctctaggtttgaggcttcccggaggcgtcggc

SEQ ID NO: 5012 - DNA, 1501 bp, Oryza sativa
tatttatgtcagaatcctatattttttctattcctccttttttcattcatgtgatttaaaggtgccttaagagagagaagggaaaagttttatgtaaataaatttggtttactaacatgacttaaattttctagacactatttataatgtcatcatcggcgtgaaaattcataccccatcagcccaccattttgtcgagttggggagtttgaggattgggcctgtgtacaagaggcagcgcaaccatgggcacggcccatttatcgcacctccagtacatgggccgcctccgtgggaaaggtgacgtcccagctcacacgtaaagcagcaaccgcgtgtcacgcgacggggaggggcagtcgagaagcgcatgacgagatgacacattgaaaccgtctcgcggtcatctcgtccatggggatggccgcgaccgagagagaaaccgtctcgtccgtccacttctctatccaccactgtccaccgtggccgctccgctccaccgcgtgtcccactcccaccacccccgctctcccgtccgtccgcgcgcttccccccatgcgagatcaccgtctcctccgcctcctcctcgttggctcgtcctcttcccccatccgcctctctctctctctctctttctctctctctccagtctcctccactctcctctcttcgagagccgctcgcgacgcgagcctcttggagcgcgcgccctataactaggcacccgtgtccccgtcccggatctcccccccacccgtcgctccgccccgtccccattttggatggattccattggtataaatcgcgccccgctgggttcctcctcctccgccgccgccgtgacagctcgtcgaggcatcgcgctccgcccggctcgccgctccgtcgcgagtacgaaccggtgagcgtgtgtttctccctcgcctccgcatttttccctcggtttttgaggcggcggcattctgattctgcgcatggtgatcctgagtgcagtgtgggtgtggcgacgatcggcttcggggacgcgtctgggctcagagcgtgttctgagaaggcaggtgtctctatctctgttgcgtcgatgcctcgtttccatgttgatttgggtgtaatgatccgagcgtaattggtggctggtgtaggttaggcgatttgattctgtacgaagcaccacggcgagagctcagaacgggaacgctgggagaagcatgaccgaggtatctcaccaagcttgcagttgctggcctttatattatgatttgatccatatgtacgtttttagggatcgcaatgcttgacacaatcatggtatgtttgtatgttcccagctccatgcaaacatgttctgtatctataaactggatcatgccacattttgccatctcttttaattttgcttctgattctaggatgtgccattttgtcttgtttttctaactttgtgttcaccttctcctttccttatttttaattatgtaaccacaggaaagaggatgtacaa

SEQ ID NO: 5013 - DNA, 881 bp, Oryza sativa
ttccttctccacgagaccctattaagtattaatacacatcgaaagtttagtttagattttattaacgtggaaatcccataattttactacacacactgtctctaggatagtcatttatctatattctctcttttctagatatttagaatatagataaaggactatcctagctatattaagtgagagttagtggttaattggtggataagattgaataaaatttgagttgattaatgtggcaacctataatagctgtaaatccgcacagcctagcccggcagacccacttattacacatagcaatctacttatacttttgtgctcgtttcatgtaaaagggttaactcagaagttgtatggttagagcgacaaggttttataagttggttttactcttgctcaactcataagatagtaccaattaagtgtacatgacactcataggccacatcctaattgggcccagagtgtcacacaaatagtacaccaaaaatctcttatatcatcgataagataggagaggcaaagtcccttatatgacaggatgtaggtatatatttggttaaccaagaatactccaatcacaaaatctattgcactttaggatgtgtgtagtcaaacataaaaatcataaattactaacgatatatgcaaaactattgagacatgatatatatatgtaaaaaaatgaaattgattagtagattatattttcaataattagtcaacaagaatgcctttatgtagatatattttcaataattttccatagatctatttgaaggaaaagttatgctaaaattacatatgcagagatgattatgtcaatgtctcatatatatgacaagtaaaatagaatgggatcaaaggagtatattacc

SEQ ID NO: 5014 - DNA, 1501 bp, Oryza sativa
agaggtccgagcaactttctacaattaatctagacgctgatcagggagtagtgttccaaatggatctatatgtgcactccatgcatcatggatggtgcaacttagtttttccttaatcatggcatggtacaagtattgttgccaatgtgaattgatgctatctcattgcttattacttacatgcaagctgttgacacaccaagcgagggggagggggggggggggtaagggagggagagagatgggtagttacttgaaccctggaattcttggcgtagctaatttctccttcccctccaaccatgtgaaagtcatgttctacgttaacattcatcgtggttgtgtgttccaatgggaataatagctaatacaataatgttgcactggctctcccttatggtgtgctatttatagaaattaaggccaggcagatttgtcattttctagaagtatgaaacaaaaagtaggtgattagagcccagagagggagaaagtacaatttgcaaccttctaaaaaggtaacacacctagagtaaatatttataatttgaataaaatagaaataagaaaaatatggagaataagggtgctggccgaaaaaaggaggaatagtagattcgtcacaaggcgaggctggcgttgttcaaaggtcaccccctccccccagcagcagtggtggcttggcacagctataaacaaataaggaagaggcccatgatggcgaggatgccccttccccggtgtgctggtggttcctagcggcgaaaccgacgatgtggtggtgaggcgatggggtgccgtgatgaaggaggtgaggacattgatgtcggccgaggtcaacgcagatcgaggtgattgatgggttggggaggagcttgaggccgccggcgtcatgaagtctagatccaagtactgaagaggtggtggtgagatctaagttagggtggagcggtggcagtgagagctacccagcacacaacaaagaccacatttgtttaatatcatatagcaaattttgcctaggttttataaacttattgtcatgtaaatttttgaaatcaaagttctaaaggttaaacaaaaacattcattcgactttaacatagtcacactcatgttgttgttgccaaaatagcaccctcttaattttaacaccactttaggaaggagaatgaactgtattagctcgttcccctggtgtacccttttaattaacgaaaaatataattaatcattggcttgtataggggaaaaaatttaacagataatttaaattaggggtccgtcggtatgtgtagaacggttaacagtgagatcttcaccttactagttatgaaaaatatttggtgacatataagagaagagtgaaaatcttaacatcgcttaacaccacctcgtaacctctaaaaaaagttgtgtggcattgggatgaccaaggaagccgaaagaagagtaataaagttttctttgatgtgctaatggttagagtcttcgtcttctc

SEQ ID NO: 5015 - DNA, 1501 bp, Oryza sativa
cctggttttatcgaaagccattgttcaacaagatcagggctaagttccggcatctcatggtactcccatgcaaagctatcaatgtattctttaagcaactcgattatcttaaccttataatcgttaaccttataatcggctttcatgtttttgtttacaaaagtcggccttggtatatttccatcacctatatctatttcctctaatggatcggccgatataaacccttttcctagcttttctacttcatcaaaatcttcaatggtttccctaatatagttctttgtagaccgatattcttgcactcacttttgtaaccactctaaattaacgtatgagaagacgaagactctaaccattagcacatcaaagaaaactttattactcttctttcggcttccttggtcatcccaatgccacacaactttttttagaggttacgaggtggtgttaagcgatgttaagattttcactcttctcttatatgtcaccaaatatttttcataactagtaaggtgaagatctcactgttaaccgttctacacataccgacggacccctaatttaaattatctgttaaattttttcccctatacaagccaatgattaattatatttttcgttaattaaaagggtacaccaggggaacgagctaatacagttcattctccttcctaaagtggtgttaaaattaagagggtgctattttggcaacaacaacatgagtgtgactatgttaaagtcgaatgaatgtttttgtttaacctttagaactttgatttcaaaaatttacatgacaataagtttataaaacctaggcaaaatttgctatatgatattaaacaaatgtggtctttgttgtgtgctgggtagctctcactgccaccgctccaccctaacttagatctcaccaccacctcttcagtacttggatctagacttcatgacgccggcggcctcaagctcctccccaacccatcaatcacctcgatctgcgttgacctcggccgacatcaatgtcctcacctccttcatcacggcaccccatcgcctcaccaccacatcgtcggtttcgccgctaggaaccaccagcacaccggggaaggggcatcctcgccatcatgggcctcttccttatttgtttatagctgtgccaagccaccactgctgctggggggagggggtgacctttgaacaacgccagcctcgccttgtgacgaatctactattcctccttttttcggccagcacccttattctccatatttttcttatttctattttattcaaattataaatatttactctaggtgtgttacctttttagaaggttgcaaattgtactttctccctctctgggctctaatcacctactttttgtttcatacttctagaaaatgacaaatctgcctggccttaatttctataaatagcacaccataagggagagccagtgcaacattattgtattagctattattcccattggaacacacaacca

SEQ ID NO: 5016 - DNA, 1501 bp, Oryza sativa
gagcaatataatcacctgacgcctggagtacttggcatagctaccttctccttccccactggtcatgtgtaaatcgccttcgatattgaccatggcttgtcttggattattagatatgtgggtctttgagtagcaacaataagcacaatattaatgcaactcaagtgtgggtactctctccattgcgaggtgccatcatatatagaccatcaccaagacatgtaccagcagtactatacatatgccagctagctagaagccagaatatctaaaattgtgcaagagaaatctgtgccaacccacaagctaacactggtacagtcgtacagaaagcaggtgtaactactggagtagtacgtactaaattagtttcgctggcggtgaaaacgaattttcatagacaagtaaacagaccacacggaaccaaaggcctaagaaacatcgatcttcacagacgggaaacacgcagcacaaatcaagatgtggattggggtcttcagctgcttcgaagctagtccgaaggagagagcgaggtaatccctccgtttcaaaatataagaatttttagcacagtgacgtatcaaacattttcaactttgactattaaaaagaacaaaaataaaaaagatcacgtggagattatgggtaccccatacccacagggcatagttatccgactagttatagaggataacttatatctatggaatatgtacggatcatgacttgggtattacatttccttgtatattacggaacagtctaaagtcctggtttgataatattgtaaagtaggtttagaaaatcgataccgtattggttaaggtttctatctcgtaataatcctgcccctcatcctatataaggcggataggaggtcctctagggtagaggattcacaattagatcgtcggatcaatattacacccggcggattcaaatccccgaatagtagtagggtattaactctcgttaagagggcctaaacctgtctaaatccttgtttctgcatccatccacttgtaggtctcatgcgctaccccgtttatattgccgaaatctagtttcgacagatcaatcatgtaaaattaatgttactagatttatcattaaacaaactatcataatgtgtaactatttttatttaaaacatcttacttttatatattattggtaaaagtagcatcttggaaaccgtatcagagtccaaaaaatgcttatattttagaatggagggagtagacaatagccaacatgaaggcgaggatgaggcagagtcagtttttggacggatggaatgcgaggacccaccatgccagtagaggccactagctccccaacatgctggcaatgatctgcctctcagctcgccggcggcgaatccgtcactcccaagccttgtggcggccgatccacctctagtgatcagcttatcagcgttggatctagaattagcgcaagactaggcttcatcaaagcaccaagccatcactatcgcagt

SEQ ID NO: 5017 - DNA, 1501 bp, Oryza sativa
atttctccttttccttttttccaattatcatgtcctctccctctcctacaaatatcctctctttcctcctccttttatctttttcctctttttttctctcccaaaattttctcccacgaatattttccttttgaaattattattaagttgtgtatgcagaaagtttgttgctttgcaaatgctttccatctacatgtaaaaagaatttcactaatttgaataatcaaaatctcaatctttagtcgataacgtactgcaaaatacacatgtatcaacttatggaatagcgacccgatcgattttttaggctatggaaatgtgtagataagggatttcttttgtgtgatgatgcatgaagcaagtgcaaccgggttcaatactatatatggtttctggctttgctttacctttattttgtttatcttgtttcggtttgtcgtttaaactggtagagtttttatcaatcatgaaaattatgttcacttgttgcaacgcacaagcatttttgctaatctgaattaaaatttcaactaagtgtaaaaaacctttcgatctgaaatatgaaacttccaactaaaatctcaaaacattcatctaaaaaatggcaaaatttttaattaaaaatataaaacctttaaacttgtgggctataactaccgattcattctttctaaaaaaacttatcaattgaaaaattcaaaagtttctacccaaaatcctaaactttcaaatcaaaattatttcaatttgaaatgtttcaactgaaaactttatactcaaatcagtggaagtttctagggatactcctatctggatcagataaagaggaggaaaaaaaagaggcacttacatgtcactcggaaggatgagcctacggttgtaagcatctcttcgtgtcgtggtagaggaagagggggtagggtgaatcagcatgctaggtaggaggtcatcgaaacacaaaagtctaggcttacatgtatgccgtggtggaggaggcggggtagggtgaagcaaagtgttgctgaagagatgaaaaagatatgtgctgcatgccaccaggatgctattagctcgccatcgtctagttcaagagaaggtagaggggtaagtaggtggtgcccaagctagttgcgtcaccggccgggaggtgacaaagcgagaaccgtagaaggaagaaaagaatcacaggaggaaccatggatgaaagggatcgagcgatggggggaaaggataagtggataaggcttgcactaattccgttgctaggtaacgtgcacaaagtaggattcctgaagaaacatagctggtaatcgaggcagcgatactttggcgtgatcaacaagttcacacttacatatattctttcttatggtgaaacaaataaggttccatccttaaatgttaaaaaaaagaatgttttggtttaaattcttaccattcttaccaatatgaaataatgtatgctttggtttaaattcataccaatgtgaaattagacaat

SEQ ID NO: 5018 - DNA, 1501 bp, Oryza sativa
agcccgccacacacaggcacgccgttgcgaatcatcgccaccgtcgcctagctcccttgctcacaccggagaaatcggggaaaatgggagaaatggcctaagattaaggtttttcagaaaaccctgcttccatgatcagtttgaagcaccctgcaggactgatttattaaagtttaaccatacaaacagaaaactaagcgcacaactgtcatgtaaacttttgaaatattttgtaacgtagtttatgctgccatcgaaggatactatggaatttcaccctaaaatatgacctgtgtacaaggagattttttttagataatgtgtacaaggagatatcggctaaaaagagaaatatgctcataatctggagtgatttgtagcttttcctttcttttatttttgggggagtaaaatatgtcaaaaatagtttaggggccggtcaattgtaaaaaaagtaaatagattgaggtagttttttttttctggcgacctaacccattataaaaaaatcagcgacttacgtaaaatgtataaattaagcgcgctgctatttaacggcgactgatggcggaaacatgaattagagatttttttttagataatggaactttttattgaacttagactagatcgccatccatattcctgggtaaaaaacaaagactaaattgccactcatgaacaactcattggccatttcctctaaaagcacagagttttaagggccaccaattctaagactagatcgccatccatattcctgggtgaaaaacttcttaaccatcttctccaaatattgacataccacaactaccatatcctgcgaaccaggcaaccaaacttctataggatagcctatgtacgaagccaatggataagagaatatataaccttcaaatggatgtgaggatactaattaaaagtcatggaggaagcctaaacactgtatggcctaatcagtttgatgattatatgtgagaaaaaaaatgctggatcggagggcccaagctactgatcgttccaccctgcagtctccgccactatggaatgtacctcgttgctgtctagctgcctgaagcatgtggatcacacgccacaaagtttatatgtggatgagatttttttcaggattataatcttgggagtgttgcaaattaatgtcatatatatatggaccatatgtgatagcccttaattttcgcacttttcggtggtagagattgattgtcctgaatgcggacaaacacagcagcaatatatacgtggggaaacaacaattaattaccatcccactttgtaaatatatatttgtatatatatcattaattgttgtaggcgtgataaacgtgtacaatcaccatttgcatctataaatataatggcaccatgatttctatatctatatatgctacttgtgtgttgaacctcccagttgtatacactcctaaaaagaagttattaggtctcctcctgtatcacattatccacactcttagtctta

SEQ ID NO: 5019 - DNA, 1501 bp, Oryza sativa
aaaaatacaccatttagcagtttgaaaagcgtgtgcgtggaaaatgagggagaggggttgggaactagaagttccgaacacaccctgggactgcgatagtgatggcttggtgctttgatgaagcctagtcttgcgctaattctagatccaacgctgataagctgatcactagaggtggatcggccgccacaaggcttgggagtgacggattcgccgccggcgagctgagaggcagatcattgccagcatgttggggagctagtggcctctactggcatggtgggtcctcgcattccatccgtccaaaaactgactctgcctcatcctcgccttcatgttggctattgtctactccctccattctaaaatataagcattttttggactctgatacggtttccaagatgctacttttaccaataatatataaaagtaagatgttttaaataaaaatagttacacattatgatagtttgtttaatgataaatctagtaacattaattttacatgattgatctgtcgaaactagatttcggcaatataaacggggtagcgcatgagacctacaagtggatggatgcagaaacaaggatttagacaggtttaggccctcttaacgagagttaataccctactactattcggggatttgaatccgccgggtgtaatattgatccgacgatctaattgtgaatcctctaccctagaggacctcctatccgccttatataggatgaggggcaggattattacgagatagaaaccttaaccaatacggtatcgattttctaaacctactttacaatattatcaaaccaggactttagactgttccgtaatatacaaggaaatgtaatacccaagtcatgatccgtacatattccatagatataagttatcctctataactagtcggataactatgccctgtgggtatggggtacccataatctccacgtgatcttttttatttttgttctttttaatagtcaaagttgaaaatgtttgatacgtcactgtgctaaaaattcttatattttgaaacggagggattacctcgctctctccttcggactagcttcgaagcagctgaagaccccaatccacatcttgatttgtgctgcgtgtttcccgtctgtgaagatcgatgtttcttaggcctttggttccgtgtggtctgtttacttgtctatgaaaattcgttttcaccgccagcgaaactaatttagtacgtactactccagtagttacacctgctttctgtacgactgtaccagtgttagcttgtgggttggcacagatttctcttgcacaattttagatattctggcttctagctagctggcatatgtatagtactgctggtacatgtcttggtgatggtctatatatgatggcacctcgcaatggagagagtacccacacttgagttgcattaatattgtgcttattgttgctactcaaagacccacatatctaataatccaagacaagccatgg

SEQ ID NO: 5020 - DNA, 1501 bp, Oryza sativa
ctgcatacacaacttaataataatttcaaaaggaaaatattcgtgggagaaaattttgggagagaaaaaaagaggaaaaagataaaaggaggaggaaagagaggatatttgtaggagagggagaggacatgataattggaaaaaaggaaaaggagaaatagaaaaaaaaaggagagaaagaagacgttgtcgaggtaggggtgcacggcgccgagtggaggcatgcgggacggtgtggtgggatgatatgggtcagttgggttgggctgagagatggagggggaggggttgggctgggaaggggtgtcttttttttttataatgcaatagagtgccgacatttgatcaacgagctacaaccaattattacataagctcgcgctagaaaagagcacataaacaagtcttaaaaagcacaccgaaaaaacctaaagcaacgacaagctaataaaagcccacaaaacataaagaccctttaattattgaatcctatttgtaaacctccaaccataattggccaaaaactgcaagaccatcgacttaacaatgtgatatctagttttagctcggtgtcctcatcacacttttgtatctaaggctagaaccggagctaatacgttaccctaaagataacctgcatataagatgaattggatacaggtgactaaaactaattaaaaaaccaacactaacactgatgacgtaccaatttttttacgaaaacatcctcaatttttttaatagtaaagaagagattataaataaaaacagtggatctcaagttctatcccctccggggtactgcatacgcgagttaagttcgacgtgcggctgcacgaattagcagcccctatgtttcctcttacatatgatgagaatacgattaaatataaattacctcttcgcacatgatttaccataaaattccgttaaataatgtattcttttatgagtgatatgatcgatgatcgatacttttctgcatgttatttggttctgaaataattctaattaatgggattagcagtacagtatagaatgctagagggcggtacagacgttaggggataatgttacatcctgacccacatccggcggcgccgagcactaaaatctcgtcgcgccggaacttggatgccactaccgtcttcccttgggtcccacggtaggtagctagcgacaccaaacacagctgaatcctccagccaaattcgccgccaatttcttggatctagctagatcgtgccattgccacacgagaacctctcgatgacgcgtcatcatatcgctctcgtacgtccgaggatgcagactgatcgtcctgctatacgtacgcttgaatcgaaactggacatcgttggatagacttgttgggggtagttctcatcttgttgaatgccgtgccgctgtcgattatttctgagattctggccggccgcctccacgggtcgctaacacagcaccaatgatcgatcacctttggccattgtgaattagtttg

SEQ ID NO: 5021 - DNA, 1501 bp, Oryza sativa
ggtttacatcggttttaaatattgaggagacttatatcggttctaaggttaaggttaagggatgttgtgatacaaccaggagcttacataagaaacaaaatagatttattctaaaaaaaagaacggagtaagcttttttttctcaagatttattccaaatttttgcttaataattttgggtttactatatattctatagttatatgagtagtatcgagtaggcgtaggatatttaaagaagggaaatgaatgtaaatttgttgttatagatttattttttgcttaataattttgggtttctatatattttagagttataggagtagtgtcgtgtaggcgtggtatatttatagaaagcaaaggagtagaagttcatgtggctggaaagggaagatagttttggaagcctctagaatctatatgtgatatttttctctagatttttcctcacatatgattgttaggtgttttttctctagtataaatttatgatttttctttaaagaatgaggtgccaagtgggccaatcaaaaactagcaaaataaattgtatttatactcgaactcttattttctttttttcctttttgctaatttcagattttattttatttttttatttcaaatattaattaatctcgtattgggttcttatatggactcttctttcaatagtgcttatttttaattccgaattttagttatttttaaattgtatctctagttagactcttattttctttttctccgattaacgtgggaatttctagctcccacagcgaacgtggtgactcctttcaaagctgtcttaataataataactagcatggtggcccgcgcagattgcgcggctagcatctttatattttttctcatataatagcttaaatattttcacattttattattaaaatatattaaaatggtaacataattttaaattcttggttgaactaacaaacgtgtgatatttttaatgtattgtatatacgtgataattatttataaattgtatttgtatatggactcaagactcatatttcaatattccttattttctaaatttcgaatttcctttattcataagttctattcctatatggattctagactactcttccaatattcatttttcttagctttgaattttagttatttataaatagtatttatatatggactctaaactcttctttcaatattttttttaaaaaaattttgaatttcaattattggtaaattgtattcctatattgactgtagacattttttccaatatttctttttttttaatttcagtaatttataaattgtattcctatatggactcttttttcccaatattccttatttgttaatttcgaatttcagttatttataaattgtatttctagggtctcatcttttcgcttatgcttattagccaaaatttgaattttaacctattttgaggtttttttcattgaagtttattttcagcctttacttttagatcgctaag

SEQ ID NO: 5022 - DNA, 1501 bp, Oryza sativa
gccgggcggcagggagacggtggtgtggtccgagaagatgaacgagtatctcatcgacgcgttgctgcaccagcaggcgatcgggaacaggggcgaggggaggtttcactccgcggccttcgatagcatcatctccggggtcgccgagaggttcggggtggccatcgacaggtcaaacatcaagaaccgtctcaagtccatcaaggagaacttccatgaatgcgagaacctcttccagaaccagagtggctttaagtggagcgcgatgaacaagaagttttatgctgacccaactgtttggagggagtacatcgaggtctgtttattttttgttgtcaatcaatcagcattgctgaaatttctcaagctgttttgaactctttgctttgatcttgtagaggaaaccggaagccaggaaatggatcaacaagcccattgatcattacgataggttactagagctattcggtaaggatagagaaagatgtctagcttctggcagcccaaagagtccaccggcaaaaaaggcgcgaagagacccaccaaaggagaaacctcaacggacaccaacaaatggtttggtgtcacccattgtcaaaagtttgaaagacatggaatctcaacggacaccaacaaatgttttggtgtcacccattattatcaaaagttcgaaagaaatggtgaatgaaaacgaggtatctatctctgaaactgaataaatatgagacatataattaattattttgctgacatgatttgttttcatttcgttgaatgagggtttagcattagtaaaattggtagggtgattggttgaatccttatttttccacctctaactatttgttatgctttcttatgcaagtgtttgtttcgtcaccaaaattgtggcatgcagtgtttctttagccctataaacctacatgtgataaacacagtattttactagcttggtcagaattattccgtggactatttggtcgcagctgcaagctacacttggcccaacagtaatctatgcaaagtagtctatgataaaatagggtaaccagatccttttgttcagtaggtgcatatgcatttttttaaaaaaaaatgcaaataagataaattgtaccttgagctttttgttattacctgcgtgctgcatgttctcataccgctgtacaatttctgtttgttattttgtgcatctgctgtcatcaaattgtctatcatttcattcatgcaaggttgtatgtaatccattgcatctcgccaaaacttcactgtacacaattgcttctctgcattgagataatccattgttctaactgttcttttggtctctttcacttgaccaaatcaaagaatgaatgcaagtctgcgcaatagtctctgagttcagtacatgagtaaaatttcggctatatgttcttgactgatgagattcctgtttctttcaggtccctagcgaggcggtaacagaaattaacatagctgaggagcaggatctatcaga

SEQ ID NO: 5023 - DNA, 1501 bp, Oryza sativa
cggccagaagggcgcggaaggttcagaaaaaaaaataataatatcgcggcacgaatctaggagatattggaaaccgatgctatctctaacgagttatctgatcaatctatcgatagaaccatgggccgaagcccgtagtccaggctcatgcataacgtacctagtccatatgcatttaactccctcaatctaattatcttatcttatcttaacctaactaaaaatttatgcaaaattggttatatagcatcgaaagtttacgtttttttatagcacttaaagatatcggtttactttaatagtactcaaagttcactcgttcacattttgaacacttccatcaattcccgatcgttttctgtccaccttagtcgctattgacccatccacgcacaccatataacctttctacccctcattgcctgcattctacttggacctctctcgccggttcggagacagcgacggagccccacgcggcgccgttgtcctcagccggcagtgtaggttccgggagggcggggtggagcacgaggcggcggtgcacgccacccgcggcagtgacaacggtggcgagggggaggtgcgggtcagcatcgatgggaagagagtggctgaggtgagctgtgtagggtggggtttccgcagcaaccgcgccaccgtgctcactgacgttgagatgatggacgtgttgtgggacgtgcacttcagagacatcccagtaagaacaagatgagagatggagagagatgggtgaagggattgactgacatgtgggccccacctgtcagtgggtcctacaatctttttaatgacaaatgggtcccatgtatattttttaattctgatattataaatgggtcccacttatgtgatgtctgatatacaagtgattatatagtgataatgcagtaatgtagtggagtcatgaaattggtgctttttaggttttgattgagccaatggggtgggcagtttttggtgcacccatgggttgccactactgttatttctatgatgcactgcatattacaatttgattagtttgtgctaagttaatgaaaacaattattttttaatgttcattatgcaatgaacggtttttttccggcacaattaaaattaagttcacccattgcaaagcacatgactcatactagatatcttaaagcgcctgcgtttgccgctcccaaagcgatttggctcctgttgactaatccgcttgagacacctcgctaatatggattgaatatggttgggttttagatgcctttcccgtggaccattcgatcctgtgcatgggccacatctatccatccgttttttcctaacgcccgtgcttaccgcgtcgtgggatcgcttggcgccgagccctccacgtcgcccactcgtctcttccccttcctcatcctcacgcccgctcgctccccccgactccctgaccgcttgcttcctcccccctttctcccgcccctctccaccaaaccctaaggccgtctcc

SEQ ID NO: 5024 - DNA, 1501 bp, Oryza sativa
gctacacctagcttagcctatccaatatccgattcaaaaagagcttggattgctaccttttctatctctgtataaagtcaattagtcccagtgttgggaagagcccactgtcaaaagatcgttttgctaggatgcttgcttgaatctagttacttccaaaaaaaggcatttggaactctatacggtatggctacaaaccgaatgaagaagtcgtaatcaggatttgatctatctggatcagcacattttattacaacttctttaggagtatgacatagcccccctccctcccagatctggccgaaggagggaggggggaggctggccacagcgaatacggcacggggcagcggcggcggccacgacgacgggtcggggcggcggcggcagccacgacgacgggtcggggcggcggcgacgacaacgcgcggggccgcggcggcggctcccctcccccctcccagatccggccggaggagggaggggggaggccggtggcggtgactacggcgcggggcggcggcggcgacgacgacggcgcggggcgcggctcccctcctttcccctccaaaatccggccgaaggagggtggcggcagcgaggcgcgtggcggcgtcggcgagccgccgccgtgattttttttgttcgtttcatggatttttgcaggagggctgttgtcccgactgtgaaaatcgttgattttcaccgttgttgtgctacaagtggtccaacccttcgcttgcaaaattcacttttgtctgtctgcgaaaatactttttctagtagtgaatgttgttctttggatggatatcaccaaggacatattactcgaaaatggaaaggcatttgggcaattgggcttgggatagtcagtgagtgctggcctgctgggtagatcaggggctaagggcatctgcctcaggttattggacgttgttccaagttccaacaacgaccaaagcacgatgttgttattaacagcatccacatctggatgccctgcaacatatacatagcacccatcccatttttccaaattacttcctccataagaaagtatatgatgtacttttataaaaataaaaagtataaatcttgaccaacaattaatatgattacaaacacacttaccaacagttaatcagactattcacatatctctggatgccctcactctgcctcccaccccacctgccatcgaatgctccccctcaagttgcatcgccccacacaaccactcaagccaagtttagttccaatttttttctttaaatttctaacttttccatcacatcaaaacttttctatacataaaaacttttaacttttccgtcacattgtcctaattttaaccaagctttcaattttagcgtgaaccagtccattgatagctccctcctcttggactacctccacaaaacaataaaggccgtggctgccaacatactggcctcgcgccaccccaagtaacattgcttgccttcctcggctcaaatgaggc

SEQ ID NO: 5025 - DNA, 1501 bp, Oryza sativa
gcctggattgccgccgcgtcgctctggtccaccggcttacccgccgccgcggcggtcgcggccgccactccagagcgcggccgatcgtcacggcgtccttgtccagagagccggacggctgggtggccaccacccgcggcggggtggcgagccgcgccaccacctgcccggcgacggactcggtgacgacgcggcgcccggggagctcggtctcggcgacggcgacggcgacgccctcgtcggcgatggcgccggtgacctgcgcgcgcccgacgtgccccgcccgcgcgttgatcgccgcggcggactgcatggcggcggcgggcccgcccttctgcgcctcgccgagcacggcctcctcggccgactgcagcttcgcggcgtccctgggcgccacgggctgcccggccagctcgccggagacgtcgaacacgtcgccgtacatcaccggccgggccccgctgccgtcgggcggcggcctcctcggctgcccctggctcatgcttgcgtcaaaagaacacacgtgacgtggcacgttctcgtggcgcaagtgcgcgtcgtgcctcggcggcgaggtggcgcgcggcgcgacgagagtatttgtacgtgacaacgtgagggcgcggggcgagagaccgagagtacgtggcgtcgtggggggtttacaccagagcgcgccggtggcggtcgaaaggggtaaccagcgagagccgagagggtatgggtatggcagatgcggcgtgttttgattctagctggtagattcgagtgcttgagccacttcacggactgcatgcacagtgagcgttgtgctgctgcgttagctagctgaaagagatggagatgggtttttcatcttttgcctcgtcttttacataccgcttaaatagatatattttttaaaaaataattaatataacatatatcattttataaatatatattatttttgaaggaaaaaaatcttttttagaaggaacatttataaatatataatatcaaataatactgacgtacttttcttataattttagaagtttaatttgaagttgcatatatatgatagatatattttatattaatctttcttattattctttttaaaaaattgataactgtttaagataatactctaaccattttatattagaggtcaattattcaaagttctttagtttaaatcaaattcatagaaaaattagcaaaatttataacactgaatctcaataaatttaacattaaatatattttgataagttttaatcaaattcatagaaaaattagcaaaatttataacactaaatctcaataaatttatcattaaatatattttgataatatgtttgtattgtattaaaaatatttgtatatttttactataaacttgatcaaacataattaaagttaaagtttaatagtttgacaaagaaaagttataagatttataatatgaaaaggtgaagtatttagataatatatgtaaagaataaggaggtatccg

SEQ ID NO: 5026 - DNA, 1501 bp, Oryza sativa
cgaatgtacacccgctctggccgagcagttcgaccaaatctagcgaatttagcatgcgtttgattatgtattagcgcgcggtttgccgaacgctaagcgaatttagcgagtgcttgaatccaataaaataattaataatatgcgtttgatcaagtattactaacacgcaagaattattagacttttttatcgtaaataaatggagaattacagggctgctaataaatcgtcttggctactcgagccatgttgcctgttgcgagagcgagaccagtgtgaccgatcggcacgacgtgccacgctcgaaacaaaggcggttgggagcgccgaactcggcatggcagcacacggtggtggcatgtcgtgtcgaccgctcccgatcccaatccgctgcgaacatgtctcgcgcgcgccttccaaaaaatctgtttcatggcacgttgcacgtagaaaatgggaaagtggttttatcccttaagatatctcctcattttatgcttacggatacctccttattctttacatatattatctaaatacttcaccttttcatattataaatcttataacttttctttgtcaaactattaaactttaactttaattatgtttgatcaagtttatagtaaaaatatacaaatatttttaatacaatacaaacatattatcaaaatatatttaatgataaatttattgagatttagtgttataaattttgctaatttttctatgaatttgattaaaacttatcaaaatatatttaatgttaaatttattgagattcagtgttataaattttgctaatttttctatgaatttgatttaaactaaagaactttgaataattgacctctaatataaaatggttagagtattatcttaaacagttatcaattttttaaaaagaataataagaaagattaatataaaatatatctatcatatatatgcaacttcaaattaaacttctaaaattataagaaaagtacgtcagtattatttgatattatatatttataaatgttccttctaaaaaagatttttttccttcaaaaataatatatatttataaaatgatatatgttatattaattattttttaaaaaatatatctatttaagcggtatgtaaaagacgaggcaaaagatgaaaaacccatctccatctctttcagctagctaacgcagcagcacaacgctcactgtgcatgcagtccgtgaagtggctcaagcactcgaatctaccagctagaatcaaaacacgccgcatctgccatacccataccctctcggctctcgctggttacccctttcgaccgccaccggcgcgctctggtgtaaaccccccacgacgccacgtactctcggtctctcgccccgcgccctcacgttgtcacgtacaaatactctcgtcgcgccgcgcgccacctcgccgccgaggcacgacgcgcacttgcgccacgagaacgtgccacgtcacgtgtgttcttttgacgcaagca

SEQ ID NO: 5027 - DNA, 1501 bp, Oryza sativa
tggcatgggagttgacgaccatcttcttcggcatcgcggctatctgtggtggcggtggctggtggcgcggcaggcccacccacagtcgcctttgtctccaccttctcgcggaggccgaggccgcttccacctccgcaccatccaagacggtctctcgcataggctcccaatgtcaccgaggttgagcttgcacaccgccgtgaggaatgcgagctcgatgaccccttacccggtcacccccctcctcttctagccgcccacttgcctctctcctctcctcggacaagctcgtcagccgcctccgcctccctctctcgcctctaccttcctcacacggtgcccggacgagctcgctcgccaccaccccacgaacgacatgtggatgctgacatgtggggccacacgttttttattaacttttcctgactagaataccacataagtcaaaaccagcccttcatactgctatggacctaacttagacggctttgctaagatgaagggtgaagatttgcctgttcggcaagccaacctgcgcttttacgtctgtacagcatagtcatagtcgaacggctgaagcattgcagcggatggccattgtagcaatgcggtaatatgcttgtcctgttgcaaacctataggagtagttgctgattggctgctgtagttgcgctgcagcgctgcaacggctagttctgccgaacaagccaattgtaatttagggatgtcaattaaacgtgaagtaaagataagggacggtaattggacttgttccttctcctttttatgtgtgagaggcccagtaaaatttcttttgtactgtacacctgtagtggttctatgctttgagatgatcttttcttttcatagataaactttaattttaatccagatagtactccgtacaagattttgacatttagcggaaacgggtagtacgagtgttactctacgtgtcaactgtcctgtcccacgatccattttaaagaggtggtacagcaacgccgtgacagacagtctcctgttgtgaaatctcgcagcaagcgacacccgtactcctgaaatactcgctgtcaagcttctgaatcatctctccgagcgtttctctgttcttttttccttaattaagacaccaggtacaggtggagcctgatactcctaccacgtagtactcctagatttgatgagctgggaaccactttcttgatactgttaagatcttcagatgatgatattttggtgcccttttcggttagtatgtttgaaaatatctttggcaccgacatcctcttgtcctctgcaacctgaaagcaaaacattttttttccctggtcaaggacacgcgctcacggcacggctcaaacaaaatggagcactttgtatgtatatactccacgtagcactccagtatagatgaaaagttcagaactgtcaccacacgacaaaacaggcagccttccatgacaaaagacaaggggaaaatgaactagtatagccaaga

SEQ ID NO: 5028 - DNA, 1160 bp, Oryza sativa
gggcccatctcccccagttctcctctccgatttctcgccgcccttcacgtggctcacccccctccctctcacggcccaactgtcagcctcacatgccaaccacgcggcggggtggccaaccagcatcctccaggtatacaaaaagaaggggtcaatcgggtggggccatctgggcccgcgcggttgggcgaaaagcgggggagcccgcagctgcagctgcaactggcaaaaagaaaaaaaagataagctgggatgggtgtgagtgggaaggggaagaagcttccagaactctcgccccgggccttcccgaacgttcgccgccacgtcaccgcactaggcagcacaccatcccggggggaaggaatgaaggctccgcttccagaactgtctggaaacttccgcccccacatcccaacccacccgacccgacgggtatatatataggccggggtgggggcgcgaatgctggtcctggtttcgacgagctccatcatccaagtacgaaggggataaagggactcatcactccacccagctggagagaaaaaaaatctcagctgtacttgctcgtgttctttcctctcccttttcttctccgccatcattttctctgtactttggggtgtacttcatccttctgtattttcggttctttttgctctgatttgtcatcttttttttgcgagcgagctcgttcgctcgccaacgaacactcctgctgtagctgttcttggcgttaatgaaagccctgcattctcgcatttgcaatcgccatttattcagctgtgatctttgtagagtgttgtgttgattaagaatcgcatgatttgggttccattggtttgtttttgcaagagtttttgtgtttttctctgatcccctttcagctgattgaatgatcatcttctcccctaattctccatctgtctttggtggtgattgatcacttaaactctacacaatttgatattttttgcaaacttttcagaggcaagatcgttccagattgaattcgttcggtggagggcgatatattttttttcggcaaggatcgccattctcaccggtcgttcaaattcttctcctgcgttaagtggctgtgtgtgctctgttcgtcatcttcctctgctactcaattgcattggttggttggttagaca

SEQ ID NO: 5029 - DNA, 1501 bp, Oryza sativa
ttaattatcaaatattagtataactggttttttattagtccatgatgacaattaatcagactagttcgtgtatatatatatggccatgcatgatcgatcagttgcttgattttctaggccggtttaatttggtcgagatggaacatggcatgcatgcattcgcgcctgacggagctagacacgctccgtgcatgcacgtactgcacgaaagctgcctttgctaaatccccttctgattaactaagattccatctcccattttttttcttgaagaaaatattcccaaacctaccaatcaaactaaggcacttaataagttcatccacattcgtcgacatttttatatatccttttggttccatcaccaatatattatatatgcgattcttgatttcgaccaacaaggtagaaatcttattggtccttcattgctcaatccctgtttaagagctactcccccctatcaaaatataagtatttttagaatagtgccaagtcaaattttttaaattttgcctattaatagtaaaaaagttaaaaatattaatcatgtaaatttgatcttactatatttatcattaaacgaaatatcataatatgcaactatttttatttaaaacattctacttttaaaaatatttttagtaaaagtagtatctcgaagaccatgtcaagataaaaaaatacttacattttgggacggagaatgtaccttattattattttctattttctgggtcaagtcatgacctgatcctgcaacctgcatgcatacataagcgtagaccatgtcaagagaactcgataaacgtagaccatgtacatgtaacttgatgagttgtttaatcatcgtgtgattaattatctttatatacactgtcacaatcgtcgacgataatgtcaatactccacctgcagccgcctgcatcaccgttcgctaagctgcgtgcactgcacaacgtgatttcacacggccattttcactttttggtccaagcttagttaggccccgtatagttcacaattttttttcctaaaaacatcacatcgaatctttggacacatacataaagtattaaatataaataaaaacaaaaactaattacgcaattagggagaaaatcgcgaaacgaatcttttaagcctaattagtccatgattagccataaatgctacaataacccacatatgctaatgacggattaattaggctcaaaaaattcgtctcacagttttcaggtgagttatgaaattagttttctcattcttgtccaaaaaccacttccgacattcggtcaaacgtccgatgtgacacccaaaaattttcttttcccaaactaaacagacccttagcttacggcttgaaattaattaactagctctcgtgatataggttttcaaatattttgtttagtactttcactagtccacgatcaattggccacacctaaaaaggttaaactgcgtggtaacttctccggcactgctaattatagccacc

SEQ ID NO: 5030 - DNA, 1345 bp, Oryza sativa
cagttacctgtcagtaacagcaggaatgagccttcaggatgtgcgaggaaagataccgtcttggcaaccttctccaagcactccttactctgcacgaacaaccaatcgcaatttcttctaacattttagtccaatcgaatataaatcaagaagaagaagagggagaatctctctctgcataccaggtagggagggtcggcgacgacgatccggtaggcgtgcttcatcgccgccggaagctcctccggctggttgtagtcgtagaaggtgaagtcgccgccgtactgcccgaaccgcacgtcgtactccagcagctgcgcggtcacatcagggctgctcgtcttgaggtaggtgtagagcgtcgggcacgcgacgcaggccaccgctgcggaggaggccgggccggagagggagacgaggcgggcgacctcctcggcgagcgcccgcgccgtgcgctcgtcgtaccagaactggctcagccgccagtcctccgccaccagctccaccccgccgccgccttcctccccttcctccccaccgtcccgcccctgttccagaagaaactcccgcagcgcctccgccgccgccgcgctcagctgcggccggtcatcctcctcccctctcacctcgcccctcactctctcctccacaccgctcgccattgttgtctcccactccccactcttcgccttcctctccgatagaggcggcgcttgtaaggaactttccaccacgacacgacgagcccatgggcctcaatgggctggaataaatgggcctaggtgggccgaggcgggctgagttcccgttattccgctgcgcgtagtggcgtcgcggcgtaggagtacgggggaagaacaggaagagcggagagaggaaaaggagaggagagagatgcctgcgcctgtgtaaaatcctgtgaattccaactcgcctccgaatcctgcgtcctctggtcggcggcgccgccgccccagggccaccacctcgccgccggtaaaccctagccgtcgccgcacgcgggggaggagtcaacaacaggcgggaggaggggaggaggcggaggcagcgactgcccgccgcggctccgttttggtcggtctcattcgctcgttcctccgcccgaggcggcgccgccgcccatcgcctgttcgtcgagcagccgcgggtagatccatccggtggttcgcgtggccgcgttgaggagggtgtgctcggggggagcgggggcgtagtgagagttggcgcgtgcgtgcggcggttggtttgcttgttctggaagcttcgtgggcggccgatccggtttgggtgcaatcagcggcggcaatgtcgggatcgtcggcgg

SEQ ID NO: 5031 - DNA, 1501 bp, Oryza sativa
ttgatctacagtttttgaaccacgccctcggcctgctccaccgcgcccccttccacggccttgcttttttctgtttgagatgtctatggatggccgtgtgtccatgacttctgaatgctttaccgcctcattagctgatccctagcattttcaatgaaagagtgcaccaaacagaagaatgacaagagtgagccataagcaagtacaacaaagactatcccatactatttaattctatcgatttcatattgcatacctcaaaatttccaacagctaggccgtgatcaccatctggcgatctcgggcgcttcagtatgttcttctgtatcaagaactcctcgccattctgatttacggaatgcaagtagcattagcaggtataagcaaaaaaaaaaaacaaacaaactagaggtgaaaatattggcaaatctgtagctagaaacaattaatcaagctaatcatacaggtttaccacagtatacactataaatggctccaagcactaaaaagcacaatcatcgcatcactgtcgaaaagtaatgtgcaagtaaggaaatcgatggagataaatatgacactgtactgtagttgagggggaaaggaaaatagcaggttggagttcgaggtttagggctgacatcatcgtcggaagaggaggactcgggcagctcctcctggtccatgaacgtggtggcgggggcagaaggaaccaccagatggtgcggcggcggcggtgatggcaccggagcggccttgccagccatccgtgcctccagcttggcgagcttggacgaggacgggttggaattagacgagaggtgctgcactatatcctcccccgccgccgacgatcccgacattgccgccgctgattgcacccaaaccggatcggccgcccacgaagcttccagaacaagcaaaccaaccgccgcacgcacgcgccaactctcactacgcccccgctccccccgagcacaccctcctcaacgcggccacgcgaaccaccggatggatctacccgcggctgctcgacgaacaggcgatgggcggcggcgccgcctcgggcggaggaacgagcgaatgagaccgaccaaaacggagccgcggcgggcagtcgctgcctccgcctcctcccctcctcccgcctgttgttgactcctcccccgcgtgcggcgacggctagggtttaccggcggcgaggtggtggccctggggcggcggcgccgccgaccagaggacgcaggattcggaggcgagttggaattcacaggattttacacaggcgcaggcatctctctcctctccttttcctctctccgctcttcctgttcttcccccgtactcctacgccgcgacgccactacgcgcagcggaataacgggaactcagcccgcctcggcccacctaggcccatttattccagcccattgaggcccatgggctcgtcgtgtcgtggtggaaagttccttacaagcgccgcctctatcggagaggaaggcga

SEQ ID NO: 5032 - DNA, 1501 bp, Oryza sativa; identical to SEQ ID NO: 5021

SEQ ID NO: 5033 - DNA, 1501 bp, Oryza sativa
gtagagtatagagtccatatagaaatacaatttataaataactaaaattctaaatttaaaaaaaattgaaagaagagtatatagtctatatagaaatacaacttagaagtaactgaaattcgaaattaaataaaataaagaatattaaaatatgagtttagaatccacatagaaatacaatttaaaataataaaaaattagaataaaaaaaggaatattggaagaatagcctagagtccatatggaaatacaatttactaataacgaaaatttagaataaaaaatggaatattgaaataggagtctaatgtacatataggagtataatttagaaataactaaaatttttaatttaaaaattagaaatataggaatataatttataaacaataaaaattcagaattaaaaaataaaaaatattgaaaaatgagtttagaatccatataggaatacaatttagaaataattaaaatttaatacgaatattatacattggtaatttgataaaattagtacaaaatttaaaactatgttgttattttaatatgttttaataataaaatatgctagccgcgtaatctacgcggcccaccatgttatttagaatcaacttagctccatctgcccgttgcacggtaaaaagggaagaactaagtaaagctaaaataactattaaccgtttcatggtaaaaaaaaaaggcaataatctggccatgaacttgaactaatatgataagaagcatatgcattgttcataagatacaagaaaaaggcaaaaattgagtttcctttaaaacagaggagaaatggggaaatttgggggattaaagaaatcttctggaaaacagttctacatgtttttttaaacaaaggaatagctttcccaaaatccttttgagtttcttatgggatagttcatttcataaaaaaatttaaaggaattttagaaagttgatagacctcatcttttattttttttctcggaattcctatgtttttttttctatgatgctaccaaactaatatttttaccaattcatctatgtttttttaataatgctaccaaactaatatttttaaccaattcatcgggattaactgcatgtatgatagattcaataagacgtgacattctattcatatatatatatatatatatattttttctaacattgtgtgtttcaaatcagggtaggatcaacttgggacatggggaaaaatactcaattttgggtatgtacctggaaacatctgtgtataaatacttaatttatacttagaattggattttttttaaacggagggagtacttgtattaaggttaaagctctgaaaataagagaatagtttattccaactatagaagagaagctagggttaacgcaagtattcccggtgggagagagagatgaatagaaaggaggggacaagaatgaaggggaaaataatagcgacttggcaacatcggcgggctcctcggaggagcaccgccgggcctaa

SEQ ID NO: 5034 - DNA, 1501 bp, Oryza sativa
gaggtattgttcccctcagctcttggaagacgcctcttgcgcgcttcacgctcctctccttgcacagtgtgtccaggagcacattcatggcctttgtatccttcacaactccaaaccgatccatcttatggaaggcgtcgatggcctcggtccatcgacttgccccagcaagccttctcatcacctttgtcatcgtcatgagcgacatcaagcctccaacctcaaccatctgattgatcaaaccccacatcagatcaaactgcttgaacttccccagtatatctaccatcaagtcatatgaatcggcacaatggcagtaccctccctgagtgccaacccacatgaagaacccgaatgccgccacccaatcattgctgaacctcgtcaggatcttgtcaacaaggcagccagtgacccttacagagcagcagtccatggctatcataatggcctcaggagacgcgaaacgagcactaaggatcctgctgacctcatcgatgtcggcctcgaactcagcatcctcatgggaggcagttgcaggaaagccagggcggatcgacagcgacctggaggtgctgctctggcttcttcgctcatccgagacgttgggttcagtcgggagcacaaaaatgtcgtcctcctcgtcatccaagccggcgcatgagccatcgtccttggggttcctgaaccagtcggggaggtcgaacccggtggtagagaagcgtgtcgcggagagcctgccgccgctatgagacacgaacttgagagacggagggaaaaaaattcggccgcaccggcgcataacctctctctggcttggaggagaccaggtgggcaaatcgtcgaacacctctcgtgcgcggccaaacaacacctctctgaatcctctctctctctctctctctctctgccgccccggcggccggcgcgacctcaagtgcgggcaaagactacagctcgggaggtgatgagatcgagcttactcgatgcgtgtgaatggcagcggcgcgcgcagaaggtggaggtggagattggggagaaacgaagcgggagaggaggggggcgcgaaccgcgaataggcggcgtcttcgcccaaacgcgcccatgtccggatcgtgcggccccgtgggaagcgcataagacgacggcgaaggggcgcgcggtcgccggccgagtagatggatgcacggggacgcgatatgtcgccggacctcaccggcgccgatccgggaaggcgaaggtgggacctcgccggcgcgaagaggcgagggaggaaggagaacttggaggcggcggcgacacggcggtgggatctccgacctcgcctcgccggagctcagctcaccggaggcggacggagcgggagaaagagggaaccaggagaggagacgggatagcgcgagccgcgaggtaatgggctgggctggtatgggctgggtcttaaagccgcaaaaccacatggcccaggtaaaataggcccgaacataaccaaatatgggcc

SEQ ID NO: 5035 - DNA, 1501 bp, Oryza sativa
cgtcaggatcttgtcaacaaggcagccagtgacccttacagagcagcagtccatggctatcataatggcctcaggagacgcgaaacgagcactaaggatcctgctgacctcatcgatgtcggcctcgaactcagcatcctcatgggaggcagttgcaggaaagccagggcggatcgacagcgacctggaggtgctgctctggcttcttcgctcatccgagacgttgggttcagtcgggagcacaaaaatgtcgtcctcctcgtcatccaagccggcgcatgagccatcgtccttggggttcctgaaccagtcggggaggtcgaacccggtggtagagaagcgtgtcgcggagagcctgccgccgctatgagacacgaacttgagagacggagggaaaaaaattcggccgcaccggcgcataacctctctctggcttggaggagaccaggtgggcaaatcgtcgaacacctctcgtgcgcggccaaacaacacctctctgaatcctctctctctctctctctctctctgccgccccggcggccggcgcgacctcaagtgcgggcaaagactacagctcgggaggtgatgagatcgagcttactcgatgcgtgtgaatggcagcggcgcgcgcagaaggtggaggtggagattggggagaaacgaagcgggagaggaggggggcgcgaaccgcgaataggcggcgtcttcgcccaaacgcgcccatgtccggatcgtgcggccccgtgggaagcgcataagacgacggcgaaggggcgcgcggtcgccggccgagtagatggatgcacggggacgcgatatgtcgccggacctcaccggcgccgatccgggaaggcgaaggtgggacctcgccggcgcgaagaggcgagggaggaaggagaacttggaggcggcggcgacacggcggtgggatctccgacctcgcctcgccggagctcagctcaccggaggcggacggagcgggagaaagagggaaccaggagaggagacgggatagcgcgagccgcgaggtaatgggctgggctggtatgggctgggtcttaaagccgcaaaaccacatggcccaggtaaaataggcccgaacataaccaaatatgggccaacacgtaagctgcaacgccggtcggacccaactagaatgagcagcccatcaatatctgcaagcccaacatagctcgttttaaagtagaaaatttgagataaaggtggagtattccccttcccttcgcgtaaaaaaaaaaaatctcccgtctcgtctcctccgctccttgcgccatctcgcggccgaacaggggtggggcgccgatctccatctggcgataagctcagtggaggggaggggatcctgatgagcatctacatactctttttttttttttgaaacgtaaagagggactttattaatgaccgaaatgtgggttacattcttggttcaatagctcaagaatttctgctggggcacagagtctccattccagacagt

SEQ ID NO: 5036 - DNA, 1501 bp, Oryza sativa
tagtgtgtacgttagtccagaggtatctctacctctagatataccactaaaaatatatcttaattggcacaaatatttatacgcctcaaaatgtaagataaattaaaaaataattagttctcaatcctattctaatatattagattagttttggtatctttttttttagaaaaaatatttctcaagtataaagaggtatacaggagtacacctctataagaatgggagataatatctcacaaatgctttctaacctggacatgtcctccctgcagctctgagaacattttccagactccaatacgaatactgaaaaggatactctcacttattctcctctaactttgagtcactgatgtatgggtccgttgggtagagggtccacgtgtcagtgacccacgtcagtgggaaataattgagttagagaatctcaatctactgctatagtgtgtactgttgtccattaaatttattaagttagagaatctcaatctgctgctatatgtgtactgttgtccattaaatttattgcatttcatgcaaaccagcctgtcataggcggttccccatctaacactgaagttacgatgcaatatcttgcattagcacctccacatttatatatacacactatctttatttaaatttttatcttaaaatatagttattcttcacatacctcctcatctcgattaaccgtaaccctcctctctataattttatctatttttaaatttatgtgcaaaacctcaaacgtacatattttaagatgtagtgagtaattaacagtctcacacaattatgtgttcaacatacattggacattatgaaccttttttttttctattcgtttccttccgatggtgaaatcggcacgcgtgatattcaatactcctatttgccttgtttattggcaggtttatcttttgtgcaacagtgaattgatacctgcttctcatctaggcagtgtagagcctctccttgacgaaggttagagctttgcatgtgaaggggccgcgtcatagctaggatttgaaggtcctgttcgaaatacatagtgaggtcttaaaatttgacagtcaaatccccacgttcttgttatcatgattgacaagatataacttttagaacgggaaaaaacgaacaaatggtcaatcacaatgattcatagaacataataatatctagttcagtagatttaactttatgtattaggcatgcatgttgtgttattttacttttcgttctaagccttaattctgaccttacgggttttatgggctttatcattctagttatactgctaattatattactactaattataagtatacttagcacttcacgtaattattaagatttgggaggcctgaacaatcgaacatgtcatgttccgacggattccgagttctgcatctgccactctgcgtgtgcctgaactgttctttgtttttatggggaatcgatgtctgaactgtttttagccatgaaaaatcttgcc

SEQ ID NO: 5037 - DNA, 1501 bp, Oryza sativa
tatagcctttttctccatgagaatcaaaatctcagcagaatcaggacctgattgtggctctgttagctgctggaggttcccaatcgtggaatagtgcacgtggaaatagagcagtccattagcgcgtgattaattaagtattagcttttttccaaaatggatcaatataattttttaagcaacttttatatatatgctttatgaaaaaaaaacacaccgtttagcagtttgaaaagcatgcgcatggaaaacgacaggcaatgccgaacacagtcaggttgacaaaggaaagggaattgagcatattaaaactccttcctcttaacacacatggactatatttatttttaaatttattaattttcatttgtacaccgacttctgaacttacaaatggaattacaattccagttacaatcacagggaataagcaatacaaatagctagagttatttacagagtctgctgtgcacatgtatcatgtatggatattgcagtgccaaactcttctcgtttctgacgagttctactgacacctgacctgatcattgtcctgatcgggttcacctgcatgtgatctcaatcgactgacatcgttccacagattacaagttcatatatagatccggcaagatttttcatggctaaaaacagttcagacatcgattccccataaaaacaaagaacagttcaggcacacgcagagtggcagatgcagaactcggaatccgtcggaacatgacatgttcgattgttcaggcctcccaaatcttaataattacgtgaagtgctaagtatacttataattagtagtaatataattagcagtataactagaatgataaagcccataaaacccgtaaggtcagaattaaggcttagaacgaaaagtaaaataacacaacatgcatgcctaatacataaagttaaatctactgaactagatattattatgttctatgaatcattgtgattgaccatttgttcgttttttcccgttctaaaagttatatcttgtcaatcatgataacaagaacgtggggatttgactgtcaaattttaagacctcactatgtatttcgaacaggaccttcaaatcctagctatgacgcggccccttcacatgcaaagctctaaccttcgtcaaggagaggctctacactgcctagatgagaagcaggtatcaattcactgttgcacaaaagataaacctgccaataaacaaggcaaataggagtattgaatatcacgcgtgccgatttcaccatcggaaggaaacgaatagaaaaaaaaaaggttcataatgtccaatgtatgttgaacacataattgtgtgagactgttaattactcactacatcttaaaatatgtacgtttgaggttttgcacataaatttaaaaatagataaaattatagagaggagggttacggttaatcgagatgaggaggtatgtgaagaataactatattttaagataaaaatttaaataaagatagtgt

SEQ ID NO: 5038 - DNA, 1501 bp, Oryza sativa
gtgcccgtcacacccgattgccatccctacacacaccctaatttccagaagcaaatataaaatctctcccctctactctcctcaatccaccgatggcagccagtggcaaacgagcaccaactgacggctcccctactccacccaccatgatccactagaggccggcgatatatagctccatggtgcccctcctctctcctcgcagcggcgacgtccaaagaggctgggaacgcggcggcggattgagtaggccgaggtggtggtgaagccaccgagtagcgggggttggggggggaggacgacagctccatggtgcccctcctctctcctcacggtggcagcaaccaattaggaggctagggacacggcggtggcggagccaccaagtggaaggcgacgtgacgagctcggtcgggaggggggggagggagaggacgacgacaagctctgcggcgcatgccagtgcccctcctctcccggcccgcgatgaggagacgaagcccctcctcaaaggacgacgacctcgacaacagcggcgtgtgcgctcggctgccaccatcatcgcctctctcctctcaagcgttgaggaggagcgggattcggcctagagctcgacggcgccgcctggatctagccaaaggtcagcgacagtggctggcaacttgagctccaccatagccaactctctcctttcccgcgcctcagcggtagtcagctcgctggggcccctcccctcccagccgacgacgaggagatggggcttgagggctcggagggcgacggcgacagcagtaatggagctcggtagtggattggcgtcctcctcgtcgtccattgccggctcccctctcttctcctccaaggatggggaggtggggatggtggggattgttgcagcctcgcagtaagattccttgtttttcttagctttttcagctgaggctctcggctctcaagttagtcttgtgttacccacgaagtaatggtctctcaccgccacgatagcatgctatcctacgtggtgagccgtggccatgctccacgtaggaacactgtgaagggccacacgattccaaaaatccaaaagtaactaaattttgatggcattttcatgtgattaaaaaaatagacaacaaacagtcctttccaaatataatcaagagctagcgatcaaagttctggctggaccacacagcatacatgctgcacaagtgcacagtctacactacttgtgcggatctacccactcggccactcctgtctgtagtgctgtagtagatctccaatctcaatcgagaaaaggccatcgagtcggtgagattctttcacatatatagttcgccgtgaaagtctatttatagtaaatccggtgcctatatatacgtcaaatcaaatcaactatcagtgtgtgagctatacacactgacagtgtagtgtgctgctctcctagctagctagagaacgccacacactggactggactggatggaggcgtcgtcga

SEQ ID NO: 5039 - DNA, 1501 bp, Oryza sativa
ttccaaaaaagttgttcctatttatagtctttatatttttttcgacttaaatgaagagataaattaaatgttttattagaacccaaagagtcatctaaatactcattggttgtatgcttgcattcacttcttgattttggttgtatgcttgcatttcctatatttatattgatgttaatgaatctagacatatatatctatctagattcattaacatcaatatgaatgtgcaaaatgctaaaatgacttacatcgtaaaacggaggaagtattagctaaatatggacccacgtgttatcatgcacacgcccacatcacgttcaaggatgcttaaaacacttggagacattattgtattgtcgatgttgaagcaccttaataacttcatcaatttcaatatatactggctcaatttttaaaggtgttcttacgaaacaaagatagatgtaaagtgtgtgtgcatattcatagggatgattgtgtgcttgtgtcaaaatcaatagtctataatatctttcataaaagaatactcaaggttatctgaaagcatcctcatcatctatggttctgagttctgacttccgagccaccgtcgtccctcgctaacttcgcatcatctcttccgccacccaccaatagattcacgtttatagtccaaacccaccaactctatattacctagggttgaaaaccgtcaaattttgaggttctgaagttttacttgggatggaagtagattccacgtaaaacttgaatggttttcaagaattcaaatttgaaatagtaaaattcgacctaatttatcaagatctggtgaaaaatatcatacagatcagggaacaggaaaggcccatgaggcctccacccgacggttcagagcccacagaaccagacaagcccactagcccagtggatttctctgaaaaaaaatgtttttttgctagccgccgtcctccccgaaaccctaatccccaaatcgaaggatcgggagccgccggattggtcctcaaatcgaccccaaatcgaaggattgagccagggacgccgccggatccgtcctctaatcgaccgccatggcgatcgcccgcaccggcgtgtacgtcgacgactacctcgagtgtgagattgctagctcccgtgtcagaggccgtcgaatttttttttgcggttgccttcgatttgcttctgtttattggctccatttcttgtcgcagattcgagcacgctggccggcgacctgcagaggattctctccaccatgcgcgagctcgacgagagggctcatggtgatgatcttttttacactcctttttcatttttctaaaatacagattatccaaaaaaaaatttaaaaaataatcattttgggtacttctgatatgtagtaatttttaatagttgatacaaggctataatgtcatgtgattgttttgtatagggctagtgcccacttatagattaaatttatgtgatattgatagttttctcaagtttgtagttg

SEQ ID NO: 5040 - DNA, 1501 bp, Oryza sativa
aagtaattaagtatatttaacatatatttcctccgttcctaaaagatattatttttaacatgacggttaatatattagataattgttacaacacgactacaccaatgcactatcccattctttaacaactgctttccactaaatttataaacaaatataataatgtttaaaataccaaattagttttattaaattagtaattgaatatattttcataatatatttgtatgggttgaaaatgttatttttttataagcttgatcaaatttgaaacaatttgattttgattaaagtcaaaacaacctacaaaattttttcagcatttttgttgaatacatgatattggcatgaacttttaacaattttagtatatgtatctataccgctcacaaatccatgggaaattctcgtaccccccctccccccaacatatcgagtcattgattgcagaccatgttaccagttaatgttatgaaaccagcacaagtcattgaattaaaaaaatgatgctgagaaaatcccatcataaactacttccttcgttttaaaatattactacctctgtttcagaatataacaactttttagctataaatctagacacagttgtccagattcatagctaaaaatgcttatatttgggacggagggagtactatctaacacgtgattgaatttgtccagattcattgttctaggaaatatccaatcacgtgctaggtagcaatatttttgaatggaggaactaagagccatactcaaaatcttgaattacaatatgatgagaagaacgggaccattttacaattggccttttttatttattcagagcatgtacaaatagtagattataaaccaactataatcatactttaaggagacaatagagaaaagaagagcactagattatagacttatagccagctataatatagatttcaagacacaatgattgtatgacaggtgggaccatgcattaataatgtagcatatgtttataggtaactattatatataaattggctactaaattgattatacatgatttagagttagtagttagctatactattaaacttgctttttattactatgattactataatgtaccctcaaagcgtgtagattcacggaggatatttagttagcctgtcctctcacccaaaaaaataaaaataaaaatcgaacccaaatttaaaagtcgtttggtaaaatttattaagatggtaattaaattagttgcgtccccaccgataaattttgccataataaaactgacccccctcgagccgcggtgagggaagcagcagcggcggaaggcgagcgccaccaccaccctctccacctccgccaccaccaaaatccgcgcggcgccgccccaaaaccctaatccgcgcggcccaccgcatcccgcggcgctcagatctagggcatcccccggcgatggcggaggcaagggcgacgaggcggcgggcggaggaggcggagatggaggcggagg

SEQ ID NO: 5041 - DNA, 317 bp, Oryza sativa
cgaatatcggtatggttcgtagtatcaagttatatctaatttagttgtagattattttaacacagaaaggtaatggttgcggttattggtcgatcggcggggcacaccgccacagtcaggttgaagcagctcgatccatgcgtggcggcgagatgctgccgaccgaaacgttagggtctgtctaagaagggcgacgaatcggtatggaagagactgatttgcataaatatcggagatttaaatgcataagttaggaccgctcccgcttgtaccgaattacccgatcctaggggttctatttgcgtacgattgatagc

SEQ ID NO: 5042 - DNA, 1501 bp, Oryza sativa
gacaattatctgccttacacttgacagaaacttgattcctatcattcttgcccttgaacacctccctcccctcgttgatgatcatattcttcaaagcagctctgaaaagatcaacattactgaacaacatgccaacttgcatgtgtggacgccgtagggtggactcataaaaaatgatatcttcaattcctcttgatctgtgcacatagataggtgcttcgtcattgaaatctattgtgtcatcattgggctcatctgacaaataatccacctcagctgattggcctatatccttcacttttctcttgttagtttttttccctactagttctttttcctgtgtagtttttcccggatgtggttctgcttggttaacctctgcatctatctggctagtaccatataggtcctcagtatcagagtctccttggaagaacattactggctccttgccaatagcaggttccttgccttttttcttttccctcaactgttgctgtacatactcttcatgcaatgtcaaatcatctttatcaaaatcacctgggacactattatgatgtccgattaatgggatactacttgggcttaaaaaccttgatgtgcttccattatcagtcactaattcctgcggcctcgcaaaaatgtacagtgagcactctgtttccgtcttatgatcatccaacatcatcttgatttgttcatcatttagaatcagtacaagaccttgtggagggacataagaaggcttcaagtagtatacaccatctcctttttgatatccatgtataagcaatgactcctccaaatcgatgaatttcagagaatccctgtctaaaagatagatcgatgaacaattcctttccccaccagatttcctagggcttccaccagttgtacaaccagtatgaacaatgaaggaaatactagttcgacccatctgcagagattataccaatttattggtttgcaacctaaatcaaagagcaaatattcgattatctgaatctagtaatacaacaattacatgcataaaacatgatccgaccaaaaccagggagaaaaaaggaacctgtagaatgaattgacgaggtgatcgaagtacaggatgcttcagtgcttccttctacgacttctcttgccgggcaggagatttgatatcccttctctctgtactatgcgatcatcgtcgtacttcgccgttgtaccgctgttctttcgctgccttagtgttgcagtagcgatcgcgaaattaaagcagggaaagatggaaagtggaagaaggtgcgcgcgcttttgccgccaatgtggcacgaggcaactctacccgcgggctgcgctgtaggcccacgataacgagaaattgagcgcatcacgagaaagcgtgaaaaccgaataggggtggaaaattggaagagaaattaatttatgtgtagtgttttgaacaatattgagttgtggggggagagtataaagagcagtgacttgtaaggggggattt

SEQ ID NO: 5043 - DNA, 1501 bp, Oryza sativa
tcttatttttctattataatatatacaataaataaatatatgtttacttttattatagtgctttaaagataaatatatatatgttgttctagtttctttaaactaaatatttttaaagttattgatgatcaaatttataaaaatttgacctgaaacttgtccaaagcgttaattattatagaaccagaggtagtactggactagcattggccattttataggtttaacgactagtagtacactatgcaatgcagcagcctgagtggctggcactggagggcctaaactttctacgtgtgcaaaataatccgtgttaaaggagctttattattggttgattctgggcgttgctagaaaatcaggaaactttaggaacgtgttaacaaggtggtatgtcttttttagttcttcagtttctgcacaacactgtttttttacttcctctaatggaaccaaaatgatcgggtacaagctaaaaaaatgtgggttgtctacaatagtggatctgcatgccatggagaccacgggtctcaagcccttattatcagcgttaaaattataggagtttccattaaaccgtctatcttttttttttgccatatactccctcgtttcaggttataagacgttttaactttggtcaaagttaaactgctttacgtttgaccaagtttattgaaaaaaagtagaaacattttcaacccaagacaattttattatgaaaatatattcaattattgatttgatgaaattattttaatattataaatattactatatttgtctacaaacttagttaaatttaaaacagtttgattttgacaaaagttaaaatatcttatagtctgaaacggagggagtatttacttaaaaaaaggaggctataactttggacagattgtttagcccctcatgctagtcttacttgatcctccgcccctagtcgtttatctgttaatagatttgaaccctacttgtacatatgtgagtgcattttattatcatcggtattgtgtgtattgcccgtatgtgatgatgtgtatcagcatatgtaatcagagaaaacaatctattatacactagtatagtcgattttgtgtgatggtcttctctcctctcgaagataaacaaatattatactcacattttatatttttatgtgccgagatatacatagacgctcacacttacataatactaatttaatactagttgataacagttgttttcttaacaaattgaagagagtaaacctataccttatctgtctccgaaataaacgaatctataatggtgtgtgatattatctagtggagtataacaaatctatacatatgtaatgtcacgaaacaaggttattttattttttaatagaaggtctataaatttatagtgacaccgtgaccagtcgcgtcattttcaatcctcaggtttacgtaccaaacaaacattacccttctacctggcaaacaaaataccgaatacttataagcaagtacaa

SEQ ID NO: 5044 - DNA, 1501 bp, Oryza sativa
ttacgatacgaatcttttaagcctaattgttctatgatttgacaatgtggtgctacagtaaacatttgctaatgacagattaattaggcttaataaattcatctcgcagtttactgaactaattagttttttttattagtacccgaacaccctatgcgacaccctgtataatacccgatgtgacgcttcaaaactttacacccctgtatctaaacacccccttagtctctgcctaagccctgtttagattcaaacttttttctttaaactttcaactttttcatcacatcgaactttcctacacatataaacttctaacttttccattatatcgttacaatttctttaaacttccaattttgatgtgtaactaaacacagccctatatataaagaacttacttgctcctgcatgcatgcatcccattacttcagagtgcttcgtttctcgaagataggttccaaaccacctaggatatacaacttgttgattccaattagcacaccggcacatttaatatgggtaaagtagaaattaggcatataataaatcattccttggtacgtaagattatgtctaaaacgtcaattaaattagaaccggagggagtatctatttatagttatgctattaaaatttaatggttactcaatacattcatcataatatttaggtcattttgttctcgtctctctgtttttccctgttacctctctctcatttctagtgaacccgacctgatgaattgatttggattggtgcccattaagacctttcctaccgccggctatgtcactacgctgcaaaacaagatatcttcagctgattttgccgatgcatatggtagagaaggtgacagacaggcaacgggcatgcatgctgcacatggcaccaccgcagctgcggtaactagggttgaggaagctgaagagcatcccctgttagtacaagtacgacatgagcgtgcattgccagatctccttcacctccgcctgcctgcttgccttacagctactcgtgtgtgtcgacctcacctgtcatcacgatttctcctaggaaatgcacagcctctcgccgcgacatcccccgccatgacactacctgtcactccttgccgcctcaccggggacccaggcatctagcgcacgtcacaaattttcaagagaaatttgataaaaataccacctaatactcgcaatttggttatttaccacctaatccgtacgttttctttaatatgcaactagtattgcaaattgctctattttgataccattttttcctttttttttcttctcgggttgttggacatttttatccctgaccccacatgttgtatgaaaggaggtttttattacacatcgatcgatggaaaaatatatgatggaaacttagaaactatcgttggatcaaaatatgtacgtctaagatttatccacgtcatcactgagtaaaaatattactcatgagtaaatctaagaataaaatttttagttgtgat

SEQ ID NO: 5045 - DNA, 1501 bp, Oryza sativa
gtaataaaatggtttattgggttccgatcaataatttaatttaaaacataatgactataaataggacttaaacttttggaaaaaccaaagaatagaataagttttagacttttagaagaagggagtaagtagtttcattactttggtttcgttggaatttggaatttgtgcgcatatattcgacttccaacttatgtctatgaattcaatgtctcgctgctttaaattaatatatgaataaaagggcatagtttccataatttcaggcattaaatagataaagaaattaagtgtacttatcataccatatcatttactccctccgttccatattgattaccatataactttttcaccaagacaaaaaaaagtattaactttcctatatttcatttaatgtgagtatgtggtagggaaaaatcaagaaacatgcacactttaactcctcttaggccccatacataagagcaggtccaattataaacacatttcgatgagataaaacagaagagagaagagcagtgggctatagatttgtagccagctgtagcacagactccaagatacatgtatgtatgacaggtgcgaccaagtataaattgtgtagtgatgtttataggagtatatgaatttcctactaaattgactatagatgatttgaagtcagtggttgactatactattaaacttgctctaagaaacgatagctttactacctcgaattcctacatacatgcatgcatactcaattttcatgcttaaatgcaataatattacacgtcaaacgaaggggctatgataacatgatgatcaatttaaaaaattcaatttgtgttaaatgatgatcaatatgaaacggatggagtatttcataggcaaagccgcgtctattttttagttctttctttcccatggtgcttctttttttcaagacatttctctttctctatattcttttagatatctcatcccagccaattctgcattcctatgagcacgtacaccaagctcgaactgggaaaatactaatggttggttgatctggtaatagaatagtttggtgtacttctgtttggtgatgacttgagcagataagcaaaggatacttgtccatccttccaaaaatccactgctgcctgtgcacctgcttcgcatggttgagcaagttatctccaattcagaggtttgcaaggctgcaagcataagaaacttctattttaacataaatcaaaatttaaacatgataagaggtcatcaatagaacaataaagtaatacatcaagcaattttctgaataaactatagagcaaaagtatacctgcaactgcagcttcttcataaagcaaggtactagtaccactccttcacagcttgagccagaagggcccttgtcaggtattcagatttcaggtgtagtgaattacttgcaagaaacatggctggtcattataaagagtgttcatgaattctaggcatgccatggcaggaaacaatagccttc

SEQ ID NO: 5046 - DNA, 1501 bp, Oryza sativa
gaaacactgtttttctactaaaattttcttatcaatagcacacgcaagcagcttcaaggggaacaagtgcacccacaaaaaagtactacatattagctgagcagcagtaattgtcactagaaactaacgcaagcacacaggtaggctgagatgagtactacaggtgcagataatggtattagaattgaaaattttgcatcattcaggacaagattgggaagcacaaaacataattcacagcatattttagtagcggaaccagtcgggaacgtcacgtcgccttcttcttcttcttctactcggtcatggcggccccttcccccttctcctccagctccacccccttgccctcgccctcctccaccggggccgccgccgcggcgggctcctcgacggccctgtccgccggggcagcggagttctcctcgtcggggtcgcgcgcggggtcggtgttgcgggtgagcgcgccgcggaggcggtcgaggaagggcttgaacgcggactccatggtgaaccaggcgaggacgaggccgccggtcacgaccaccgccgtcttcagcgcgttgccctctcgctgccctcctcctcctcctctcgccatggctgctcgtggattggattgcgatgggacgggtggtgtgggatgctctccgcgctcgaggtttgggggggttttgttgtgagttggggaaggttttttttttttttttttgtcttgcacgaaagggaaaggcgagacgaggaagaagaaagaaagcgacgcgaggaaggcacgtaatttcgcggaaacgtgaggggcaaaacggaaaaaagtttagcacgggaccaacgtggcacaccgctaccgcgatcaagacaaaaaaccgtcgaaacgggacagcgacgcagcgagcaacgtgacgcgagagacaagaactttttttccaaaaaaaaaaaagaacggaacgggggatatggaacaacgtgaaaggaaaagagaaaaacaaaaaaggaagtgtcatttcccgacttgggctgggttgggttgggttgggccccagctttcgtgcacgatccattttggaagccaggagattggaaattttgtaaccagttgggcctggtttttatgggccaaagtccgttcctttctccatcgaaggctggaggaatgcacgagcaaaaagtacagcatcgcctaaatgaaaactgtgccactctcaccgaaccactaattttcttgtgcttcacaagaggacactttcatgatgtaatactaacacacatggtgacagattccgacctcctgcctacctgttcagtcgtgacacctcacctgtaatctccctttttttgtgagattaattgttagattcaccagctattcttgatcttcatacaccaaacacatgtaactactcaaagatgctaaaatgatcatggtaaagagaaagatggtagctcattacaatgagaactcagatctgagctgaaactctgcaagatcatcccaagaacaaat

SEQ ID NO: 5047 - DNA, 1501 bp, Oryza sativa
tccatccaccatgtgggctgtggcgtcttgcctgcctgcccatctatttgactctcttgcaaattgcaatatgttgggttgattctggccaaatcgatgcaaagcttcccaatgtggtgaaagagcactcaatgatgtagtgtgtgtcctaggatacattatcaaacagcattgatgctcttcataatctacattgaaataccttaaattgtcttttagaaaacctgaaactgaaggttttcagtccttgtctatcccattgcgcagtttttatcataagcttcctactctgattcttcttggagggtcacagtgtgatatacctttgtgctcggtgtttttaactgtgttcagtgttcataaggaggcaaatgtttccatttgttcttgctagtttcactggagccttttgattatcactaattttcagaaaggaaagggtgttctgtgtttggttagcatctaatactcaaacaaacgggagaggcagctgccgtgtcaccaaaagcaaaagggtatatatcacatgagaacatgggggaaggaatcatccaatgaaacatttgctccctccctcttcctaccgaagctgtttgtcatcttccggttgcacctagacttttcaaggccttttcagcaattggactctgccttttctacgcaggaaacaatcaaacatgccagccattgcaaccatcacaaacatcattctcatcagtacaatgcaaaaactgaaactgcatgcctacatttctcatcagcacaaatgcaagcgtgtgtcacgttttgttcctacgatatgtttctgcccaattctttccaagatcagaggactttgaccttacttacaccatatattccttgcggcaacgtgcaatcatcccattcagtcaaaccgaaaaatcaatcgacagaaaaattatctcatacgccaattcattcgacagaaaaatcatctcatacagtcaaaccgaagggacctgaaatgtgatctggaagaagcacgcgagccacacacaaatcgacggattgcgcggctgcagttcacaagtcgttcacaagtccaactccgataataacactcgggcctcacctcacctattcttcttcttttcattcggttgcttcctctcgccgccgacactggcttttattaaatgaagggcaaaggttggttgcgaggttggtagaagaatcagacgagtggaggggcacaacacagctgcaagcctgcaacaactcatttttctcatggaagcagtttaactgacctgtcgtcactctgccatcaggctgtaatatgcttgtagttcttgggacttccagttcagaggtaggtagatagctgcagagaaggaacaaagaccaatccaagagtactccagttctgcattggcaaaagacagggtttgtgctgtatatgtacgtaactgacaggcaagagaagctggcttttgttcagctttccaattattgatttatagttcagtttcaaagcata

SEQ ID NO: 5048 - DNA, 1501 bp, Oryza sativa
cccttttattcatatattaatttaaagcagcgagacattgaattcatagacataagttggaagtcgaatatatgcgcacaaattccaaattccaacgaaaccaaagtaatgaaactacttactcccttcttctaaaagtctaaaacttattctattctttggtttttccaaaagtttaagtcctatttatagtcattatgttttaaattaaattattgatcggaacccaataaaccattttattacttattggttacatgcttattggttttgtcacattgtaaataaattaattactccttggtcttggtgccaaaagaaataattcctccatcccaaaataaacttaattcctgggtttttgtgtctaacgtttgatcatccgtcttatttgaaaaaaaatatgaaaaattttaaaaagataagtcatgcataaagtattattcatattttatcatctaacaataataaaaaatagtaatcataaaaaatatttcatataagacggacggtcaaatgttgggcacgaaaacccaagaattgagtccttttggaatggagggagtaggtcttagacttttggatggagggagtattttcattttatctcctggcggagctaaaaagattttttgagcccaagcaaactatacttctagtatttattatataaatttcatcatcaattcattcaataacatataaatttaatggagtttttgtcggtgagtttgcgcggccgcctgcgatagccaggtgtggcttcacccctgcctccacatgtctgtaaaaatcaagaaaatccttttttaaaaaataattttatcttcttattctttaaacataacgttctaaaagtgcataacattaaaaaattctatttgcacaataaagaagagtaaggaataaattatttgtttgaaaatttggaattgcgttgagctcaagctaaagcaaaagatactggtacctccttattctcttctactacttaattatatcctggatactccctaaaaaaattatatcctggataaatgattgcaaagaggctttatctgcccattgcaacttgtatgtgcagccgaactgtggtccgcatcgtttgcttatttcctaataagccaaaacggcttattagaaaataaaaataaatttgtaggtaaaacttttataaatgtattcttggtgacttaaaagccaatgttgaaaaagaaactacgttgaaaatatctcaaaattaagcttgaaaattcaaaatttagttttttctttagctgattaggccatccgatgggagcctgtaagtgtcaactgagagcacaatcaaatgatataataagatctttagtttttctcccccacactatctgaatgtaatactcactgttttttcatttagatggcaacgtcatgcaaaaaatcagagccgtccgtctgtacattgatctagccgttcgtacgatgtcttcagttgcaggcttgcagctaaataaagtca

SEQ ID NO: 5049 - DNA, 1501 bp, Oryza sativa
agtaataaaatggtttattgggttccgatcaataatttaatttaaaacataatgactataaataggacttaaacttttggaaaaaccaaagaatagaataagttttagacttttagaagaagggagtaagtagtttcattactttggtttcgttggaatttggaatttgtgcgcatatattcgacttccaacttatgtctatgaattcaatgtctcgctgctttaaattaatatatgaataaaagggcatagtttccataatttcaggcattaaatagataaagaaattaagtgtacttatcataccatatcatttactccctccgttccatattgattaccatataactttttcaccaagacaaaaaaaagtattaactttcctattttcatttaatgtgagtatgtggtagggaaaaatcaagaaacatgcacactttaactcctcttaggccccatacataagagcaggtccaattataaacacatttcgatgagataaaacagaagagagaagagcagtgggctatagatttgtagccagctgtagcacagactccaagatacatgtatgtatgacaggtgcgaccaagtataaattgtgtagtgatgtttataggagtatatgaatttcctactaaattgactatagatgatttgaagtcagtggttgactatactattaaacttgctctaagaaacgatagctttactacctcgaattcctacatacatgcatgcatactcaattttcatgcttaaatgcaataatattacacgtcaaacgaaggggctatgataacatgatgatcaatttaaaaaattcaatttgtgttaaatgatgatcaatatgaaacggatggagtatttcataggcaaagccgcgtctattttttagttctttctttcccatggtgcttctttttttcaagacatttctctttctctatattcttttagatatctcatcccagccaattctgcattcctatgagcacgtacaccaagctcgaactgggaaaatactaatggttggttgatctggtaatagaatagtttggtgtacttctgtttggtgatgacttgagcagataagcaaaggatacttgtccatccttccaaaaatccactgctgcctgtgcacctgcttcgcatggttgagcaagttatctccaattcagaggtttgcaaggctgcaagcataagaaacttctattttaacataaatcaaaatttaaacatgataagaggtcatcaatagaacaataaagtaatacatcaagcaattttctgaataaactatagagcaaaagtatacctgcaactgcagcttcttcataaagcaaggtactagtaccactccttcacagcttgagccagaagggcccttgtcaggtattcagatttcaggtgtagtgaattacttgcaagaaacatggctggtcattataaagagtgttcatgaattctaggcatgccatggcaggaaacaatagccttc

SEQ ID NO: 5050 - DNA, 1501 bp, Oryza sativa
gttcatccttcgttccagcttggtatgatccaggacggcgtctcgccgcagagggccatctccagcttgttgaggcagcaggcgagcttcttgaagctccggttctccaggctgaacaccgactgtacttcatcgtggtggaatgccgatcgttcacctccttggtggtcaccgagtagatggtgttgccctcgaggttctcgaatcccgcggtctccatggcaaatccgtgcaggaatcgacaaacagggcgcggccgccgatgccggtgagctcctgtcaggccaagtcaaagctgtccggaagccttggagaagtcgatgtcgtcgccgaagaggtacatcctttggacttgatgagaaggaagagctcgtcgcctgccaccgcgatgcgcgcctcggcggggagctcgacggcgggcaccgggatgacggcggcgatggggagggtgagggcgtcgacgatggtggtgcagcagtagcagacgtcgtcctcgaagacaaagaactcgccaccggagtagttgatgctgctcgcgttgcagtcggccatggcggcgataggggcccaggcggcggcgggcgggtcggaggcgtaaagaggagtccctcgccgcaggacgccatgacgccatgcggcgaccagtcccaggccaggtcgtccgtctcggcgaagaaggccgggagcggcgggagggcgcggacggctccggtgaagaggtggaggagcgacgcggcgaggtcggtggggtcgatggcgagcgtccacccgtgcggggagacgtagaggatgcagtggcggcaaggagcggcggtggaggagacggcggcggtggagaaggcggcaggcgatgaaggcgtgataggcgtgaggaggcgtcggcggcggggttcgcggctgccggcggcgggcgacggggtaggcgcgaggaggcgtcggcgccggtggagaaggtggcggggcaggggagggggagatggatcgctaattaatttctataaccgttcacacggagtgggatcgctaatttctgtgtttgttcagcccgggttgggaacccaaatcctcagaacgaaaacggagcgatacattaatacttgattaattaaatattagtaattattttaaaaaataaattaatttgattttttaaacaattttcatatagaaatatttttaaaaaatacaccgtttaacagtttaaaagcgtgcgcgagagaggggttgggagctgaagttctaaacacagccataaattcgttggatgaataagggcggtcctaaccctccatttaggatggtgtctatggcattaactatattgccatgtaggacttttatcttatgtggcactatattaattaagagagagtgaagagaggaagaaactggatctcatgcaagacacagcttcaacatgagaacctatgcactagacactatcaagttttgtattggaaaagaatagtgactttataatagatgaagaataaatatgagt

SEQ ID NO: 5051 - DNA, 1501 bp, Oryza sativa
gccactgtgctttcctctcctcctccatgcacagttgcacacgtacgggccagctccctcctcttctcatcgacgtatagccgatcgacagatgaggtgaccagcgttgcttgcaagcggactcgacgtatacactgcagcctgatgtgatcaccttggcggatcgatcgaaaactgatctcgccgtcgcgcaacttggtctttacaagattcagaacagcgaacctagattatatatttttcatgagtcgcttgaccgatcgagtcgacacttgatgactagaggccggggaaaagaaaaaatcggcgtctgaatttacatatcgttgctgaaagaatgtgaacgagtacgttgtagcgacagccagaatttcccgctttcgaccgatggggagataaaattctgcgcggttaatttttcagatcttttctacctttgcccccgattttcgatcaacagaatgtaaatatatgtgctttaccttgatgagttacacacacttgcactagctagctagcatgttgtcccaaatgtagcatttccaacgtgaaggtttgaaggctgggttttgatgctgcactgtttaacacatgtcattaactaaagtctccaaacaacgtgttaaaagtgttttaggagtgacaactacttaaggagcctaggtgtctgtgtgtccctaagaaaaggtaaagacagatcaagaaaggaaccttagatactaggaagcatatatcccatactaaactagctagattacgataaactgcaggcttattcctcagaatgcatgcagcagtgacgacaagacggtgattcccaggggtcattccttcttcctcgtgaaggttcttccatcctttcaacgtttgttgcctctataaatagcctctccatgttgcctaccgtcctcaccaacctagctaactagcgcccctcgaggtttcagggagacaactgatcgatcagaaaccttggtcgaccgatcagtaagagcaactagagacagaaaccttaattctcgatcagcaggagttgtagtagtgctatatatgatggacagcaggagggagtcctcggagaccctgaggtaagatggtcacaaactgaatgccattactacagtagtattgcaagatgagctgagcatgcaagactggtgtgtgatgaactagctaattaatcaagctttaatcatgcatggtagtacgttcttctcgtgctctaaacatcgagctagatatataggacccttttttttcttgtcctagctagttccattcaataccttgaatatgcatgtatatatgatactacatattctgcgcacgaatgaatgagtaccttttcaactttcttatcccctattgccggtgcaaagaatcagaatttcataaatgcgtgcatagtgcctcgctcgcgatattctaaagacgcgatcgaactcaatcgatgaatgaaaatgatgatctcgcaggaacaaatgcgcggcgtgctacaggc

SEQ ID NO: 5052 - DNA, 1075 bp, Oryza sativa
aaatgtggtgagattttagtcttcatggtaacgcctccaataagaacattatatttattgcaaaatccaagatcaagagatttctccccaaatctcaaatatcattcttcacggaaatgtttttagaaatagaacgccgttcaagttgacgtcattgccgaaactaactaacaaatgtcaatagtagcaaatgactagatcaatgaaacaaccaataaagaccaatcaccgattacatatccatcaagctaccatatacaatctttatttttagtgtgtgtgttttggctgggtgcatcctaattatgcagaggtcgaaagtgcgctcagtgctttttatcatcttgacgtaattggctgagttcaataaaaactttatttatctaaaacaaatatggaggtcggatattagggaaagctatacctccaccatcactaatcaccactctacatgctactttcttgtagtcgcatggttgtgtaccaatgctcttcatgtggaggcatcaccgccgatgccccaaatagatgacgtggtcaaatgaatgatcagaaccgtattgatggatcggaaagacactaccaaggagactcattttaaagacaagatctggaccgacctatactgatttttcgtcatctcggttcaccatagtgaaaaaaatgactactggatttgtgggtttctgaacctcaggccccaggccatggtttggataccaggggtctagatccatctctagacactattgatgataaggctatctaggatttattttttcaccaccgctatgaggcaggtgccgctggtggcgaggaacctgcctccggtaacatcagtcaaaagtagagtgcgacgaggtgcctcgaggcgtttttggttgttgtcttggttctccatgatgtgctaggttgctagcgagatgagtagctctcatctttgatcctatagctagataaatcttagaaaagggcaaaccaaatctcccctaagaaacatttcttctttgaaaacataaatgaattatattgcctcgcaattgaagtgaactaaaggacatgcatgaatgtgttt

SEQ ID NO: 5053 - DNA, 1501 bp, Oryza sativa
aacggcccagggtctcatcgtttggcttttttcgtaacaagccaaaacggcttattagagaataaaaatgtatttataggtaaaattttatatatgtgttctcggtgacttaaaagccaatgctgaaaaagaaactatgttgaaaatatctcaaatcaatataaaaattgtgtttgaaaattcaaacattggctttttctttgactgaataggccatcctatggaagccctaattttccaatcaacacggctagccctgtagtccatgcctccttgggttgtgttcttccccccattttcccaacgcaactatctcgttttccacgcgcacgcttttcaaaccgttaaacggtataatttatgcaaaaattttctatatctaagttattttaaaaaatcatattaatttttttaaaaaaataataataaatacttaattaatcatgcgataaaacgaacttcgttttgcgtgccagagaggaggggttcctaaccccctcctccgaacacatccttggtgggtcgggggccttgcctcgtgccaagctgcaggcatcgaatgtgaggcggctcagccaggaggagttgaggcctagggtagataagaattaataagagcatatccaacaacatctctaaatacaactttctaaatacctatttggccagtttgccaaagagttggagagtcaaatttgcatttcactccaacgatctctctattaccttctccaattttaatagtgggtcccacatgtcaatctctaccattcttcatttctcttcacgtcattccctttccccaccctcccgccggtggatgcgcaggtgatggcacagcggctgctgctgctcgaggcaagagggctcgcggcgatgcttggcggcggcaggggcggtgatgcagatggcgccgcaccgctctaggaggcccctggcccatgtggcgcctgcgtggaaccccttggccgcgccaacaacagcctccacgtcgcaggcgacgtccggcgggagcttctggaggtccgtgaacaagggttcatcctcctcgccatcaccaccgccaccggcatggcaggaattgattgggacttgcgattcgttttcctcactgtgcgtgtcgtggtttcgccttttgcggtggcgacggctctacgtgaccgtggcgcagcgacaatgacaatgactgccgcggcgaacggtggcccagacgacgatagtcgcggcggatggtggcccagacgccggcggcacgctcgtggccggcgtgtcctccggttcggccccggccgatgcgctcaagttgctgccttgctggtgggtagacagaaagagaggaaggatcagactaggagtggtggtgggacctacctttggccagtggaggaggctggctacatttggtctgtcggaggagcaatttggtcatccgaatgaagaatctgttggagctcattttttctctgtgttggtcaaatttctgttggagatgctcttattt

SEQ ID NO: 5054 - DNA, 1501 bp, Oryza sativa
cgtactctgccttatctcggacatcatcggcctacgcgagccgccgctcgtgccggattccttgctgggctagaggcgactgggtggatcaccgtgcgcgcgccggcatacgtcacgtgctgggcagggccgcgctacacggaggcgttggtggcctccccggacgccgccgcgctcgacaccgttgtgttcacctccaccgccgaggtggaagtcctgctcagggggctagacgctgcgtggttcttgacgctctcgcctcgatgaggagctccgccgcgagcaagtcgccgctcatgtcgatcccctttcagccggtgagcggcaatttggtctcatcaagctgcattccagcaaaaaaaatggaattgaaaatgaccaaaaaggagaaaatggcaaagtggttgtggtcaggcgttccatgttggcattttagcgaaacgcgttttcggaatggcattccaacgaaaccgttttttgaacgtggccaaatgtccatttttctcattttaaatactagaaaaataactatttttaagaggaaggtactccatccgtttcacaatgtaagtcattctagcatttcccacattcatattaatgttaatgaatctagacatatatatctatttagattcattaatattaatatgaatatgaaaaatattagaatgacttacattttggaaaggagcaagtagtacataactaatacaagattagtagattacacctcaatttgctagtttgctcacgagaggtcctgtcttcccgactgaactgtgaactcccagcacttcgaaattaacaatagacttgatttcaaatctgaacaaacgatgattagtgaccgggaggcagctgttggccgctgtcccggtgtcccctacattcattcacgcgcggccgtgcggcaccatgaatgcatgagaccatatgggcggagagtcgggttgatcgagctccgccccagggatcctcgcggatgattgatgattcttccaccgccgccgaagggtcacaggactcacaggtgctgtcgactgtcgtgctgatccgacggcttccagtaggattacccatacagaggaccacatgaatatgaattcgtgcaaacgaatccctaattcgaatcgctatcaatcgtacgcaaatagaacccctaggatcgggtaattcggtacaagcgggagcggtcctaacttatgcatttaaatctccgatatttatgcaaatcagtctcttccataccgattcgtcgcccttcttagacagaccctaacgtttcggtcggcagcatctcgccgccacgcatggatcgagctgcttcaacctgactgtggcggtgtgccccgccgatcgaccaataaccgcaaccattacctttctgtgttaaaataatctacaactaaattagatataacttgatactacgaaccataccgatattcgtaataattgattatgtctaagttgttactccatttatttttagacaaaa

SEQ ID NO: 5055 - DNA, 1501 bp, Oryza sativa
  unsure (1)..(1501): unsure at all n locations
ttagatatagaaaatttttgcataaattataccgtttaacggtttgaaaagcgtgcgcgtggaaaacgagatagttgcgttgggaaaatggggggaagaacacaacccaaggaggcatggactacagggctagccgtgttgattggaaaattagggcttccataggatggcctattcagtcaaagaaaaagccaatgtttgaattttcaaacacaatttttatattgatttgagatattttcaacatagtttctttttcagcattggcttttaagtcaccgagaacacatatataaaattttacctataaatacatttttattctctaataagccgttttggcttgttacgaaaaaagccaaacgatgagaccctgggccgttggtttgtgccccggagccctgatcacgcgaaagtggtggatggccggatcgaaaagttttgggggatttttatcccgttactctgcacttctgcagatcatcagaagcgcccggagagctgggtcctgtgctctgaattatccaaggggcaaaaaaaaaaaggcaaaacgaatgaaaagaaaatgattcagatactcaaggggacaggatttttgttccacgttagattaaaatcgcaaaatcattggcgagaacgtgttgctggacccatcaagatggaacattgttgattggcgagctggcacgcatgctaggtagatagctagttcatgggtcccatgacaccgttgatgcgccatgggcttgaactggcttttgtgtattttgcaaggcttgcacagcgccaaaccaagcttcctcctatcatagcatcaagttgaacaaagttgttcctcgcaaaaaaaaaagttgaacaaagttgttaaagatctttttgccagcttcaagccttcaaacatggggtttgctacagtgtaaatatcacttttaaatcctaaagactaaagaggatcacatgaagtggaccgatgaattttcaaacacnnnnnnnnnnnnnnnnnnnnaccagccttttaacacttcatttctctaatctaataaaaatctccgcaacacctcctgataacgaacgaactcgctatcgcttttagtttgagtaggggccggaaaacacaaaggaaacggtgaatagtgcactgcaaatcacgcccaaattgcccaagttattggtcgccgaagactcggccaagtgaatgactcgtggaaaaaatctcgttctagaacaacacatgcgcgcgttagctgcaaagcctgcaacttaatcaaccgtgaccagttcaaagttcagagatgagaggtaaaccaaaccaaagcacacacacaacgtggacgcctctggctgcacgaaacgggagagatcaccgcgcgaagccgcccgttcaccatgcacacatgcaggcacgtacgcgagcctccacatggcggccactcgcatccccgaattagccccccactaatcccgctataaattgtccccgtccccgcggctcatctccctc

SEQ ID NO: 5056 - DNA, 1501 bp, Oryza sativa
ggtgggacttcttgaaagtaaaatatgaattccaacgatagttttgttcaattattaaaatgctaatgacaataaagattaagcgacggatgggtcatagaggagtatattggcagcatttgacgggatttctaaagattctatttggtgtattactaacagtttttatatgtcgaatcaaccgccaccactctactcttttataggcttgttatttaatttatctcaccgtgtgttttagatggtctcttttttaataatctttatttttatcaccagttttagttatttataaattgtattctattttaaatcttttttctttttctttttctaatttcagaattttttttaaaaaatatttaataccgtatagtgttcttttaatatttttatttttcatttttgaattttagttgtttcaaaattgtattcctacttgaactctcttttaatttttctaattttggatattattttattttttattctgaattttaattaatctcagatggggttcttatatggattcttctttaaatattgcttttttttaattctgaattttagttgattttaaattgtattcctacttgaactcttcttttattttttctatttttggattttatttttatttttatttcgaatattaactaatctcgtattgggttattatatggactcttttatcaatattccttatttttaatttctaatttcagttatttttaaattatattcctacttggactctcgttttatttcctaatttcgtattttattttatttttatttcgaatttcgattaatctcgtattgggtttttatatggacacttctttcaatattgctttattttaattccgaatttcagctatttttgaattgaatttctacttggactcttcttttctttttctctgattaatgtgggaatttatagccctacagcgaacgtagtgccttagcatcattatattttctctcatataataacatatatgttttctcaatgtattattcaaatatattaaaatgacaatataattttaaatttctaaattgtatttctatatggactctgtttttatttttctccgattaatatgagaatttcgcgcaattacgcggctagcacccaaacaaaatcatatatttttttagtatgattttacttaaaatttattaaatagctatctagctatctcattgtcttaagattttgaaagaccaaaccttatcatcctcgtgtttctaattatatagttttcaaaagtcacaccagttgctaccccttatgtcatctccttttttatttgcttgctcaatctatcactatttctattcattcttcttggaacctttaaatttggattttatagtttttagagtttattgtcatgttgggtttcatttttataatttctagatgtcccgtcaaacgttgccattatactcctctacggcccgtccattgtctcttctctttgttgtcatt

SEQ ID NO: 5057 - DNA, 1501 bp, Oryza sativa
ggttgaacccacatacattaggatgataaacaatgtttcctctgaatatcttgtggttcttggcgactatcagacatgttctgttcaggacatggtagattatcacacaaactttcctcagagtgaagctgcagttcccatggtgagtttgcaagattttctgtttggaagtgttagacctcaaggaaaattcaaggttctcgcgtcaagatctcatcttccacctcactacaactacatacttaactgtgaggtatggacttcacatcatctgatcaccagggaggagagacctcagaagctttgcacctgactatctcagatgttgatgtatgatgtaattatctgaatctgaatctaaatctgagaaattttcaattgtttttcacccagtgcatgagcaaatgtgtttacttcaagctcctatgtaaaatgtgctgctttcaagaggctttcctcaacgttgcccacgacgcacatgcaagacacgtgagctagcaaacaattgtggatgtggaatgaataacggcaaactcgattatagactaaatgttgagcgaccataatagcataatagcaggaaacacttttaaactcttgaggggatgtcctctcatttgctcaaacaccactcaaatagttattaaaaaaatctcaaaaaataacattcatatgacatacatatatcactttaaaataaaatttaaacttaaactcaactcacacattgagaaatgaaaagggcaaattcaacatatgaacaatatagtattattcatcccataatttgttttttttcaatgtatagatcaagtttgaagttgattattggtggagcgatagatgttactgtactctacattgtcaaattattatttacattttgtataaccatttacatgaacttgaaagaaaaaatatacaaagggacatccccggattagattccactccctgcaatagcgaagtggcgagataggagctccatcgacgcggatggtttatatgtgttctctggtgggatccgactgaggagtggtgaggaatgtgatgatcgcaaggatgggcgctgaggatgaggaggagcgtagtgatggtgtacaggtattcggcacatgtgctaaaacctctacaccttgccactgcccatgggcataggccacttgcccacctccactcccccctattaaatatgtgatccgaattttgggcccacaatatattcggattagtttcctagtaggagtcctattaggtgtctttctattatcccttatatatactcttgtaagccgtacgggaaggggtgacgttcccattgttattcccctacgtttgtaatcaactcctctatagtgatcattgccggtcggcgcccgtggttttttcccgcgagggttttccacgtaaaaattcgtgtctccgttgtgcatctattttcataacaagtggtatcagagctttggagatcgatctacacgtcacgcagccgccgccggtt

SEQ ID NO: 5058 - DNA, 1501 bp, Oryza sativa
gagatgaggcggcggggatggggacgacgacgagggccgcgcggttctccgcgacgtcgtccgcggagcctgctgaggtgcagtcgtcgtcgtcgtcgaggaagcgcgcggacgcgctggcgaggctgcgggcggcgttcctggcggcgatcacgcaccggcggcggcggcggcagctggggtcgagcctgacgggcaccatcttcgggcggcgccgcggccgcgttcacgtcgcgctgcagacggacacccgctcgccgccggtgctgctggtggagatggccgcctactccaccggcgcgctcgtcagggagatgtcctccggcctcgtccgcctcgcgctcgagtgcgagaagcaaccaatcaacccaggtacacacacacgcacacacacgaattaatcaaccttcatcctcttcagcgccggcgagcactaacaccacgacggccggcctgtcggccaccggcgacgttcgttgcgttgcaccatgtacaggcgagaagcggcgggcgctgctggaggagccgacgtggcgggcctactgcaacggccgaaagtgcggcttcgcggtgcgcagggagtgcggcgccgacgagtggagggttcttggcgccgtcgagccggtgtccgtcggcgccggcgttctccccgacgacgccgccgccgccgccgccgccgaggagggcgacctgatgtacatgcgcgcgaggttcgagcgggtggtcgggtcgagggactcggaggcgttctacatgatgaaccctgacggcagcggcggcccggagctcagcatctacctgctcagagtctgaccatggatcatactatcatggagcaaaatcgaaaagaaaaaatgagagaagaaatcatcttgatgtttgcaattaattgtacgtaatccatccatccatgcatgcatagtttggcttgtgttaattactttcttgggtttcatgtaatttgaagggtgtcaaggtgtgtacagtattactgatcacttggggggggcttaatatatcaatctggtaaacattggtgtgatgcactgatgctgctgtactatctgtttgtgagacatttcacgtctgtgtgcttcaggactaattcataatgtctttgctaatctatgctgaaactttggttcattggctgatggctaataaattcatgcatcttaaaaaatactatgcacttttatgcgttcaccttaccttagtccagtatataatactagtagctgacggccagttacaaggatgctcaataattttcagttaagtgtcactgtctactgaagatagtgttttgccgtcggaacactttattagctcattgaagagcatctcagagcaagtataatactatggaggaattacaactcatggccaaccaaaataagtaacagttttagtgtcagttgtgagataaacattctacttttaacttatctccattcatttctgttcttttgaaatgataaccaaattagtcaagcgtagc

SEQ ID NO: 5059 - DNA, 1501 bp, Oryza sativa
aactgttttaaatttaactaagtttgtagacaaatatagtaatatttataatattaaaataatttcatcaaatcaataattgaatatattttcataataaaattgtcttgggttgaaaatgtttctactttttttcaataaacttggtcaaacgtaaagcagtttaactttgaccaaagttaaaacgtcttataacctgaaacgagggagtatatggcaaaaaaaaaagatagacggtttaatggaaactcctataattttaacgctgataataagggcttgagacccgtggtctccatggcatgcagatccactattgtagacaacccacatttttttagcttgtacccgatcattttggttccattagaggaagtaaaaaaacagtgttgtgcagaaactgaagaactaaaaaagacataccaccttgttaacacgttcctaaagtttcctgattttctagcaacgcccagaatcaaccaataataaagctcctttaacacggattattttgcacacgtagaaagtttaggccctccagtgccagccactcaggctgctgcattgcatagtgtactactagtcgttaaacctataaaatggccaatgctagtccagtactacctctggttctataataattaacgctttggacaagtttcaggtcaaatttttataaatttgatcatcaataactttaaaaatatttagtttaaagaaactagaacaacatatatatatttatctttaaagcactataataaaagtaaacatatatttatttattgtatatattataatagaaaaataagatcaaagatatattttgtagaccgtgttattgtccaaaacataaattaaaataaaaccggagggagtatctctgtcaaaataatagtccaatgagaggagaccagttcggacactcaaaatgatcatcacgtcatcaaaaagcggccgtccagggacgagggggggtaccgtggtcatttgccgcaccgcacgctcccctcgcgaagcgccaccgcttttcagccagccgccccacgtgaaattacccctctaccccccacgctccctctctcctcctcttcccctctctctctctcctcccccgctgtcccgcagcctttcccaaatctagccgcacgacgcaccaacccacgcccgagccagagccaggtcgccgcgccacctcttcggcttcgccgcgccgccgcgagcgggcggggagactccccacccccggtgagtgcccgcccgcgcagatccgcgcggttctttatatttgggaacagtccggcggggggtttcttgcggttcttggggttggcgggaattagggtttcgttggtggggttttttcatggtggctagggtttttggtcagatggagcttcggttggtgatttgggtgtttctttgttcggaattgcagggagggagagggcggttcgtttattggatgagccgtgaggaaattgggaggaagaaggcgtga

SEQ ID NO: 5060 - DNA, 1501 bp, Oryza sativa
atctgaacaggcccgatattttttttggattttctcaacaaatttttgtgggcctctttgggtcgcaaccaatccatctatgaatgggcctggattcctatgggcctaaccggaactcgaccaccttatcctgggccagcaggagccagcccaacttgcggaaactccattccatcgtctccgactcttctgcgctcccctcttgtcccctacccaaacccccaccacgtacggcctccgtccccttttccggcgacggcgacggcactgcaccgcccgcgccgccggtgagggcctccactccactcgcctccacgagaggggggaaagacgacctcacctccgccgctgccgtccccggaaggcgcgcgcggtccggcgaggctctcgcgtgtccccgctccacgttaggttctcgcgcttcgtctctctctctctctctctcccgctgccttgcctctaccccgcctccctcccactcccgccccttcgccgccgccttccattggtaacccggagcgctccattagtgttgggcacctgctcgtgctctggtggtgtttgatggtgttcgtctccgcggtggatgaactgagcgctgcggcgaatcgggaaggttctctcctcgctggccgcacccatgatcgcctcctcctcagcgcaatcatggattaaggtatgggcgtatgtcgtttctcttcacatactatcccccttccttatctgaaatgaggtcgcttcacttcttcagggtcacaccaatcaattagcgagggtgttttctttggattttcgcagagggcgctctagaaggattccttccagaatgaggtattgattttgttaggttcccctccccttgtgggcaatttgtgcttgtggctagaatagcgagttagcaactagcactgaactgttcaggttgcaggtctagcaatgctcttggctctaagctcttccggtggtgttcgcgcgagaatcacacgtccgtcaggaagctgttggaggtggatggcacgtcagagagatcaaaactcctgaacaaagtatgtgccctgccagcaactggttgtgttcacttgttagtgttagccttcgattttgcaggcatcagtaatgagtttagttctgtatgtttcatctgttcaatcgttccaccatttgggctctaccaagtgaaagctatttatatttcccaagtcctctaattattgttgtgagttcaaactagtgcatagtaaccttgtttaaatacaatgcgcatatacttgtacattaacttccttgatgttatgacctttatagtttaagcctatgcaatagctctacttaatgacgtctggatttgatttgcacggctctctgcttgatgccactcttcactaataatgtcacacaactattcatctgtacttgctgtgaacagtgaacattgtctggattatttatgattgcaggtgtctgttttgatgggttatagtaatacacaagaattaattga

SEQ ID NO: 5061 - DNA, 1501 bp, Oryza sativa
cacacagagctgtggcatccacgtcgagcgatggcgcgacgacatggcatgggaggcggtgacagtggcaagctaggaggcgtgcaacatagggtggacgcagggtggagggtgcagcagcaagtcaccaagcaagcaagaagtggccatcatcagaaaatggatagatcgttgatatttatcttatcttatcaacctcgaatatattatactaatcaatctttactatttgtttcgtagattctacatatatgatatatctatctatcatcactaattcctacatgtgatgtattgctaaaagcatgtattttttttctttttattcttgttttgtgctactgctaacacaattgtccatgaaccacacctgtattttttttccgtcctccgccactgtccatgatcaaagacaatggttcaagatattgactgaaaacaagcacttctgatttcatggcttcatacatgcggacaatctccataatgaactttgtctcaccctctcatgggtttgatcataaactctttaataaagacacattcacataagatgtttatttctccaacagttttgcatgtgtgatgaggactgatgggtgtatagatcttgtgttctacatcaagagtccccattgctacaatgttctttatagtgttatagtgtgatgatttccttttgatgaggaagaggatttagaatcacaactgattctctcaatctgagaagagacttctaaagggtgtcaccgttatggatatgcacaataggatcaagtattttccggattccatctatatcctctgtgatgttatttagtgttaaagaacaaaatttcttaccttcacccaagtgaagaagcatatcttgcttggcatcaaactaaggttttgtgcttgattggttgtttcttgaagcaaagcatcttttcttcaaacttttagaagtgagatctcttgcaaaatttggtctaattagatagaggatattataaaagctctagaaagttattttgaaatggagcctcaaactatgtttccctacatgagaaaaggtaaagaaatcggtacaataagaaaataaacaagtaaaataatattggggatcaaaatagtgtccatgacactttaaaaaaaaagcgtctacggcacaaaatgatagacaagagaatctctactattctaaaaattgaagatatttttgccagtactttggtatgtcattcgtgtatgagtcgtttttaagttcattcgcttttgcaaatacatatccgtattcgagtcgggctttaagttcgttcgcttttggaaatgcaaaaggagtcgtataagaaatctttttaaaaaagactcgcatgctaacttgacatgattttctagaaaaatatatatctaagcaaattctcacaatgaatttcacggtgaacaataataagatgaaaatagccttcacccgttgcaatgcacgggtatttttttctaagttattttataggtacca

SEQ ID NO: 5062 - DNA, 1501 bp, Oryza sativa
gatttgaagaaacaaatacagtatcagtatatgaacacgatcgagtgggggagaccattaccttcagctggcttcttcgcggcttgtgtttccccagctgcatcgccctgctccttctcagcgccagtgtcactgccctctacgacggcaggttcactaacttcctcgatctcgggcttggcatcctcgactccatcggtcaccggcacctccggctccgccgcgacggcggcctggcttccaccctgcgccttcgccttgttcctcgcgcccttcgacttccccgccatattccctgcccaggccaaaaaataccaaacccaccaaatccaaatcaaatccaaaccccaccacagagtcggccacacaaacgactccctaataacacgggtcgcgccgctaaaccccaaccaaacacgatctggagtcgaatcaaaaaccctaaaccctcgccaaatcgaccccgaggcgggcgctccgttcggccggacgcgagccggggaggagaacggattgggggaggggaggggggagggggggcgagtgagacgaacctgccgcgcggcggcggggaagcttcggctccggtgaggggggcgaggagaggagaggcggcgcgaggcggaggggaagggagagaatgattggcctcgcgagaggggggctgcttgggtagagagcggtggcggctggacgcccgcgccttttatatgggcgagcgagccccctagccccctccccctctggccgctggtctctgcggctctgggtgaggcgctctggctattttcattattttttttcttttttttaattcgctgcgcacgtaatgcgactatgcgagtgatatttgtgagggcattggtgtgctgccttgtagaaggggattgttttttttgttttgttttttttttgggagatgtagaaggggtatttgtggtagtctacttgtggagccatcccgtgggagggattaggggggttgttagggttttgggaggggtttaggcggctctaaacccctgtcacgctaactaatgacgatcctgagtgtcgcgtggtgcagccattccattcaagacttcgtcacaaaagcaacttggggaaattaattttggcataagctatgcggaaacgcttaatatcggacgtctgacgtatcataaaaagtcagatgggcaaactactatctccctatccacttcatacatccattacatgatataatgatctttaaaatattttttctcctaaactacttatccaatcgatgatatgatcataccattatatttgttataattaaatctttacaacaagatatcacatcattacattccgatgaaagaaaaacatatatttcaatccgttaaaatttaatgtttcagacgcggtagcaatatgtttcaacacatgtttttgttatgtttcataaaaaaatttaaatgtttcgataactaaattttcttgtttcaccatatataacctaatgtttcataaa

SEQ ID NO: 5063 - DNA, 1501 bp, Oryza sativa
gtgcaacctcgtgaggaaagggttgaaatagacccggcccttgtggcccctcaacagagacgtaggatccgtggatccgaacttcaggaaacaaatcaacgtgtctcctctcttggtttgctcgttcttgccatctctcatattgtgcttgagcttgtttttgcctgatctacttgcatgcttaattaatatagttggtgaccttatatcttgcttagatatcttatttgtcaccttttgattcatatacattttgtttattcgtgctacaagtccatagctagtgttttattccgttatccgctgaacctttcggttgagatcggaactttcaatcccataccaaaagttccgatttgaaccgaaagttctcatctatctaatatgctatgaagttgtggtaattttttaggaacgcctattcaacccctcccccaccccctctaggcgacatcaaggtcctttcaaatcatgatcattgatgatgcgtttagttggagggatatgatgggttggattataaagaactcgtttttcatagtgtttggcttggaacaagtggaatgatccgttaaaggaattccctctagatctggttagctccatccctcaaaagtggatcaatctaatccacttcctcttgacatgtgggccacatcctctgaaactaaaaaaaaaagatcattaacacataaatgaaaccatcccatcctaaaaaaaactaggatggacctaacacatcccacttgatccccaaaccgaacacatgctaacaaaatatgatttttgttacatggcactcaaaataaattgtactctctattatttaatgctgatagtgttcagcagcaaatgtaactatcttgttccagccctttaggtatgggataccgtccctcatcatcccttttttgaagtgacaaaatttgctactccctccgtttcacaatgtaagtcattctggcatttcccgtattcatatgtttagatttattactatcaatataaatgtgaaaaatgctataataacttatattgtgaaacggaggaagtaaaaaaaaaaacttctggtatgagatactgtacgtcatcatctcttctttgaagtggccaaatcttgatacacgacaaaaaaaaaaaacatgatctttaataaaatataatttttgctacgtgacacttaaaaaagtaactccttacttgcatgtatatattattttagtgtatatggtattcagtagcaaatgtacacaaaaacgaaattagcgtagcacattttgcctgcgtactgcatctccttgaagaaggcaaaatcgttgtactacctcttaccttcaagaagatgaaactgttattctgacacagtccaatgctggataatggtcctacaatccaaaaagcatgaagaaataggcaataccaaatcatggacattctttttctgccaactaagctaggcagtaccgaaatacgattccagcaaaaacgacataattttatg

SEQ ID NO: 5064 - DNA, 1501 bp, Oryza sativa
gtgtatattttttcaaaaaaattctttatttttttaaaaaaaaatcatattaatacattttctaaatttaaaataactaatacttaattaattttgtgctaatgataaactcattttgcatgtcttctttaatcttcttcttttccattctgtcaaaagctttaagttgatgaccccggtggcctttaatcctgactccgcccctgtctgtgggggctaaaaattcccacattaatcggagaaaaagaaaaggagagtccaggtagaactacaattcaaaaatagctgaaattcggaattaaaaataagcaatattaaaagaagtgtccatataagaacccaatacgagattaatcgaaattcacaataaaaataaaataaaatccgaaattagaaaataaaaggagagtccaagtagaaatataatttaaaaataactgaaattcgtaattgaaaaataaggaatattgagataggagtccatataagaacccaatacgaattagttaatattcggaataaaaataaaaataaaatctgaaattagaaaaagaaaagaagagttcaagtaggaatacaatttaaaatcaactgaaattcggaattaaaaataagcaatattgaaaatataaattaaaaataagcaatattgaaaatatatgaacccaatacgagattaattaaaattcataataaaaaataaaataatatccaaaattagaaaaataaaagagatttcaagtaggaatacaattttgaaacaactggaattcaaaaaataaaaaataaaaatattaaaagaacactatactgtattaattaaattttgaaaaaaaataaattctgaaattaaaaaagaaaaaagaattcaattaggaatacaatttataaataacaaaaattgatgataaaaaataaagactattggaaaaaaaagactatctaaaacacatgacgagataaattaattaacatgcctataaaagagtagagtggtagcggttgatacggcatataaaaactgttagtaaaacaccaaattgaatcctaatgattattaaaagaagggacgacaggtaggacgtgaagcaaacggataaggctgttgccgagacttctagaaagtaaaaaaaaacccattgataatcatattcgattttaaaaatcttaatgataacaaaaacgagaagtagagtgcggcgtgtataggagtacagttacagagccgtcgacagttggtgagacttctagaaaataaaaaatgaattccaacgatagttatgttctatttttagaatcctaatgacaataaagaataggcggcggatgggccgtagagaagtatagtggcattgtttgacgggacttctaaaaattataaaaaatgaaacccaatgagacaataaagtctaaaaactataaggtccaatttttaaaggttcggaacttctaaaaagtaaaaaaaaaacaatgataatcatgttcgattttataatctcaa

SEQ ID NO: 5065 - DNA, 1501 bp, Oryza sativa
ttatcacgtaaaaaaaaggagtttcagctcgtatgggctgtgtaaacacccgactgacgtatgggcccccggaaaaggacgagggcccctttgtcggtgttaggtatcttttcttcagtcgtttcagcttttaattacttgcttagtgcatctctgacaagattgtctcgcacaggttaaagcaaaaaaggcccggaagttttcccttgataaaaaaaaacgagaaagtatccacaagggcgacgatatataacaacaaacagaaaggtaaggtatatccacgggacaatcttcaggcacaacacgagttctagttagtccagttcttcgcttggtgcacgctccagcgtaatgaacaaaatgttatatagagtaagaggcgaaatcagtcgaaactatcatcagcgtcagctttattatatagcgtgatgagccatcaattcaaacaatatcttactaaaggataattttactattcaccgaaaggtacaatatttatagcgtaaaaattttaatatagaaaacttgatatctcgagatattttctcaagtacaataaattttttctttactaaatgattttggaatttcatcggctaaccttggtgatgaacgtagctagctccgccctttatatatgtactccattctaaaatataataatttttagacttcaggatttgtcataaaatataataacttctccattaatattcttttcccaaccaatcacaatccccaccatttacttttcatacatacctccactactcatccaatcacaactctccactactcatttctaattactttcttaataatcgtatctaatcttaaaacttcttatatctgggacggaggggtattattttaaaccaagaagaaacgtttcgagcatgacattgttttcgctcggataagagtcacgcggcatacttgcttcatctgagtactattgcaagtaaagatgaactctggcctttaattgcaaagggtccaggaacatcaaaaggaaagaaagaaactaaacaactgccatctccatgtttctttttgaacgaaaggtcatcctcatgtatcgatggactttaaagtatcgaaccgaaacgatactccagctgacattaatggaagtttttttttttctacaccaaagatgtatatatgtacacaaaccattacgtatgcacctgtacctacgcacacgtgagtgcaaccccttgtctcttcatcggacccatgatgtttattgtccaacataaaccacctaattggtaggtggaaatgcaaacctagacaattattgaaaatgaaattgtagtttctggaactggcaaagctagaaaaaaaaaagagcttaggtgatcggcgttttttttttcctattgtttagttcttatttggctacttgtttcttgaaataaaattttaaatcagccattaggtgatcggcgttttgttgtttgtttggaaaattcatagagcaaggcaatggctccaa

SEQ ID NO: 5066 - DNA, 1501 bp, Oryza sativa
ccccgacccgcaccgacggcccagatcgcttacccacgccgctgcacgcgtacgcgagggttggagccgcaaaattccagcgtggaatagcagcacggcatttcctccctctctctctctccacgggaggcggagataaaaaggcacgcagccgctccaagaaaccctcgcccccacgacgctcgctctctcctctctctccctcttccgccgccgcgcttggggaaggaaggagaaagcaagccatcggcccccgcctccgcctccgaagggtgagctgctcccgtcgtttgcctctcctcctccctcctctcctccttttttgggttgtgctcggtggagacggtgatgtatatatagatccgtggatctggctgtggctcgcgcagatctgcttgtttcttccaagtagacttgttacgcctgttggtgttcgagtggtaggagcccttgggcttttccaggttcagatcgacgcctccttcctctggtatgggaggatctcctgttcatctgttgactgggtggtcggttgcttagatctgttctatttctgctttattttgtgcatgtattgtgtggtttgtagggttatggctcccctgtgcgcggatcatgtgggtttgggtttcgtttcgttcgtagaatctttggatgttcgggttggctccgaatctgtagatcggaaggtcattggtcaggtggggatggtggggcagccaaaagggttgcgtttttttactggttttctttattttcactgacgtcgactagatctggtcgtctcatgtgcctcagatgcgtgatctgaacgcacacaacccctccaaacatgactctgtttctcgatttgatctgaccgtgaccgtattacagtaacgatccatccttgtttataaacttgtacagatttactagtataatcctgtgtttcatgcatgctagttttatacttctcattacctgttggtagaatttaataatgtgctctggaattgcgattccttttgctctgcacaaaaaggaacggccctgcttggacagggaccatccttttctgcgacctatttaaagttctcatggtgcgtcgtgatggtgatgtgcactactgtgtagaacaccttatactgtttgtcatcaggagttccactgcaatttttaatacattctggatgcatttttgtagagactgtacaattgtgtaattacatgcttatatatagttttttgggcttttgttcttggtaaatatcagtttattagctctttccgtttagtttcttaagcactacctctgtttgtacaccatgatttcttctaatgaatgaaatatctcaacaataaatctttcttctgcactgtctgttcgtatgctatgatttcttttgagtgaaatatctgaactacaaatattttgagtgaaatattttgcctgtgatcctggatttctaaaccagtactgttgccttttatgatgcaggacattgttgctagttggtga

SEQ ID NO: 5067 - DNA, 185 bp, Oryza sativa
aacttttggacctgtaagtatgcattttctaatttgcacccgtataaaaaactagggtatatatatttgctctcgagatgtacgcactggtgaagaacacctggcttctgtagcagtggttgatcgttaaaaagaagaatattgtgctgcttgcaactctagctaggacggacggggggcaaaaa

SEQ ID NO: 5068 - DNA, 1501 bp, Oryza sativa
tacgatttttgtaccgttgattttggctaaggataatcaatcatacacacaagacgggctggtgtaaattagcaccccactagagacaagtggggaataaactagtcccatgtctcccattagaactcgagaaattttcttgtcttctgctcaggttctcatatgcttcttacgattcccttgcttctgtacactttgttttcatgggaaaaaccttcaccaacaatgctcttcggtgcttcattcgtactaaaatatattaaccaaataatgaattagatattatataatactacagtctaacactacatactactaatagtagtattagggcctgtttggtacaggtacagctccagctccacccctcctggagctggagctcagccaaacagtttcagttccaccaaaactgggagtggagttgggtggagttctctcataaaatgaactagagttgtgaagctaggtttagacagctccacaacttcactgcagacctaactcctgaagctaaatttaggagttggagttgtaccaaacaggttattagattgtatagtaagagtttattatttagcgactctctatttatagattagtagtagtaatagtattagatagtgtggtaagagtttgtttagcgaatctgaccgtacgaatatccgtttagatagtattagatatcagtcaattcaaatttgtacttagtatactagtattccctccgtttcgaaatgtttgacaccgttgattttttagcacatgtttgaccgttcgtcttattcaaaaacttttgtaaaatatgtaaaattatatgcctgcataaaaatatattttataatgaatcaaatgataggaaaagaattaataattacttaaatgttttgaataagacgaatggttaaatatgtgctaaaaaattaacggtctcaaacatttcgaaacggagagtatattttagaaccgacgtttaatccctgagagccagccgttggctgtgtacttcatgcctctctatgacaccatatggtatcggattggtgatagtaatccgtcgcgttgcagcggcggcggcgcgttccatgctttctccctttttgtttttttttcgtcagtttttgcaagtagcgctctataaaaatctcgcattatcttcttccccaatttgcgccgctactagtaggtgctagtctcgcctcgagcccaaatccagcctgctcgcgtcggccgatcgatcgatcataccacgggccgattcgtggctcgcgccgcgcggctggggtctaagctagggtttacgctcgcgaaaaaaaaaaagaaaagtgttgagcgaataatttgctcctagacctttgctgcttctcccctgtcgataaagccgaccacactgctcgcgtccccccgcgccgttcttttcggagattccgctcgcgcgcgccgccgccgccgcagccgcccgccggggagcccgggacgaggatggaggtcgtcgtggcga

SEQ ID NO: 5069 - DNA, 1501 bp, Oryza sativa
caatgctggtttatctttgtcaactagttagtgaaagcacgggagcagcggacagccggacaccgacactgctatcgatcaggtttttctttgtctgaaagtgccattgcatcatcctgaaagaactgcatttaaaattttcaatgatgtagcgtgaataaatggtaaaaatgctgaagctgagacaaggctgggtcattagccaaaagcccacgggtagtagtagaaaagcccgttgctacaattagtatcgtggatttggtcgagagaaaaatctgctcatgggccagcggctagtgttgtttattctggtccgtttgaacgaaacgctgcctctgaattttttgtttacagcaaagggatcgaaagcgagatttgatcggctgcatgaacaaaaaggattaaagcagtgggcagtcggcagcatgttcctgtgctcgtgtctctcctgcctgaatcctgaaaagctcgacaggtaatgcagcaatggaggaggacatcatcatcaattcatcatcattagaacgaccaaatccaaataaacatggcgcacgtactggccattatcttaacgaaactgcacggagagtggaagtagtgatgggaagagagtgattcactttggctgtgtcacgcagcggaagtttcgatcgatctgtttgggtttccatccgaaagataaaagatggaagccactatttctcgccatcatctgaatgaagcccttctttttttggcgggcctcatctgaatgaagctggtcggaaggagcaagatttgcagatccacgtatgtgcaaatcgcaccacgaatcctaatactccgacatgattttgcttgtgtcgtcacaccacaaactctatttttgagcttagtttgttaacatcacttgatcgctctcgcttgcgatctgtgaatctagtgcgtgcatactgtgcagttgaaaagtttgccgtcaagtgagcgtagctcaaatccaactcagatcgaagttataaagttgacacatatgctcgcttttacggttaattattctttcaacagtagacaatatagccgttgatagtaatgcactcgcaacaacttcatgaaactcaagatatgttaatccagatttctaaatgtgctaatagagataaaatgtgtgttcatatggagatatatcagttcagtttttttggaggtgtttataggagtacggcgcgtttaaaagtgtggtatgcatcgtgttgtgagtgtttgtgtgtttctttaaaaaaaaattgccatttgtcaattattgtggattttctgcaacttgttgtccaaagaaaaagaaaatagtttcggtcaacaactcaacatccatctgggggtatgaccgaccgagcgcggtggccgttgattggctcgtcgcctcctcccttctcggtctgacggtctgaccagtgccgggtaggaagcgtaattttgaggagagactccgacccgcgccgccgccgccgcagccaagccatggagg

SEQ ID NO: 5070 - DNA, 1501 bp, Oryza sativa
cggctagggacgagagccaggaagctctcatcatttcgacgggacggggcgaggcgtgtgacaggccgcctgttgccacctaacccgcgatctgaccggtctgtgaccggtcacacaccgcgaccggtcacggaccggataagcgtgcgctgcgccgcattaaatgcggcgtggcgcgctcgtccaacccgctataaatgcggttaggtgagccccgctgtgctcacctaacccacacacgtggcgccaaaaccacagggggtcggggcgccccagccctcggggccgaaacgggggcgccctagccctcggggccgaaacgggagcggcccgacccctcggggagacagagggaggggtggccacgtcaccctcgggcccgaccccccccccccgagggggtcaggccatgtgggtgaccgcggctacccaagcctctagtcacgatacccccggccccatgtcaccgacatttatctataaggaatttacataaaatattctaattaatagatacaattgccttcccaggactctattcgtgcgtggcaatcatcttgaaatacattaacttgaacccgatgtcgcgtacgattcgtattgtcggaatcggctgtatcggcttactcaacccgactcagacccagctgatcctaatcgtagccgatttggacttcagccgattcctgctctgtttccgaactcgatctccgcctccaactttgctttgatccaatcttctttcctgacatagatgttaccaaatttggttgttaacagccccacattgtcaagatgccacatcagcaccctccctcttcattctcctctcccttcctcctcctctctctctcactcttctcttctcttctctggcaagccagcggcgctgctggggaggaggccgccggggcgaggcgagaaaggaggaggcggcggctgcgacgcgagagaaggcgagggcggcggccggtcacgaatggtgttgtgtcaccaccggcggcgaagcggccccgcagcgttgggcgatgaggggaacggcggagcaggcgagcaacgacggagcgggctgatggcgcgcaggcaggcgaagcggggcgacggcgggcggagcggcgacgcacgcgaagcaagcgggggtggcagggtggcggcgggtggagtggggtgatggcgtaggaaggcgaagtggggcgacggcgggcggaatggcgatgcgcccaaagccggcggggcgacggcgcaggctggcgaaagccagcagggcggagcaacgacgcgcgaagccaaaggggcggattgggtggcggcgggtggagcgacggcgctcgaagccaaaggggcggagcagcgcggcagcgggcggagaggtagcaatccgccgtcggagccgatccccacagcagaggcgcgtctccttctcccacgttgtcgttgccgccgccgccgccacgtggcccgtcactgaccgccactgtcattcgtataagcgttttatacg

SEQ ID NO: 5071 - DNA, 206 bp, Oryza sativa
tatacaagctcctagcttatacatgaaaatctctctatatatatctctctgtctccctctcattcattcatttttatggcagttgaggggaatgttgtctggtccgagacctaacaccgggcggaatggcggattcagctgcagctaagcaagctaggtggggggtttcggaccaggcttcattccccccaactcaactgtttagt

SEQ ID NO: 5072 - DNA, 1501 bp, Oryza sativa
aatagataacccgcaagtcaaatccatgggttacccactaattttgcctataaacgggttcgcggacaagcctgcttgcacccctagtgaaatattttttaatggcaaaagaacatgatctgtttggatcccatgaagacgaatattaagtatggacatgtaaaactagaaagccaataacacatggttaatttagttttaattattttaaacttagaaatggatttatcttatatcttaaaacaatttcacatagaaagttttagcacaaaatacatcgttttagcagtttgaaaaacgtgctaacgaaaatcgaggtaaaatatgtatcttataagacaacggaagtcattcgaatttttttagtgaatatcaacaactaattcctaactacactaattcgaaagtagaaatcacagattcagaggtcgggtggaccgacacgggaacagaggaggcccgtggtggtggggcgacgccatgctccctagcctcgccactcttctcgccaagttcacgcttcccctcattgtgtcgccaaaggtgatgacacctagcctctctctctcctttcccatatcttcccattatgttctctcctatcttcacgacgccgaggcctgaggccctcacgacagcaaaaatgacaacctaagcatcaacctgagcttccccgtcttcgtcaccgatagagctcggtgatgccgccgccaccgtctagctcctctctgccgactaccgcccttctccctacacaggcacgtgccatggaggcctgaatagagatgaggaagagagagaggggaggaagaagatgttgtttcaatatttaggaccatcatgatttttttttattttctatttttgcttttggttccaggtcagcttaacacagcctacaaagctgccttgggactacattcgtttgttttgaaagataaagaacgtgtgttatacttatatctggtactgcggtccaaagacacgattcgaactcaacgtgaattatgagggacctaaagtgaacttattctatcacgcggttggagttcaatagtctatcaggcccatccgggcagagagaacaaagcggcccatccaggcagagagaacaaagcggcccaccactggcgggagtaggcgtaggaacaatctgtccctcgctcgcaagccgtggagatccatcctttttttcccattgcgtgccagttgccacctctcaaccccccgcccctggctcaccctccgggcctccctcccccctcctctcctctcccctctctcgcggtcgcctcggtgcagcccgcgaaaatagcagccgcccgttccctccctctccctctcccctgccctgccgaagccgcggcgatgaacggcgccacggccggctccggctccggctccgaccacgacgacgcgcgcgccgccgaggaggccagaggggaggaggcggcaggccgtgccgtggaggttgaggaggaggaggaggaggaggaggcgg

SEQ ID NO: 5073 - DNA, 1501 bp, Oryza sativa
ggtttaacagcttgttggttgtgacagttttttttccccacctaaccctggctatgatcatatataacctgcaattctaaaggcttaaatttacccaatcgaacagcattgcgcgctggacgcctagatttagtacaagtggtactacaaatctaccatctgtttgcccatgatccatttttacgagacagttgtgtggacctttgtgcgagaaaatctgcattcctcccctagccggccatccatgcatgtgccggccacagccatctgatctagccgagcaatcaatgcgacagcattgcacggtatcgattgctacagtagccgctacatggcatattggcataggttgtgtttagtttcacgttaaaatttaaagtttgaaaaaaaagttagaagtttatgtgtgtaggaaagttttgatgtgataaaaaaattagaaattttttaaaaaagttagaaactaaactcggccataaatcacagggcgtcccgcagtcacagtgacgtcaccgttggctgcgtactcggtaaccgcaaagttcagaccttcatatgtgagttgtgacgccgccgaatgctgcaaaaccagccggtctgagtacgggcgtgggacgcccctttttttctgctacgagtagtggatgaaaatttttatcattgtgacatattttttaaactaccaaacaatatatttcttacgaaagttattctaaaatattagataaatattttttaattatacattaataccatcttatttaacgtaaaatatttaattttcatttttattttcatttccaacaatattttcatttccaacacaaaagaacaccgcgggtcgctttcctgatccgatcccgtttcttttaaaaaaacacgatcccgtctagtcatgtccgcatcttgcgagtcagctgctgagctaatcaatagcggcaacagcaacagcgagataaatcacggtaatcacagcaacagcaacagcaacagccggtcccggtttgcactgagaaatcactcggttagccagccgttcgaatccaaaataaaaaataaaattaatcaaaacgcaatcattttggtactaaaatttatcggcaaacttattccgaaaaccctgcgtccagcttacctcgccgattcgcgctgatccgcacgaacgggttcgtcgtcgggcgcacgcacagcacaaccatcccatctactccatctcatctcccttattccaagggatggcccacctgtcagccgcgccggctataagttggcagcgtggggcactgacaggtcaagcccgcgagccacagcggagacgacgcgacgacgcatcgaaatcgcccgcgacgcgagagagaggcggacaatactagaagcatccctcgacgcgagacgcgacgtctctctcgtcgccagcggcggcggcggatgggggcggggaatggtgaagtgcggtacggcggcggcggtgccggcgccggcgaggcggcggtgatggcgg

SEQ ID NO: 5074 - DNA, 1501 bp, Oryza sativa
atctcatacgaatttgatcaaaaaaattttagggaatagatcatatactgtactccacctgtctcaaaatatatgattcgtagatatataacttctcatactaaattaatttattttggacgaagtgaatatttgttttaactatgtgccttatgataaagattctgtgttcggcactcactgctgggaacatatatgttgcgcacgaaaaatagagcggtccattagcgcgtgattagttaagtattagttttttccttcaaaaatgaatcaatatgattttttaagcagcttttgtatagaaactttttgaaaaaaaataccatttaacagtttgaaaagcatatgcgcggaatatgagagagaggtgttgggaaccaaatgtaccgaactgggggtttggatggaaccatgtcacatcagatgttggacactaattagatgtattaaacgtagattattgacaaaatccattccataactctaaactaattagcgagacgaatctattaagcctaattaatccatgattagtctatgtgatgttacagtaaacatgtgataattatgaattaattaggctaaaaaatttgtcacgcgaattagctctcatttatataattagttttgtaagtagtatatgtttaataatctaaattagtgtcaaacatcggatccgatgtgacaggtactaagatttagtctctgaacccaaacataactgcctagtcaggatgtaaaatatttccaaggtgagcagtgactgagaccaaaatctcgcacaccattcccatgctcgagcgagttcatcacatcaaccacacatttcatcatagattaccgagtagagagtgcttctcgttcacacttttccaaacgatcgactgcataaaagagagaagaagaaaaaaaaacacatttctcgctgagctccatcgatgacggatgactcacactgctgacaaaagagcagatttgcaatttgcaaacagcatcggacgtggaaaacgcccgagcctctcctgtctcctcccggtcttctgcttggaagaaaagaaagaacccgccgcccatccgcgcgcgggccccgtgccgttccccctcccccgcccacgcctctgcttgcggcttgccgcttagatccccctgtcctgtcctgtcacgccgaacatctgaacgcccgaggcgagcgagagagacaatcccgcggtcacctcccctctctctcgctgcgccttccgtgtacaccaccatcacaccctcccgtccgtccgatccccccctccgatcgcgtaccgagcaaacacgcacacgcacagccgggaggggggaggcgaggtccgcgtcgttcgcgatcgccttgggttgggttgtgtctctctctctgtctccagtgatcctgggccaaggaggcggatggacgtgcgccggggcgggggcggagggcgcatcgtcggggcggcgcggagggcgctcacctggggggcgctgcccctcccga

SEQ ID NO: 5075 - DNA, 1501 bp, Oryza sativa
tttaacggaacatatcaaggctagctctagaagcttgcgatacacagcgcatgtatataatcgttggacaattacgtacgtacagtgctccaaatgggggccaaaacggctgcgttctttccacaagtttcccaacccctttccatcgttttccgcgtgcacgcttttcaaactgttaaatggtgtgtttttttgcaaaaagtttctatacgaaagttactttaaaaaaacaaattaatccatttttaaaaaaaattaactaatacttaattaatcacacgctaatggaccgctccgttttccgtgcggtggagttgggttcccaaccccaagtatcaaacacagcctatactagtactaaacgaacccaatactcttggatatgatcgaatgaaaaagccttcatgcgaaacctagctactcctattttatacgcgtcctagctgcaaccccatactatatagtataattaaactacatatatataaaccgggcagattttttttaatataaaaaagcttcacaaatcaggaccggttcgtaggttttcaagtagtagcaggaaggaagcgtacgttgcatacatacttcctccgtcataaaaaaaaaaaagacaaactctagtttacgtgtccatcgtttgatcgtccgtcttatttaaaaaaattataaaaaaaattagaaagacaagtcacgtataaaatattaattatgttttatcatctaacaacaataaaaatacgaattataaaaaaaattatataagacggccagttaaagttggacacggagaccaggttttgtctttttttattttttttttgacggagggagtatgcaggtcccgtgtagtattatcttatgcggattgcttgtacttgcccgggtgtatataaaaatcaccggtacagtaaaaagcgacgacccaattgtttaacacgccttgtaggtccaattatttgcttgcttgtctgcctactgtccagtgactgaccgagccctgcacaccctacgtgacagcaccactaccctcgacttggcaccgatcgatcggtgcatgcacatgcaccgcgctgccgctaccgcgcacgcatttgggcggccgcctgcgcgcgagagcaacggcgcgcccgcgaatttcacgacgacccgcgtcgaccacgacgtcgtgggcgaacgcgtcgcgtgcagctgcagtgcgggcgcgtcccgtgggcgcgcgcgggggagggagacgtactccacgttttttatgttcaacgaacgcgacaaacgagtccacggcgcggcgggcgcctcgttcgctcgctttggcgtacgtggcctctgctacttcgggttgcccccacacgcgcgcgcgcgcggtggcctggcctgggcggggcaggccggcctttccgttccccgagcgagcgagctgctagtaaaaaccggggagttggtgtgggtgggattggcattgtatcgtgagagagattgatagagagagaggcggacctcc

SEQ ID NO: 5076 - DNA, 1501 bp, Oryza sativa
cgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcagaagccatagcaatccaatgcagatatgcaagctaagctaatggtacaaaattgcgacatgcatgttggattgttgattggacgatcgacaggcctttgtactgggtgcaacatacgtatgcatctatcatgcatgcgttgcaaattaagatttcaattcatattcatgaggaggtttatcatatacacatattttaacatctgtgggggcaagaagctagaggagagttgcaagagcaagctcggaataaaccaaaggtcagtgagattatccaatgttttgtgtttaattctaccaagtgtttttttttcatttttttctcttttgcattctgtaatatggtactatcctattctagtttgtatcttttgatcggtagaaccatgtttctgaaaaactcttgttcccttttttcaacctctgaaacatgtgcaacaccagaactgtcttatggtcactttcactggtctgaattcaagctcacgatttggtggcgttgaatattattttttatttttattttttgttttggaaccagatggtgatattgaatggttctcgacctggtcaaaatttcgaaccctagctaagctaggtcgatctgaagcatgcattttgaacaccattttttttg

SEQ ID NO: 5077 - DNA, 1501 bp, Oryza sativa
cctgggcctccccaccagcacgctgggctggcccggcacggtcgggccgacccggcacgatgggctggcaggccaggcccggtacacaaagtatagggactaaaaatagacatataaatgtcaatgtctaaagaatagggaccttaaatagacttattttagctatttatataccacagcacaaagaagagggaggtaaaatagactttttttagctatacaatgtcacagcccaataggagggagaaaatttagacttattctgaggaaaagcacgatggcccatcgtgccttcgggccggcccggcacggcccgaggcgtgttgggccgtgcctgggctgtgagtgcggcacgtgggctggcacggcacggcccggtgcgtcggtcgggccgtgccggcccgacaagcctcggcccaggcacggccgggcctgggccgtgccgtgccgggcggcccacatggccatctatactactgatggagctgttgtgccgattcgtcaaaaaaaactaatggagctgttgtgcagcacatggcaaccgacagggccgaatctgacgtcaaatgccaataggccagatggaggcccaaaagtgattacggcccattataaactggagcccaccaaaacgttcagcttggcctgcaacgctacgagagggcccacaactcgcgaaaaaagtacacccaaggtccctcaacttgtcatcgagatacaaaatcatccccaaccgcaaaaccaaatatatgacatccttcaacttacaaaaccattcactttagatccttcggtagttttgaccccggttttgtctaacgtggcagctgagtcagtatgggtccccatatgggccccacatgtcagtgtccacgtcagcaccttctctctttttttccatcttctctctcttcctcctctctcacattcttcttgttctcattgccatcgcggtgctgcatttggatgcagaggatctcgccctgtgcgacggcgagctgcatctgtagctgtgacacctggttctgcatgaaggagatggccccgacgcagccgtagactgggtcccgcatccggtcgttcgcctcatacaccaggctgctcaccgcgtcgccttgctgccgcgccagcagctcctgcattggaaacacgcatcagacgcaagcatgcatgcacggtggcgtgggcgccgccattgatgacgaccttatacgtgttcgtgcataggccatgcaatgccaatggacatatacacatatatgtatgttgggtaagaagaagtttgatttaatatacctggaggctggagcatcttgctaacattgctgtgttagacttcaggagtcttttattgcttggcttcactattctatttgggatttgggcctgatggccttgtaaggtggctggtgcgtgagtgaaggcccagctgtgagctgtgtactagctggaacctttatatactttgccgaagcgctggtcgtaggcaacgaataagaaa

SEQ ID NO: 5078 - DNA, 1501 bp, Oryza sativa
actagtataagaagtctacaaggcacgtatgttctctgtacttgagcatgtagatgcgcatacatctgaaagaaaacacataataagggagattgagggaggggcttctaaattctcgaaggaacattccgtcgttatttatatatcattcaaatggttgaaaaaaaataaaaaaaattcaaccaaatagattaatatgagatagatcactccacaaatatgcaagttaaaattcaacttctacatgttgaaaaaaaaatagaaaacactatggctagttaacgtgttttcacagtcaaatttgtttttttcgttacaacttgtgaaagttaaatttgaccctacatatttgtggagtgatttatcacatattaatctatcttattaatttttttttaatttttttataatcatttagatgacatgtaaataataagggatatcgccttgagaatttataatagtttcccgggagattgatcagggtgtacattgcttgctcattgggcaaaaccctgtttgaaatttgagaaagagatagagagatgatcacaagggtttgactttgaccagggatagaggaaggcgcaacgctgggagcaaatgaaaattgaccattgaccggccgatcggtatgacgagagattagcccgttccttctgcacagagacaaaaacatcactggagccacaccagcacatgttctaaccttcaggattccaattttttaatgtggaggtaatagccattcgcctgcaggtaatcacttttttttttctgtgcaagcttctgttatatgagtatgttttcgccgggtgttttatgagtatgtttgctttttttttcttttttctctctcattgtttttttagaaccaacagtaccagtgttgaaattgatcttgtttatttcgtttgggagaaacctgttagctgtgtttgagacatctgaattttgtgtactctgaaattgatatatgccttgacatttactattttatttcccattgacagattatacagtgacatgccgagcaacaaaccggcctactatttttcttctttccggatggagtcacgatcgctgttgcacggacattttgtctatgacgcggtaagagggagggaaaaaaaacagtacatattatggacgtttgcgttgcagccttgcagttgcgggttagcccgttccttctgcacagagacaaaaacatcactggagccacaccagcacatgttctaaccttcaggattccaattttttaatgtggaggtaatagccattcgcctgcaggtaatcacttttttttttctgtgcaagcttctgttatatgagtatgttttcgccgggtgttttatgagtatgtttgctttttttttcttttttctctctcattgtttttttagaaccaacagtaccagtgttgaaattgatcttgtttatttcgtttgggagaaacctgttagctgtgtttgagacatctgaattttgtgtactctga

SEQ ID NO: 5079 - DNA, 1501 bp, Oryza sativa
tttggatttcaagatgagagccctgacagttttgtaatgtgggtgcttaggtgctaaataagagaaattgattatgatatctgttgtattgtaggtatatcctttcttaagtgtcagtgcagcacatgatattggggagactgtccgtcatcaaatacaaaagtcacacaatcaagttgctgaggttttcatacacataggtagcctgcaacctttaaaccagaatgctctctaaccatttggctactgtacgcattgagttctttgcatgtactaattggtatctctagctttttttttaatatcgcaaacccgtatatacatactgcctactggaatgcatttcattatgtgaaacaagctattattatatgttttgggcagctaccttgattgtgcattatcttattttagtccaatctatggtttgcgggactgctactagtatgcatacttgttcaaaaaaaaaagtgtataaatacatcttttactcatagtactacgattatgtaaaactgttagacacagagaatttagtgttgcaggcttgaaattttagagttctaactcttgtggctttctgaaaagctgttagacacatgcagtttgtattgcaaacgtacagttctgaagtacatggttgtgcaattaaccacgagacatggttgtgcaatctttctcatggttaattgcacaaccatgccaaaacccacagcaggaatatttatgaagtacatgcattgtagatccttcatattcagtggaatccaacatggaccaaaaagggatttgggagaatatagagagaagaaactcagatgctatcccacgacaacaaacggcagaagccattgtgtcttgtataatttcctcccatttctcaaaggtaaatcttttcacagtccatgacaatgcgaacacctccctcctgcatctactgaaaccatgatttggtgcagaaaatgtcacttgaacacctaatgctgcattacttgcaaggacgagtgttacttcaggtcgaagtttcaatgtctccagaaattatgatccggtaaattagctcttccatttctatcccaaatcttcaccttacaagtttctaaccctgtgttttttttttctccaattgctcgacccaaagggatgcaatggacattgcaaagcaagcggaagaggagatactgaaggctgattccagcataagccaagtaagcgtacagctaagattgggccagcaaattaagcaacttaagctgccaggaggcaaaaatagagcgaagaatcaacaggcacaaatgcagtagcgtcagctacactgtcacggttgattaggctgttttttttttcttttttttttcaaacattattcgatcgacttcgcttgctgctgagtgctgaggcagtagactagttctagcttcgtacagagtgatcttagcctgttcaggcttcagagatactactatggagcagtatatatatatatatatatatatatata

SEQ ID NO: 5080 - DNA, 1501 bp, Oryza sativa
ttttctatcaggtaaagtgcaatttcaaatgaaatacattaccaacaggcatcaaaggaggtcgactctttccaaagtaaaaggatgttactttggcctccttagatgaaaaaatatccttaaaatctttgataagcgaatgctgccccggctgaacactacaccaagtagaggaaaatggcgatgtgcttgatttctcctctggaagttgctcaaatatctaacatcgcattaaggactttcaaaggcaaaatatttaattgtctaatcattgcttatcacttaattgaaaatcttattatgcacaagtgtccagtaaaaatcaaatcctgttggtgctagcctcaaacagagccagtaaggaacccactggataaggcgtaggcaataaaaaggatacataagcatgcctcacaggtgtattgaaaacaacttcatcccctccacataacgtaactttattagtcttgtcaaaagactttccatttacacgaacaactttggactcgtagatttcaagaagagcacctcgctgatacatgaaataaagataagacagggtacataagacgtgaaatgtgtataacacaggaacttctaaaacaccacgttaccttagcatgcttcaatctacaaacaagtgagttggtatatgacccttccagtctcaagttatggtgagctccataaccaacagtaaaatgcgaggcattaataggaatggaaggattctgcacattaagaaagaaatgcagtaaatcaaatgaagagcagagagtgtattatgaatttgctagaagtattacgtagctactaactaatgttggcaaaatatatgcaatagcaaaaataacaatagcgctgtttcataattatacatgcttgcgatagaattgttatgtaattcgttgtgtagtaatacaattcctgcacattgcaatacctattgatggcccaactgaaatagcagtgaaggtttagttagaggaaaaggatttatgactgcaagatacataacacatttaacacttagtggattcataacatatttaacagttagtaacttagtggatacaagcatatttaacaatgtgtctttaatttaggcattcctggagaacactaccaggttcttaatggcataatatacgaattttagttgtttgtgaacattatgttatagaataaattgtatttatatatgaaattaaactgttcgctgataagctccaaaaacatagtacaatttcttattaaagattggaggagcaggactattctgaactaagaagttttacgaaaatgtagtatgcagtaagctgatgagtagaaatgatgttgttgacaagtaacaaaagtgttcatgagtctaatttatcatctaagcataaaaaataaaaaatatattaacaatgagcaaatcgagttcacggttttattgacccaaacaacatcaagaacaaaccgcgcagccagaccttagcatgttgagatattaatc

SEQ ID NO: 5081 - DNA, 1501 bp, Oryza sativa
caacatcccgcaggcccccctgcccaccgcctccttctccctcctctccgtcctccccttttctccccccctccgctccccaaaacctaaccataatctccacgcctccctccccgccgccgcccgccgttgcgggggctcgactccaccctccgccgcggtccctcccgggggacctcgcgtgcgcccgcggccgccggctcctcctggttctccctcttcctgcttgcgtctctgcgcgcgtgggggcgggggcacggtagggtttcgggatggacccgcggcgccctccgtcgcgcgggggcgccgccgccaacggcggcgggctctcctactccaccctcttcaacctcgaggtactgcctgctctctctctctctccctctctgtatgtgcgtgcttcggtggatggtggttttgacgcgcgcggtagtgccggtgttggagtggggggcgcgttgtgattggggtgggtattggtagtgctcattgtcgctgggttttggagaattctctccgggcgctgtatcatcacttggttgtttttttaagcctcagttcgatcgaggttttagttgtgtctcgcgggattgggagctcgttagttgtgggctaatgcaggttactttgcatcggtgttgcgatcgtctgtagaagccgatgccccgtgctactgttctgttggttaggactcaaataagtgtgtgccacataagtgttatgctgtttagcagtatctagttgtttcctgagactggttcagtagtttgctagatcttcatgtagacttgggctactttagtggcttccaccgatcaaagtttcgtgtgtttcagatagtgacagagtgatacgagtatcgtgatcatctgttgtgccattcatgtcgctaatcaaatgttgatgccggtaacttggtcgttatattcatgcaacatttccaatatcgcatgcgcgacgatgatgaccttgttttgttgcgattgcatgccatttcttttttctgaatttagttaatgctatgtttcgttcatagatgagtattgtcagttgctggcatcatctgtgtatgttcctgtgttgtctgttgtgattgtggtctgcatggcgtgcaacatgctgctgcactgttatcattgttctggcagttttgttgttttttttatcgctgttcttttattatttttcttgataagtatggtcatgcataataaagttttttttcttgacatgtgtgatccttgcttcgggtttaaatttattttatttgataaggttatgaattgggggcctgcaagggtacattggtttactacgtaatcgcatcttttatcttgtcatcctttgtttttgatactactatagtgttattgttgcttgtctatccgtttggtctatatggatgcaggtctctttatttgtctttggtagggttgaaaattatatatagattttgtcattgtgaagcatatgtcttcccactcatgttaataatatggtt

SEQ ID NO: 5082 - DNA, 1501 bp, Oryza sativa
ggaaaaaagcgaaacaacatatttacaaacgaaaaataatttataaataaaacttttatatatgtgtttttagcgatctaaatgcaaagatgaaaaaaaaacttcgatgaaaaaaatcttaaaataaactataatttaagattgaaaatttcaaaatttggttgtgataaacatgagcgaaaagatgagaccccaaatttttttaattaaattattattataataaataaacgagggccctcaatgttggctggtggctgcaactgcaagctgccagtttgactacaaataccaccgcacaccgctggagggaggggaaccttccagaagctccagattccaaaccagcaggagtcgcctcgcctcctccttcatcctcctcgtcgtcgccgcgggggtcgcctgaggtaggaataccaacaaccccccccccccccccccacccaagcaagcttctagggttttcgaccgcgcctcgcttcctccggtttcgtgggaggcggtgggtctccctccctccctgcgtgtggatctcagatgggatcggtgtttccttgttggtcttgctgcttcgcggggatttggggcttcgggcgggctgggggtggggggggggattgttgtggatgttgattgatcgatcggtgttgttggttcggggcgattggttggttggtggggaggaacggctcgtctcgtgtgtttgaatccatatgcaagttcaagtgatgcgagagtgttttgatgcgtggacctgctgcttccttttttttttttccttttgagcgatgattcgtgctgctgcggagggatacggatttgttagttgccgattactagtaataatcattggaattgtgtactgggctctggctgctcatgatgcgatgggctttgtgatatgttcatgattagatttagacatgttttttctgcaagtgtggagttgattgcagagtgtccttccctgatatgtcgggggattgggtggatgtagagaattgtagatttgggagttattggactagccaacagacagtttcctcgtgaattcgatcccttcatgcagaaatgaatggagggataggatgaaatggggtgagaagaatggatagctaagattgaaacttaccctttagatgggtgggaaatcatatcccaaaccgattttctagggataattcctctatactagacgtgtgttttgtttgtatctagtatgtttgcagtgggcagtggcatttgttctatgatgcctttggtttacatgctttggaaaaaacaatagatcattgggccatattgttatctttttctgactagtagtaaatgatgcgtctgtgttgcttctgctttaacatcttttcaatcttcactaggataatttcatagttcaatatgttctttgggaacttggttgggttttaggacctctagaggctacttctgccacttgctaagtaactgttttgtggaatttgtttacagatcacattaacaa

SEQ ID NO: 5083 - DNA, 1501 bp, Oryza sativa
atgatcatataataatatcttgaaagccggtgaccatgaacgaatatgaggtaccaatatattgggatattttcttgatagaggaatcatatggaaaaacccaatcagtcgctgctttggatgggaatgttatgggtactgacctcagtaatagcccatagctgctgctacaatgatagtaggcaataggtgtagggacgaactgcaataggagtttagaaacacaacaaattataggtacagcaaagttgaaaaaatggtttacataccatgaacaggctagtagaaaccttataaataccatgaattgactcctttaagtatacagaccaaataaatttcaatcttgctagtagaaacataaagaagggacaaaaccaaatccatctgtctgtttttctattctttgataacttcagtggcaagaggaacaaataaatctagcgtccatggaaaaagaaataaaggccataaattgaatgaacatatatgtgattcaagaagaggaggaagcagacctttgggagaagattgtatactcgtgtgatttcttaaaggtgaggggctgctccaggtttcatgggagggagaggccgtttccagtgacggagatgaagtaggaaaccaatcgaagtaatgcgagaagactgttatgctgtggaagacggtttctaatgaaattttactccatgtgcggcgacgattagttttctgtctctccaaataccaaggaggcgagcagtttcgaggaggcggggaggcgcgcgggaggtagggagccggcgcgtcggccgttattcaggtggcgcgggtagatggaaacgctcggcagtgtagtgggaacgggcgaattgggcctaggcagtggattgggcttgcccatgtatattgggctactgttaatggaagggaagctaagtagagactgcaatctaaactgttgctatttcatctaatggctatggtaatttgaggtgacgtgacttaaccacatatattagctttgggtcttaagaaagaaggggcaagtcaggtttgcctcctcaagccctcaagggcgagctacgcgtgagtccatgccaccttcacctggtttgatgctgccatcaattcacatcaccaagctactagtagtaggaggtataggagctcgtaatcaccattgtctcatgaataaaggagggctaaggctgttcttagattaagggtgaaattttttgtcgtgtcatatcggatatacagatacttatttgaagtattaaatgtagtctaataacaaaacaaattacagattccgcctgtaaactgcgagacgaatttattaagcctaattaattcgtcattagtaaatgtttactgtagcatcatattatcaaatcatgtagtaattaggcttaaaagattcatctcgcaatttacacgcaatctgtttaattagttttttttttctatatttaatacttcatgtatatgtccaaacattagaatgtgacagggtgaa

SEQ ID NO: 5084 - DNA, 1501 bp, Oryza sativa
ggagtaaaaataaatatgaagtgagaatttttttttgtaggaccattcaaataggcatatggaggatagaatatagatgagctgctagggatgctcttatgaccatggaattttataggaattttaaaggattgaaatcctataaaataatatagttctgtgaagctcgttggactacaagaatatgtttcaaaatttctcccattcatccactttttgaagtatttcagacatttgatcaaagactagtagcagcatggttttcattgggctactgcttccttctcgaaaagaacgagtggacaggataagcatgacccgaaaaaaaacagactaaaagaaaaataaaaaaaatgaatgcatacggatacgtgtgtagatgatctaatacaagatttgtcctaaaatataactacttctccaccaacatttttttcccaaccaatcacaactctccacctacctccactactcaatcaatcacaaccctccaccatttacttctaactactttcttaataaccgtatccaactcttaaaatgcttatattttgggacggatggagtagctatctattgtatatatactactcttactagttaacttaaatgcttgatgtggatattattggagctaatagcaaagctatgttattggaattgctctgatatattttgtctattttaatcgtctgaatcaaaattcctatgattctcatatgcagtagctaaacatgtcttttaccaaattttcctataggcttcgaccaatacgatactttatttctgtatttcctattgctgtatttcgaaggagtcgaagcttgcaggagaaaaatttccgtgaaataatctaattaagagaaggccctcgtgccgctcagccccagggcggcacgggcggcgaccagacgagcgcgccgccgccaacctcttcctcttctcccctccaccttgccgccgctcgagcgcccgccggcaaagccggggggacgcaatgacagcggcggcgaggctccctacctcctctcgcaggcgcggcggctggggcgatgccatgaccggagagaggtctcgcgggtgcagcggtcgccggcggccagatccggcgtcggtaggaccggatccggtccccacacggctggatcgggcgtctcagccggtggcgacaggaaggaggcgcacgctcaacgaggagcgcggaagaggcggcggaagtggcgacgtgcgaggaggacgacgttcgcgcgcaggccggtgacgctcccgtcaccggcggcccaggttcccgtccagatccgggccgggcgaggcgctgggaggtggcggctagcggcgggggagaggttaacgtcggggctggagagggtgcgaagaccggtggcaggcaggggtggcttcgcggtgggcagcagcggcttgcgccgaggtcgcggtgttgacgggaggtcagcaacggggctggagacgacgcggagatggtggcaggcaggggcggcgt

SEQ ID NO: 5085 - DNA, 1501 bp, Oryza sativa
tggaggggaaaaacatcgctctagcagaggctccatcagatgcgccaaaattggcggatcgccaaacacggagagagaagtgccaaatttggcgcttctcctcacgccatccccaaacgcccgctctcatccggttctcctgcccccatttggatcgagcatgaagggtgaaggaagagagaagagaggacgtaccggtggctaccttcgccgtttgaccgccgtcggccaacggaggggaggggagcggaggggatcgttcgaccgccgtcggccaacggaggggaggggagcggaggggaggagacctggatctagccgcccgtgccgccgtccccgccgctcgcctgacaccgccgcccgctcgccgccgcctgcctcctccgcggctcctccgcccgcctccggtcgtttgccgccgccccttgcccgcctgccagcttgtcggtggacgcgcagtgccccgccacctggtgctccggcgcaagcaggtcggaggccatggcggcggcggtgggtggtggaggtgaaggggattcggcgagagaggagaagagttgagaaatgagtagaagagagaagagaagagttaatataaaatagatggcagttgaaagataatagtaaaatataggatagatgatgtaatatgaatgatctgttggagtaaaaataaatatgaagtgagaatttttttttgtaggaccattcaaataggcatatggaggatagaatatagatgagctgctagggatgctcttatgaccatggaattttataggaattttaaaggattgaaatcctataaaataatatagttctgtgaagctcgttggactacaagaatatgtttcaaaatttctcccattcatccactttttgaagtatttcagacatttgatcaaagactagtagcagcatggttttcattgggctactgcttccttctcgaaaagaacgagtggacaggataagcatgacccgaaaaaaaacagactaaaagaaaaataaaaaaaatgaatgcatacggatacgtgtgtagatgatctaatacaagatttgtcctaaaatataactacttctccaccaacatttttttcccaaccaatcacaactctccacctacctccactactcaatcaatcacaaccctccaccatttacttctaactactttcttaataaccgtatccaactcttaaaatgcttatattttgggacggatggagtagctatctattgtatatatactactcttactagttaacttaaatgcttgatgtggatattattggagctaatagcaaagctatgttattggaattgctctgatatattttgtctattttaatcgtctgaatcaaaattcctatgattctcatatgcagtagctaaacatgtcttttaccaaattttcctataggcttcgaccaatacgatactttatttctgtatttcctattgctgtatttcgaaggagtcgaagcttgcaggagaaaaa

SEQ ID NO: 5086 - DNA, 1501 bp, Oryza sativa
ccgttgccgactccatcattattgatttgagccgtgtttttcaatgctattttgtttacgatcccacgcgtgctaattacatcgtgcttatactataattatatatgtaatttttcagacttacatcataaatgcactaaaattatatatataatttacgaacttacaatataaatacatatcgactgtttttttaaatattatgacgttataaatataattactctcttaatttaaacagatgagatgatatttgagctttaatgggtcacggatgattggtggcctgtttaatagtgggttggtcatacaggtttcgacctgttttttacttttcgtaatggtttgtatagactttttgataaaaaatataagaacggttacgaaagagaactcaaaacccacagatagaacataaaagtactctagttacgaacataaccagaagtttaggagatttgtaatgtgaagtgaaagaggcagattagagtgagtgcaagaggaattcgaagggtagacagggatatgttcacggagtcaaggaagaaaggagatggagggtctgagcaccgaaaagagttgaggatattgaattgaaaaaactcaccaggtcaaactcgcagggatgatatagcagaaagaatgctcgttggagtctcgcggtggcagaggttcaccgacgtctgtagtagtggtggtagagccaccagggtagatgagcagctggagataggtaagcaagcgggtcgacatgtgaatctacttatatattaaatcttggcttccttattatggtctagcttaccgtatcttaccgtatcgaaagatataagtgggtcgtcccataaacatatttaggtcaaattaataggttacccgcgtgagttgcccactattttaacatataaacgggttcgcggacttgcatccataactggagagactcgcgcgcccggcggtggtcgtagccggtgtcgcctctcagctccattctaattctaaagttccctcctgcgaggaagaagcccatgcgggccccgcaaaccagagtcccactcccacgacctaaaatgaaaaaaaatccatccaacggcccacgatctccaccaggccgaaccaacggtgagatgggccaccaagtctcgcccgctccctcgtataaaaactccccccaagcccaagccctaaaaccctctcgccgccggcaccccctctcccgccgcatcccacaacacctcgctctaaaccctcgcggcggcggcggcggcggcggcgcctactccccctccccaccatctcgccgcagccggaccttcgcctcgcgctctcctccccccatcgtcgattcgcgtccaatcgagccaaggtttgcgccattttcttttcttgagggtgtatatatcctagctgctcggtttgacccaagctttcgatcttgtggtttttttttttgatttgggtttgtgatccaggtgtaggtgttctcgtgcggtgagagaga

SEQ ID NO: 5087 - DNA, 1501 bp, Oryza sativa
cttgaaaaaaaaaaagaaatcctcatttcttgtgctttaatctcactcacacttggaaagtgaggggcaggtacagtcaagtgtcctgcactccatgcctaattagcacaaagatggaagcaatcaatcatgaggagtactagtactacttgggttaagcttgagcaatgatgcttcccttggctatagtggcatcatccctgccctgacaatgacattgggacagagtgtcatgccaaaataattgataatttggtttcttcttttccacaagtgtggtctattagtattataattcgcctctcatgcaaagttaaccagtactgtaggagtaaaatatagagtaagtaataacttttaaaacgaaattattataaatataaaaccctattatttatataatatgattttattcagtaaattgtccattctggttgtaccatctatgtgttctatatatagtcttagctagttcatttgtatatctacttattttcttaatatttactccatattaaagccaacccttattatagtttgaaacgagtggattagtactagtcagctgtacttatacacacatttattagttaattaattgtgctacaatgaatgtgtggatggatagatggatgtgtgcatggagggagggagggagagttgtgagatgcccatctttttcagccactcagcaaggaaggaagagggagggaggaaccctaatcctacctgctctcaagctccatctccattccattcccttttttgtgtagtagcaatcataggtagtactagtatactggcattccccaaccattccttcctacaccaccaccacctatcaatcacccattcaccacctaaaaattcccaaggcacctgctcctcctcctcctccctcctcacctccgcctttcgtttcttggaatctttgcctctgccttcttcttgttcttgctccctccgcctcctccttccagccaagaatccattgcagaattttcgtgctcaatttcggataaatgttgggtgttctgtttggtgggttgagagcttgaattcgagccgttttcttgcttcttcgagctggtggtggttttcttggcccttggattgattctgggattcagcggcggagacacctacctccgcgtgaggatttctgccatttcttgcttgctgcgtcgagggatttggtccccgccctgcttgcttccagctcagttcggtgccttgttggtgttcatcgatggattccggcatgggcggcgacgccatggagacattacggtgaaattagctcggcccgtctctcggtcagtacggtgaaattcctccccctgttcttgcgattcttggcgttccgtttggtggaagatttgatggaaatggtggtggtaaatttcgtgaccgggtttttcttggcgcggttgcagcctgcagatttgagagattggaggagaggtgtggattaggagggggaatcgagcgaggaggaaga

SEQ ID NO: 5088 - DNA, 1501 bp, Oryza sativa
ataattattgatgttgtttctttcctccggctgtttgtttagggtatatttagatccttggtaatttttttcaccctgtcacattctaatgtttggacatatacatgaagtattaaatatagaaaaaaaaaactaattaaacagattgcgtgtaaattgcgagatgaatcttttaagcctaattactacatgatttgataatatgatgctacagtaaacatttactaatgacgaattaattaggcttaataaattcgtctcgcagtttacaggcggaatctgtaatttgttttgttattagactacatttaatacttcaaataagtatctgtatatccgatatgacacgacaaaaaatttcacccttaatctaagaacagccttagccctcctttattcatgagacaatggtgattacgagctcctatacctcctactactagtagcttggtgatgtgaattgatggcagcatcaaaccaggtgaaggtggcatggactcacgcgtagctcgcccttgagggcttgaggaggcaaacctgacttgccccttctttcttaagacccaaagctaatatatgtggttaagtcacgtcacctcaaattaccatagccattagatgaaatagcaacagtttagattgcagtctctacttagcttcccttccattaacagtagcccaatatacatgggcaagcccaatccactgcctaggcccaattcgcccgttcccactacactgccgagcgtttccatctacccgcgccacctgaataacggccgacgcgccggctccctacctcccgcgcgcctccccgcctcctcgaaactgctcgcctccttggtatttggagagacagaaaactaatcgtcgccgcacatggagtaaaatttcattagaaaccgtcttccacagcataacagtcttctcgcattacttcgattggtttcctacttcatctccgtcactggaaacggcctctccctcccatgaaacctggagcagcccctcacctttaagaaatcacacgagtatacaatcttctcccaaaggtctgcttcctcctcttcttgaatcacatatatgttcattcaatttatggcctttatttctttttccatggacgctagatttatttgttcctcttgccactgaagttatcaaagaatagaaaaacagacagatggatttggttttgtcccttctttatgtttctactagcaagattgaaatttatttggtctgtatacttaaaggagtcaattcatggtatttataaggtttctactagcctgttcatggtatgtaaaccattttttcaactttgctgtacctataatttgttgtgtttctaaactcctattgcagttcgtccctacacctattgcctactatcattgtagcagcagctatgggctattactgaggtcagtacccataacattcccatccaaagcagcgactgattgggtttttccatatgattcctctatcaagaaaa

SEQ ID NO: 5089 - DNA, 1501 bp, Oryza sativa
ataaccctccatcattcaaatttcctaactgatagtatcttcaattctcaaccaatcacaatattccaccatttaattcaacatatttttttaataatcatgtttaactctaaaactctttatatgtttggacagatgtagtagttagcaaggtaaaatattactgttcaaggatggattaacattaacagtctgtttataggagtaaattttaggcatagttaagttcactcattaccctcatgtaaaaacactattactgccctgttctaaactctattttggagttgtagtttaacaacacgaaaaaacatgatggcttattatcgtataattaattaagtattaattattataaatttaaaaaatcagatttttttttatttataaaacctttatatgcatattttttgaaaaaaaaaatatcatctaacatcttgaaaaatatgctaacgtaaaacaaagaaattgcagtttggagttaaaagaaaagagtaaatttcactttggtcaacctttatttaccaaattttcacattggactagagttagacttatattttcacttaacaccatatatagttaccattatttgcacttcgtaccgggtttcacaaattacacatagtataatgattgtagatctgatcttatttcttttgtgttagaaaacttagaattcaacaatttgtactaacactacagttgggtattgtaaaacatgtaatatcttttctagaaaaatagttcttaaactcaatatttctccaattttgtccctagtataagggttgtgaatattcatatgtagtagtaatgaagtcccattaatttgataggatatcatataacatgttacaattattgttcttgcgctaagcatatttgcatggcagagatttctatatcattgtttcttgtaaaatgctaagcacctagacaacaactcgtgtgatggtaactataaaaccaggtctaaagtgcaaacaatggtaattatacgtggtgttaagtggaaacatgagtctagccatagcttaatgtgaaattttagtcaataaagatggtccaaagtgaaatttacttgaaagaaaataacgtaggctataggtcagtattttgtggcctttcgcgattaatttggttgagacttcttcttaatggcaagccattcaggtcagcaggtgtgatctttccctgcaagttgagtttttttttaacatcacaagtaaagcattcagccaaattcaaacagtcgtcgcttgtcaaatttaaacaaggtcaacttttcgtgtcattatcacgtaatttgcacagaattcgaagcctagtagtctccagaatctctgtgctgcctgtatataatgcccctggtcagctgctacggccactctccagtctccacacctgccggcgaccaccgcgcgcatcgcaaggcacagagggcctccgttgccgacgtccgccatggcacggcgcgcgccgccgttcgtcctcctcg

SEQ ID NO: 5090 - DNA, 1501 bp, Oryza sativa
ttttttttatcattatcaaaacaaatgcatatcaaagtttaaagagtttatacatggcttcccccaacatgtccatgtttttctttataaattgttcgatgatcttcttactttttcttttccttaatttgataggacaccaattcatcagttttaaaatatatatatgtatatcaaagtttaaagagtttataaattggttttcaacttgttttttttaaataatttgtttgatgatcctcctacctctccttttctttaattttaaagaattaattttaaagaatttataaattgattcccaacttttgtttatgatttgttcaataatcttcctaattatcctttcccttaatttataaaaatattgtttgcttctaccatgtatttctactaatataaatactaaatcaataatgttaatataaatgctaaatcaattatgtgagtgaattagcatcacgatatggttaagtttttgttcccattaccatagatgcattgttcttcaccctgcatttgtagaccaattatttttcatactttcagcacgttttcagactgaagcaattcaataagcagtagaaagaagttgcacaagggcacgttgatttactaaaccaatattatgatccaatagtattgaattgtgtgtaatctgatctcagaaggatgggtgatgtgatgcatgtggcctcaacctcaagtgcagaagtggttgcctgctacctgaagaaatcccacaaaggaaagcatataatcccatcggagaactgcaaatgagtaaacattgcattaatctaatcttttggacatcttgctaacaagtaggagtagtaattaacaaccattttaaagttgaaagataataaaagtgatatatgtagcaatcagtactaatatgtaaatttgacaacctcatctaaggcactattacacctcaccagctcacctaatcaagtgctagcacactttgcagcctgcacaaggatgagccaaaaatagactgaaggaagattttgtggtgcaatccctggctaccaatttccatttttcagtcccccagcatctgtgctgaaaatgattcatctgcaaactacccttgacttgaaatggcttgcgttccagctccaacaagtaacaatccaccttcatctatacaaccaaacagctcatcttgccatgtcacaatcctatctcttgcagtcgcaggccgatcaattaaaacttcgcgaaagatcaatcagagccgcccaagaacgttagctaaatcgcttgcgtctctgaaaagataattcagtgccatgtgctgctgctgtttcactataaattcacaggaagctgatgtgcagaagaacactacccatgaactgatgaacaacctgcagtcagagatggcgtcgccgcgaatctgctgttcggcgctgctcgtgctgctcctggtttcctcgtgcaatgcaggtgaccacccggcctgcccggcggcgtggtcggcggcggt

SEQ ID NO: 5091 - DNA, 1501 bp, Oryza sativa
gtgtaattacactgtaactgcatgggaggacactgtgactacaatgaaactggacgtcgctgccgctggacttcgagatacagcttatcgaagccaaatagcgggcgtgggaacaaatccttttacatatgtgtgtgctgagatttttttcttcttcaccaaaacaaattttgtaatagatctaacgattcaaaattacgtaaaacttaaatacaagttacaccttagttacatgcaagttacagtgtaattacatacgagttacagtgtaattacactatgattgtattataattatatatgtcaaatttttagtagaaaatttgtcgacaaatgtataggtagtcccgttcatttttagatacactccaattaatccattccattccaccgtttctcggatcaacgagaatttagcttgactccccaattcttaaaatcgaagagaatacaagagtcgagagcctaccaaacttctcgtggtatcaatatgacaaatggcgggggaggaggaagatataccatcaacttcagttaatagtgttgaaaaattatgagaccagatcgaggaagataagtccgtgagcacaatcttatcaagtgaatatatgtggaagatgaataccagatgcatgtcaaaccccctatctctgtccgcgtttctcctagaactcgtcttcgatgaaactaccacacattttcgtatacatggtaacaaaaatatccatgacctaaggctctgcttgacaaagctatcaaatttcatgcgtcttttcacgtcacatggaacatttccatgtgtgttttcccctaaagaaaaacagtaataatattaatattagtatcacacggaaaactcaattcaactcttaaggggatatccccttattttcatgtcacttaaaaagttacaaattttttttaaaaaaattagtagaatagactaatataagatatgtcacttcacaaacataaacatgtaaattcaaattcaacttatacaagtagaaacaaaaataacaaatttgactaaacgcgtaattcacggtcaaatttgctatttttgtttcgaacagtataagtctaattttaactcgcatgtttgcgaaaagatatatcatatattgatctatcttaatagttttttttataactttttaaacgagatgtacaaaacaagggagaaaaaaaatccacttccgtatcacactgttactgtcacagtgctccgcggtagactattcccccacacgcagccgccacagtctcccccgtccttaacaaccaccgccgctacagttgcaaaagaggagaagggcgggcgggggctgggccccacgtgtcagcgacacacgcagccgcaccgccaccgagtataagtacgagccccaccccgacgcggcctctccctccctccccccaacgccaccgaagaaaggctctcaccaatccaacggtgctcgatccatccatccatccaatccgcctcgctccatccatg

SEQ ID NO: 5092 - DNA, 1501 bp, Oryza sativa
gctgtcccgtgtgctagctagctgctcgatcggtcgtagtacgtgtacactcctcctcgactgtaaccaacaaattaaacacccctttaatttctatacggttgcattgtatacgtacgacgacacgcatgtcacgatccaggtccagtacttggtggtacacccttcataaattcagacccacacacacgaaaaataaaaactgaaacagagggagaggcgtgccgttctctctcgcccggccgctacagagagaaaactaaacaaaactccaatatgtaaatatatttcgatatttacgtataaatactaatacgtgctaatcatagtcgcaaccaagccaattagctgccgtctccgtcgacgctgaaagcgatcaggaaaaaagcgcaagttgaatgcgagaacggatgcatcagctaattaagctcggatatatatatatatagctgagagctgacgatgagtgtgtgacactcctaccataccacggctaaaccacaactaatgaacaccttgtactatattagtatctcggtctgcattattatgctgaccccattgttctgatcgaatcatgcagtgcagggcgcgcgtttgctccgcaaacataaacgaagacggaatcatcaacagacgacgatgaaacggacagtttatccgatcaaattcatcaagataatgcttcatattcgcagctgatttgcgactgctagaacaaattaaaccccagattttgtttgaagagcttctagcaactacaattttcttaataataaaaaagaaactagatctcttaactggtgtacctttttcatttagattttaagaaaacataactgtagaatctagaaaataaactgaaaacgttttctagctttttcggattttcaaaattggctgcttatcagaatttagggctcactgaacatgcccctgttctgcttctgctccaatgctgatcgctcgttctctcgctcgatgaggggggcaagcagaatgcaagttgagcaaactgcgtgtctctctgtgccaagaactcgaaaacgccatccgggtcaaggctgaccacggaaaccgggtctctcacgtacagccacgggtggcgcagctgcgcatgcaaaatttcgatagatttcagctttagctatagctattagctgacgaatgtgacggcaatggccagcagaaaggggcaaaaggacgcctatcaagttctcgattatgcatatccagcatctatccatatcttgcactggcaagtaacagcgcctgcgtactatagtacagagacggtgtacagtgtagtagagtcgtcggtagctagagccttatcgacatctcaggacccaagagaaaaagggagttatagtagctaggaggagtagaggaagaacaagaaaaagaaaagaaaaaaggaaaagaaaactatggctgttcttttctccttaatttttttttgagaaacacagtaaaaacgcagacgctcacaacgtgtgta

SEQ ID NO: 5093 - DNA, 1501 bp, Oryza sativa
aagcagtttaaccataggttttgctgaaagtcgtcggtgtcgtctgacaccgacgctaacacaaccgcccctggctgtttacatatatatattatcactctttcaatctcacatattattgttttttttaaaaaaaacatctcacatattattaagaggaaggctaaatgcagacctactcaaagttgaatctccatcaatgtaaaaaggaaaagtcaaccatagaaacaaaggtcaaagcacctgatcactcgttcatctcgttttagcaacaacatctgctctcaagctaagaaattgccatgataattaaatagggagaagaaaatatatacctttaattaatcaactggtgtagctagctagattaattggtttgttatagatgttcaatatattcacttagaaacaacaattgaatgtatagaaaaacaaacaagagttatccatcaaatataagactactttcaaacaaattttgagctagctccccaatttgcgtgccaagtttggatagttaagagttttttaatgctgaaattaccgcctacatgaaattttagctagctaggggtttgaaactaacatttgtttgcaatccaaattcaatatctgaggaacaaattaaacgtcgagactctgccatgtacatagtttggttcaaaccctcataatttttttctgagtgatcaagaatgtatgtattgaatcgatctatgcatgccaagctgtcaccaagctatacatacatatagctacatatgcatatatattatcatcatgcttccattattgggacttccatcgacacatgtagagggtgaatttccatgtgtcagtcgaagtgccctagcctaatgtaacatgtcatgaacggatgaccgacacataggccagtcaaaggcatgaacagtagagagggtccaggggagattaggccggggatcaatgcaagcaaaagtgagtgcgcccggccacacgtatgcattcactggcaaagctcgatcaaacaagcaaatggaactcgatcatctctccggcctctttaatttagctagctaatcttgagttgatccggcgatcgagcgagctactaataatataaatgttgggctctcctttcttggccctataaataccagggacgatgcccaggaagagcaacctgtgtcagttcaggtggtagtagcaaacacacacacagctagctagagggttgatctcctaaattgctcttggattaatactggtgtgtagagcaggagaggagatcatcctctgatcaaactctaattaagctagcatctcatatcctccaagatggttcaggcattggtctttgctgtggggatcgtaggtaacacacatgcacacactagctaattcgagattacacacttctataacaactaaccacatctagcatgcagtagtattagtggtttccacaacaagtatagtatgcatccatgcatgcatgcattatacttcaatttgccac

SEQ ID NO: 5094 - DNA, 1501 bp, Oryza sativa
gttttcattcctcattcttaaaattgtgcctaataagtataagtacgatcgttgcttctaacaaagaatggacaaagatcaatgtatatctttttatcatatagtccaaacaaatttctttatgttttgtattatcaggtcattcgctatatatgtgagccctatatgacagtgggtataggtgaaccaccactgtggtgtcttttatgcatgaagtgcgcatgtgttttaaaaatgtggtgccatgtctcatctagctaacaagcgttttttttcttttgaacattacaagcgttatgatctatgcagtggcggatctagaaagagatagcaggagggtctgaataaagtagctaaaagctacagccctcattctcaactacatatatcaaaaaattttagcggggactttatgggggcttcatagtactcgcgccagtactgggggctcgatcgagaccccaccgtccccacgttggatcacccctggatctgtgtatctgactgatactagctaagggtagattatattaattctcttctttcttttctcttttcccctaccataacgcaataacaaaaaggataaggcctatatatagaaatagagtactccctccgttccaaaataagcacagccatgagtttccgtgtccaactttaatcgtccgtattatttatttttttaaaaaaactaaaaaacataagtgacgcatcaagtactattcatattttataatctaacagcaataaaaatattaatcataaaaaattcaataagatcgacaatcaaaattggacactaaaactcatggctgcgtttattttgggacagatggagtaactccaatgactaagctgagttcattccagctagttcccaacacgaaacagtgcacatagaaaacaggacggtccattatattagcacgtgattaattaagcattagctaattttttaaaaaatatatatatcaatatgattttttaagcaactttcgtttataaacttttgtaaaaaaaaaataaaccgtttagtagtttgaaaagcatgcatgcggaaaacgagagggggagttgggaacgcctgatatcgaaacacagcctaaagctactataaccttcccaaccaggatgaggcataagcttacactgattacacctctaaatttagaattcgatgataatccatgcaactacttctattattttagtccaaaatgcaagtaataagcttggtacgttctgcataaatttagaacgatcaaaaaaaaagataagtatagatattgtattctgtttaggcttaattaattgattcagaaaataaaatagtgaaataacaaaaattgcagcacattacaatgatacacatgcatatcttaattaacgtccacgaactgacctttcactttgtggcagccatggcccatgagccgctgtccagtttctatataaggcgtttgaactgtttttaacaatgtgtgtgtgcagcagagtt

SEQ ID NO: 5095 - DNA, 1501 bp, Oryza sativa
taacacaataggtatcaccatgtataagcgtgtaacattccaatcccaggtaatcttaatgtattgcttgaggagcgattgaggttgtattttacatgttactagttgagaatcttttagaattagtaataaatgctccctctgtttcatattactagtataatgcccatgcgttgcaatgatttttttctaattgtctaatatattatcattgtgctaattttactgccatttcacagagatggaaaatttcacaatattctatcgttacattttcctttcgacggggtctatggtatgtagggctgtcaaaaaagctctaggctcgcgagctgctcgagctcggctcgagctccagacgagccgagcccgagcctctccctaagctcgcgagctttgtcgagccgagctcgagcttccaacgagcctagttatatatgatttttgttgttatttaataaattaggagatcaaatatgttttgtatgtcttatattgacatcatatatttattttattcttttttactcttctactaatatgatgaactagaaattgattatttttttaaagattatctttgaaatatatattgtcttacttaaaaatcaagctcggtagtcgagctcgagccgagcctgtcagaaagctcgaacattttataggctcggctcgagcttgtatcgagctcgagcctaggcagacgagctcgctcgagctcggctcgttgacagccctaatggtatgtgggagctaggaaacaagaaaagtttttatctcacggttcatgagtcccgcatggtagttgggtgatggtaatgacaaagtcaccactaccaccactaccatcttttatattagtacagataaatcgctttgattttttttagtcaaatttcttgaaagtttgaccaagtttatagaaaaatagagcaacacttatagtaccaaattagtttcattacatctaacattgaacatattttgatagtttatttgttttgtgttgaaaatattattatatttttctatcaacttgatcaaatataaagaagtttgacttaaaaaaagtcaaaacgacttataatatgaaacggaggtagtaccaacctatgataggtgatgttgagcgctatgcactactttgatttgtgctggactatggatgattatagtcattctcaacctctcatgtttcggctaactcgcggaacgctatgttgctattgctatggactacggcatcagcatctcatgtttcggctaactctttcgcaggaaaatcacgggaaacccctcccccccaatcacctgcgcgggcgaggccatgagcttggcgttctggaagatctcgaggaacggcaggtggtcgtcgccgcggcgcccgccacctgccgccgcagcctggagctcctccggcgaggcggcggcgagggtggacaggaacgggtcggccctcgggttgaagagcgggttcgggctcccccccgacgccgcccgc

SEQ ID NO: 5096 - DNA, 1501 bp, Oryza sativa
tttcaactacaaagttgcaggtcacgtcgagggttacaattttgatacaaagtttgtcttcattagagttcacataaaaaagttatgaattattttttgatataaagtttttagaccgtcttgtttagggaccagggtgacacaactgaacaagttggaggacctaaacgagtcatctacaagtttagggaccgggatgatacaggcgaacaagcttgaggacctgaacggtcgatttgcaagtttagggaccgggatgacacagcggtataagtttagggaccggtgatggactttactcttatgagttcatgataacctcactcagtgtaattattcacgtactcgatcggtttggcaaataacttttcttttaatttatttacaaagtgataatatttttgtcaaaaaaaatcatatttttatcccaactaaattagcagggggtaattgttagatacacgatagttagatatacatataacatattctgtcaaaaagaaagtgtgtacatctatacaaaagaacttgcgtttctcgttgccaatgcctcaccaccaaattaaacacacatccatgacaatatgacatatgtcgaggatgaatcgaattcctcactcatttaagttgcacagtatgaggcccatcgatcgagatgcgaattttatatgaaggcccataagtcaatggcgatgacgcccgatgatcatcgggtgggcctctttgatcgtgtaaaccttcagtttctgggcttacctcttgattcctttttgttgggctctgtctgaaactctgaatggatctggccttttcccagctttacacagtacattgaattagaaaaagtacaccgaaggtccctcaacttgtcatcaagttacaaaatcgtcccctaaccgcaaaaccagatatccggtgtcccttaactaatcaaaaccggtcacagcagatccttcggtggctttgacctcgattttatcctacatatcggctgagttagcgtgggacccacatgggccccacatgtcagtgtggccacgtcagcatcctctctctttccctcttctctcccttcctcatatctcactcacttctctgcggcacgacggcatggtgtaggacggcagctcgttcagcggtgcgacgaccctggcgcgggggcagagcggccgtgcaacggcgctgtctggcgaaggatggccgcgtcagcgcagtcgtgcgaatcctgggcggcggtttcggcgtgggctgcccggcagcagccatgtgccgtggcagcgcggcgcggcggccggcgacgcgggggcagcggcaaggacggatgagaatccgaggatacggaggcagcggtgaggagggatggggatccagggacgtaggggcggagaggtagccgtcgagctcggccccggccgagctttgccgccgccaccgctcgctgggcttggtcaagggaggggccggtgagcccgttcggacagtgaggagaaagccatgccca

SEQ ID NO: 5097 - DNA, 1501 bp, Oryza sativa
tagtttattgctttggtatttattttttttggatttcaagatgagagccctgacagttttgtaatgtgggtgcttaggtgctaaataagagaaattgattatgatatctgttgtattgtaggtatatcctttcttaagtgtcagtgcagcacatgatattggggagactgtccgtcatcaaatacaaaagtcacacaatcaagttgctgaggttttcatacacataggtagcctgcaacctttaaaccagaatgctctctaaccatttggctactgtacgcattgagttctttgcatgtactaattggtatctctagctttttttttaatatcgcaaacccgtatatacatactgcctactggaatgcatttcattatgtgaaacaagctattattatatgttttgggcagctaccttgattgtgcattatcttattttagtccaatctatggtttgcgggactgctactagtatgcatacttgttcaaaaaaaaaagtgtataaatacatcttttactcatagtactacgattatgtaaaactgttagacacagagaatttagtgttgcaggcttgaaattttagagttctaactcttgtggctttctgaaaagctgttagacacatgcagtttgtattgcaaacgtacagttctgaagtacatggttgtgcaattaaccacgagacatggttgtgcaatctttctcatggttaattgcacaaccatgccaaaacccacagcaggaatatttatgaagtacatgcattgtagatccttcatattcagtggaatccaacatggaccaaaaagggatttgggagaatatagagagaagaaactcagatgctatcccacgacaacaaacggcagaagccattgtgtcttgtataatttcctcccatttctcaaaggtaaatcttttcacagtccatgacaatgcgaacacctccctcctgcatctactgaaaccatgatttggtgcagaaaatgtcacttgaacacctaatgctgcattacttgcaaggacgagtgttacttcaggtcgaagtttcaatgtctccagaaattatgatccggtaaattagctcttccatttctatcccaaatcttcaccttacaagtttctaaccctgtgttttttttttctccaattgctcgacccaaagggatgcaatggacattgcaaagcaagcggaagaggagatactgaaggctgattccagcataagccaagtaagcgtacagctaagattgggccagcaaattaagcaacttaagctgccaggaggcaaaaatagagcgaagaatcaacaggcacaaatgcagtagcgtcagctacactgtcacggttgattaggctgttttttttttcttttttttttcaaacattattcgatcgacttcgcttgctgctgagtgctgaggcagtagactagttctagcttcgtacagagtgatcttagcctgttcaggcttcagagatactactatggagcagt

SEQ ID NO: 5098 - DNA, 1501 bp, Oryza sativa
ttccacttgattaatcggctcccagagcctttttcattttctcggactcccagagtccagctgcccagcagcacaacaatccgcttccactcgggaagcctagtctatgatgcccgcagacatcccgaatcacacagatttgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttccccagccgacccagggttacctcatgccacatagaaggatcaaatcctcacataaacataggccattttaggcgtgcacaaatcaaactccaaccaccttgatcggtaagtgagcaagcttctcgtccttgccttaccaggaacccggtttgtccgaccccgccccggcgttcccaactattggcatgcgaggtttccctgaaccgtctagttacttagccagggtgtcccattccaccttgtggttgcactttggttatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcgatttggcatgcaaaccgaggccaagcaagttaagtgtgtgattctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttacggaattactggaagtggaacggagtcaatcggatgagcggttgagaagatatgaattttggaagtttaattggagtttctggaataggagaaatggtttatggaattttatagaaataatattctcaagaatattattgacagtcactgacgcgcgggaccaaaggaaatgatttgtggaattttggaataaggaattgatttatgggacaaaggaaaaaggatttattaaatccctggaaaaagaaaaggatggaggga

SEQ ID NO: 5099 - DNA, 1501 bp, Oryza sativa
ccggagatgctcccatccctttgaatcgaaccctcgtcgtctcgtcgtgttttcccctttttgctctccggtgattgccgccgccgcaatccgccatcgtcggcttctctcgcgtcgattcctctcgccgccacgcccccggggatccccttgacctccccctggctgccccaaggccgtcggccttctcctttgtctccgcgccgtgtcgccgcttccgccgccgcataacgccgccgtgcgtgcgccgccggtgaccatcgggtcccgcgtcaccgcgtgcgcgacgcaacaccataccggttcggctaaacccgagcccgcgcacccttcgctctcctcgcgcgcggccacgtcggcatgccggcgagattggccgccgccgccggccgtcgtcgcgcgtcctcttcctgatccgagccgtggaatgagttccccttctcctcctcctgccgccagtgctagccgccccttccggctcgccgccgttcgccggatcccgccgcatgccgtgagccgtcggatcagcctgcccggcctcctctgcctccccatctgacgtgacttccacgtggacgccacctcagtcccgggcccgcttgactgggtcaagtcgcgcccagtcagcctcctctctccgtcttccctcccgtgcgcgctgtccacggcaagccgtgcggctgcacgtgggcccgccgccatccgtccacccggcgcgccacgcctgaaccgcgtgcatccgaaaccctagcgcccacctccgcgtgcaccctccccaccgtgaacccaaccactgccatgtgggtcccgcgcggtggaccgcgcccaccccgacgggccaccttctctccccgcgcgccccttgggccgccctcctcgcggccgtgccggcccattaggctcgcccgagctgcgcaagtccctcgggccgcgccaatgccacccgagacaagtctgattgacatccctccatccttttctttttccagggatttaataaatcctttttcctttgtcccataaatcaattccttattccaaaattccacaaatcatttcctttggtcccgcgcgtcagtgactgtcaataatattcttgagaatattatttctataaaattccataaaccatttctcctattccagaaactccaattaaacttccaaaattcatatcttctcaaccgctcatccgattgactccgttccacttccagtaattccgtaaaattgagatctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgca

SEQ ID NO: 5100 - DNA, 1501 bp, Oryza sativa
aagatggatatggaccaacactgaacatgatcattcagcttatatctttctaatgtttcctcctgaccgattcttcttcacggctaccccattgcggaaccttctgcggcggccagggggagcaactcgagcaggaactttattatcttcatcttcatcatcatcttcgtcatcatagacctcgtactcggcgtagcctttcgtgtagtattgtttgaggatagcatcccgttcctcatgaagatcgtcccgtagcttctcccatctagccttgcgctctccccgggtgttctcgaactctatcaagctgtcaagaacctcgggcggcacccgatcgaggatatccttgctgagcacctccgagagcttgggcagggattcctcgtcgtcgtcgtcggatatgtccgcactgaacgccatgcagttcttgatctgctgttgggtaaagcgcaccatcttcgtcttcctcttctccatcgtcgtcggaggcttgctatcttcgtcgtcggaggttagtagcgccgccgccaaaatccgcttcgcctcactaaattctatcttggagaaatccatcaccccgacgcctgaaattccgtcaccattgaaaccgaaccgaaagagctaagtcatttgtatgataataatgatacaacatcgcatcagatcacaacatctgaatgaaaaaaggtgcggcatctaatcctaagcccacgaaggcaaggccagctgcgcccctgatgaattgttcccctgagtctcctctcgattgaggcccaagacccgattgcgatagagttatcgggttcgggtagatgccggaatatatataggcagcgcaagcgcaactccaacaataactcggtttcggaatcgcttccgcgaatcgtcggacccgtttgttttgtatccgactccgaaccgaataggttccggattcgatgccgtctgtgactgtgagtgtgcccggctgcccggcataccaaacattggagaaaaaggacaatatggcactcttttttcacgtggtttcgacaaaacgccacccattaaaatgacaagaataaaatgctacttaataggttgtttttaaaaatattttatcactttgagtagttttaagactacactataaatagccgagcaattatcggcgtaggatatgggtgaagtggccctcggcgcaggcgggcgcgctcggcaccgaccacggcaccgacgacattcgcgccgcgtgcatcgccgcgcttccggctgcgcgcgtcgcaccgccgccacaccaccgcacgacgcggtagacaagcgcgcgtgcacaggaggacccggatctactagctaaatttgtagttggtgcatatgcatggcagcatgtcaaattaccttcgggactcctcccgacacgcagaacgaagcttatattattgtatgattaattaagcattaacttttttaaaaaaattggattaatatgtttttctaaaacaactttcatatataaactttt

SEQ ID NO: 5101 - DNA, 1501 bp, Oryza sativa
cgtggtgttaggagatggggaaagtgaaagggagggggaggggaacgtatggtgaaatcgagagggggtatatatacaggaggggtaagggtgcgtgtggggtcagggtgtcagtgactgcaattccaacggacggtggaaaatatttggtcaaaagaatcgtaggagtagtaagagcaggtacaatagcaggctataagccagctataaacatattttaaagagataaaggaagagagagaagaggagcgggctacagatttgtagccagctgcagcacggactccaagacgtaatgtgtgtatgacatgtgggaccagatattaatagtacagtaagcaactattatatgaattggctattacattggctatagacgatttggagctagtagtgggctgcactattgaccttgctctaatacgagtaggcgtaatttcggggagaacgaggcgccatgcgttacctcgggagattgagctgagctggatcgttcgagatgtcgaggcggtcggtatggtgcacgaagcggtcactggagtattcgaggtgaatatttaaatatttccaaataaaaaggtaaattaaatcaattgaaatgaatttctaaaccctaacgtctctaccttttgagggcgttatcgtgccgccccttcacctccagtggggctgccgagtgaaaacccagtctcggctctctttgagactttaatggacgacgacagcggtgtatcctttgctcctctccttggagacattatctaggcagccccttgccgaatccttccagacaactggtgtaagcttgctctagatgcatgtccccttgtgtcggcgctctagcttatgcaaggtggacatgacgaagggctaggggggaaagcattccaacattctctctcaccccctctctccctcaatctcaagaggtggctagagtgggcttggtgtcagttgttagggttagattttggacattctcggatatagttcctttgttggcctagcagcgactggtcatgcatagcgacaaccagttcggtgctagccttttctcctaggtttgttgggttggagctgtcggtgcatgggtgtgggttatttttctttttttcttactctatcaatatgaatatgaactttgcattgttgcgagacgttaaaaaaatgtggaggcaccgatgtggcaaattccggtacgcaatatactactatctccattttaggttacaaaacattttgactttggtcaaagttaaactgctttacgtttgactaattttgtagtaaaagataataacattttcaacccaagaaaaatttattatgaaaatatattcaattattatttaataaaactaatttggtattataaatattactatatttgtatataaatttagtcaagtagtttgattttgatcaaagtcaaaacttcttataacctgaaattgaaacggagagagtactattcagtattcgtccaaggcacaagcaaatg

SEQ ID NO: 5102 - DNA, 1501 bp, Oryza sativa
tttcatgtacacatatagttttacatatttcatgattttttttaataagacgaacagtcaaacacgtgctaaaaagtcaacggtgtcaaatattttgaaacagagggagtacataactttaacctatggaccaatcaagaatgcctacagtaatcttatatatggggtttacctggggatgaatatcgggatttgaacgctgataaatgaatgaagtaatcttgcacccatgatttcactatcacactcgacaccaccatatagcaaatcaattgaagaactaactgaaaatatactaatccatttttttatattataaatcattttgaattttttccctatttaaactaaagtttaaataagtttgtaaaaaaatagtaatatttttaacacaaaataaatatattagcaaattatattcaatgttacatctaatgaaactaatttaacattatagatattgttaaaaaaattataaacttgatcaaacttaaataaatttaacgagaaaaaaaaatcaaaacgacttataatatgaaacgggtagtgtaagtgtgtaactaaaatgcatagatgctttactcgatcacttgttattttttagccttctgaacccttttcaatcatgttgttagccccttcctcgttgcttaattactaatcatcctcatcatcatcatcggtaacaatatcatcttcctcctcagcataggtgacaatttcgccttcctcttgatcctcatcatcggttaggatgacttccctcatgacatggatgaacgcatagcccaaattctcgatttggtgacggaatgtttcctgatcctcgagcatgctctcatttaacaaacattcttcgtcgttctcgtacgataagaccaagtctagatccccaccatcgataacacgctccaccatcttcttcaccttcttcctcttgttccgctccagatctggtgcctggggcggatctagaattgattgggagggagaactcacgttggatccgcccctgccccgctccagacctggtgtctggggcggatctagaattgattgggagggggaactcacatcggatccgcccctacccggcgcatcgacgacggcgacgacggtggaggcagcggcattattattctcggtgacccgttgcgtttgtccgtaggagaacgatgctcccattgatcgatcgagcagctaagctcctgcagtttatcttctcgcaagtcgtttgtgacgtacgctcgcgtcgatcttgctttcagggggcagcgaccagaaagcaataagtagtagtagtataaagaacttgagactgggttgaacagaatcggaattaaattaatccactactaactaatttaatcgatctttctcaccagtacgacataattcggaggaacagtggaacagaaaaaacgaagtccgaagcataatccgatttgaatatatagtctgaagcctatatcaattcaccgattgaatatgaatccacaaa

SEQ ID NO: 5103 - DNA, 1501 bp, Oryza sativa
aagatggatatggaccaacactgaacatgatcattcagtttatatctttctaatgtttcctcctgaccgattcttcttcacggctaccccattgcggaaccttctgcggcggccagggggagcaactcgagcaggaactttattatcttcatcttcatcatcatcttcgtcatcatagacctcgtactcggcgtagcctttcgtgtagtattgtttgaggatagcatcccgttcctcatgaagatcgtcccgtagcttctcccatctagccttgcgctctccccgggtgttctcgaactctatcaagctgtcaagaacctcgggcggcacccgatcgaggatatccttgctgagcacctccgagagcttgggcagggattcctcgtcgtcgtcgtcggatatgtccgcactgaacgccatgcagttcttgatctgctgttgggtaaagcgcaccatcttcgtcttcctcttctccatcgtcgtcggaggcttgctatcttcgtcgtcggaggttagtagcgccgccgccaaaatccgcttcgcctcactaaattctatcttggagaaatccatcaccccgacgcctgaaattccgtcaccattgaaaccgaaccgaaagagctaagtcatttgtatgataataatgatacaacatcgcatcagatcacaacatctgaatgaaaaaaggtgcggcatctaatcctaagcccacgaaggcaaggccagctgcgcccctgatgaattgttcccctgagtctcctctcgattgaggcccaagacccgattgcgatagagttatcgggttcgggtagatgccggaatatatataggcagcgcaagcgcaactccaacaataactcggtttcggaatcgcttccgcgaatcgtcggacccgtttgttttgtatccgactccgaaccgaataggttccggattcgatgccgtctgtgactgtgagtgtgcccggctgcccggcataccaaacattggagaaaaaggacaatatggcactcttttttcacgtggtttcgacaaaacgccacccattaaaatgacaagaataaaatgctacttaataggttgtttttaaaaatattttatcactttgagtagttttaagactacactataaatagccgagcaattatcggcgtaggatatgggtgaagtggccctcggcgcaggcgggcgcgctcggcaccgaccacggcaccgacgacattcgcgccgcgtgcatcgccgcgcttccggctgcgcgcgtcgcaccgccgccacaccaccgcacgacgcggtagacaagcgcgcgtgcacaggaggacccggatctactagctaaatttgtagttggtgcatatgcatggcagcatgtcaaattaccttcgggactcctcccgacacgcagaacgaagcttatattattgtatgattaattaagcattaacttttttaaaaaaattggattaatatgtttttctaaaacaactttcatatataaactttt

SEQ ID NO: 5104 - DNA, 1501 bp, Oryza sativa
aaatggatagataggaggctcatggttgtcatcaaacctgaagctgtaccttgaaatcaagaatttggattacttacgccgtgtttagttccaaaataattttttaaacttttatcttttccatcacatcaaaactttcgtatacacacaaacttctaacttttttatcacatcgttccaattttagtttgaactaaacatagccttacatgaatacaagtttttttttttactgaattcttactaactctgacgaggcatgtgtgagttcatctagatttggtataacttccatctaaataaatcaaacgactgatatcgttgtttgtagaaattttgtaaagaaaatttacatgtagcttaaaaaaacccatgtgtatttgaagtattcccttctctgcagtcactatcaagtgcaatctgtcatgtaggattatttattcacaaataaaatgggttgtgctataatttttctaggttagtttgtttttgcttgggtcaggatgacagtgactgcagatacagacaatgggagcatgaagattaagagtttaaaaccacatgtgagactcatcatccaatcatgcatatagctgtcaatactgagaaaaatactgtagaaaaatacataaaaattcgcatacgtcaacacctctcaatttgtttctcaaaaaaggagtacaaattgcagccgcctttggagaaaaattctaacaaacaaaacactttaaaaagaaaactctgcaataaggtctagtttgattttctaattttctgatgacatctgagggctacaaaacgatgaatgaactacttcaaacttaaaaagctgttttaaaaatactctaatcacttttaaatctttttcataaaaaaaacatcccgtttacaagtttcgaaagcgtgcccacaataatttataatctataagaggaaaatatttggccctaaatctgcccaaattatttaaccacctgtaacaacttcacatacacactagctcacactaatgctaatttgttaatcattaccagccaaagtttttaaaacgttaattattccttgtaaagagatactccctccgtttcaggttatacgacgttctgactttggtcaaattcaaactactctaagtttgattaattttgtagaaaaaaatagtaatatttacaacactagcagagtttcattaaatatataattgaataaatttttataatatatttatcttaggttaaaaatactattacatttagagtaatttgattttgtccaaagtcaaaacgtcgtaaaccgtaaaatggagggagtacaaaataatgaaatatttactccacgtggcgttatcccattggcttagggcttccaacccaagccaatttctttctcaatctctccctctataaaaataccaaccaaagaggaaaaaatcgctcggaaaatacaaaaaaaaaagaggagaaataaatcaaacacctttcgcccaccctcccccaccaga

SEQ ID NO: 5105 - DNA, 1501 bp, Oryza sativa
cacgataacgccctcaaaaggtagagacgttagggtttagaaattcatttcaattgatttaatttacctttttatttggaaatatttaaatattcacctcgaatactccagtgaccgcttcgtgcaccataccgaccgcctcgacatctcgaacgatccagctcagctcaatctcccgaggtaacgcatggcgcctcgttctccccgaaattacgcctactcgtattagagcaaggtcaatagtgcagcccactactagctccaaatcgtctatagccaatgtaatagccaattcatataatagttgcttactgtactattaatatctggtcccacatgtcatacacacattacgtcttggagtccgtgctgcagctggctacaaatctgtagcccgctcctcttctctctcttcctttatctctttaaaatatgtttatagctggcttatagcctgctattgtacctgctcttactactcctacgattcttttgaccaaatattttccaccgtccgttggaattgcagtcactgacaccctgaccccacacgcacccttacccctcctgtatatataccccctctcgatttcaccatacgttcccctccccctccctttcactttccccatctcctaacaccacggcgaagatgcaccgtctccgccgccggccgaccggagagcacggcaccttctccgccgcgcttgcccgccggtggctgccgcggaagacctgttcctttctccggcggacggcgggcgggccttccgcgccgtcgacccgtccatagctccgcctccgtgatggcttgtcgtgtcgccggcggcggcggcggcggcgggggtggggtttcctccgccgcttcgtctcggtggcgaggccgacggcccattggggcccaatggggaaggcccatcccccgtggcggcttcccggccacgccaacgccttcttcttctgatgaactctccctggcaactggggcccgcaccgactcgcccaacggtctcccccaattttcgcctcttccgcctctcctctcttccaactccgacgagcggggccaacgccgatcgccgcgccggagcagggctagggttccggccaccgccaccgccagaacggtgcgtcgcgtcccgtccccatccttcttctgcttgctttccccccgttgtgttgcgctgtgtttttgattccgttgttcttgttgattttcttgcaggaatggggggttcgttcggatggttggagtttctcttatcgacctcgcacccgtgcgaggatgatgcggcggaggagcttcccgtcgagccgccggtggcggcgatggatgccgcccatgacggccgcgatgaggtgcggggagaagtcccctccgagccgtcggaagtactcgctggagaggaggaggcggcgatggatgccgcccatgacggccgaggcgaggtccggggagaggtcaccttcgagcgggcgatcggtgcctcctcccgtgcgg

SEQ ID NO: 5106 - DNA, 1501 bp, Oryza sativa
agcaatgagctcatgctaaaggatcaagaaatgttccagcggcagatcgagaattttggctatgcctttatccatggtgtgaaggaagtcatcctcaccgatgatcgatgaggacgaggaaggatgcgatatcttaagtgacgacgacgaagatatctccatcgccagacaccctaactaggacgatttaaacaccatggatgtgacaactgacaaatactcattgatgaatacaagttagttctgcatgagaatgcagctagtgatctgtttctaatatactactccgtttagttccactgatttggtattttgcatcggttcttcgtttaatgtgcttcctgctcccacctcatcgcctcaggatgcagctagtttaggctgtgcttagttcctcggtcaaaaattttttaagtacacaaacacacatttgaaatattaaacgtagactaataacaaaacaaattatagattccgtatgtaaactgcgagatgaatttattaagtctaattaatttatcattagcgaatgtttactatagcatcatattgtcaaatcatgacgtaattaggctcaaaagattaatctcgcaatttatatgcaaactgtgcaattggttttttttatccacatttaatgctctatccatgtatcaaacatttgatgtgacggagtttttggaagttttgaaataaactaaacactgccttagtatattttcttaatttgtaccactaaacctattagtattatttaatttggagataattaattaagacggacaaaaacaattcggggaacaattgttggtatataaaaatagtaaagcaaaaggtgttattaagccctactgattggtggggccgtaaaaaatgtgggggggggtccaaaaataacaattttttatacagatgcttatatcatccacacgtaaaaataaaaaaaaaattccctggaacagaagagccttatctggaaaaatagtgctatacggatattctgctcttttctgtttatggttgctgatgaaattgtttcaataaataggtattataaggatatcatgataatttaatttttttttgagaattacacagtataacgcagacactcacaacgcgcgcacttagatcacccctatgaacacacgcacgcaaaccctacccctatgagcatcttcgaagactgggccgggaaatcctggagagattaacgaagtcaccgcaggcgcctcgctgtcgacgggtacgtcgcctaccactgaaagcacaacgcctctttgaagactgggccggcaaatcctggagagattaacaaagtcaccacagacgcctcgctgtcgacgggtacgtcgcctaccactgaaagcacaacgccgatatatatatcctagaaaattcactcccatggtgagtcgaaaccaggacctcaggtgctactaagactcttgtaaccactaggctatttttttaggttaactggacacatgccattacaaat

SEQ ID NO: 5107 - DNA, 1501 bp, Oryza sativa
ttgtgttggtacttctgtttttaggtgcaacagatgtttgatgaccagtgcaatttgtattcgattttgtgtaaagctgcttttaggtgtagtgccattgtctattgttgcttgcctggtaccttgtgaattcttggtacagtatgatgatgagaaaataccagtataatcatttctggccttgaagatatatttgtttctgagtacttgtagtagtagaactctatgttgtgctgggatgtttggtgttcctaacttcgttgtgtagagctcgtgttaaattggtgtattctcctggtcatgtgttcagatcagtttgtggattcatattcaatcggtgaattgatataggcttcagactatatattcaaatcggattatgcttcggacttcgttttttctgttccactgttcctccgaattatgtcgtactggtgagaaagatcgattaaattagttagtagtggattaatttaattccgattctgttcaacccagtctcaagttctttatactactactacttattgctttctggtcgctgccccctgaaagcaagatcgacgcgagcgtacgtcacaaacgacttgcgagaagataaactgcaggagcttagctgctcgatcgatcaatgggagcatcgttctcctacggacaaacgcaacgggtcaccgagaataataatgccgctgcctccaccgtcgtcgccgtcgtcgatgcgccgggtaggggcggatccgatgtgagttccccctcccaatcaattctagatccgccccagacaccaggtctggagcggggcaggggcggatccaacgtgagttctccctcccaatcaattctagatccgccccaggcaccagatctggagcggaacaagaggaagaaggtgaagaagatggtggagcgtgttatcgatggtggggatctagacttggtcttatcgtacgagaacgacgaagaatgtttgttaaatgagagcatgctcgaggatcaggaaacattccgtcaccaaatcgagaatttgggctatgcgttcatccatgtcatgagggaagtcatcctaaccgatgatgaggatcaagaggaaggcgaaattgtcacctatgctgaggaggaagatgatattgttaccgatgatgatgatgaggatgattagtaattaagcaacgaggaaggggctaacaacatgattgaaaagggttcagaaggctaaaaaataacaagtgatcgagtaaagcatctatgcattttagttacacacttacactacccgtttcatattataagtcgttttgatttttttttctcgttaaatttatttaagtttgatcaagtttataatttttttaacaatatctataatgttaaattagtttcattagatgtaacattgaatataatttgctaatatatttattttgtgttaaaaatattactatttttttacaaacttatttaaactttagtttaaatagggaaaaaattcaaaatgatttat

SEQ ID NO: 5108 - DNA, 1501 bp, Oryza sativa
gtacaatagtaggctataagccagctataaacacatttcgaggagataaaagaggagggagaaagccagcaggctacagatttatagtcttatagctagctgcagcacggactccaaggtgcatgtgtgtatgacaggtgagaccagatattaattatgaagtactgcctccgtttcaggttataagactttctagcattgcccacattcatatatatgttaatgaatctagacacacattcatatatatgtctagattcattaacatatatatgaatgtgtgcaatgctagaaagtcttataatatgaaacggaggaactatatgtttataggtaactgttatatgagttggctattaagttgactatagatgatttggagcccgcagttggctatactattaaacttgctctaaccaatggcaatcggaacgtacaggatcatataactagcatacgcaaaaaaaaaaaagaaacccctggtatttactaaattattttttgtgtaagaaaattaaattttgacaatgccataaattaaatctttgggtaatgccactagatctctgaccaaatttgacttgacaaaatttggcttgacatggcacgttgtggctttagaatctttgggtcaagcatgcatgtcgtgagcaataagattttttttcgtcgacgtgcataaaataatttaccaaaaaagcgcgcgcgcatacgcatacatacatacatacatacatatatatatatatatatacatacatatatatatatacatatatatatatatatatatatatatatatatatatatatatatatatatatgtatatatatatatatacacatacatacttcttcgtgttatattataagtctttttaattattttcctaatcaaacttctttacatttaactaagtttataaaaaatatagtagtatttttaacacaaaacaaacatatcatcgaaatatattcaatgctgattgctagaataataaaatatattcttaaaatgttacttatttttcattaaacttagtcaaacttaacaaagtttaatctctttgttaatcagaaaaagtcaaagcgacttataacatactcccttcatccacaaaaattacacatattacttttgacaccaagaccaaggagaaattaaattaccttggatgctacaaaatcaagaagtaaataaaagcatgcaaccaatgagtatttagatgacttcttgagttctaataaaacatttaatttatctcttcatttaagtcttaaatgcataaaaactataaataggaacaacttatttggaaaaactcaaatgtgaaataggtgaaacttttgtggatggagggagtaaaataggagtatgtataattaggctaaggctgaaaaatataggtactactatcaactttcagaaactaaattttggttacttataaggccacacgacgagagcaagattgtgatcaggaatacccagaagcatgt

SEQ ID NO: 5109 - DNA, 457 bp, Oryza sativa
ttccatgaatcattttcctttggtcccgcacgtcagtgactgtcaataatattcttgagaatattatttctataaattccataaaccatttctcgtcttccagaaattccaattaaacttccaaaattcatatcttcccaaccgctcttccgattgactccgttcaacttccaataattccgtaaattgagatctatttaatggcactactaattagtctaaataggatctttctttttgtcttttgtttaggttttcgattgtttgcgtatagttgcagttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattataatcacacacttaacttgcttggcctcggtttgcg

SEQ ID NO: 5110 - DNA, 1501 bp, Oryza sativa
ttcggagggcaaccgtgcagatctccgtccatttatgtaaagaagaaaagtccagtttgaaaagggaagagtgcatgtggtatccccttaagatataaaaggaggaccatgcccacaaggagagggggatgggattttggattttcccgggagaggagagggctggttgatattttgtaacttgctcttacacaaatccaccaaaaacacaggagtagggtattacgcttcccagcggcccgaacctgtatagatcgtccgtgtctcgcgtttcttcctggcacgcgatctttctacatacagagagagcttgagatctcaccctaagcccccggccgaactggcaaaggggggcctgcgcggtctcccggtgaggagccacgagctctgtcggaatacgatatataaaagaaatcatgtatgacgacttctttgacttggcaccaaactcaccaatttatcctatgaacatgttcaaatttaagccgtcgtacttaaaatatgcacacacatatccaaccattttagctagtgcgtcgaaatatatcatcgttctaatttcttatattcagactacaatactttaatatataaacaacatataaaaataatatgagttcatttcgagtttataaaacctcaagcatacttgtagatctggtggtactacgcctttttctaccaatctcttgatttttgttatagttaattgcacgagagataggtagttcagattgatacatgctctcccttcaaatacaaagaaataatataaacataattttaacaatatttaaattcaaataatagacctctatcaatgtaaacattacacaattttttaataggtatttcggattaatatacatattttaatacgtagatatgtgtcgacgtaaacgcaatcgtaaatatgtactggatgcaaattccaattagtgatggaactcaattagaatttcaacctacgaaatataagcatagctcaactgattaggtttcttgtggtggaaccagctcaccccggttcaaattatttgatacggatgatcgcattgataactatttattttttcggtggtagacgatataaccgtcgataacgagtcgtccgtggtgtctttatcaatttcaaaaaattactggatcagtaatgctcgcaaaccgtggttattaaaaaaaacaaattcgaaccggaatcctcaaaataatcagatgttcccccaaaccaaaccggactccatctccatccccaactgcccaagctggaatccacctcaagctctccctcatcttctcatcttcgcttaaaaacacaaacaaaacgaatttcacaaaaatcctcgagaaacatctcctcctcccccttctctctctcttcctcctccccccacatctcccgcgagatacgaaaccctagcgctcgcggcctgaatccgcagcagcaggcggggggcctcgccggatcaccgccgggcggcgggcggcgggcggcggcggg

SEQ ID NO: 5111 - DNA, 607 bp, Oryza sativa
tggacaaggatgaccgatttgtgaccggtctgacactgctcatgtcgtcagcgcacagccacgttcccacgacgcgcctgcccccggcggaagtggaggtaggtatgtgccgtcccatcagaaggacgttcggagggcaaccgtgcaatctccgtccatttatgtaaagaagaaaagtccagtttgaaaagggaagagtgcatgtggtatccccttaagatataaaaggaggaccatgcccacaaggagagggggatgggattttggattttcccgggagaggagagggctggttgatattttgtaacttgctcttacacaaatccaccaaaaacacaggagtagggtattacgcttcccagcggcccgaacctgtatagatcgtccgtgtctcgcgtttcttcctggcacgcgatctttctacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttttcttgttcagcctaa

SEQ ID NO: 5112 - DNA, 1501 bp, Oryza sativa
ctgtgtttttggtggatttgtgtaagagcaagttacaaaatatcaaccagccctctcctctcccgggaaaatccaaaatcccatccccctctccttgtgggcatggtcctccttttatatcttaaggggataccacatgcactcttcccttttcaaactggacttttcttctttacataaatggacggagatctgcacggttgccctccgaacgtccttctgatgggacggcacatacctacctccacttccgccgggggcaggcgcgtcgtgggaacgtggctgtgcgctgacgacatgagcagtgtcagaccggtcacaaatcggtcatccttgtccaccgcgtgtcagcttagcaacgtgcatgtttgcccttcttcacacaacatcttgcctgtaatggttaggatgaagcctggtattcatctaaccagggctaacgtgtcatctctaagaggtaacacgctagctccggctggagacgcgtgcctagaggctctcgtcttgacgggacggggcgtggcgtgcgtcagaccgccagtcgccacctaaccgttgatctgaccggtctgtgactggtcacagaccggataaaagagcgcgctgcattgcgctgcatgcagcgtgacacgcttgaccaaaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgtgatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagccatgggcggtctcttcaagactgccacatcacttgagcagcgctcgaatctggacgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaagacttgctcccttcctttcgccactattcccctttccttcgccgtttgcgccctaaactctctctttgctgcgcctcaccttcgccacacacgctcgttctcaaccctctctttctccgacgaca

SEQ ID NO: 5113 - DNA, 1501 bp, Oryza sativa
gaattcaagatttcatggttgtaagtaatttttatttagaatttatgtgttgcaaggataattagcattcaaaatagtcacaaacaaaatatctattatattattaagacagctcgaaaagaaggcaccacgttcgctgtggaggctagaaattcccacattaatcggagaaaaagaaaaaaaaagaaaaggagagtccaagtaggaatacaatctaaaaatagctgaaattcggaataaaaaataagcaatattaaaagaagtttccatataagaacccaatacaagattaatcaaaattcgaaataaaaataaaataaaatccaaaattagaaaaaggaaaggagagtccaagtaggaatacaatctaaaaattgctgaaattcggaactaaaaataagcaatattgaaagaagtttccatataagaacccaatacgagattaatcaaaattcgaaataaaaaaataaaatccaaaattagaaaggaaaggagagcccaagtaggaatataatctaaaaatagctgaaattaggaattaaaaataagcgatattgaaagaagtttccatataaaaacccaatacgagattaatcaaaattcaaaataaaaataaaataaaatccaaaattagaaaaggaaaggacagtccaagtaggagtataatctaaaaatagctgaaattcggaattaaaaataagcaatattgaaagaagtttccatataagaacccaatacaagattaatcaaaattcaaaataaaaataaaataaaatacgaaattagaaaaggaaaggagagttcaagtagaaatacaattttgaaacaactgaaattgaaaataaaaaataaaaacattaaaagaacataatatgatattaactaatttttttaaaaattaaattctgaaattagaaaaagaaaaataagttttcaattaggaatacaatttataaataactaaaatttgtgataaaaataaagactattaaaagaaaagaccatctaaaacacatgacgagataaattaagtaacatgcctacaaaggagtagagtggtggcggttgatacgacatataaaaattgttaataaaacaccaaatagaatcgtaatgacgattaaaaggagggacatcagttaggccatgaagcaaacaagtaaggcagttgctgggacttctagaaagtaaaaaaaaaacattgataatcatatttgatttttaaaatcttaatgacaataaaaaggagaagcagcgggcagggtgtataagagtatagttgcagagctgccgacggttgactagacttctaaaaaattaaaaatgaattaaaaataaatagtaggcgacggacgggctgtagaggggcatagtggcatcgtttgatgggacttctaaaaattataaaaaataaaactacaagtccaatttttaaaggttcggaacttccaaaaagtaaaaaaaaacccaatgataatcatgttcgattttaaaatctcaa

SEQ ID NO: 5114 - DNA, 1501 bp, Oryza sativa
atcttagtggcttctaaactgaggacttcaagatgtcgaagtgtttgacacaattcttggggaatctgtttgatctcacactgccgatcagatgagcacgttttcccttcctgtagcaaaataaatgtctttaacatcttcaattgggacatgcaaattggcagcgattccgtggaaggatgaacgagcagtgatgcactccgagtagacaagataatgtcttgaacagcattgaactgaccaactctgatgattgagctggaaactctgtctgcatattgcacgaagatgtgcaatatcttgtgcatcctgtacatatgcctacctccatgatcatattcttccaccggataaaagcactcatcaagaaactgttggaggaatcgtattcgttgggcttcaggcacggtcgacggtataaagcctttggcagcaaaaagatcagccagttcttcagcagtgaagttgaagtccaatgggaacagcgagcaaaaaagaaaacaattccgcaattcggacgagagatgctggtaactggcataagctctctgaaagacatcagtcagttcttcctcttgttgaatcctccaagaaccttccagaactcttttccaccggatcagagttagctggtccctttgaagtataagaaatgatgtgtactctaacagcagaggcacaccggcacatttttcgaccaacttgataccgtactcgtgataagggggaaggtacatgtccatgacgtgtttggaggattcctggtccagtggttgcaagaagtaagcctcagtggttcgcatgacgacggccgtccgtggtatgatagagggagttcgtgtggtgagaaggatcctgccatttggggggaatgccagcataaggttgtcccattcaggccagtcgtgctggccaacattccacacgttatccaggacgaccaagtatttcgctcctcctcttagaacactggaaattacttgttgcagataggatggcccatccttcctatcgaccaaccagctgcttgtaatcgtactgacaccctcagatagatcaaaatgtggtgagagatgcacccaatgccgcacctggaacgcctgcttgaccctatcgtcgttgaataggaaccgggctagatatgtctttcccatcccaggccctcccactatcggtaaaaccagcggcccgtcgccctcctcctcctcgccgtcggcgagcaacatcctccccagcatcttctccgccagctctgatctccccaccattggacttttgacatagtcgtcgggacccacatcgttcgtcgaggttcctactggatacaagtcttcgtccatactctctccagactctggcacggaggcaagtgattcctctagccccgcaagcttcttcaacaaactcctaagctcacggacggtggcacggcgaaagaagaggttgctaatgtggagagcggttacctgataccaagaatctggttccacctgcctgctca

SEQ ID NO: 5115 - DNA, 1501 bp, Oryza sativa
tccctgcccgattcgatcggcaggctgcgtgagctcaccgtgctggatctccgggcatgccataatctggaggaattggggcaagggatcacaaggctggatcgattggggtatctcgacttgtctgagtgccacctgctcgtcggaatgcctaaagggattggccggctcacacggctcgaggtcctcaagggatttgtggttgcaaatccaagcagaagagagccctgccatctcaatgagctcaccaagctgaacaagctcaggaagcttggcattgtgattggcacaatggctgttccgacagatgatgagttcatgaaattgggcgagttcagggcgctcgaatcgctcaagatcagatggggtgtgctggcttctgatagcaaagggaaaattgaagcatcgtcgcatcaaaaaccgatcgacaaaatgaagtttgcgcttcctccaaatctgaagaagctagatctccgatgcttcccgctgacggatttcgctcagtgggttacaccgaagggtgttaagaagctgtacattaggggaggaaaactgatgacacttggagatgaacagggctgggaggcagaggtgcttcggctgagatttctgaatgatctcgagtatgatcacgatcggcttaaacgatcattcaggaagctcaaacctgaaaatacagagatccatgcatgtccaaagttcatccgtggacaatgatccagatatccagtgtactggtcgcctcagcttgcaacaacctgtactggttgctttttctgaaggatatatgggctggttttactgctttctattgagtctttgaaaaagaaaagaaagagttaccattctattctccttcacaagcaacttagctggttcttgccattgtactgccttcctgaaagatgttgtgattggttgtttccagataagaacaatatcggtcatatactttcttatagccctgctacattttcaggctataatgttcaggaaccctttttacccttttttctccatgtctgaagaaattcgctgaatcctatggtctggcctgttgtagaagggctgagacaagagtcaagacaagacaaaaatgtggtaccaaaatacaagttgctgctcccgtttgtggagtccgtcaggtacatccttttgcattttacataagtgaacaacctttttgtgttcagcttaacaatgctgctgattcctcatgatattacaatgctgtgataaatcgggtgagtaattcaatatagaagaaattctcattttacaatacagagaacatgacagattaggatcgaactagaactcgattacaatatagaacataacagctaacatataacaggtacaagggaccctaaaattacactgaaattattcacaaaggaaacatgctcactacaattcttcgtgcacgaagagttacatttcctcaagatgttagggcctgtttgtttgagttgtaaaattgattgggtcgaagaaaata

SEQ ID NO: 5116 - DNA, 1501 bp, Oryza sativa
cacctgccggcggggcgctccctgccgggagttccggcctctttctttttgtcgctcgcaggcctcccctttcgggtggcccgcggagcgccctcgacggcgaggacatgaccctcgtcgccggaacggttcgacctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacgttccgaagactcgccacaaaggctctacagccaacaccaccggccgggggcacggagggctgatcttcacgtccatgtcggggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgctgcggacttgtcgaccctctcaagcgcctccccctgcttagggctttggcgcggagggggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctgg

SEQ ID NO: 5117 - DNA, 1501 bp, Oryza sativa
gaagcaaacaaatggcagaggaatcatagcatatccattaacatacggaaaaataacctgtacctttcagaatcatggccccggcgtcgatcacggtcatcagaacgttcacgatcgtggtgttcccttctttcgcttctatcgcggtgctccctgtggcgatcacggtccctgtccttgtcaccacggtcgcggtcccttcggtctctatcacggtctctgtcgcgttccttgtccttgtcccgttctctttccctctctctagactttgaggacctgccatcatgtggctgtgtctcgtgctgaataaaagaacaagagttatcagtcagtcctcttatcttcaaaagagaagattcaattattgtttagccccaataagctgtcaacgaccagaaactactctctaagagtccaaggtgatacaatcagcataaggtgaatgttgaaatttgcacaacaattaaattcaaacagatctaatccgaaaatcgcctaaaaatttcctagttctatgttttatttgaatcgtggtctccagaggaaattaaaacagcacaaagcaattacaatcaacctaacaacctaatagttccatcgatttggagagcataacattgcaagcaaagtaaaccacctaaatccctaaatctcaggcaaccagatgaaatccccttgcacccaacccatgaaacaatcccaaaaccaaaccgccccccatcccaaaacatgggccaaattccccccctacagatccgcgacgcgcgcacctgagaacggccgccgtcggtggcgccatcggagaagccggtgggcttggcggcggcggcgggcggggacccctcgggcgcagggtactcagcgtacgcggaggcgggggccgggtcgccgccgttcccgttgccctcgtagggctgctcctcgtgctccgccatcggcgcgacggagtgggcgggcggcggcggcgggatttctagggttcggtggctcgagcggtggaggcggcgggcgcgaggtgggagagcacgcgaggggaacgggtcggtttatatagagaaaggacactgacgtgtggggcccgggactcgggtgagagccacgtcggtttttggaggcggtggcggtggcggcgtctgcaaccgtcgcgaagtcgtgttttgagtttaagtcggttgaattcgtgctttgttcaagagaaaaaaaaaacatcgggtttcgttttgatttttgcgtttccgcatcagagtatccaatagaagtccagaattcgatgcgtatttgggttcgaatcccacacaaggccacaatttaggccactcggctgcaacgcggcccggtaaaggcctgactcatacggcccatatacataacaatattcacgattatgttcaaatcggtcatgcgagtgttgttgtttccaaacgaattgatgttaaatattcgaacgagatttcaaaccgagatcaaatggtgttcacaacgagtcgtccgacacgatcac

SEQ ID NO: 5118 - DNA, 1501 bp, Oryza sativa
gtgtcgaactacgccctgtccggcctgcccgcgtgcacctcggctggcgcgtcatgttcggcgtcggcgcggtccctccagtgctcctcgccgcgggcgtgctcgccatgccggagtcgccgcgctggctcgccatgcgcggtcgccacgccgacgcgcgcgcggtgctcgtgcgcacctccgactccgtcgaggaggccgagctccgcctcgaggagatcaagcacgccgccgaggcgccaccgcaggaggatggcggcggcgtgtggcgggagctgctcttgcggccgacggcgatggtccgccggatcctcacgtgcgtggtcggcctacagttcttccagcaagcgtcgggcgtcaacgtggtcgtgctctacagcccggtggtgttcaagaaggccggcatggcgtcgaacacctccgtcctgggcgccaccgtcgccgtcggggtcgccaagacgtgctccatcctcgtcgccacgctcttctccgaccgcctcggctgccgcccgctcctgctggccagcacgggcggcatggccgtcaccctgacctcgctcgccctcacgctccgcgtcgcgccgccgtccgcggcgagcgccgcggcgtgcgtggcgtcagtggtggcgttcgtcgcggcgttctcggcggggctcgggccgatgacggcggcgtacaccgcggaggtgttgccgctgcggctgcgcgcgcagggcgcgagcctcggcatcgtcgtgaaccggctgacgtgcggcgtgatgagcatgacgttcatctcggtcgccggcgggatcaccatggtcgggttcttcttcctctacgccggcgtggcggcggcggcgtgcgtgttcgtgcacgcgcggctgccggagacgcgagggcgaagcttggaggacatggacgcgctgttccacaagtgatcgtgtcggacgactcgttgtgaacaccatttgatctcggtttgaaatctcgttcgaatatttaacatcaattcgtttggaaacaacaacactcgcatgaccgatttgaacataatcgtgaatattgttatgtatatgggccgtatgagtcaggcctttaccgggccgcgttgcagccgagtggcctaaattgtggccttgtgtgggattcgaacccaaatacgcatcgaattctggacttctattggatactctgatgcggaaacgcaaaaatcaaaacgaaacccgatgttttttttttctcttgaacaaagcacgaattcaaccgacttaaactcaaaacacgacttcgcgacggttgcagacgccgccaccgccaccgcctccaaaaaccgacgtggctctcacccgagtcccgggccccacacgtcagtgtcctttctctatataaaccgacccgttcccctcgcgtgctctcccacctcgcgcccgccgcctccaccgctcgagccaccgaaccctagaaatcccgccgccgccgcccgcccactccgtcgcgccgatggcggagcacgaggagc

SEQ ID NO: 5119 - DNA, 1501 bp, Oryza sativa
agagacatcaggaatcccacacttagcaagagctgaataattaatcagttaaccccttacgttatagttttttcagttcgcccgtactgatcatgtgcaacgaaaaaacacggatgatcatgttgttttcttaatatgacatcctgtactgataattttgtttgtttctgggaggctagtaataggagactggcgagaggattcagacattttcatcgttgctcttattcctttcagttcagtgactctagattcagaactactagattgttaatggacatagtagttgcatcatattttgcctagctcagttaacagaagatgtgctaattgatttttgttttgttttgtgaaatcacgctgtccggtctctctttctatcttgtgttgactctgttagtttgcaacttttcatagtggcacatactagcagatcatctaacccggcttaaactgtaataaaccatgctccttataatttgttactgctttctggcttgtccacaagaaaacaacatgtcatgaatccaacacgcactttggacctgattcagaggttgccatggacaggggcgggcccagtgtatattcaagggtattcagatgtatacccaagatttttggacaaaaaataggtatatatactctatatttcgtatatgtatttaaaaaattaaaaaagaaaccttaaactgctcatattggaccttatttcaccatttcttctctattgggcctaaacttcccactcccctccccctttcctctcagcccgcggtctaattgggccgttgtcaaccttgcatctcagcccatttcgacatatccccaattcccctcccatctaaccctaattcgcctccccatccatcccgacagttgcgcaggcgtgcggctggcggcgcgccgccgagcaggcggggcttgtggcgccggcccggccgcgcgactcgtgtcctcgtgctcgtggtcgtgggatgtggggcgccgcgccgggcgcagggcggtaggcggctgcgccactgagggctgccggcacctggcctggccggctgaccggctcagccgcgcagggcaggaccgcagaagcaggagcaggacagcaacagcaagccgcgcaggacaggagcagcacaacagtgacaacacagtgagtgactaaatctgtacatgcacaaaatttgaataaatgtagtgaagattttaggattgggagctgcaattcactgatttagtgagtacacaaatttgaataaatgtagtgaaaattttaggattgggagctgcaattcactgatttagtgagagtgtacttgcttgcttagtttgtagtggtctagtggacactggacggtagttcatagttcataccatattatcaaatttgtttaattttcagaactgaaacatgaagacgaagaagggccagctgttgatttaaactcttttttggagaaacaagatggggcttcattaaaaaaaattcaatttgcaagctaag

SEQ ID NO: 5120 - DNA, 1501 bp, Oryza sativa
gttgtgccccgatcgagcaggtgatcgtgggacactccgaatatttcttcttctccgggagcttgtggagtatgacgttgctgcagtgttccgtcagcttgaccacctccgttgttgggagcggtctcttgttgttgagtatgtccttgagataacgggcgtatattggcacttgcattgcatccaacaacagcacgttgatgtgaatcctctggatcacttcaacaaaacgagcgaacagctcgtccactgacgttttcctactccattgaggaaatggcagcaaccgtgtgtcgcagtactcctgtggcactgtcttttctggctgaatctccttgtcagccgagtcattagatggcgtttcttttgacatcccattagttccggcagggttaggatacggtggatcacgagtggacttacctccccttgtcgtgatcgccttaacattttcaatggaggagtagggttgccccggaatcctcccagtttcatttgcagggactaaatatgccaactgagctaactgggtttctacatcttattaaagctcagctggttttgaaatgcggaagcaaagccatctagctagacatttatgttctctaagatcttatcattggcagcaagctttttgcttagcgcatcagtggctttagcttgcgcaaaaacaagatctttcaaggagggttggttagagaagttaccgttattatttcctccttgataatatgagcgtggttggttccacccctgaactccttgtggacgataaccgttgttgttgttgcccatgtacatcgcctcctcacgggtttccgggcagtcgttcccagaatgatccgtgcctccgcagacttcacacgtgacgtgtgagtccaaggccttgacggtgccttgtggccgtttctcatggttgtccaagcgtttcatgaggaggtctagcttggcagcaagtaactccgtctccttgacggtgtgcatgcctcgctgacgggtctggagtcgttccttgctccaacccatattggagaccatcttctctatgagttcaacggttccttgaaccgtttaaaagaaaaaggctcctccagctccggcgtctaggtgatcgcgggacattggggtgagcctattgtaaaagttctgcaagatcagccagtcgtccattccatgatgaggacaggcggccacgtactcctgcagtagttcccatgcttccggaatggactcgtcccttgtctgctggaaactggaaattcgtccacaaagggcgtcggttttgcccatcgggaagaacttcgagagtaatatcatcgtcatgacatagagtaattgcataagcaaacactatacccgcaccaaagcatttcccagataagctagccgtatattcagtataataagaacataatataaagtaggtactcatatactcggaaagtatttcaataccataaatgtatatagaagagtattctaataaaagtacaaagcttac

SEQ ID NO: 5121 - DNA, 1317 bp, Oryza sativa
attaacatatatatgaatgtgtgcaatgctagaaagtcttataatatgaaacggaggaactatatgtttataggtaactgttatatgagttggctattaagttgactatagatgatttggagcccgcagttggctatactattaaacttgctctaaccaatggcaatcggaacgtacaggatcatataactagcatacgcaaaaaaaaaaaagaaacccctggtatttactaaattattttttgtgtaagaaaattaaattttgacaatgccataaattaaatctttgggtaatgccactagatctctgaccaaatttgacttgacaaaatttggcttgacatggcacgttgtggctttagaatctttgggtcaagcatgcatgtcgtgagcaataagattttttttcgtcgacgtgcataaaataatttaccaaaaaagcgcgcgcgcatacgcatacatacatacatacatacatatatatatatatatatacatacatatatatatatatatatatatatatatatatatatatatatatatatatatatatatatatatatatatatacatatatatatacatacatatatatatacatacatatatatatacatacatatatatatatatatatatgtatatatatatatatacacatacatacttcttcgtgttatattataagtctttttaattattttcctaatcaaacttctttacatttaactaagtttataaaaaatatagtagtatttttaacacaaaacaaacatatcatcgaaatatattcaatgctgattgctagaataataaaatatattcttaaaatgttacttatttttcattaaacttagtcaaacttaacaaagtttaatctctttgttaatcagaaaaagtcaaagcgacttataacatactcccttcatccacaaaaattacacatattacttttgacaccaagaccaaggagaaattaaattaccttggatgctacaaaatcaagaagtaaataaaagcatgcaaccaatgagtatttagatgacttcttgagttctaataaaacatttaatttatctcttcatttaagtcttaaatgcataaaaactataaataggaacaacttatttggaaaaactcaaatgtgaaataggtgaaacttttgtggatggagggagtaaaataggagtatgtataattaggctaaggctgaaaaatataggtactactatcaactttcagaaactaaattttggttacttataaggccacacgacgagagcaagattgtgatcaggaatacccagaagcatgt

SEQ ID NO: 5122 - DNA, 1501 bp, Oryza sativa
aaatggatagataggaggctcatggttgtcatcaaacctgaagctgtaccttgaaatcaagaatttggattacttacgccgtgtttagttccaaaataattttttaaacttttatcttttccatcacatcaaaactttcgtatacacacaaacttctaacttttttatcacatcgttccaattttagtttgaactaaacatagccttacatgaatacaagtttttttttttactgaattcttactaactctgacgaggcatgtgtgagttcatctagatttggtataacttccatctaaataaatcaaacgactgatatcgttgtttgtagaaattttgtaaagaaaatttacatgtagcttaaaaaaacccatgtgtatttgaagtattcccttctctgcagtcactatcaagtgcaatctgtcatgtaggattatttattcacaaataaaatgggttgtgctataatttttctaggttagtttgtttttgcttgggtcaggatgacagtgactgcagatacagacaatgggagcatgaagattaagagtttaaaaccacatgtgagactcatcatccaatcatgcatatagctgtcaatactgagaaaaatactgtagaaaaatacataaaaattcgcatacgtcaacacctctcaatttgtttctcaaaaaaggagtacaaattgcagccgcctttggagaaaaattctaacaaacaaaacactttaaaaagaaaactctgcaataaggtctagtttgattttctaattttctgatgacatctgagggctacaaaacgatgaatgaactacttcaaacttaaaaagctgttttaaaaatactctaatcacttttaaatctttttcataaaaaaaacatcccgtttacaagtttcgaaagcgtgcccacaataatttataatctataagaggaaaatatttggccctaaatctgcccaaattatttaaccacctgtaacaacttcacatacacactagctcacactaatgctaatttgttaatcattaccagccaaagtttttaaaacgttaattattccttgtaaagagatactccctccgtttcaggttatacgacgttctgactttggtcaaattcaaactactctaagtttgattaattttgtagaaaaaaatagtaatatttacaacactagcagagtttcattaaatatataattgaataaatttttataatatatttatcttaggttaaaaatactattacatttagagtaatttgattttgtccaaagtcaaaacgtcgtaaaccgtaaaatggagggagtacaaaataatgaaatatttactccacgtggcgttatcccattggcttagggcttccaacccaagccaatttctttctcaatctctccctctataaaaataccaaccaaagaggaaaaaatcgctcgaaaaatacaaaaaaaaaagaggagaaataaatcaaacacctctcgcccaccctcccccaccaga

SEQ ID NO: 5123 - DNA, 1501 bp, Oryza sativa
tatatatatttaaataatcataattcatgcgtacgcttcttctttcaattctttttttcctttttttctttttctatttatataatagatatatattttttaaataattatattttacaaacaaagaatctaccatcatacaacttagaggtaactaaattatctctacaatttttgaaaataaaatttacaccattatatgttacccattaaattaataatgtaatataatttccatttaaaccggtgtactcattactttgtactattatttttaaataatgcactattttaaaataaagttcacacattatattgtatacatacgtatgtgtacgtacgcttctttcgcttattttttccttttttttcttcttttttctatttatataatggatatatattttttaaataatcataattttacaaatagagaatctaccatcgtacaacttgcatgtaactaaattagctctacaattttaaaaaataaaatttagaccattatatgttacccataaaattaataatgtaagataatttccacttaaaccggtgtactcattactttgtgctattattttccaataatgcactatttaaaaataaagtttacacaattatattgtgtacctatcaaataaacaatttaagatctatattaactaatttatacgtgcatttaagctgatggactcattatttaaatcactggatttattttttattacattggactattattctccaataatgcattgtttcaaaataaagtctacactattatattatgtacccattaaattaaaaatttaaaatctataataactaatttatacttacactagaaccggtggacccattatttaaatcatcggatctattgttttcttataaataaagcgttcgaagttctcttttttggcccgctacacaatgcacgtctgcactttttgccttttgcacgcgtgacaaagcgtcgtgtctaaggcatctaaggtgattacgaccgccgctacgctaccactttgccacatatcaagtcatatatggagttgattaattttattaataacatgtaaagaaaattaaaggtgtgatgccgtgagagaagaattaagcaccgcgggttgaattttttccaacacttagctctgtttaacctgaaactaagagttgattatagaataattataatgtattgtgttatgtcatatttggattttgtactatttgttcgtacaggtgaaagaaatcattatgttataaatatgggcataatattaacgaatatcaatagaacttttactaagacaagcatactataagagagtttaaccctctttttttcccaattccatagtttgggttttcgtttgcacgctttccaagtttctaaatgatgtcttttttaaacaacattttagctttttagaagtcaattcattcatttgtaccctcaaataactatcatataaataagctattctaaatcctaagt

SEQ ID NO: 5124 - DNA, 1501 bp, Oryza sativa
aataatgcattattggaaaataatagcacaaagtaatgagtacaccggtttaagtggaaattatcttacattataaattttatgggtaacatataatggtctaaattttattctttaaaattgtagagctaatttagttacatgcaagttgtacgatggtagattctctatttgtaaaattatgattatttaaaaaatatatatccaatatataaatagaaaaaagaagaaaaaaagggaaaaaataagcgaaagaagcgtacgtacacatacgtatacgtatgtatacaatataatgtgtgaactttattttaaaatagtgtattatttaaaaataatagtataaagtaatgagtacaccggtttaaatggaaattatattacattattaatttaatggtgtaaattttattttcaaaaattgtagagctaatttaattatctatgagttgtatgatggtagattctctgtttgtaaaattatgattatttaaaaaatatatatccattatataaatggaaaaaagaaaaaaataagcgaaagaagcgtacgtataactgtgtaaactttattttaaaatagtgtattatttaaacataacagtacaaagtaacaaagtaatgagtacaccagtttaaatcaaaattatcttacattattattaatttaatgggtaacagataatggtgtaaattttattttcaaaaattgtagagataatttagttacctctaagttgcatgatggtagattctttgtttgtaaaatataattatttaaaaaatatatatctattatataaatggaaaaagaaaaaaaggaaaaaaagaattgaaagaagaagcgtacgcatgaattatgattatttaaaaaaatatatatatctattatataaatggaaaaaagaagaaaaaatgaaaaaaaaaaagagaaaggaaagaagaagcgtacgttcatggtcgtatatatctagggaggaggagaggtggggcccatagtatttggtttggtttatgttaagatcaatttcatctaacggtgtataatattggacccaccaatttaagtgaaaattaaggggtagatgttttgcttttttcttagaatttctaggattttctctaatttattagagcgccacgtggcgacttgagagcgtttgtaggaagtttaatggacttttagtatataatagatagatagatagatagatagttacatactacactattaatatctggtcgcacatgtcatacacacaatgtgtcttgcagttcgtgctacagttggctgcaaatctgtaacccgctgctctcctctctttttatttatcttcttaaaatatatttggagctgacttatagcctgctgttatacatgctctaagagaaactatagattatccccgatgatggacagaatcacaggaggttcactagcagcttagcttgggagattgaagcccacaaggtggatagaggatttttttggaggcggaga

SEQ ID NO: 5125 - DNA, 1501 bp, Oryza sativa
cttattctacatggaatttttttttatttggccactcgtaaaagttacttccgttggaacatactagctacaaagagagcacaccaaccaacatgtttattttttccgaagagccggttcatgcgttcttgaagaattattaattatatcaacgacttgcacataaatgtttacataattgctctactaaaacattcaacatactagaattaatattttctacttgtcccattatgtagaaaagttctcttttgagatattattttgagacggctcttgcctactcgaagaatcgttaattatatcgaagagcactgcatgtgaaacatttacataattggcccattaaaacgttcatcaagctggagctttttttttagtttccatttatatgtttgtcgggaaataaacattttcagaattgtttccaaatagaagtatcacaaataccagctattatcgttgcttggttcatttaggatataagaaattaaaattctttcaaataactctacaacatttataaatcctaaatgaaaaatataaatattcataggttattgttaagttgttgcgccaaaggcgcgtctattttctagtcggacatctatggatgggtacgcctaataggcgatcgatagccatggggatggggtagcaatcagattcgctccccgcctcccccctccctccacctggtttcctttttttttcaccgcattatttttctattttagtaaatttatacaactaaagtttatacttctaaagtttacacatctaaagtttagagaccaaaagtttataagtcaaaagtttatatatccgattcaaatttgaatttgaattcaaatatttttttatatatagtatttctgtacatttaaagtttatacacctaaagtttatagacctaaagtttataagtcaaaagtttatatacccgtttcatatttgaatttgaattcgaattcaaatatccgattcaaatttgaatttgaattgaaatatttttcatatgtagtatttctatacatctaaagtttatagatctaaagtttatagacttaaagtttatagactcgattcaaatttaaatttgaattcaaatattttctatatatagtatttatatacatctaaagtttatacacctaaagtttatagacccaaagtttataagtcaaaagctgattcaaatttaaatttgaatttaaattttttatatatagtatttctatacataaatttttctaacttttgtttttcaaaaaaatttgtgtggtctactatagtagaaagaggagaaggagaggaggaagggggagaagagggaggagcgatcgctgggcgggtgggggagcgatcacccgtccattagcctttccgtctatggatcggactgatggatgtatgcgagtaagcagctaaatgtttcttctcattcctttcttctctctctaaatatttttctcctaaattacttatccgatcataccat

SEQ ID NO: 5126 - DNA, 1501 bp, Oryza sativa
  unsure (1)..(1501): unsure at all n locations
gggggaggggaacgtatggtgaaatcgagagggggtatatatacaggaggggtaagggtgcgtgtggggtcagggtgtcagtgactgcaattccaacggacggtggaaaatatttggtcaaaagaatcgtaggagtagtaagagcaggtacaatagcaggctataagccagctataaacatattttaaagagataaaggaagagagagaagaggagcgggctacagatttgtagccagctgcagcacggactccaagacgtaatgtgtgtatgacatgtgggaccagatattaatagtacagtaagcaactattatatgaattggctattacattggctatagacgatttggagctagtagtgggctgcactattgaccttgctctaatacgagtaggcgtaatttcggggagaacgaggcgccatgcgttacctcgggagattgagctgagctggatcgttcgagatgtcgaggcggtcggtatggtgcacgaagcggtcactggagtattcgaggtgaatatttaaatatttccaaataaaaaggtaaattaaatcaattgaaatgaatttctaaaccctaacgtctctaccttttgagggcgttatcgtgccgccccttcacctccagtggggctgccgagtgaaaacccagtctcggctctctttgagactttaatggacgacgacagcggtgtatcctttgctcctctccttggagacattatctaggcagccccttgccgaatccttccagacaactggtgtaagcttgctctagatgcatgtccccttgtgtcggcgctctagcttatgcaaggtggacatgacgaagggctaggggggaaagcattccaacattctctctcaccccctctctccctcaatctcaagaggtggctagagtgggcttggtgtcagttgttagggttagattttggacattctcggatatagttcctttgttggcctagcagcgactggtcatgcatagcgacaaccagttcggtgctagccttttctcctaggtttgttgggttggagctgtcggtgcatgggtgtgggttatttttctttttttcttactctatcaatatgaatatgaactttgcattgttgcgagacgttaaaaaaatgtggaggcaccgatgtggcaaattccggtacgcaatatactactatctccattttaggttacaaaacattttgactttggtcaaagttaaactgctttacgtttgactaattttgtagtaaaagataataacattttcaacccaagaaaaatttattatgaaaatatattcaattattatttaataaaactaatttggtattataaatattactatatttgtatataaatttagtcaagtagtttgattttgatcaaagtcaaaacttcttataacctgaaattgaaacggagagagtactattcagtattcgtccaaggcacaagcaaatgtcagannnnnnnnnnnnnnnnnnnnnnnnnnnt

SEQ ID NO: 5127 - DNA, 1501 bp, Oryza sativa; identical to SEQ ID NO: 5102

SEQ ID NO: 5128 - DNA, 1501 bp, Oryza sativa; identical to SEQ ID NO: 5103

SEQ ID NO: 5129 - DNA, 1501 bp, Oryza sativa
cacgataacgccctcaaaaggtagagacgttagggtttagaaattcatttcaattgatttaatttacctttttatttggaaatatttaaatattcacctcgaatactccagtgaccgcttcgtgcaccataccgaccgcctcgacatctcgaacgatccagctcagctcaatctcccgaggtaacgcatggcgcctcgttctccccgaaattacgcctactcgtattagagcaaggtcaatagtgcagcccactactagctccaaatcgtctatagccaatgtaatagccaattcatataatagttgcttactgtactattaatatctggtcccacatgtcatacacacattacgtcttggagtccgtgctgcagctggctacaaatctgtagcccgctcctcttctctctcttcctttatctctttaaaatatgtttatagctggcttatagcctgctattgtacctgctcttactactcctacgattcttttgaccaaatattttccaccgtccgttggaattgcagtcactgacaccctgaccccacacgcacccttacccctcctgtatatataccccctctcgatttcaccatacgttcccctccccctccctttcactttccccatctcctaacaccacggcgaagatgcaccgtctccgccgccggccgaccggagagcacggcaccttctccgccgcgcttgcccgccggtggctgccgcggaagacctgttcctttctccggcggacggcgggcgggccttccgcgccgtcgacccgtccatagctccgcctccgtgatggcttgtcgtgtcgccggcggcggcggcggcggcgggggtggggtttcctccgccgcttcgtctcggtggcgaggccgacggcccattggggcccaatggggaaggcccatcccccgtggcggcttcccggccacgccaacgccttcttcttctgatgaactctccctggcaactggggcccgcaccgactcgcccaacggtctcccccaattttcgcctctcccgcctctcctctcttccaactccgacgagcggggccaacgccgatcgccgcgccggagcagggctagggttccggccaccgccaccgccagaacggtgcgtcgcgtcccgtccccatccttcttctgcttgctttccccccgttgtgttgcgctgtgtttttgattccgttgttcttgttgattttcttgcaggaatggggggttcgttcggatggttggagtttctcttatcgacctcgcacccgtgcgaggatgatgcggcggaggagcttcccgtcgagccgccggtggcggcgatggatgccgcccatgacggccgcgatgaggtgcggggagaagtcccctccgagccgtcggaagtactcgctggagaggaggaggcggcgatggatgccgcccatgacggccgaggcgaggtccggggagaggtcaccttcgagcgggcgatcggtgcctcctcccgtgcgg

SEQ ID NO: 5130 - DNA, 1501 bp, Oryza sativa; identical to SEQ ID NO: 5106

SEQ ID NO: 5131 - DNA, 1501 bp, Oryza sativa; identical to SEQ ID NO: 5107

SEQ ID NO: 5132 - DNA, 1501 bp, Oryza sativa
aaaaatcattgtccatggatagccatatagtaaacaaatgtccaaactgagagagaacggttcgtttttgcaaatgaaaaaaagaaagcattcctcttgtgcaagcacagtgctaaatgcttatcctcgatcgatgatgcaggaggagcttcactagcagctagccggggagattgaaaccagggagcattggagaattttggagacggagatgaacctgagacggttacgggaggtgtggggtgagtgggagatccgcgttcttgtcctgtccagcctatcccttcaggtcttcctcctcttcaccggcggcctgcgcaagcgcaaagccgcttggtggctgcgcatgccactctggcttgcctacctcctcgccgactacatcgccatctacgcgatgggcaacctgtcccagaaccagaagctctgcgacggctcactcgatggcgagatgcacctcctcgtcttctgggcccctttcctcatccttcatctcggggggcaggacaccatcaccgccttcgccgtggaggacaacgagctctggctgcgtcacttcctgagcctgctgtcgcaggtcgctctcgccggatacgtctactggaaatcacggcccggcgtccggctgatgatcccggcgataatcatgttcgtcgccggcatcaccaagtacggcgagcggacgctagcgctcagggcggcgagcatgggctgcctgcgcagctccatgctcacgccgccagatccggggccaaactacgccaaattcgtggaggagtgccagtcgaggacggacgccgggctggtggccaagatcgtcatcgtgcaggagcggcctccagacgacgaccaccatgtcgaagtcaagcagcaggaatatggcgacctggtgtacagtgcgcacaggttctttcagatcttccgccgcctcttcgtcgacctcatccttagcttccaggaccggatcgacagcctctccttcttccggaggctggagatggaacaggcgtacaaggtggtggagatcgagctggtgctcatgtacgaatgcctccactccaaggccctcgtgattcatggtcgcctaggccgcggcctacgcttcttcaccctggccgcgccggtcgtgtcgctcgtgctcttcacccgcgcgttgggtgatatgcgaggctactacaagcaggttgacatcaacatctccttcgtgctcctgggcggagccatcttcttggagacctacgcgattctcctgatcgtcgtgtcctcctggacctacaccgacatgcgcaggacagaagcgctccgccccgtggcagcggcggtgttttggctgatcggcctgttccagccagagaagcggcctagatggtcgaacaagatgtcgcagtacaacctgatcagctattgtgtcaaggacaggtcccgctggtacaagaaacccatggagtggctggagtggaggtggaacttccgcgtgaagacgatgtgggacagctggagg

SEQ ID NO: 5133 - DNA, 1501 bp, Oryza sativa
atctgcacaaggaactgaactgacaatatattcccttttcagctcaagcatcgaacgcttcctccagtcttggcagaagaggaactccttatcaataccaaactgaacaccagtttacagcactagatcagcctgccaaaccacagttttgatcatcgacgtactcaaaccaaacaacgtatcctatgaacaattcagttcccacttcccagacccgcattacaaatcaatccttttaattggtggaatgagaagagcatatacacgccctgtgctgctgccttgcacatttccctgtctcataagtttggcgacttgcagcaaatttgttggagatgcacacgagcgaacgccccgggccccaataatatttgcattacatgcgtgggggatcaacccacgtgtaccgcccatgtgaggctggatttgagctaggaatttggaatcttctaacatgcatggtgctttctttgacagttaacaacttccctttccttttctttttttctttccgcacgcatgaacacatccagcttgatcaggttgtagcacctacataaacagagtggtgtgctccttaaaaggaaaacgaaaagattccattgcgataagcacgaaccatcggaaaaattattgaaacagctaactgatactaatttcttagcaattgtttgtgggtagtaacagcactatctgtacacaactagagccatagtattgtgcagggacaaaggattacgaggaaatttcttgcaagtgttattagaaaaacttcatgattagtcagggcatccgtacttgcatgtttcagtttttttgcgattgatctggttagtagtattatgtgattgattctgctggtggattctctcttcggtttgcacgtggttctctgctgataatgtcagaatgattcatgagcggagcactaccccaataaaaatggcgagctcggtcctgagattcctgtacatacgcctcacgaataccatatttttactctcgaggaagcttcatagcgacatcgtacacgcacagaaatggataaaaacactgcactcaccaaccaggtcaactaccacagttaacagtacgtgccaagttggcttcagtttagaggcctgatcaggcagaatcgatcacatcacacggcatacgcgctagccaagtaggagtatagatcctagcttagcaaggtgccagacgatcgagcaccaaatcagcaagagcgccgtgacatttcagcaatcaggtcgccttgtttaatcgccaaattatcctaatcaatccaagggagagagtacgtcttcacatggatgcaatgcgtacaagtcaatgcacttgggggagccaggaactgacacaaaattcatttacaagttacaattgtaccagtagatcagcagtagtaatgagcataatcaatggaataataaaataaatgtagtgtccgtgcatgcgttagcctatatataacggcttcttcttcttccaatttgct

SEQ ID NO: 5134 - DNA, 1501 bp, Oryza sativa
gtgtcatatattaaaaacaaagatattatatggttattgcgtaaatgctcaacgccgggcgaccggcgcggggggagccggatcgggcgcttccccctcctcacgcgcaatgtctcctcctggccccaccatgtatctccaccatatattccattgcaacaaatcatccacatattttggaaaccctctattaagggaatttggtttattttttgttccaccaaaaatgtttcatatagtgcactcacaatgtttcactatgtatagatctaatgttgcagtgaactaaaatactccattgcaacaaatcacccacatattttgggaaccctctattaagagaatttgttttataatttgttccacaaaaaatgttttacctagtgcactcataatgtttcactatgtatagatctaatgttgcagtgaactgaaacatacttttactatttgctgaaatattgtttttatataaggtgaaacaacatccgatttaaacaagtgaaatattttcgatctacttagtgaaacaattccgatatacctggtggaacatcgtgcaacatttaaaaataattcaataataagctaaatttttttcatcagaatacacatggtcttgttttgaagatttaattgcaacaaatttaatggtgcaatcgggtcatgatttggataaataatttaagagaaaaataaatttaaaatagttttgtacgcatgcgtgacgctgacgtcatggcccaattttaaccccctcccagtcccatcgggcgtccgaaccggagtcgcttcttgattattagtatatgcagcttgttaatttgatgctactaggtcactactattttggtactatctcatcctgcagtgtacacgttagctacatccactgtttgaaccggaagatacatcggtgatagtcatgcatgtctatgtacgtatgcctattgatcacggtgaattccaattccaatgtacttctggctagcaagtcaccatccacatgcatcggacggcctgaaattaacgagcgtgcataattaattacctcgcgaactgaccgtcagggagcgagatcaaaatcaggccacatagaaaagcaggggactgggtaaggtgagtgcggcgggtgggcccggcaaaatcccccgccaccgcctctccgcgaatggggaggcggcacccacgtgagcaagccccacatgctgacatgtccccactcgatcgtcgatccccccctatttctacctcctccaccccgctgcttgtcacgctctcgttggtcgatcactccatcgatccatcgatcgatcgctagctactcgccgtcgtcgaccggtcgatccgccattagcgagctgcaaggctctctcgcttataaatcttccgagtaggcaagcctcaatcgatccgagagtttggtcgttgatcgagctgatcgatcgaccggtgagtggtgcgtggtgtgcggccatggacgacggcggcggcggcggcg

SEQ ID NO: 5135 - DNA, 1501 bp, Oryza sativa
acatgatccaataatgaatcagaaccaggaaaaaaaagcaatgatatttgtcattaactaacgaccgtgtgcttcatctatgtaatagccaccatctatttactgaaagaagtatatactgaaagaagaacaacaaagataagcaatgatccactgtcaaaagggaaacatgaacacggggaaaatcgcctaaaacctaaaaactctgtgacagtaaatcccgtgcaacaaacaggccagtacatggctacctgagatgcaccaagcctaatcacaggataaaaaggaaacacacggcacagacagaaaggaaggcagctaggccagatacagaaaacccaccagcacacgcgttcaccccccagggtccatgatcaaacgaagaaagcacaacagcggagaatgggctagaacagacgacaagaagaacagcgaacgggcaccaaaaggcaatgcaaaggaaatggtgaaaaagcagaagggaaagagaagattggcaggcaatgagctacttatactggtaaacaaaacaaaaaaatatgtaacataaaaaacaacatactcagaggctgtcaataggaccccacagatgacagggccatcggtcaaccacagcatacgacgtaacacatcagtgctctgacggaggccatcctcgagctctccgtgttcgcctcgaacgccgagcagtaacactgcgccggacaaagggcacatcggcggagcctactacagcggccaactgcaattggcatggaccacgactacgtggggcccgaacagcagcggagcatgattggctatagccgtgggaccgaccactcgccggaacacgcacagacaccaccaaccacctcgcagccccgacgaccggctgccattgaccaggcatgctcgagctctccgtcccgccctcgaacgacgagtggtggtgagtgcacctgacactggccgcactggcgggatcctcccgcagcgacgagactcgactggcatacaccacaatggcccaatcagagcatcttgagtggtgtgagcgggcaccctgaacgatttgtaccatgctctgatatgcagcgacaagtgaggaagaacaacaagcaaacatccaacaccaattaactggccatccattaccagggagaaaatgtataaggaggaagaaatcacaccaggcatgcagattcggcactgagataaaaagagcatcgactcaataccaaatcaggggggcaaaacaatggagccgctgatatcggagcaaaaatcgcacggaatggcgcggccaacgacgaagaggaaatgcgagtgcatccagaaaatgccacgtcgtccccttccttctttaccacggatgaaccgcccaagctgccacggacacactcaaagacacgtgccttcacatgcaccaataaacgcagcccgtacacatgaaacgcgaccaccgtttctgaacagcgcgaacaaactaaatttgccgcagccagcgtggacccccacc

SEQ ID NO: 5136 - DNA, 1501 bp, Oryza sativa
tgcgtcgtttgtgtggaagaaacacgaggacgatatggtccacttcgcttccagtttcgacatctttttgttggaagtacacgcacctagccgctatccccgggagacgaaagctacggcgatctcgacgcgggaggtgactccgaccacaccgcgcgcttgtttcacgtttgcaagtgggcgcacgcgccgccccgatcagtcataactagcgactctcttcttgaccccaaatgcacttgagctctatagttgtttttctcgaaagttcatcttaaccgagtaatcatgttctcctacataggctcgcaccagccgtgtcatcagctatcaagccaggagccccgtccacgtttacaactgttcgtcgcttcatcagtgcaacttggcaagacagcaaaatcagtgagaggggttgctgtgactgtgagagggattaaatggatctggtaaaggatggcaaataagtagttaaaatcccccgcaatcagcatcggccattttcctgatatgtgtacgggggacagagagaggcaatcaggcgaatgcgtttttaaaccggagaagggggccacatttcctactgcgctgaaccggatcctctcggtatcacctcgcgccacgcaaccgcggggatccgtatcctctcaaattgtgcaccctccacctgtccgtcctcctccgtaggccaagtgcaccgccgtccttgtcaaaccaaagaccgcggcgatcgactatgtacgtggaaaacaattttaatcacttatatgtatattgtatgtcataaatagttataaaagaatttatttaaaaaatcaaaataaattgacatataatatgtcactccaccgatatacaagtttaaactcgactctataagttatgaaagcataaaaaattaagctctaattaattaatcttttgtagaagttaaattttacaagtttaaactcgactctataagttatgaaaagttatgaaagcataaagaattaagctttaattaataaatttttatagatgttaaatttaaactcgtatgtatatcgaatgatatatttcatatcaattgatttttattttaaaaaaatgtatataataatttaattgacatgtgtaataaacgggctcgacagccaccgagacatggagtgattataatcaatctcccgcggtgtatgggctcggcgcacgcggcctaaccctccccttcctttcattccctccccccgccgccctcttgaccctcctctttaatcacgagacccgcactctttttttgcgtcgctcgagcgcccgcgttccccgcttcgccgaaactaccaaccgcctcgccgttctcctctccccgtggcgccgccgcgccgcacggcgggagggcaactgaccgagggagactgcccaccagcgtgccgcgcgccgtcgcctccggctccctggttcgtggaataatggcggcggcggtcgcgggcggtggggaggagggggaggagctgctcct

SEQ ID NO: 5137 - DNA, 1501 bp, Oryza sativa
accagatcagaaacatactgaaaacttctagtttgttttccatcaccataaactgtcataggctgtctacgcaatgcctacaatgataatcatgtataaactcagaatttcatattgacagcgcaaatgtgtaaccaaaagttaataaaatagcggtacgtgttaaacgaacctgggcaacaaaattgctaaccacacggccatcatctagacacattcgagggccatatgtattgaaaatgcgagcaatgcgcacctgcataataagtcagttagcaaaagatcgtagaatagctatagttactaagatgttgaagtcacataatgctacaatacgaactacagtattgcagcaattctactctatttcatcctaagagttagtgaacaagattatatgttggacacgttaatgtaattgttactttaaccattttttcagtttcatgaataatatagactgaataaaaagtaatgaactaactaaaaaatgacaactaataaagatcatcatcgccccctcccccccaacacacacacccaccctgcaatagactgtccaaaacaaaagaaaaaaaatatctttcaggactaaatggtaaaatgaaacagatctgtcataatacctaaatccatgtaaatgaaaatattagaaccccaaaagtccgcatacaatcgtcatctcaatatgttgtaaacccagcatggaatataagtgggacatatttagattattacctcaacaccaccacctctgtgatagtccatggttaaagtctctgctgttcttttcccctcgtcataacagctcctaacacctgaacaagggagagaagtcagggcttagttaattggaggtccaaatgcaaaggactgaccagaaccaaaagattatataatgtggtaccaataggattaacatgcccccagtaagtctccttctgtggatgttcaagtggatctccataaacttcacttgtgctagttagcaagaaccttgcaccaattcgctttgccagacccaacatattcaaggttcccatgacattggtcttgtaataattgttaagaaacccagatttgataatatacagatgcaacacatgattatattgtaaatagtgaaaataacataataagttgcaaaaaaacatgattggtcaaatatccaggtaaaagacataacggttttatatttaactataaaacttcaactatatattgagttacgatagagcacataaaaagcctttttaagaaaaaaaataaatgtaccttataaaaattcaggtgatctcttttcctaattctcgtacaacagaagctggtttgtgctatatctatatggcatttcaatgaacaaactaatcgaatcctgccaaggattgttcatggaagtatgtttagaaaatgggttagaacccggcctctacatccaaaacggatgtacacagccattgttcatggacgtatggaacaactactactctctgttaaaatc

SEQ ID NO: 5138 - DNA, 406 bp, Oryza sativa
caatgcctgcgggcttatgatgtaataattagcactagactcttgtgtatgtgcttttggtatttcagctatgaactcgtgtgtagcagaccacttgatccagggaaatggtactgtttacacgaatgattcatgttataaaaacgggggtccacagagctggtatcagagccatacgactgtaggaaaagaccaaaaggcgccccaccccttttctaagttggccaagggaaaaattcccatttagtaatactttcgaaaataaaaacgctatgtttacaaaactcggtatgattttcatcttactcttaactattttctttacaaaataggttttactctcaactgactttgggtttttcttaaaattagatggcagatccggattcacccgctacctgggagt

SEQ ID NO: 5139 - DNA, 1501 bp, Oryza sativa
gaaaatttcagattcaccaggtattacatcattaacagcatattacaatctctgcctcgttaaggttcaaatccccttcagtatgagctgaacctggtgtaggcactgaattcctttgcctcttagcctcaagtctagcttgctcggctctcccatcctcagctctaagtccaacaaatgtatgcatttcatcttcctccatcgaaggcatagaagaaccaagttgatgttgtggaattggttctatctccaatgcatcccaatcaatagcaagttgaggaacttggttatgtggaattggagctatctctagactatcccaatcaatacaactgctgcattcttgaacatcaccttgcctgtctgtcacaacttcacccattgctacctcattgacctctgaaactaccgagttagtcatcaactgaataggcttgtcctccacatcaacaaacaaaatcaactttctatcactcttcctaacaaacaatgcatgggctacatccatattatccttaaacggtgtttcctcaccagtgcccatgtcgtagccacttatcacagcatgttggttgctgccccattttacccttactgcaagatccttttccaaactctccaatgtgcactgatgatagtccacaacccattcaagccatttacgcgccacttcaacacaagtaccatcatcaagtttagctgtaaaatgaccgaactaaacgcacacgctaaactccgcatcacatacgaacaagaaaaacgagagtaaaaaaaaattagttcgcccgctaaccaaatccgtcctaattttgttcttcagcccgttaatgcaaataatggagatgtggagagttatagcattacctagaagggagctcagatggaatcgaggagcttgccgcttgcgccatgatctcttgaaccgtgaccccctgtcccatctctatcttcaaaaccctaggtccccgagggaccggaggccggccggcggcggggcaaggaggcctgccgacggcgagccaagtaggctggccggcggcggtgggtggctgggcgatctggaggctggtggcggcgcccggtgaggaggcggcgcggcgacgggacgggagcgcacgcgctctgcctccccgttcccgatccccttctctcgatctccctatctcttttacctgacagatgggaccagtggtaaaactgtcccagaaaagaagagaaaaacagaaaacgaaaaagaaaaagaaaaagtgatgggaaggagagaaagtggtatgaaataagaaatgtgcactcctagtgatgtattagagaaggcatgcgaattgggtggtaagtttgcaaaggcgcgcgtatttagtggcttattatcaaaaatctccctcgctcccgaaatcacgccgcatcctctcttcagccaacgtcgcccacccgctcgtcaccgattccccatccacgatttctctcctctcccgcgccgcccctccgtcgtcgtcgcgtgaag

SEQ ID NO: 5140 - DNA, 1501 bp, Oryza sativa
cgctcgtcaccgattccccatccacgatttctctcctctcccgcgccgcccctccgtcgtcgtcgcgtgaagtcctggccgatcccctccgtcgtcgtcgcgtgaagtcctggccgatcccctccgtcgtcgtcgcgtgaactcctcgccgatccccttcctccgtcgcgccgtcacgccgccgattcccccctcctcgtcgggcgcgccgcggggttcagtcggcgccgatccccatcccccaggtcgccgtcgccgatcctgcatctcctctgtcccgtcctcgccgatcccccgcctccctcgcgccgtcacgccgccgattctcgcctctccaagaccggtattcttgcctttttgtacaatgcaactgtgtatagacatatcctagcagggatagaagtttcagtttttttaattaatgtgtcttgtgtgagaccagtgcaaggggatccacattgttcttgattttgttttggtttcaagtttgctggtgcatgtgcatgtatatgataactattgctcctcgatgactgggtcgctgttgaaggctcagttttggcaagttttgaattcgagctcgatggccgggtccctgttgaaggctttcagttttggcaagttctgaattcgagcgaggttagtgtaattttaattattttaggtcatttcagtggtgcaagtaattcatatgtcatgggtgcaattgatttacttaatcattttagaattctgtctgcagccatagcggcctgtacttaaagaaacttgagcatgtgtaaaaaaggttaaagaggcagatgcagtgtactccttcagtgaaatagcagagtacattagagaagtgtaattttacttgatttagtgcctcgcacttaggaagtgatcaatatttcagtgctgggcatatggcacttgcttgtccttaccaccttgaccaaatctgcaaaatagagtaggaaacaaaacatacaacaaagatataaaaaaaatgcagctaagatattttacttcgtttagctgaatcaaatcaaacaaaccactcatctaatttcttctttttatctttgtttaatgcaaatactatggtaggaacccaattgtttgtttgacataagaaatcagtcatctaatttcttctttttatcttttttatgcaaatatggtatttagtaagaaatgctagagtactaatagtccctctgctcaaattgatcaaatagaactgtcaaataaattcaatatgttgttttggcgtcgttaaatggcatggttgttttataacacacagtaaatacaatgttagacacagtaaatacaatgtgtagaaattaattcgagaagctcaccatcaatgttagatacacctctgaaattagagcaataatggcagatattagatcaatgcacactataggggtcttggggtcttggggagatcgacggccccggtgtcttggggtcttgggtttggttcctaactgaatattgttgtttcaac

SEQ ID NO: 5141 - DNA, 1501 bp, Oryza sativa
gaacaagatggataaccgtaaaaggaaaatgactgtatcccaggaggcacaaggtagtagccagaggcagcgtatcaagccactccaaattggtgaatctttttctgcaggtcaagaacagtcacaacagttgggcatcagtggtgagatcaactcagatactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattattggagttgtggaataaaagatagactgtagtttacctatgcctttttctttctagccgttccgaatctcgggacgagattctttgtaaggggggtagatttgtcacatcctgattttcgtttcaggatttataaattatttaataaattattaatagaatttatattaaacgttcattaatttactagtgaagttaaatgtgggaaataaaatttcctaaatataaagcatggaaggatttaatttttattaaattcttcatggttaattatactctctggaattttctcagatttttcggagctcaattcctaatttttaatcatacaaagagcatttcagtaattacccacatattaaattaatcattaaatggtctaattgtaatttttttaagtactttgagtgtccaagtattttcaggatttttcttgaaattatttgagcattggaagtatttttaataattcaaagatcatttaagtgattattttaattgggaaagtaataaaatcctcctcctcagcttgggccattttcagcccattccttcctttccttcctctctcttccgccggcccaacctgagccgcctcctctcctctcagcctagccagaaaagtctattttctttccctgcgctactgttcatcttccaactcaggcagagcccgagccagccgtgccgtgcacagtgccgccgcctcttccttccaaatctcgcctccccgttgctctttttctccaattttgttgaggggaaatattcctcttatcctcctctatctttacccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgc

SEQ ID NO: 5142 - DNA, 1501 bp, Oryza sativa
tgcagtcgacatgaaggcaaaatgacgaacatggggatgatatcgcccgtcagaggtgacgaaaatgttggtggtggtaaaaacaatgacaccaatcaaagatgatgaagtcgcatagccatcgaggcgaaaaaactagtcgacagtagtcaggtcagctagcagtgaagatgaaggcgcccaacaacaacgacagagcagtcggtggcgacgaaagcaagccgactatgaagaagtagacacgcatcgatggtgatggcgaaatccaccaattatgaagatgaagaaaatagtcggcgatggcaaacgcatccgacggtaatgatgattagcggcaacagagatagccggctatgatgacgaagttgcccatcaacggcagcagagtaggctatgttgaagaggcttgacaggatgttgatgaagatgacgatgttggtaatccagtcaatagcggtgtagcaactgatgataatgacgaagacgctcatcagcgtttgcattgtaggtcaaccgtgaaggtgaaataataagtcggcgaagacatagtcatccattagcaacagcggagatgtcagggctaatgaagcagaggtgctagtgatgatgtcagcgacaataatccatcaaactgttcagaagatatcaaagctcaagtagtttccttgacgagagcgtgtgcataaagaagactgatgcaacgcttcttgatgtacgaagatgactgcagaacttagtgttatagctgttgtaaatgcttcacttggaggaaagtagatgctgttgtccaactcgtctaaaccaagctgattggctgataactccaaactctcgaacatgtagattaaatcttgaacttgatactttgagaaatttggagtagattatggcagcgtccagaaaccaaaattgctagtgaaataattggagttgctgaagtagaatatctgcttcgaagcaaagatgaagataacgactcctggagttgactcgttggctgattaattgatttcttcagcttgttgaattttgagagtcttgtatttgtgtagcccccgactctttggttagttagaaggcaactgaacatagagtcgagaactgtagcttcttgtcatcgagtactcattgcacgagtaaagatatgtgttgaggatgtccgaatagaaatcttgaaaattagggaaccacttgttgtagtagaataacacggcatcgaatatggaagtgcatgccgagatgtcgaagctcttgtagacgtggttggtgaagtagcaaaacatgcgaagttgcgacaattgggtttgccggtgccgaagataataaagatgaagtcgctccaccatggtgacaaagttgcatagccgtgacgaagtgaacacgagtcggcggcaacggaagcaaaccgtagcgaagacgcatagttgtgaagataaaaacaccagtcggcggcgatataaccagtcggcgacggaagatgatgatgtccatcagtagtggt

SEQ ID NO: 5143 - DNA, 1501 bp, Oryza sativa
cggcggcgtgtcttggcgtatgtaggcttctatattgtggcttctatgtcgattgtgttgggtgttgatcctccatggtgggtgtccccctgtcctcctaggggggcttgtatttatacccataggtgtccccttgtccaagcagaacgaatgaaaccaatatggatacaatccgggtagtccttatcgtttccatgtagaactctgggtgtctttccttatccggaactcctcctatatccgaaggttgtttccgtataggacatagtatgtggtgggccctgccgagattcagtcaactattattaggtatgtggtatccataaccctgacaatattttttttactaattatataaaaggcattcacgagcgcatatataaatgtatgcacatccatcatataaatacacatacgcacacctacactaagagaaaaaaaatttgtctccaaaagagaggaacaagtacgtgcttagtatttgccagaaaaaacatatacacattcaatgaaagtgtcttatggaaccacatcatatcttcttttaattatgtcattctcatctatataatgttaataattagcacaaataattttgacaatatagattattctatcttataatacccatgaacatgcataggtgaatcaaatgtataataaaagaaaaaaaaacaaaaaattatgaactcatatgtttacaaacaatgatgataaatgagtttatatataaccgggacaattcttaccgtcgttgtagtttaagggtgtaattcagactttttcctttaaaaagtcatttccacataaggatttataataaaattttaatcatcactaaataagtaaggtgcctgcacatgtgctataaacgctctcaagtcgtcacgtggcactcctttaaatgctcctatgccaccacgtggcattttaataaatttaagaaaatcacaaaaaaatctgagaataaacaaaacatccgtccatcgattttcactaacatgcagtggacccgttgttttctatcattagacttatttatccaaatagataaggataaaaaaaaggcccccatatctcaaacctctcctgtacttactccaaccagtatgtaccttcccagtcccaccaattttccttctctcctatttttctcctattttcatcaatttgttagatggaaaaaatatttataacccattattttctatcattagatttgtttatcaaatagaaaaaggaaggataagaaaacaagccccgcatatccacccctcccattcagtacatacgtgcctccccacctattttctttctcccctatttttctcttttagttagatggaaaaaaatgttttatgaaaactaattttaaacaactatattatctaaatcatatagctactttttaattggtgcacaccattagattatttactataaaatttaaaactgaagatctaagttaagtatattattaaagaaattcattactttgtgt

SEQ ID NO: 5144 - DNA, 1501 bp, Oryza sativa
tagtggaataagagactcttggctaccgattccaagagtgtagcaccattgcgcatagtattctgctcctcctgtggtagcattgtagaccagaagtggagccagtaggaagacatgaagataacctgcatagggttagataattgtttaccattaaaaactttatcattgcgacaacgccaaattgaccaacatacagcgctagctccaattagaatcatcttcttaatggacctagatacccctctaagccaattaccgaaaatgtttttggtgttacggggtgggggatattaaaagcaaaaaacacacatctccaaacaaactaagcgacatgacactcaaagaaaagatgttggattgtctcttgtgcatagcagaaagaacattgtttgtctccccctccccccaatttcttttagccaggttatctttcgttagaattactttcttgtgaagaaaccacataaagaccttgatctttagtggaattttcaagtcccacagaattctctttttatccaaacattatagttcatgatcgcggcatatatagatttgacggaaaattgaccattcttatggagcgaccatacaaagcagtccttttcatttgacagagttatattagctagcctgaggatcaaatcgttccactcaattagcttttggccaacaatagcccttctaaaagaaatatttagcggcgttgtgctcatgacctctgccacagtagactgcttctttcgagccacattatataatgtagggtattaatctttgaaagcacgcgatcccaaccacatgtcttcctaaaatcttatgtttaccccattgcgacatctaaaagaaccaaacctaagaaattggtctttgactttcattaaaccagcccagaactgagaaatacctatcttgctggacataccagaaagaggtttaccctttaagtattaatttcccaaaaggtcttgccataggccttcaccattaaacaactagaaaagccatttgttaataagtagctattacgataacagagaacttttacgatgatctctactggtagtatcacggacggcacaatcaacggcgggcgcttcaaaaacgtgaagggaagtgggagtatttaggacccttcccagcaatctcacccatccctccccttcccctgcttcggcagctgctggtgtggtgatacactcgcctagctttggccaccactaatctctgctctgctttttctcctctgctccactgatcatccaattcttctcttcctgattggccattctgattggctggtgacatgtcgaaggtgagcctttcttgctcttggattctgatcctgattagctcgtgtagaatcaggatcatcatcttttcttcttcagatcccaacaaccttttttcttgcttgtcttcctgaattgtatcatgttcaggtgtttgtgattcacacattgccaaccttaaccctctgtttcacatgttgctctgc

SEQ ID NO: 5145 - DNA, 1501 bp, Oryza sativa
cgcaggccacggcgccgtcccccttggtgggccacgacgctgtcctcctccgccaccgcgggcaacgacgttgtcctccctcgccgctgcgggaggctgcgggccacagtgtcgttctcctccgccactgcaggccacggcgccgtcctcctctgccaccaaccatgccgtcgtcctcttccgacgccaacctcgtcgatttctccctcggcgctgtcttcctccaccgccgcgagacacaccgccgccccttctctgtcatcctcctaagccaccggtcacgtcgccgtcctcttcctccaccgccaccggtggcagagccctgggatggtggtcgtgtcagctcgtgtattccacgatgggatgagggggggagatagagaagagagaggatgagttggaggaagtgggtctcattatttttaattttattatttgactgacatgtgggcccacatattttgttttatttttaaaattgttaaatttggcttcatatgccacgtcagatgaagaccgagtcaaattagccacgtaggcatcacgccagctgaaaccgtcgtccaaaccgccttgggacttgttttgcaccagttttaacaattgagagacccattgtatatgattttccagttgaatgatgaaaatcggattgatcgacaagataagggacctcatatgaacttattccatctttgtttggttatctgcacggagatttttgggtcctaaccagttagcagaccaaggctttcccagccaaccaaagcatcaaaatcctgcaagcccaatgacctcttttgcaggcaaccaaatggctgcttttgagtttaaattaaattcggaatttaattgtggaacttcccttttattcagaaaattgaaaattcaaaatattaaatgaatatggactttcaaatttcatttaaaacgaaattcttttatttagacgatttgttgatttttttttcttgaactcgtaacctggaatttgataactgaactaaaattttattgttttagtggagtattagttactcctactgcatgtttcagaacaaaaataattactcctactgcatattaatgatatttattgcactacaaatcattttttccctcctaagtggtatcagttttatttacaatcgtattgatacagggctcgagttcatgcatttcattattatttaggagcttgtgaattaaataaaaatttcattcccatttaacatttcttgtttgtatcagatacactcttgatccatgaattgtactatggtgtactagataccaacttattatttttcttttcacatatattgagtttgctttagctgagattaataaattggatttatgaattgctttaattacagtttgatgttcttatatttcagaacatatataaggaatgacgccatccttcatcctaaaaattttcagcactgaatacaatcggtttatagatttcaaggagaaaagaagaaaactcttgggg

SEQ ID NO: 5146 - DNA, 1501 bp, Oryza sativa
tccatgaatcccgcagtaaagcgcggggtatcacctacgtagacccgcagtaaagcgcggggtatcacctacgtagactatgcaataaagtctcattgggactacctattaatctttcaatagatttatagtttcgaattagagaaaacaggaaaagagctaagagggatcaaacccaagaacttcttttcaaggagtgtctcaaccatcgagctatgtcacatgttgttcatgtattataacacacatctatttgaaccgctttaaaccagcggtttgattggtccgaccaataaaccagtgaatcgtgtgccttagcggttcgatcctcggtctggtcttaataactatgccaatggatatagcccgttttaaatgaaataacaagaaaaagagacaaatatataaaaaaaaatcgtaaatctagaaaaaaaactgttgtaaaatataattttggttcactgtaattgaatgtaagtgctatgtaactaagtataagtacattgtaactgagtataagtgctctgtaactgagtgtgaccgtaaattgagtacacgagaatacgaattttgatgaaagattttacgaacgaaaaagtaaatgatagaagtcaaaaatctatcgcaagtaaaatagtaaatccgttttgcttttgcttttgcttttcgtcaacgagctaaacggtttcgagcttaagcttgtacctgcatgtaccctcaccacttcaccaggctgcaggcgtgatatcaattctggtaacacgttgagcttagagagtttatagtcgcgcccgaacacaagccacaaacgtagaagtgagagttaagtcagatcagggacacaacagtgcacagacgtacgtggcaggcaaaacaaggtgaaaagaaatcgcaccatagtcgtcaccgcacctcgccgtcctattggcgatatcccacttcccggcatatttccagcggcaatcttctttccaaaatgcactgtatggttgttgcactttagcccgttagccgcagctaacaggtacccagcctttcgtgtgctcaaggtcgtcgttgcctggctgacacaagcagcgcaacaagcgttcttttgcatcgcccttgatcgtgctcccttgtcaaagtccaatacgccggagctctcatggctatatatacgaagccatatcatggcttctcacttcattccaacatagggaggtagatcacatttggccagaagcctttgtcacgttcctctctttggaaactagctttggtagcttgctttactcttcctaggaatatatctgtgtgtccagaaaataattgccacagaaacgaaagcaacgagagcagaggtcaacccagtcgtacttaccaaaggcgagcgaattgaagcaaatttaggccgcattttcgttgcgtacatagagaatcgaggcttacaatagggacccatctggtgtgtgcagcggcgctcgtgtaccggtcgccatcagcatggacgccgccgcga

SEQ ID NO: 5147 - DNA, 1501 bp, Oryza sativa
tttttacatcaagtttgaccgttcgtcttattaaaaaatttaagtaaatatcttttattttgttgtggcttgatttatcactaaagaaacttttaagatttgcataaaatttttaaataaaatgaataataatgttgtaaaaaaataaaataacgtcatgtattaaaaatgaagggagtttatgttctcattcctcgtcagctccaatcaccaactttttttctctcttcctctcatcagctaatttatgtcactggtcactggagatgaccacaaagcaacacgctatacatctcgatcggtctgaaagagatgatgactgcaaaacctatccacgaaaccaattgcttgagagagacgacgacgtctctaactacagaatggtttttttagataatgaactccagaatggttaacgtacggattgaattgacgaataattcgtaataataatttgaggataaaaaataaattaactattctaaagttgaaaaatgggtttaaaacagtatgtatgatttacatacacaaatatatatatatataggtaaattatatagatatatatatagagagagagagaattattgtaaagaaaacttatttttaggagatcgagaaacgtgtgcattcatcaatgtattcatttgttaagcacgaaagaacaggagggaataatttggtgctacacgcatggacagggtgaccaggcggatttccaagacagatcgaaaaacctgacggagggaatggaaaaggagtggctggtctgattggagcattggagggatggggacgcctcggaaaaagggctacgctacattctcaacgaagtgttttcttttcctcagctgaaagagaaaacctttttttcacatcaggtccatacctatacaggtaggatgttaaggtccatgaacagtactagctacagtatagcgaggtagtacaaattgatggttagtttcggtttacctgtttgcaaattgcaatattgttaaagcgagaacggttattcgctcccgttaattccaaatctaaggccgctttcggaagtgagggttgggcctggcacgaaaaacaaagcagcgattagtgcatgattaattaagtatttgctaatttttaaaaaaaatggattaatatgattttttaagcaactttcgtatataaatttttttgcaaaaaacgcaacgttcagctatttgaaatgcgtgcgcgtggaaaacgagggaaggaagttgggaacctttgatatcgaaagcagcttaaggtggtgtttggattcagggatttaactttagtctttatatttagacactaatttagagtattaaatatagactacttacaaaactaattacataaatgaaagctaatatgcgagacaaattttttaagcctaattaatccataattagataatatttactgtagcatcacataggctaatcatagattaattaggctcaatagattcatctcgcgaatcagtccaaga

SEQ ID NO: 5148 - DNA, 1501 bp, Oryza sativa
agtatgagtggcatccacccgattttggttttcatagtggtatttttccaatttaacattttcgtaagggcatgggccaatatattaaaaaaaaactcactatggattgcaaagaccggttgttgaatcaaaactagacccaactataaatcgggtacccgatgtgccccttcccaacatgcaagttacttttctctccatagcacctctgcatgcatacctcatttctctctcttccactctttctacgcgcatgcaagctctctcctccacacgctctctctctcctatacactttttttttcgacacctcctggtatcgatcacctctctctctctcctcctatatactttttttccaacacctcctgtacttaactaggtgattccccgcgttttgctatgaaaattactaagtaagttttaatatgtttttttaataattgagctaagagtgaaaagtatattggttgttaacaataaataaaactgatttgtcaaactatgttcgatgagaaataaatttagtagactctgtaggagattatacatgaaatatgatatcctgcattttgattatatgaaaattcaaatgcaaaaataagatcaaattgtgattctaagatgcattcctaataaaacaaaacatgtgttttctccaaatggcagcaagcacgctcggctgagcaaaaaaaaaaaagaaaaaacgagtgatgactaagcagaaaaaaaggtctggacgacgcagcataggattaatagagaaaaaaagaatccaattctcatgaaattcacgcaaacctgcagctcctcagtaattaaattagagatacatattgttagaaaaatagagaataaaaagtaagttattattcacatgaataataccgatgaaactatagctcttcatcatcaatcacacatttatcccagttttcggacccttaacttattcctacccacgaatcaccatccatagcacacactaattgagctaatccctctttctatatagttgagacccaaagctgatctgtgattaagccacgtcaccactaaaacctcagccgttcgatctgatctggacggtcgcacacaggtgaagcccagcccacttctttccaggatttttcggtttctcctaacccatccgcatcgcgcagaggctatgccgccgccggatgcggcgcttcctctcccttctccttcaccctcgcgccgcttctcctcccccgtgcgcgcgcgcgcgagctgcgccgcgggcccgcctctgatgcggtcgcttcccatccccgcgtcgcactgcctccccccatccccacgcgtcagccacgccacgcgcctgtagccctagggaggacgaccgtcgcgtcccgcaacagctccttccaccgcctcccctcccctcggtgcttcctctccattacttgatgccagaagggagcacgcccatcgtgctgaccacccagcggcgcctccccagccatgctcacacccgtcg

SEQ ID NO: 5149 - DNA, 1501 bp, Oryza sativa
ggaccaaatcatcttacccgtgtgtgctgtggtttttttttctttcccacatgtgtgaatcttaaaataaatctaacggtttaaaattatatgaaagtaatatgcaaatttattagggcaaggccaatgcttatggttccatcaaccatatatatgggacccgctataagtaagcattagctatgttcatatccacaatggttgtgcctatgggagaaaataagctgggtcccaatgggtcccaccgaaggataaaaaaatcacttcttatcctcctgtgaaactctttgcacaatgaaaatttcccaaaagtactagcgtgaacagtacatcacaaaagtattgtattctatagtcttgttgccacaccataaggctaatgctcatttttgatgtcagattcttatggtccactttcacaatacttaaggtgatatactgtagagttatttattgcttaaggttacttttagcacacattgtggttgaccttatagttacatgcaagatacaatataattgcatcacaatcatattgtatttatatttgataaatttttagtacaaaaattcatctgtaaatatatagcaaaaatcggttaattattacatgcaacgaaaacagatggcaacaaacagtacaccgtggaccaatcaattaataatctacgtacaacaaggacccagaggatactgcattgcattggactcgctagaacagtactcacagagtcacagttctaaccgaaaccacaaacgtgccctccatttactagctgattgggctcgagatagatttggtaaaccctaccaaagaaaccgtacactgatcaccatcggtcccagtcccagtccaacacttccaccccatgtgggatgctcaaatattaaaggaaccttttgcttccttccatggcgcgctggtaccgacaaagttaatgccacccctctcctccaccacccgctgagctaaagctaagttctagccatggagtagtacagtattgtgcgggtttgtttaacaacgctttaacatttaaatttagctttaaaagtttattatggaataaaattatggagtagtctgaagttttgaaactcgctatctctctaattcagtttatgaaagtactttaaactgttcttttttttatgaaactatagcctgaaggacatgcccttcacatccggtggttgctatgtgcacgaagctggcactagtgacccactgacaagtgagcctagctgaccccacagtgatactcagcttctatttgcattgccgcgcagaattgaagctaggagaacgacatggcgccccatgagttgcagctatttatcgcagccttcacctccttgcaagttccattctttcatctcgcttcacctcatcgccattgccatccaaagcaaagaagagagccaccctgcagacacagtacgcacacgcagagagagagagagagagagagagagcaagggatgaggcttctcggagctc

SEQ ID NO: 5150 - DNA, 1501 bp, Oryza sativa
aattactttggtttaggttcaagggtaaaattgggaaggtttcttggaccataatccataaaaaaatagaaagggttttcaaactaattttgaataaaggaattttagtcaaaagaaggttttaaaccaaatcaggaaatacatcaattcaaccacatgtattttaatttttaaatgaaaaacacaaaagaagttaaataccagaaagagattttatgcaagttagttttagaaagtccctctaattatattttcctaggtttaggaagttattaagaacataagactcagcataatgcagaattagaaaatggttaatttttggtatgttacacgccgctccgcctctcccctgccgtcgccgccgctgggagattgagcacctgccgccgccggtctccgcctctcccccaccagcgcccgccgttgccggtctcctcctctccctcgccagcgcccgccgccaacgggagatcgagcgcccgccgccgtcggtctccgcctatcccctatgcccgccgccgccgggagatcgagcgcccatcaccgctgatctccgcctctcccccagcgatccagcgccgctgccgccggcgtccgcccccagcgcccgacgctaccggcgggctcgagctcgtctcctccaagtgtcggcggagctgcgtcgagttcatcccctccaccatcgagctcctccatgtccatgtggtcgccggcgagctcaattgagctcgtttcctcctccgtcaagctcctcccctcctccttgtgctcgccgactacgtctcttgcccctagctcgcgagcttaacgagctggctcgagcctgttgacgagccgagccgagctaggtttctaagctcggctcgttatcctaacgagccaagccgagccgagccagctcgatatccacccctagagatggggtcactgacatgtgagctccgcatgctgattcgcttggtaggactagctttcatagttaagtggtcaaagatattagtattgcagttgagggatacggtaaggttggacacatatcgattgaggaacccaaattggatttgttgcatacgcaacagcgcaggccgcatgagtccgtcagcccctgagccacacggcccatggcgcgctagtaccaagcgttacccgctacacagttgtcgttccgggggaaaaacttctgtatttgttgtaagcatagattcgccgaatcaacgcttccacatttgaagttcgctctccacgcttcacctggaagaagatccacaggttttatgaggggatcgtatcgcatggcactgatagatggcagcaaatgcgagatcgcgatgtgttcttccttgtatcgcactcgcgggctctcctataaggaaacctctcacatttggaaaacgttcttgacgcccttatatatgagcagagattggacatgcgattcctctcacagcgctccaagatcctccgctcctctctgctcatctctctaggtatgtatacg

SEQ ID NO: 5151 - DNA, 1501 bp, Oryza sativa
cttcttcgaaccgacctctcgccgcctataaatagacggcgaggtcccctctttttcacacatcatcatagcttgaagctcttcctctctctcctcccatggccgatcgtcgacgccgtcggtcgatctccccatccgtagctcctcttcccctctcctcgcaccaccggcttcgcctccatccggcgagtccatttttcccctttcccctctccctccacctctaagtcaagtcaccaccaccatcatccatgccgactcatggtgagcccttgccgccgctgttccggccatctccctcactccctccacctgccactaccctcaccgggtgcgcgtcgtccgggaacacgtgtgtccgccggcgtcgcaacctctcgaccaccggagcaccggcgcccaacctctctctcctctgtgttctcggcagaaagaagaaggaaagaagaagacgggagaaggagagagaaagagaaaagaaaaagaaaaggagaacggagtgacaggtgggcccttctacagtacaatttcgtattttctagatttaattcaaatctaatctttagaagcccatatctcctacaccatagatccgattccagtcaaacttggacctaaattcatctaaattcaaaagctacattttgatatcaaatttgctattttactattttatttgaaattccttcatgccatttgaatttatatttgactttcgaatatttcctttttactccaaaatagcctttagccactaaaaagccgccggttgaaactttacgccttccatggggacgttcgcgcggtctactggccccgacgtcgaaccgttggttgtaaagcccggcagaacccaaacccaaggtcaaagtgctgctcctggcaccctacgcctcgacgcgtataacagtcggagcttcactattccctcgaccttcacagcacgccgcatagttagctctcgagctctgtgtgatcctagccgctccaccgccacccacggttgttggagtaacactccacccccaccaaacctataccaacctcctattcctctagccgatatgttgtcggtcgacaccggctagagaaaggtatcaaatctactcgttatgctctagcatcgactagcatacaaccaaccaaaccctagccgatatgttgccctacttcacaatcggcttaaataccaccaaaccctaggtatcatactgcccaaacctaccaccagccaatactagccacatactcacttaaccagttatatcctttattctccaagcaaccaaaacccacacatgaaatataagcgccagtagttgcttaatcccttctagcctccaactctctagaatatccgcataaaatatcagcaccgtaatccatataccctataaaataaaatagatagactatatcctaaaccctagccctcctaactgtttatctctttcttgctattatatggattttattgaaattggttcttcatctttcttag

SEQ ID NO: 5152 - DNA, 1501 bp, Oryza sativa
tggatccacttgccagccttaaagctcgtcgcctgcatcctcctcggctaccgctgtggaccaagaagagggaagaggaggcaatgttgaaccattagagacataagctcgctggccacgctgcttagatccgctcgtagactccttggcagccaccatggctcaggaagagagaaggcgaccactaagcagtagccatagaagcttggtggcatgccacctagatccgcttgcggccccgaagctcgcgcctgtggccttctcggccactgccatggggtgcgaggcggggagatgaggtgatgatgaagcattaatgatagaagctcgccggccacaccacctagatcttctcgccggcctcgaagctcatcgcctacagtcttcttgggcaccaccatggagcgagaagcacccgttctcaacttctcattgatgaagatgcatagggagagagagaagaaagagaagaaagagagagtgagaaataagaggagagtcattgacaagtgtcataactaggtcaatgagccacatcagcgaaaactatcctcaaaacatcatctatatagttattttgtaccagttttaaacttttaatagttagaaaaatcagtgatatttgtgatggggagatatgaatttaatttgggaaactataatttgatgagaaagtcaatgcgttacttatttcgttgcgtatttcgcggaagggatacgggccagaggccacatcacagcaccgtggggcgggtgcgctatcagcgagtgggcgtggccgacgtgatccagcccagtattcgagccgcacacggagcgcgagagaaaacaagacggacgaggccgcctgcctgccgcccgcgccgagcgccacgcgaggggcagatctggccgcccgatcgaccgctatccggccgcggaacagtggagcttgtgacggtgatccccgcggcgcattccgtggctatatatccacttgcgcaatgtcagtgcgggcgtacggtacgtcggcggtatctcgtccgcggcagctgcaatattctcggaacgaccaaggccaacggcgcttttttactgccaaacgggctgcagtcttctttcccgtcgagaatcctcaaggctcaagccagtgtccgtgtcttggtgtacgtacgagccctacacatctactcgattcgatattgcgatgctgcatttattgattactacttactccctccgtcccataaaaaaccaacatagtaccaatgtgacatattctaatattacgaatctagacatacgtctgttcagatttatagtactataatgtatcacacattcgatatttcgtttcttatgaaacggatggagtattactaactgttgcagcttcgctctcactggtggagaaggggtttttactcccggttcgtaacccccatgtactacgaatccgggactaaaaatgtttttagtcccagtttttaatataaccgggactattgtgaaatctggtcga

SEQ ID NO: 5153 - DNA, 1501 bp, Oryza sativa
ggctcctttgccctttttcttcgtcttcgactccctttgcgtttggaagctcgcagcgcttcgatcggcttggcctactgctaatcatgtgcccaaacgtgctgcttgtggagatagcggtagcccagttgtaggctgcttttggaccgaggaatgagctcgctttttagggccgatctgatgagagtgagtacgtaacgtagcagcagtagtagcatcgtgctgtaacatctcgtggtgtgatccatccatatccatcgatcggtggatcggtccggatatactgcagtcaaagctggtgtggtctaagggtgcagcgacggcagcgtacgtacgttgcgtggtcgttgatcgatcgatcgatccgaatcacacagagtcacagctagctatagctcgatcgatcagacgatcacatggtacgtgtagtaaataaatggcattcgatccatcgcgtcgtcgcgagagagataaaaggggcacgatgcagtggatgcatgcagtgcagatgcagatgcagcgccaggctttcgggattcatcagagagctgcccaccgaacaacggacgcttgcgcatgcatgcaatgcatgccacgccatgcatcatatcctcgtcgtcgtggctgctttgccagcttgtttgcccccggtggtggtggtggccggcctggggatcccacaaagcccagcagagagggtaggaggattcagggacagatcgaactgtgcccctcgtgatcggcgaaacccaatggagactggacgagtacccagcagatgagccgcacaagctatagtttggcgctatgcaccagccagcccggcctccacgtccccatatgctgcgtcggagactgttcccggtttcacgtggcctctcttttgacccgtctttgaccacgccccagcaagccagccagccagccaagccgatcgatcgaccaacaggaaggcaaggcagacatgagacatcctcctcgcccccgcgcgcgcgtcgacgcgcatctgcctatctatcccctgcggcggacgggcgctgcatcgcgtctcgcgcccggccggaatccgaaatctagccgcgcgggccagggcggccacaggccacgtaaaaagccgccaccccaccgtacttcacgtcgtcgctataaaaaccccacacccgtaccccttcacccatcatccaccaccaaccgatccatccatccatccatctgccgcaaatctcctcgtcgtttcgccgaccagctctcgctgccgcccgcgtttgatcgagcaagtcgatcgttggttagcgcgtacgtacgtcttggtcatttgcagctgccacacctccgcgccatcactacaaactcgatcgatcgatcagagagtagtgcagcgcgcggttgggcatcatgctgcacgaggcggcgccctgcacgtgcgggctgctctacggcagctgcggcggcggctgctcgctgctgttcccggcgggggcgccgggggaccaccaccacc

SEQ ID NO: 5154 - DNA, 1501 bp, Oryza sativa
ctgccgtgggggctcggcgtcatgccctcgtcgccggcgttcggcgccgtccgggagatgccaagcctgttccagtactactagctaggctaccagcctcatcttactccctcttcactcactagatctcttttctcccctttttagtaacaacaagatgctgtacttctttttgagggcatgagatgctgtacttgaccaacgaccccagctgcatgaaagttgaagctgatatgtatggtcatcaagttttctatactaggctgcattttgtcatcagcgtccattgccatttgtaatgtctattatttgagtaaaatagatttttaaggcaaattagccaaacattaattatatatgcgggtgaagccaacctgctaaactatcatctctttgttgcacgacgattgcaaatagtagtagtatagtactgctgctactaaagtacagtggagccctgttctttttgtgcaagagcatatggtatgacgctgcattaccaggagtaacagtgcctgttcctgttggtaaccatgattggtttccattggaaacaccgtgcacagggtagtacagctagagcctatagagagatttgcacctttttgctgggccctgggagtgggaggatgccccaacggtcaatcatcggtagctgcatatgtcctgggacccgccaacgtaagggcccgcgttttcatagtttctacagttgtaatgtatcagtagtctcgactttctacgtgattctgagtaagaacaagtttaatagtatagccaactactagctccaaatcatatatagccagtataataatcaatttatataatagttacttactatactattaatacttgattctacctgttatacacacattacgttttagaggctgtgctgcagctggctacatatctgtagatctgtagcccgctgcttttctctatcttccttttatctttttaaaatatatttatagttagcttatagcctgctactgtacctgctctaagctgcccgatggaggagcgcccaaactgcagtcgatccgccccaccgctgtgtgtgtctcagtcctcgtttctcttctccggccgccgtgttcgtcgccgccatcccactgactacctcgacatagttgatagtagtatcattttctcaaaaaaaaaaaacatagtgtagtttcatcttgaaaaccagattacttagcccaagttgcacaatcttgattgttgggcagttgggcttagttgatgtatgccgtgtacctgggcgtctgggcccattagaaaccccagaacgtttggtgtaggcccaggccgtgtacttgggcccatctgaaaactccaacacgataacgtggcaggctggcggcgggccccttcccccatgacccccaaaatctgatccaaaccaccatccatcaacccaaccacaccccgcgcgccacgctccgtcgccccccacacacaacacaaggcgttactccggcacctcccg

SEQ ID NO: 5155 - DNA, 1501 bp, Oryza sativa
tgctacatgggtcggtagatgcgtatcatcaaggtgccaaatggccaataggcaatagcatcatcaacaattcacatcttacatattacaatagagtttaaaaatagaacttcctccacgcaaaaaagatagaaacaacatccatttgggtatctccgcgcatagatatctggaaccttactacctcaggagtgttcttcatctggccccctctacatgtcaatggtgtcatgcactgggagaaagagtcatgcggtcaaaatgacaaccagaaatggttgtttctgtaaattcaatacgatcaagggaacacggcataaatgcttgaaatcttctggtaaactatcaatttagggtgtatttagttcacgctaaaattaaaagttaggttgaaattggaacgatgtgacggaaaagttagaagttttgatgtgatggaaaagttggaagtttgaagaaaaagtttggaactaaagtcggccttattgttttcgtatgacgcactatcaatttgtttgacatgtctaatgtcttcgagaaaaatagtttgacatgtcagtagagtgatgtacacaggcatgcaaaggaagcaaatcacataaatcacactaactattttcaacacaatgaaaaatgataagcggagaagactactgttagtgttattgttactttaaatatggtatatatagcatgtgttcctgatgaaggaaatcacaaacatgcaaaaatcgtcatgaacaacaaagaaatgtgagagctgaaaaggcatcacagtgttaactggagaaatgagctgagctaattcaagaataaaggtgataaccacagcactgaaaacaaggccaacaaataaaaatgggatggcacattatggtagaatgcgcgcacaaactggaaatcagtgggcagtgatcctcacaatgctagaagctcccccacaaaaaagtgacagcagcatttgagcatctataacaagaacagatttatatcgagaagaactataggaacaagctgaacaagctaactaataagcaaccaatctgcatgaagttttaattttagacacaattattgaacagccccaagatgtgtaatgtcacagttgcaggaaccaatcatctacaatatgtatatgttagctaacgacatttgctcatattcgcttatctcggggcaaaagatgatactttgaaacaactgtctgtcacttgtacacgggcaggatcgcagtaatgatacatatcaacttctaagtgtcttggcatcatttgcaggatggacttcaatgttcagaagctcaagagatattgattccaacgaggaaatgataaatagttgaatctactctaaaaatatgatagtaggaaatatggagtgatttaatccagagctgaagcttgagcatgttcagaattttcacttcgagttaagggtgattgacctgacagtagcttttctctactgccatgattaacaatttaacagacagcataatttc

SEQ ID NO: 5156 - DNA, 1501 bp, Oryza sativa
ctcggtagtcctcccgaacgcgcgtggacaaagcccctagcctcgccaccacccgccataggcttgccaccgtcgccgctcgctcccggaggctgccgctcgtcgccagatctccacgacgtcgctctgccccatccaacgccggagatgaactccttgaaccccggagatactcccaccgccttgaattgatccctcgtcgaccgccgccgttttccccctttgctcgccagcggcgcgcgtcgccgcaatccgccgcctccggcctctttccggcgaatccgagccgtcggctcgcttcctctcgtccattccctcccccggtgcgctttctttttccattgaggtagcgccttgctccggtgaactcggccgccgtccgccgtccattcggccgcgcccccttcttcctcctcccaccggcccgcgtggctgccacgtaggcgccacgtcggcgccacctcggctttgaccgagccgagccggtcagccgcctccttccttccccccctcgcgcgcacggtccacggtgcaccaactggctgcgcgtgggcccgccacatccttggtccatccggtgctcgcgcgtgaaccgcgctcacccgaaacccttgcgccgcacctcgcgtgcgcccatccctccgtgaaccatgtcgcagacatgcgcgccccacccgggacctcgcatggtgggttcggtccacccggaccgccccctctcccttccgcgcgcccctaatgggccgcctccttgcgcccgcgccggcccaatggctcggccgagcctccttcaacccattgggccgcgcctcacgctcggcctaaaagtccatatttcctccctccgtccaagtcagtgtccatctctcatgagctacaagtccaaatttgctccctctcaattttattctctctcaccttcttgttgaccccactagtcaatgagtcaaagatattcttgagaatgtcttttccaatattccacaaatatttctcttttctataaattcaataaatcatttccccctctttcagaaatcaattccttattccaaaatttcatgaatcattttccttggtcagtgactgtcaataatattcttgagaatattatttccataaattccgacaaaacatttccttgtccagaaaatccacttagacctccaaattcatatccctcgatccgtagctccgatcgcctccgttccacttccagtaattccgtaaaattgagatctatttaatggcactattaattagtctaaataggatccttctttggtcttttgtttaggttttcgattgtttgcgtatggttgcggttgcggattttcgtcgatcgcgggttttctcgaagattcgtgaagcttcgtgaaggccttgagcaaggcaagtcaccctttgatcaattgcccctataattgaaaagtcattattattttgtttgcaacttgcattattagaatcacacacttaacttgcttggcctcggtttgcg

SEQ ID NO: 5157 - DNA, 1501 bp, Oryza sativa
ccgaatcacacagattcgtttctgaccactcaggtcatccatctgccacataggctgattctggttacgattcccacaccacaacaacttttcacaaagcacaggcaaacaaatctacgcaacgggaaccaccttacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaatcctcacataaacataggccattataggtgttcacaattcaaactccaaccacctcgatcggtaattcagcaagcttctcgttcttgcattaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattaattttatttttaaacacaccgacaccacatatcgggttttgaaggcttcacaaacccatttcccaagttttcgacaaacaacggtgtatgtgggatatttggtatatgcgctcagagagcacgaataccgaggtaccacaaggatggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggccttcacgaagcttcacgaatcttcgagaaaacccgcgatcgacgaaaatccgcaaccgcaaccatacgcaaacaatcgaaaacctaaacaaaagaccaaagaaggatcctatttagactaattaatagtgccattaaatagatctcaattttacggaattactggaagtggaacggaggcgatcggagctacggatcgagggatatgaatttggaggtctaagtggattttctggacaaggaaatgttttgtcggaatttatggaaataatattctcaagaatattattgacagtcactgaccaaggaaaatgattcatgaaattttggaataaggaattgatttctgaaagagggggaaatgatttattgaatttatagaaaagagaaatatttgtggaatattggaaaagacattctcaagaatatctttgactcattgactagtggggtcaacaagaaggtgagagagaataaaattgagagggagcaaatttggacttgtagctcatgagagatggacactgacttggacggaggga

SEQ ID NO: 5158 - DNA, 1501 bp, Oryza sativa
ctgccggtgtcggccgacgacgacgcggacgtgaaggttctctctatctctctctcctcgtactcttttgactggtatctcgcaggtcgctagctgggtttatccccccgggtggatttgggatgggatggagtgtttgaggtgtccggttgctttcgggatgaaaagggcgtgaaattggcaccctgtgacggtgaaaccgagtttgtcacatttgggggtatcgttttcgtgcctgtggcggtgaaatttagagggcggagttgctgtaaatgtcattttcttcacttttctccatgaatacgttctcgtgtactttcggttttgatacgtttcatgcatccttaggagctcgtaggctggtagctaacctgttaatcagtagttttattgaatagatcattggaaaatatttttttccttagtaaaagtggccattcccctcttctctttcagctcatgattcatttggttttttagtttctggttgtgtggatctgggttgatgtactattttggaaaatgacattggcacaattctgagttagttagggaccttatcttgtaaggaaggaaaaacttcatacttgcaattccttatcttgtaacagtcttctaaaaaggtgcttttggaaatatttctctgcagagtctgaaatgtgctaatcttatttcccgccactgtgaaatattaaactacttgagcataatgaaactatctcgtcatgggtaggctacttcgaacaagaatgtgctacttctgtgattagtttggttaaaaccattcaagaacgttgtcatttctcaagccacattaagctatgaaaactcccaaccatcaagaagactcaattccttttgttctggtttggtttgaggtgaatactccctccgtcccattttttatggcgcacctttttttttgcaaagaccaagacgtgaaaataggtcacgatttcttctgcatgtgcccctaattaaacactaattaatctagcatgcagatcactcccatcgctcctcttcccataactcacgcatgcatgtagattagatccaaatgtccctgcccgatacgtctgccctctcccgcaaagggtatggcttgacaagccgattaattgtcgggttagttgcatgcggatatccaagcgttagatgcatgcaaagcagaagggcatcatggggaagaaagctacttaatacatgatacgccctgtaatttgggactccgtcgaaaaaaagttacgccttgtaaaatgggacggagggagtattatgcacagattgtcaccgtagttagttactgtgcattgaaagtttcagtaacgtagaatgtaatgctgtaatcttttaaaacatactcttatgacttgaaagtttgttaaactttttggcaataatatctcttttacaggaagaagaaaacttccagcatctcaaggccattcagcaacttgcaacatcagccaatggtgtgtggtctaaaccaaatgtgaga

SEQ ID NO: 5159 - DNA, 1501 bp, Oryza sativa
tgcgtgggatcgatctctccctctcgctcgctcgctcgctcgccctagcacctcgcgggcggggcgtcgcatgcggcggcgcggcgaggcgaggcaaatgcgggtggattcgtcgctggcggtggaggagaggtgagggggcggcggcggcgatggcgatgcagacgatgcagacggagcagcagcagcagcagcggaggaaggtgagaggaggtggcaattcattttttgttgcgcggtgtttctcgccgggggtggttgggtttttggtggagggtggtggtctcatggtcatgggtggttggcgtttggagatcggtttggtcgtcccgcgggtcgagacgatcttgagttatatggagtcgggggattttgtgcaaaagaacgatttgtttcccttcctttctttctcgtggagcttcggattcggatgcgtacgagcgtagtaagggtttgttcttgccgttgttttcctccgcttttttgctcgacttttatctgcggatgactccgtatgttggattgtggtgaatttcagtggattttgagctctgcagtcgctgtagttctcgattctcatgttccatttgttcgcaaaagagatttttcccccctccccttcgcctttctctggatcggaaattatccgaattgtcagaaggttctctattcgatttaaccgtggatgccttcttgataatatctgaaaccttctggtgctgggcgacgtctgctttttgtgccctcgaaaggaaatgacatcctttgacaacttttcccgagtcagtcgaatactcattgcgccttgatgaataactagtactccaattcagagaattttcccaccccacttctaatccgagataacactccaaggagagaagattaattcagatgctacttagaagcatcacaaatgcggtataagattcgctgagtagatatgtttatcctaagccagctctgcggtctttcttaccttcctggttttttttacttgcaagaaaagaatagccaatcattttaattgtcccagtggattatctaatcaatatattccatgcccactttggaggcatattgatcgagatggttttatgccccagaggccaagagcacttcttaagagtcattatttggctttttttttagtcttgttcggtcttaggctttgattgtttcgttttgctcattgctggagagtggagactaaggagtctttgcatcagaagggcaggtgtagctactgtcttttctgatacatcagctactagagtccagttgctcgttctaggatctatctgagtttgttgaactaggatctgtctgaatttgttgtacgcagattaaccatctgctgtttcagtggtctgttagcaagtactcttctatgcattcaaagacattagctttgaattatatactccctcttttttaaacaagctatctccagcatagtgttaactcaatttattgacttatgttcagggttcgccagaga

SEQ ID NO: 5160 - DNA, 1501 bp, Oryza sativa
ccgggcatcagcatcaccacggcgtggcccgagggcgcgccgggcgcgcgcgcgacgcggtctaggcggacgccgccggcgtccgcgagggcgccctcgaggagccgcccgttggcgtcgtccccgacgcgcgccacgaggtaggtgggccccgccgcgaggcggcccccgcaggcggcctggttggcgcccttcccgcccgcgaggctgcggccggcgcgcgccgccaccgtctccccgacgagcgggaggcggtcgacctcgacgtagatgtcggcgttggcggagcccacgacgacgatgggcggcgccgccgccgccggggcactggcggaggatgacagggaggcggagggcggcctgagggcgaacgagaggctgcccggcttgggggtggatcccgggaaggaggtcgtcgccggcgatagtccggcgagagggaggcggaggcgagcgtcgagagtaggcatggctgatcgatgagagagaaagcgacggtgtcagcgaaggtcacggggtggactaaagctcaagtctcggatgacgatgatgatttggctaatttggttttggatcagagctcaaatcccctccctgatctgctggaaattccgaatttccaacagatttggttcgagactttggctctatcggcctaattaacatatcctatacacaactactccatccgtccaatataaacattttggggcaattgcaaatttaccactactttgaatcgttattgcaaaactgccactagaaaattgcaaaaatgccactagaactgtcattcgagtggtatccttgcaatattcaaaaaaccggtggcaaatttgcaaatgccccaaacatttttaagagctgaacacgattattaaaaaaacatgtagaagaagttaaaaaaaacaaaaacaggtaaaagtgaatggtgaagagttgtgattggttgagtaatggagatagattggaaaagtaaatggtggatgattgttattggttgggaaaagaatattgggggagaagttatattttgggacggagggagtagtaagtatcctaaaagaattatataaaaaaaagttgaacacatagctctaataatattacacatatatataagattttatcttcaaatttataatattttagctcacaagactaaatttgaataaaattttactcttaaaactgttatttttttattttattatggctaaagtataataaatttgaatatgaaaattttatagatatgtgtgatagttaagagtacgagtaaaaattttcaattatcacatctctagattgcacaaacgctgttaaaaccaggaacggtaattttcctcgtaacaaaggcctgacgaagttgacctgggagcctggcccacacacgcaacgtttcggcccgtagcaactataggctggaactggatcgcaactaagaaaaaagtacaccgaaggtccctaaacttgtcatcgagttacaaaatcatccccc

SEQ ID NO: 5161 - DNA, 1501 bp, Oryza sativa
cgatcgagcacagctgagtgtagtactagtatgcctgggtgacacggagagtactgaaacgtaatccctccgtactaataaaaaaaatcgtttagaataatattttaagtcaaatcttaggaatataaatcatgaataactcttaagttattgagtttgaaaatatataaattatatgaatagatttgtcttgaaaaatacttttataaaagtatacatatatcacttctcaataaatatatttatagaaacaaaaagttaaagttatattttagagaccgtgtcgttatccaaaacgacttcctttacgattaccggagggagtacgtgctcgccggcaaggagaaccgtgcaaattggaatttctcgctgcagaaatccaaaacagtcactagcaaccagagcatttctttacatgtaaattggaccgacgtatcggctactgcaggtcagcaattatatttttaaagaaaatttgcgtggacgccgtgatgactaatcttgctgggtttaacactgactaggacaccaagtaggtctagtcttaaatttttaatgtctcatgtacgatgaacttagtaataggtggtgatcgaaagaacgtaacattgctgaagtatatagatctccaatacgaaaatattctctagaaaagatcgcaaattattagggaacaacgaacacaattttgaatgtttggactaaaatacttgatccatatgcatgcctatgtggcgtcttaatccacgtcggcctcaacaatactagctactatatattatgcatgtgttaatttggttttagttcgcacgcgctagttgtacagattcatgtatagaacacgtattttgtaagcttatctaccaatgcactcagctcataaaattgtactccatccgtttcaaaatatttgacaccgttgactttttagtacatatttaactatttatcttattcaaaaaatttaagtaattatttattattttcatatcatttgattcattattgttaaatatactttcatgtacacatatagttttacatatttcacaaatttttttaataagacgaacggtcaaacatgtgctaaaaaatcaacggtgtcaaatattttaaaacggagggagtatattgctagtgtaatttacttttcttttaattaggctaaagattgtagttcagttcactcgaacagtcagttagatagtgacaggggcggagctatagtgtagcggccggtgtcaggcgacaccgataactttcggtaaaacctatagttaaactgcttatccacatattataatattatgatctaattataattagcattctatgacaccaacgaattaattttctggatccgccactggacagtgatgttctaatttaatttgcaaattgcttgatttgggttgcttaccagaagtgccatgcagctatgcagctttccttttggcacgatgtgtatgcacctgtagcaccttgacgacggggtgcagat

SEQ ID NO: 5162 - DNA, 1501 bp, Oryza sativa
aggtacactatctaaaattgttttacctaatcaaattccatgacatccaatacaaagaagcataaaaacattgatctccaatatgaaccagttactgatattgttctgaagtaattccagcttgctgccttgtatgataggcaagtcacataacctagatttataagcccaaaccaaatctagtcatgttgcaaaggggattattcattttgttcagcaaagaacgatgaggattaactacagattgcaactaaagtattccgttcatcctcctactactagatcatatgaacaataaccatttcaaggcatctaatacctagcaaagggcagcaattgggactgattcgtcaattccccggataatcaggtcgatgagaagtagtaaggagacgtacttgtgggcgcgggcatcgacgccggaattcttcgcgccgagggggtcaccaggagcggcgcgcttcttggcccggcggaactcgcccgaggcagcagccgccgcggcggcgtcgtgggcggtgggcttgcgggcctcctcctgggtgcggtagagctgcgccttgaggtcgaggatggacgcggcgccgaccccctcgatggccttgtgcttcttcggcatcaccgccgactccgtcagccaccccagcgactccatccgccgctccctcgtcgcgcccccctgcttcccgggctcctgctcctgcgccctctgcgcggcatccgtgtcctttgccgaagccgaaggcccgctctctcccggcgacgacatcgcggcggcggcggcggctcggggagggatcggtcgccgccgactcgccggtggggaagaagaggaaaggagaggggaggtcggcgactcggcgaagtgggctgggctggagtttgtactcgttttgatgggcctcttccacgagatgcggcccaagtcgctggctcagtgggcccggcctctcagtggacggagctcaaacatgtggtgcgcgcagcgcggcttccctctcctctcctcttgtggttggaaccgtgaaggccggtgacgcaagctcgctcgccacgaaaaaaacgggaaaagggaattgaaatcgaatttttgtttttgccacgaccgactttccagcgaagtcgaggaagaggaggaggagagggtgagccatggcgtgcagcttcccgccttcgtccgccacgaggctccaggccgtggacgcggcggccgtgaggagcagcagggtgccgcctagggcggcgaccgtatccccggtgcagagatcgctgggcgccggctgcaaggccgcggctgccgcccggcaggaaggcgcgacgcaggaccccgccatctcaggtacaccgtacacctcctcgacttcgatagttacctctggattctcatatgtgtaggattgaaatgtcctctaggaaaatgtccagagaagatgtgaagatctggcatgtaagctagcctaactactaataattagtagtccacgaactgcttcagtgtctc

SEQ ID NO: 5163 - DNA, 1501 bp, Oryza sativa
cgacagcgaccgcgtcagccccgccgccagcctcgacgacgacccgccgccgccgccgcccgcctgcagcttccaccaccgctgctgccgcccgtgcacgcactcccgcggcaccatcatccgccgcagccaccctccccgccgccgcggcggcttctcctcatcggcccccgccgccgccgagccgtgcagctcgacctcgacgcccactggcgtgtagtgcccccgcctcctcggcaccgccgtcgtcgtcgtcatcatcctcttcacccaccctcctcctcctcctcctccccgccgctgcttcactccccccatcgccgccgcctttccaccacactcatcagtcgccgccggcgccaccgccgccgcaatctcggcctcggcgcccatggccgccgccatgggagaggaagaagactcttggaggcggagacgtgcagcgcagggacgggacgagacgaggcgagatgaccggggattggttggacacggagcaatataaaggagacgaacccgtctcgtctcgtctcggctcgaggagatgtgatttggattcgagcctgcttggcgccgaaggctcgcgccagccaaccgcgagtttatgcttactacttacaactcaccgtcagctgtcagggtcgttgccggtttgatctgcaactgcaaaccgccataaatccgtgtaaacaaatgaaaagcacggagtactttattagagttcgtgttaagataaatctccaagattaatctaatcgcacgagctgtacaggttctagaagcatattggtattggcattgggcagcaatcgatcgatcggttgctggactctgtttctgttcggctggagcccggctggccgtgacagcagagcgtatatacgtgcaggcctgcattactacatacaacgctaccctgcaactttaggttctgtctctctaatccttctcgctgtatcataattcggtgcaattttgaatacgtcccggccggctttgttgggtccttctcttcggatggaacggtttggtcaaaatagacaaaggctgcgttaatttgggtgataggaagtgagaatgcacatcgtttttcgcgcgcacgcttcctaaactactaaacgatgtgtcttttgtaaaaattttctatataaaagttgctttaaaaatcatattaatctatttttaaaatttaaaatagttaatacttaattaatcatgagttaatggctcacatcgttttgcgtatcttcctaatctactcaatccccttcttctcagacacaccctttaagtggtttggtttggtagcctcgagccgcgccgatgataaccgctagtcaaaggctcaaagacaaattgggagcagttgcccctgaaattgtcagttacttccaaattcaaatgatttagtactatgagttcttttcttcacataattttcaaaaactggcgccccagacaaggccaaacggattaagacaaaataatacagtcacgcagt

SEQ ID NO: 5164 - DNA, 1501 bp, Oryza sativa
atgtcacacacgtcgaggtacacaccgctgctctcggctactagctgcgttgcaataatactacgagcactgttgcgacactttagttggtactgtgtatttaagaagctgcatgtgctgtggcctctttctcgcgttccttgcttccttcctcctcctactgtgaaagtgaaactgcagctagctgagttacgttgtcttgttgtttagctatggcgcggtggtggtggtggtgcatgggccacgtttctcaaaatcatctgcgtttatggcagctatagctatagactagagtatcctcctggtcctagttctgaacattggaaattttgctgtagtctctccactaaaaacgtcgtttcgttttcatttgagacaaaaacgtcgtcgcggtcgaaccgttaaaaaaaaaagtttctagataggactaaacgaaacatctgtacagttaaaattcgcaatgcatttcccgtgaactttctgaattttaaccggagcagaaacactgaaacaggcaggagcagcgatcgatcgggcttacttgttgcggttgcagcgtagggagggaggggatgccgccgagtcgccgaccgccccgcctccgcgcccgcgagctcgtcagaaaccgcgagccaacgccgccttggtcgccgccggctccgcggggagcacgcgaggcatggagtgggcggcgagctcctccggctttgaggcagctggggaagttcgcgagactcgcgatggctatttgagcaaagaagacgggaggggagagagaagtagagattctgtttctcgggacaggtttatatagggaatggcgactgctgttattgtgcatcggaaatgtgatggaccggagcaaacctctgacgaagatgatggacttcatttctttctttacaaaaacaaaggaagaaataaaaaaacatttttttcctaccaaatgccaaaattttcaggtagttctctcgctttgattgttttttcctatttggtaatggtaagttgtcattttcttaggtggaaaaatggtaaagtttcatatataccattacatttggttctccgaaggctgaaaataaaattttggaggcataagcaatgataaaacctccaaattgttacttctaaacaagaaaaacaaatactccagccacagaggtctttttttttattttaattaaaaagtccgaatgtacttagtactactgattagtgatgagcgatggtaagtactccatagaagcgaagatagcattaacgtgcataaatcacgataaatcaattgtaatatgccatagcactattgtgaggataatacatattctataaatgtaaaataaataaattaaaagagatcgaaaaatacaataaatatgtcttggcatttaaaacaaataaataatacatgttgtcgacgtttgatgtcgcgattccggtatttgtatagtatggggatcgttggtactaggatatatgcgagactgaggtaaaaaga

SEQ ID NO: 5165 - DNA, 1501 bp, Oryza sativa
tcgccagctaggaagaaacgcgagacacgggcgatgtatacaggttcgggccgctgagaagcgtaataccctactcctgtgttttggtggatctgtgtatgaaggagctacaaagtgtgagccgacctctccctcgttctaggctctgaatctggaaagaatcaacctctttctctatgggcaaggtcctccttttatacttcaaggggataccacatgcacccctccctttccaaactggactttttctcttttcataaatggacggagatttgcacggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccacacgtcggctcagcaacgtgcatgtttgcccttcttcaaacaacatcttgcttgtaatggttaggatgaagcctggcatatatcgatcggggctaacgtgtcatctctgggatgtaacacgctagctccagccggggacgagtgcctagaagctctcgtctagacaggatggggcgaagcatgcgtctgaccgcctgtcgccacctaacccgcgatttgaccggtctgtgactggtcacagaccggataatcgagtgcactgcactgcacttcgtgcggcgtgacacgcttagccgaggcgcaataaatgcggttaggtgagccctgctgtgctcacctaacccatacacgtggagtagaaaacgcgaggggtcggggcgcctcgcccctcgggggcgaggctggagtggtccgaccccccccccccctcgggaagaccaagaggtgggcgcacacatcaccctcgggcccgacgtccccgagggtgccaggccacgtgggcgattgtgtctgcctcaagcctcgagtcatgatactcccggtcccatgtcaccgacatatatggactctagactcgtcttttaatatttctttttttttaatttcgaattttttgtatttctatatagactctatgctcttcttccaatattatttatttttatttctgaatttttattatttctaattgtatttctacgtggactctaaacttatctttcaatattctttaatttttaatttcgaattttagttagttctaaaatgtatccatatatttatattctcatattgaccttaaactcttcttcccatgtttttcttaattttgaattttagttatttgtaaattgtatttttatacggagtctaaactctacttttaattttattatgtttattccaaattttagttagttttaaattcctatatgactctgtactctatttctaatatttcttatttttttaattctgaatttctattttttttcttaattgtatttctacatagactctatactctacttctaatattccttatttttaatttcaaatttctattatttcctaattg

SEQ ID NO: 5166 - DNA, 1501 bp, Oryza sativa
caataagtaaaatcagtgaaacaaaggaaatgcgtcaaaaaatggttttgtaatatcatcatttcatcattgtggagcgttgagttttctggtgtctaaactcttgacacaaattcgctattccctaagtgtaaaagtcacgcaaaacaatagttggcagtaaaggtccaagtcacagggatcccaaaaactttttgatggtcaatatatagtcatttgcacacgattctgacttgccaattaaaaaaataatggtgtcatgagcattggcccgagaggccgaggcccatggtcaacccagattctaaaaacaggttcatgccaactttagcactaaattcagaaacaacaatgtcagaatagctaattgctacaaaaaccatggatcactaggagaaacaaggaatggcatttagtggacccaccgactataagtaggctaaacatgttgggaaatgtaaattattcaggctcatactctctcctctctttctctctttaaaaaaaacaagttgtacagttctactcgtgtaataggatgatgttttctccaatatgctgagcttccatttgtcattctccaaaaaaagaacagtgccatttgtaaggtacttacttcggagggagtcaggaaccttgtgtatgggtcacccaggttagccagcattttctgaatgatatcatgggctctggaacgggatctgattgaggtttggacaatatcttgcttctttttctgcattgcattgaagcgaagcaattagccaattagcatattcaagatataacgtttccctgagataaatctatggaggataaaatatgttcagaagactggccattccgactagaaatccattaatgtacaaagagacttccatataggcaattgaaccacttcatagttcatattcaatcatttgttaagtgctcaccatccacatctccggcgaccagggacggcttccggcgtccgggaggaacccctcgttgaccacctcccacgcctcctccacgagctgctcgttcgtcaccacttcgctcctcctcacctcctccttggtctcggcggcggccccgtcgcggcagagctcggggccccgcggccgctccgcccccacggcgtcgccggtgaggagggagagggagatggacatggcggccgccgtggccgcggcagcggcgcggagggcgtcggggaaggggagcgcgcacggcggccctggcttggtcctgcgggtggcgagcgagcgctgcggcggccgcggcgacggcgcgtaggggagtagccgcatggcggcgtggcggcggggcggcgggcgtgggagccgcttcggattagtggtgggagttcggagtggatggggtagagggggatggcccggctgtgcaacacactgtcagagattttagctcgtggagatttcataggatttttcttacgggaaacaatcatttttctcacaaatttcatgaaatttctctatttcaaaggaggcct

SEQ ID NO: 5167 - DNA, 1501 bp, Oryza sativa
gaattaaattatttatagagattttaattgaattataacgcaataaaaaattattttaaaaagaaaaggagatttattgcgtcagcaggcttgggttcatggtgtaccgggtgcaccgaaacggtccaccacgtggcacgggcgaggcggggatgcggtcgacgtggcactgacgcggcgctggcgtggcgatgacatcacaacaacattaccaccggtggcggcggcggcggctcaggacctgacggttagcggcgaacgacaacgaggcggcgcaattggagggcaccggcgggtagagcgcgacgcggaaaactcaccagtggctcggatgacggcgaactgtcgaaacatgaattcggcaataataaaagggggtagcgcacgaggcctaaaagtggatggatgcggagacaaggatttagacaggtttaggccctctcaatgagaggtaatactctactcctgttttgggatttgaatccgccaagtacattgtagatctgacgatatggttgtgtgtcatgccccctagagggcctcctgcccaccttatataggatggggggcaggattacaagatagaaaccttaaccaatacggtatcggttccctaaatctactttacaatcttatcaaaccaggactttaggccgttccataatatacagggaaacgtaatacccaagtcatgatccgttacatattccatagatataagttatcccctataaccagtcggataactatgccgtgtgggtatggggtacccataatctctacagagcccctgagaccttcatagtcgaaaagataatcttctctcgaaccagattactccaaagccaagttcttcaatcatctttgccatggtctcccgagtacttttaccaaatatgaagactatggagggctgaaaaataaagtcaggtgcatcgactagatgcacctaataggtgtagccctcgactatgtggttagctgaacaaactaagcatatagtcaaggaataaataatccaaccaaccgagtggttttgataattgtaatcaaccaaatgacttgatatcaatatatagcatatgcggtgtgaatcccccaaataacatgatccaagtgatataccgactgctttgtaaaatatgatgagtgcaacctaaagttgactacatcattgaaaataaaacagctataaagaagcttatatgctgtgaataaaaaatttccaaagtattgggcacacaccatgcgcacactgctttaacagatgtgcttaagtccctaaaagacacatggtttcaccacacctggaaatatatggcatatgtggtatgaaatccgagtaaataaactcaaaaatgatttaccaaccgcttggaaaatgaccacaatatataatcagcctaagccataatattagtaaataaaaatgcacacttacgtggcaaaaagcaacgatattgtatccaatcaattgcttaaaaactcaaacatcaccttg

SEQ ID NO: 5168 - DNA, 1501 bp, Oryza sativa
gccgggctataatactttgctgtcatagctcctccaggggtggtgatgagcagtgagttcctaagcctttctaaccccagctgatttctccccacgaattgcacagatataaacgagtgggaagctccagagtcaaacaaaatggtagcggggatggaatgaatgaagaacgtaccgatgatgacatctggagttgtctgcacatcctctgcagtaacatggttcacacgaccccgagtggcatcctttccaccattgttggggcggggaggcgcttggccttcctaacgcctcggctttgggaatttatccgcgaagtgcccaggctctaaacagttgaagcacaaacgcggctgaccttgaacatccctgcgtccatgactaggctgcacggccggtgcagggggacggggtgcacggttcccttgctgattctgctgttgctgcggctgtggaacgcgtaccacaaattgaggtcatggcactgggcgaggttgttgctgctgttgttgtgaggaggatccccctggatagggattggtgtagcggatcctttggttagccccctgttgattacggaaattcgccaagcgacgtttgtgtgactccagttccttgtgcttggcctccaggcggatgctcttgtccactacgagctggaaatcagggtaatccccggagaccagacgcacagaaagttcagggtccattcctactagaaacttctcctgcttttcttcatcttcacgaacatcctccagggcgtaccaggccaggttattgaactcatgcaaatactccataacagagcggttgccttgcttcaactcccgaaattccctcttcttaagggccatgactccagctggcacatgggtcctttggaaagcggcggtgaagcgggcccaggtgattggctgtccttctggctgcatagcctggaagtggtcccaccatagtgatgcgggcccttgcagctgatgggttgcgaagataactttttcctcatcattgcactggacggtgtccaactttttcccaacggcatgcaaccagtccaaggcatcaacggggttattggagctagagaaggtaggcgggcggatgtggaggaactcggcaagcttggagtgctgtgggggtggtggtggtggtggtggagcattgtgttgcggcggagtctggatgtggtggaggaaagcagccatcatgttggcctgctgagcgaggatttgggtgaggatggggttggtatcgggtggcggtggtggtggcggagggggaggtggaggtgggctgccatggttgttgtggttgctgccttcggggtgactgccctcaccggtagcagcgcttctcctggttgtcaccatctgaagattccacacagaaccagcaaacagaaagagctgacgattaaaactaaccacccacgactaccataattcttgaatttatttctgctattaaattggttcattaaggttgaagttgcttatgc

SEQ ID NO: 5169 - DNA, 1501 bp, Oryza sativa
cgcccgacggccgcctgcgcgcctcgcggccttcggcctcccatcctcgagcaacatcacagcaaccgagcattcgagcaactgcaacggtgagtcgccgagtcggtgaactgaagtgtattgattattttagcttcatagtttatgaatgactatctagattactagattaggatttaggaaccaccgaacctgtgctgctttgctagtttgctcaattgctctttgatattgttgtttgtaggtttgaaacatgaagagaaaaaaagggtcccatggttaatttaaagagtttttttagaaaaagttgctaaaaaaaagaaatcaataaccaactggttctttgctcgcggtttgtcaataagacgggacaaccagttgaacggtttcttggtcttggttttgtatgctcaataaattaacgcattcaatttatggtcaattctattcatttataactttatgaaaacatgtttatacctttacatattatacaactattagaccttgggtttgaaaattttctctctctcttacaatttcgaatacccaagttgaaaaacctgggcccgatctcgtcgcaactccggttcgtgtagttcggcgcatcgccatcgtcggcgggggcggcaggcacccactgccgtggaagatgtcgcagtctccacttacgagctgcccacgagccaaacaaggtagagccctacaaggagtacaattggaagcctgcgggtgcgcagtccatcaaaagattcaaaaccatggccatagcagccgcaacatccctcggcccatgtcatagcctcaaagagacaaatacgtgcgcatcaggaataagttcactttgtgaccctcaggagtgatcgaaatctaatccgtgaccctaaaccacaaaaccggatatctcgacccccaaactcttaaaaccaatacaaatttactccctcggcggttttgtagagcggtttcactgacgtggtgcctacgttgcgatattgaccgagtcttcgttccacgtggcattgacgtggcacttacgtggcattagaattaaaaaatatgcgtgggacctgtttgtcattcacacaaaaagaaatgtgggcccactaacatgtggggcccatatgtcagtcctcccttcttcctcctccctctctcccttctctctcgttctctcccttcttccccttcggcaggcggcggggcatgggccacggtgtggtggcggcggcggtgggctggagctgatacgggttctggagcagggagctcatcctcccggtcgacggcgacggcgatgatgtagacaagggagcggatgaggctgggtagtcggtgccgcgatggggctgaggctgaggctgcggggggagctcgtccggcgggtctatggccgtggatctcggctcgatgaagaggcggtcgccacccccctctggcggtggtgccacggtccccggagtggagtcgacgatgctgaggccagcgctcggcgagatgg

SEQ ID NO: 5170 - DNA, 1501 bp, Oryza sativa
atcgcaggttacctattaatttgaactataaatagatttatggattgacctacttgcatctctaagtgtggcaagccgggtcaagatgtagaaacccgcggattaccatttatttaaactaggtttgcggatcgatcagcttgctttcatccctacacaccgcctcctcgcgagctccttccccttctgacagccgcgtgcagcagcccagcggtagtgttggagctgctgcatgctaccacatggtctctatggtttgcatccgtggtgccccggtaagcgaggcgatcgagccgtcggtcgtcgtcgttagaaaaggcggagatgtcgcatgtcggcgagcgcgcgggagctcgatggcggtgcaggtttcgatatggagcaaggacatgacgttctccttatatgcgcgacattctggcggcacggccggagcacttcaacgacgcgttctgcatcggcaagggagcttcgtgagcgtgtacaacgccgaacgtactggccgatcgacgggcgctctacagggtttgcgattttgaaacttgtgtttctactagtggggaccaaaaacccaaaatcaccaaaatttcagtaattttggattttttttggctgaatttttttaacttttaacatattttgacagaatttaaacaaattttaaccaaatttacaaatgtttggcaaacaccgaaaatttcaggaagattttgaccttgctgttgggggccgaaatttcgaaaattccaaaccatggcgctctatcgccgttaagccgcggctcgacgtgtagtaaaccggcgactgctgggacatcagtgagaagagcttggagaattgaacgagctggtgctgacgcgcgtccgctacgggaacatcgtcaagctccaagtacggcttctgcgccatgagcgggtacatgtacctggtgtacgagctcggcagctcgccgagagaggcattgttagcgaaagtagccattgtactgtagcgaaacctgcaaactgaacgagctaggacgcgagagagaagaacgaacacgacgaagtactccacaacgctgatcaggaccgcacatcttgcaagtcgtgagctgactcaaacagactctaatgcaaaaactggggagagtactaattaacagaaaataacagaacacgaaacccagatacctacgtatgttttttttttaaaaaaatacgaattaccccccctccccgcgaactatcgcggtcgtccgaattactcccctgaaccacaaatccgaacattctttacccccaactatgcaaaccggacgacttaaccctctcgacccaatccgcggtggttttggcctatgtggcgtgcaggtggcaatccagtcagtattttattttatttttaatggtgagacccacatgtcagacccttcgttttctcttcctctctctctttctctctctcttcgtcggtcacgacggtcagcggcagcgcgcgcacggccggcggccggcacgca

SEQ ID NO: 5171 - DNA, 1501 bp, Oryza sativa
tggatccgttggaaagaggactccgaaagctttccatcaaatactcatcagccggaaatggaggtcgtatgcagatttggcggccatttaaagtcagcagtatagcaggtggccgaatcggattccagtactaggaggactatcttgatattttcttcatccatgatgtgagcaacggtatccataatagccatggtcacatcacgctgccacgccaaaaggttcagttttcaaaaatactttttggattggtctattaataaaattaaaaaaatcttagaaaaaaattcctggccatgctagcttgttaaaaaaatacgaaaaagtacgaattaacccccccgaactatcgcggtcgtccgaattaccccctgaaccacaaaactggatattcttcacccccaactatgcaaaccggacgaattacccccctcgacccaatccgcggtggttttggcctacgtggcatacacgtggcactccagtcagcattttattttattcttaatggtgggacccacatgtcagacccatttctctcttcccctatctctttatttctctctcttcgtcggtcacgacggtcagcggcagcggcgcgcacgccggcggccgacacgcatggcgcagcgcggggaagggcgatgggcggcggcacgggggcgggttggcggtcggcgcgcggggaggtggaggggatgggggagaggcgggcgccggcgagtcgacgagctcggccggctcaggtggcagcggcagcggcagcgacagcgtccgcggcgggacgtggagcaaggcagcggcggcgacctctttccccaccgtcaggctggcgcggagctcggacacgccggcactacggtggccgcccccttgcccccgcgccaccgtccaccgcagttgccgcactgccgtcaacgcgtagctgatgaccccgtccaccgtggtgttgtaccgtagcccatgcgcccacaggacctcgtgcgctgcctccaccgcagttgccgccgccgccgctgccgctgccccgccccgacctgacgagcgggaacggcctcgtcctcctcttctcccccactcctcctctcccctctcctccctcctgacggcggtggagggctcggccaacagggcaaggtggattaggggcgcaactgtgcggatctgacggcagtggggaggtgcggtggctgtcgcccgtgcggatccgacgacggccgtccccccgtgtggcgctggcggatctggtcgtgggaacggcctcctcctccgccgtcgctgcctccctcttccgcctctcttgctcctcctccgccgtcgctgccttcctctcccccatcccctccacctccccgcgtgccgcttgcgcgccaaccgccggcccgccccgcgccgccgcccatcgcccttccccgcgccgcgccatgcgtgccggccgccggccgtgcgcgcgctgccgctgaccgtcgtgaccgacgaagagagagagaaagagagagag

SEQ ID NO: 5172 - DNA, 1501 bp, Oryza sativa
gaactctccaaaccctagctttttcctcctccccctcctccgcgaatcttccatgcccgacggctatccggcggcgccgcccgggatggagcgccctgccccggaggcggcggctgcggcggcggagccccctggggcgaaggcggaggaggaggaggaggggccgaaggatgtgggggtgaagggtacggggaaggagaaggagacagagaaggttgaggccgagaaggagatggaggggaaggggaaggggaaggagtcgatggaggtggaggaggggaaggagaaggagggtaaggggaaggcgaaggagaaggagaaggagacgaaggtgaaggtgaaggaggagggtggggaagagaaggagaaggggaaggttgaggtggtggaggcaaagcggcggccggctggtgttggcgcggagacacccatcctagcggtgccgatggtggccgtgccatgcttcttggcgtctcctgcatttgcggtgagtggtgccatttctctttgtcactaactaggggcattttgttttaaggcgagggagagatccatgggcggagaatattagggttttgatgggttgggttcacctcggtcaggttatccgtggcatgttagtgatgattttattctggtcactagttagcccatcataactgcagctaaattgtagcgtgatgccatttctatgatacgaatcgctagaaatgggcaggtttgcaatgccgtatcccctctgtctgtttgtgatagattttgggaggccacctgcattggatttaggatattcttgatactctctatctgaagcaagcttagttgatggtaactgtgggaaattatgcactgctattgtggggggatatggtgtaacgttgttttattgaaaaataacttcctacatataattgaacaacatttacaagactgatttccattatatatatatatatatatatatattttttttttcatcatactgcctaatataatgctgtgtgatgtaatggaacatgaaattccattgaattggcataagtttacatgttaaggtatgattgaacaaattaatattgtactagtagctattctgtttatttaacactatgttatgctatctgcatgctatcttgttagtctttagttgaacacagataataaaacttgaatatagtccaatgagaatcccgtcaaatcccgtcaaacttgaatatagtccatatcaacaaagttcagattatctctcttttaactcgacatatgttctgtattttactttggtggttttcttacatgtgtgcaaataatcattatggaaactagggtcacttttcaatgagccatcaagcagctttggcgagtgtgacggctcaggcacaaatacaattgcagtcaccaaccacaccatattcagaagggctgcccagtccatttcctataacacctaaagctgtaatgcccctgcagcgatcaccttcaggaactgaagggagtgttc

SEQ ID NO: 5173 - DNA, 1501 bp, Oryza sativa
agttaggcagcttctagctgctttgccacacatttttgagccaaagctatggcaaggatttcgttcgccacacttttggcatgtgctaacttgaggtgtggtaagttgaaatacccaaccaaacaggccctatatataggagaaatctaggagtcctagtggggaaagacttagagtcatactaggaaactaatcctaatagtcaacttctattaggaaactaatccgaatatattgtaggcccaaaattcgaatcacatatttaaaagagatttctgaaggaccataaaattccttatttcgtataaactatctcctaattaataagaagatggtgtgtgtaaaattaggagaaacgcctatagggttttctggttagctctatttatttgatattaggtctttccctaatagtcatattttttttataaaattagaagcatgtttagcacagctctagctccagctccagctctacttctcctagagctataactagccaaacagtttcagctctctcacaaaataaactagagaggtggagctggatttaggtagctccacaactctactctagacccaactcctgtaactaaatttaggatttggagctctaccaaacaggccaggccatatgaccatcacctctaccgtgaaacttgctctcatagcctgggtggccatagcgaaatcatgcgctcctcactccaagtcgtcgtcgtcgtcgagatgacgaggagagacaaacacgcgcctttttctagtggccgcaagaatcaagatccatccaccggcagagaaccgaaccacgcaagctagctggtcgatcgatccatccatcgacaggcggaaaaggaggcaatcgattccctaatctcgctaccgccatccgccaagcgaagcgaagcgaagcattgactcctactcctactacgagcggcttaaagtgaccagtaaccaccaccaccacgccgcggccgccgtcgccatccgcgcgcgcccccacctgcctccgctcccactcgcgcacgcggccaccacccccaccgatacgcttctcctgcctgcctgcctgctgctgctgccgcgcgccggcagggagaggagaggaggaggagcatcgcttccttgcttcctcctcacgtgccttgcccccgccgctaagtagccggcttcctaccgaacaagaactgcagcgagcgactcgggaggaggaaggcgaggggatatgcagcagcagcaggcgtgggcggcggggcttggcggcctcgcggtcgccggggtcggggaggagggcggcgggggaggtcccgctcccaccaccgtcgacgaggcgtccatggagcggagcaagagcttcgtcaaggcgctccaggtaggcctgccggccggccggggacccggatccgggagagatcccgcggcgccgcgaggctcgttttttttttctttctctgaaatgaattgcagttcttgattcttttggttgaactgatgtcgc

SEQ ID NO: 5174 - DNA, 1492 bp, Oryza sativa
tgccttgaactccactccaaaattcaaaccggagggcgtctccgcaacggcacgcgagtcccagggtggaagccgcaaaaacgggtggcctttactctactccaccaccacgcctccccttgtcgcccccctctctcccccctccactctctcttcctccctctcctcggaaggagcccctgaatccccaccccagcctcgccggcgacgatgaacgggggcggtcgccggcgatactcctcggagcagctcatgttcgacgtccccgccaatgccgggggcggcgccggcaagtggggccaggtacggcgtgcggggttcttcgagatctacgcgtgggggtgcggccgtgcgggatcaccgggatgagctaatgggtgtgtctcgtttgtgtttgtgtgtgcgtgtgtgtgcagcgcggtggggtgcggcgcggggatggggagatcttcgtgtcggtggagccgacgacgccggcgcggctgcggggaggggaggcggcggctgcggcggcgggggagtcgccggggcagaggcagcagctcagccccgggctgctcgatctccacgccttcgacaccgagcttatcagcgatgtaagaccagctgcatttctagttagtgcccacccttctgtttcgattgtctcgcatggttgggggttaaatcgccgcgtttccaaattgacgccgacgttgtggatctgatgctctgaatcccaatgcgatggcatggccgcttgggcagtcagaactgtcgcttttttaagggtgtttttttttcttttcagttaatcagtgagttggaatttggaaaggaaatggagaagtgcactgctttggtgcttttggtcttcttttaggaatgctaggttggatgcgcaattcttttggggattggaatgtcaagatgttaaacaaataatactttggtggaatcgtggacggttgttgagatgtggcaccgcatcaatactgactatatggtccagttgttggtttgtttaagtttcgttgttgagtttacatgatgcagtgtactaggtttgttgattgatggtgcattttaaacctaaatgtttgcacgaaccttgtgttgttgcagtgaggatcaaggattatctactatccaatcttttaccatactgaaatcattctattaactggagctcaaattcatatgcagtttcaagtgccagggattggcatgtatgatggtgcccaaaaatttggctatggcaatggaggctttgatgattcagacccaaccttcgctccaaataaacagatgagcaaatccactgtttttgctgaaagtaatttcctcaaggccttccctgagaaagagaaggcagctcctgttgcgaaaatcaaagtggtggtatgtttcttggttttgtccataatctttgataattattccttcatagaaaagctgagcttaagataacctgcaaacttctaatagatttgatgtgaaatgtgaatgcagg

SEQ ID NO: 5175 - DNA, 1501 bp, Oryza sativa
gcttcttcggaggcctctgcttcgtcgagagaattcgaagccgattggtacagctagcttcgtggatcgctccgtgaccgcagcaatggcgagtcgaactctgacatggacgctgcacgacgcaagtgaatgaacacggggcgtcaggattcagtgcacttcgagacgagatcacgaaatggaggatcacaagtgacaatgtggcgcggggcgcgtaccacggtggagcgactccttgcagtgcgcgatggcgctcgcgatgccgtcctgctgctcgaggagcgagtcgtcgcggcgaggcggcggcgactggcacgccgccgtctgcgccgcggacgccgaccggctcttccgtagccggaggtccgcgccggcgctgggggctacccggcgcagttgcctcgagatcttgctgaggtaccgcctgatcacgtcccgcgagggcgtcctcctgttggcctcgtccccctggtccggcgagccgtagccgaacgcggcgaagagcctggccgagcgcgcgctgttggagctcctggagaagctggcgcggccgccgtagaacgcggccttggcggacccgaagctgagcgtgcgcagcttgccgcgcctgccggagccgtaccgcgaggcggcgtcgctcggctcggacgcgcagaacttgaggtgcgcgggcgccgccgccgccgcgcgcgcccacccactaccgccgccaacgtagaagacccgctcctcgtacgacggcgacgcggagcggctccgctgcagcgagatgacgaagtctgactcgccggcgcacgacgagtagtcctccgactcggaccccgactcggcgctcgacgcgggcgccgaggccgagcagcacgacaggtcgaggtcaaagaacgggccctcgtcctcgccataccagccgccgccaccgcatggcgtggcccgcgccgtcgccgtgatcgtggacaccgcgcggcgccggaaccgccgcgccgcgagcagccgtaggaccttcatgtgcgcagctgctggtgttcgggacggtggtgctcgtcaggtcggtgttattagtgggagatgtggaggggtagtggtgttggtggggggaggcaggaggcggggcggtggctcgcttttaaacgggagcggcaaaggccgcagcgtcggtggagtacgtgcgcgagatttaagaaaggccctactgggttttcttggggagtttttccatgtttcggcggtgtttgcggtgcgaagtgttgaagccgatggcatccgcggcgtttcgcggtttcgccaggcaacttgggttgggtggctcggcgcggtgtgggtcgcgtcgcgtggcgtggcgtggcgcggccgttgcgttgccgtggttgttggcgtgcgccgcacgggccgtggatggcaaggggagcgtgcgtgcgcgcgcgcggcgcggtgcgtggcagtagcggccagtttcgagcgcgatgccgctcggctccgtggtgtcgccggcgtgcgtgcgtgc

SEQ ID NO: 5176 - DNA, 1501 bp, Oryza sativa
ttaaaatcattccttcttctaatatagatacgatgcgtggagaggaaggtacgatgtactattcgtaaacagtaaaaaaaaatcctatgcgatgcatatggaaggagaggaatgtacgtatgtactacctaaaaaaaattacatgatatacgtttatatgaacgtaatgtaagatcgtacgatcggaaattaaaaagcataaagcgaaaaaaccaaattatatataaaagtccactaaactttctacaaacgcttttaagctgtcacatgactcctacaaacgctactaagccatcacgtggcgctctaataattaaattagagaaatctaaaaaattttgagaaaaaaaaggaaaacattatatcattgattttcacttaacatggtagacccatcattttatctcctattatctcacctgctcacttctttatccaaattttctagatagcagctcagtacataacaataagaaatgctatattaactatctattatatagtacaaatcaaataaactccgtacaaacgctttcaatctgtcacatgcgtggtgtgctacaaacgctcctaagatgccatatggtactcaaacaaattaagattcctaaaaattatgataaaaaacaaaccattgattttcctttaaataggtgaacccaaaaattatatctactacaataaatattttttaaaataatttttctatctatattgattcacatgcataactaattgcacatatatgagaagtaattaaagagagggctagcaggatggtaaaaaaaaccaatgaaagtttgttgatatttcttcacgaaagagatatataaagaacactcaattcaaaatagaaaatacgttactttaattttaatttgatttgttagaactattttcgaaacaaactaatgcgcagcccgcgtaaatgcgcgggctatcttcctagttaaataaacaatatagaaaacctaatccattagaccaatggagacaggtgttgaacataaaacatttcacgtattttcttttttagcaaagcagtacgtagtccatgatttcaattagccgcaaaagatatcatctgcgaggacattattaatttatttatagaaggtataagaagggactttcctcttgtagtaagaatgactttgtcactaactaattccactgatggatctaagctaggaggcccaaacgaattaggcaggataacctcacaaaaccacccaccaacaccaaacccactactactaaaatggagtaatggtactactggtagctgatagtaagaccatatggacacagaaagtggagtatcctttcattcctaaaaagggcatggaatagaacaaccccaattttggaaacggggagcagagccattcagctgtttggggaccaaaggcaaggaggcatgaccgaccgatccccatccattccaagccttcaaggagacaagatattttcgaagagagcacacctaggccctagctag

SEQ ID NO: 5177 - DNA, 1501 bp, Oryza sativa
gaccattgagcgagctagctattcaaccatcgagagtctaggggtggtaagcccaatgacgtgacaaaagggtcgcatcgccatattgctcggtggtcttcttcagacacgctcgactagtcatggttatgattggacctcgtcgtgggtccaccgccatgtggatcatgccatgtcgtccactgattcttaagaaagggacacaatgtctgcctcagaaaaagatggtgcacagggagcaccccttgccatcgatgctaacacaattcgaagaaaccatgaaacaccgtccgatgtttttgaataggatcagaagtccgactactcatcatgtcatgttgagatatatagagagtgtttgggagagagggactaaatctagggacttatttttttggagagagggactattagtacctctcccaaacaccctcatagttacaaggaagatacctctgcctagaattaccctgagaaattagcataggctggctcgggacttgtctctgggctgggtcgctcctgctcccgccgtggttaaacagtggaagtgtggaaccaacggtagtttcgaactttcgatgaataagaatcagtgtcacataatagtcttgatacaaccatccaaagacgttatagcaagaaagggaaatctcgcaaccttcaaacaccagccgtgatgcacgtttgtctgcgttacgctcgaaaaggaagcgagaagcgaactagtggtccccaactcggcaaaaaccatgatctcatgacatccatcaataccgccgcccccacgcgtctctgctattggtggtgttgacagcccaaggcccaagtgtcacacgcctttcgccaatctgccgtggtgctaaagcgtacaactattctgtcaccgttaacattcggccaaatcagaaagcattaaaaagaaaaaaaaaacccagagggaatcgaatgacggcatgacggagttacaaggcggagaaaaaaaaggtgctacttttaccctagtgatgaaaggagaattttacatagacttgagttttacacatagaccaagtctatctagtatagcgaaataatagaaataaacaataggaatcggccactcgatccgcgacaacgagattccgccgccgagaggtgtttgtgcaccggaaatttcacccctcttttttttgggccaaatccgcgtcggcatcggcatccgcgaggcgtcccaatcccaatcggcaccaccccctcctgccccgtgacgccgccgtgccccgtgccgtgggctcgctcggctcgatcctggccgcgacgcgacgggaccgacccgaactctctccaaccctcctctctataaataccgcccctccgtgtctgtgccgttcgatcgcacccgtaccgaatccgcgcccctgaaagttttgcatgccgctgtcgaagtcggcttccgcgtaggtgtggtcgtcgtgtcggcggcggcggcggcggcgggaggaggaacgaggaggacaca

SEQ ID NO: 5178 - DNA, 1501 bp, Oryza sativa
gctgcaatggcaatcgggaaaagaacagtttaggatcataagaggccagggcgacaacaaagctaaaatttctcaaattgcatctaactgaccttgcacgcgaagtcgatgacatcgagcagcagcaggcgagcactgaactggtttgcgagagccttcgcgagcgactgaaggtacgcctctgcaacagagaaacagcggctgtgagaaaaaaaaaagatcgcgcttttggcgaaaacgaacaacgcacattgcggttcaggaagcggagggcgaacctgatgggccgcagagcagtatggtgcggctggacgcggagaggacgcggatgtgattgggcaggatcgttgggctcagatgcacgaacgccgtgctggtgagggccagcttcgactgctcgctgcaagaaaaccatgggaaacacatgctcaattagccgcccttcaccaaacaccgcattgatttctactgacgacgcaacgcgtatccatgggatcagtaattaaatcatgtgatcctacccgaaatataccagcaaagtcataaactaatcgataaagctaccggtcaaaataagggaaaaaaaggtttggttttttttttccttctcccacattggattggggggtttttggctctgaggattcgcatcgacgacgggacgaacctgaggtagtacgggaagtcgtcgaaggagacgccgacgtcgcggccgtccaccaccagacaccgcagctccgcctccacctccgccgccgtggcgccgccgccagtcgccaacccggtcagccgcgacgagacgaggccgatgccgacccccaccccgacgcccacccccacggccgacgcgatgatgctcccgtgctccatgtgtcctcctcgttcctcctcccgccgccgccgccgccgccgacacgacgaccacacctacgcggaagccgacttcgacagcggcatgcaaaactttcaggggcgcggattcggtacgggtgcgatcgaacggcacagacacggaggggcggtatttatagagaggagggttggagagagttcgggtcggtcccgtcgcgtcgcggccaggatcgagccgagcgagcccacggcacggggcacggcggcgtcacggggcaggagggggtggtgccgattgggattgggacgcctcgcggatgccgatgccgacgcggatttggcccaaaaaaaagaggggtgaaatttccggtgcacaaacacctctcggcggcggaatctcgttgtcgcggatcgagtggccgattcctattgtttatttctattatttcgctatactagatagacttggtctatgtgtaaaactcaagtctatgtaaaattctcctttcatcactagggtaaaagtagcaccttttttttctccgccttgtaactccgtcatgccgtcattcgattccctctgggttttttttttctttttaatgctttctgatttggccgaatgttaacggtgacagaatagttgtac

SEQ ID NO: 5179 - DNA, 1501 bp, Oryza sativa
cacttccctccgttttcgatgccgacaggggcgaggattggtgctggagaatgaagcggcggcgcggggcgtcaatggggcggagaggggaaggaaagcaatgattctagggttttgggggaaggggtataggtatatattgtttttcaaaaaagccctttgatgctcgtttttcagagcgcggtcctatttttagatttctctcttcttcatgtaagattttcttggttatggagggcttatacgtaaaagaccacaacgtcgcaccgtatttcttgggttctaaacacattaacaatgcaacggagggttttttttttgaaaaattgccaccacactcttgacgatgatcgatcttagccgtcgctgcgacgaatcgaacggctgggagctgcacggcgcggacgcacgagagggcgcggattccgcccgcctcccagcgctcgcgggcgacgtggatgcctctgcgtacgaacacgccgctccgaatcgctctcagctcgccaattcccagtaggttttaatataaccgatttcatccgaaacattatctgtgttatactcctttatactgtcttcatttttttatataaactatatttttttatataagacagttaacatttttgacatatgttcggtcattcgttttattaaaaaaaatcggacaagtttcacaaatcttcaataattgaacagtttcttgtttttcaccttccaattacatgtgtttagtaatttccactaacacaagtttaatcccatccttgaaacttttgagcatgtcaaatgtttgacagtagtttttctcttgggaaaaaaaatctaaagcaccaaagctccccagagcttagttaaccttgatgcttcatgagtaatttggattcctctttcttttgttcatggaagaattgaattgaactaaaacaagaaaataatcattttgaaggtttttttggtgagccatattgtctataaaaaaaccttttatatatttttttggccatctcaaatagtcccatccatcccattttgatcattccataaacaaagagcaacgaaaggacaccaaacattcatcattttgaaattgatttaaggcggttctctattgtttcgttccaataaaaaataacttacactttaaatgttgtgtcacgccctgaactagccccgagcgagactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaagcggaagccaagacttggaccaaacatcacaggcgcgacttgggaactaggccgaaaccctaaaactcatcgtagccggcttgctcctggaagaactcctcgtcagcgggatccgcttcatcttctccagcaactggggggg

SEQ ID NO: 5180 - DNA, 1501 bp, Oryza sativa
tctagcccctaattctagtaacggtgaaactttcagacctgtcaaacccaacaactcgatctaagtaaacccaaaatcctcatgaagtcaaacactggaacaatgaaatatctcgcgatccattcctctgtaatgagatagtgaagcctcgagcacgcaccaggcttgaagaaaacggaaagaccgaagtcagtggccttgagcggcgagtcctcgcttttactgaggaacaaaaagttctccggcttgagatcccggtggaagacccccatggagtggcagctgtgcacgacggcgacgatctcgcggcagagcgcggcggcggcgcgctcggagtagtgccccctggcgatgatgcggtcgaagagctccccgccctcgcagagctccatgatgaggttgaccgagtggcggtcctcgtaggcgccccggagctcgacgatgttgcggtggcccgtgaggtggtgcatgatctgcacctcccggcgcacgtcctcgatgtcgtcgcggtgggcgagcttccgcgtggcgatggacttgcaggcgaagcgcttccccgtggccttgtgggtgacgaggtaggtgaccccgaactggccccgcccgagctcgcgcccgaaggtgtaggtcgcgcggacgtcctccatcggccgccccagcaccctccccatcgccgcgtccggcgccgccgccggcggcggggtcggctgctgcggcctcggccactgctgctgctgctgctgcggctgaggcttcggcttgggctggggcggcggctgctcgggagcggcgcggtggtggcgcgacgtgcggttgcccatggctactggaggctgggtcagtcggggtggggaacgcaggcgatgtggtggagcgttgggtttgaacaggaagcagaagcgcacgagtagtagacgcgctccgcggagacgaccgaggggcgaccgcgacccgccgctgcggttatcgcgtgacgaggcgcgcgttgcgacttgcgagttgtgacagtggggatcgggtgcggacggagtgcgacggcgacgccggcgggggatcgcgtgtggcgttcggatctggcttgggggtgggggtggggtggaaacgcgtgggtggtcccggcctccagggtatggtggggtcgtggagtcagtggggagttggtggtggggttgcggagtcagtggggagttggtgggtgggtgcggtcgcggttgtcgatggagattcgctgttcctctgctcgcgggccgcggcgggtggtgacgactagcgactcggcgtggatattttcttggacagcgaatccgtgtgccacggacaagtgtattgtggtgtggtccggttggacgctgccgccagcgacggctaagggtaaaatctcccttaccatttacaaaactagacattacgacgcgatgcgcgctctatcggggttttatagtcatgctaagattatcttttgtggtagcagcggagttgacataccaaccaccttcagtta

SEQ ID NO: 5181 - DNA, 1501 bp, Oryza sativa
ttaaacacttatttctcatggcttgctgagtactcccgtactcacccttgctctatataaataatcccccccagttgctggagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagtctcgctcggggctagttcagggcgtgacacaacatttaaagtgtaagttattttttattggaacgaaacaatagagaaccgccttaaatcaatttcaaaatgatgaatgtttggtgtcctttcgttgctctttgtttatggaatgatcaaaatgggatggatgggactatttgagatggccaaaaaaatatataaaaggtttttttatagacaatatggctcaccaaaaaaaccttcaaaatgattattttcttgttttagttcaattcaattcttccatgaacaaaagaaagaggaatccaaattactcatgaagcatcaaggttaactaagctctggggagctttggtgctttagattttttttcccaagagaaaaactactgtcaaacatttgacatgctcaaaagtttcaaggatgggattaaacttgtgttagtggaaattactaaacacatgtaattggaaggtgaaaaacaagaaactgttcaattattgaagatttgtgaaacttgtccgattttttttaataaaacgaatgaccgaacatatgtcaaaaatgttaactgtcttatataaaaaaatatagtttatataaaaaaatgaagacagtataaaggagtataacacagataatgtttcggatgaaatcggttatattaaaacctactgggaattggcgagctgagagcgattcggagcggcgtgttcgtacgcagaggcatccacgtcgcccgcgagcgctgggaggcgggcggaatccgcgccctctcgtgcgtccgcgccgtgcagctcccagccgttcgattcgtcgcagcgacggctaagatcgatcatcgtcaagagtgtggtggcaatttttcaaaaaaaaaaccctccgttgcattgttaatgtgtttagaacccaagaaatacggtgcgacgttgtggtcttttacgtataagccctccataaccaagaaaatcttacatgaagaagagagaaatctaaaaataggaccgcgctctgaaaaacgagcatcaaagggcttttttgaaaaacaatatatacctataccccttcccccaaaaccctagaatcattgctttccttcccctctccgccccattgacgcccc

SEQ ID NO: 5182 - DNA, 1501 bp, Oryza sativa
aaggaataattggattgcgcttttgtaaggtaaccagagttagatagtagttatcttctttctgaaaatgatggcagtgccaacatccattatttctaaacacacatttctattctttcagttcactcccatgatactgaaggatctgattctgattgcaaactagacaattcaagggtataccctttgttttctcctttagagaaggaaactctgaaagattttattcactatcggaataataatagttgttattctttgttacaatccttacaaaaataacatggtagttcttactttatacactcaacctatttgtaggtatgtttagcttgaggatttttcattttccaaaaaaattactatgcattttatattgtgttgttgtaggtttgtagaggtaaagtcgatgttctttacagagtttgccctacttgcaaggtgtggcacatctttctggccgatctcttacaagttatagttatgtggcataagaaagatgtatcagtttttatgtatttggtcattggattacgaatgatgtctgggagattttataatgatacaacatatggagtgcaggttttattttttagattcatctccaaagagacctgcaagatctcccttttgaggtcatgaagctcccctttcttgcctccctaggcttggggcctcgactccctctccatcgatggaaagctactgaggcagccagccgacagaagacatagagttgatcaagaaacaacagcacatgcataacaagtgatgattgttcttaaaaaaaaagacaagtgatgatagaaatctaaggatgtttgggcatatgctatgctgtatatgtattatgttatcgtttcattggtttttacctgtttttcttttaactgaaggtggttggtatgtcaactccgctgctaccacaaaagataatcttagcatgactataaaaccccgatagagcgcgcatcgcgtcgtaatgtctagttttgtaaatggtaagggagattttacccttagccgtcgctggcggcagcgtccaaccggaccacaccacaatacacttgtccgtggcacacggattcgctgtccaagaaaatatccacgccgagtcgctagtcgtcaccacccgccgcggcccgcgagcagaggaacagcgaatctccatcgacaaccgcgaccgcacccacccaccaactccccactgactccgcaaccccaccaccaactccccactgactccacgaccccaccataccctggaggccgggaccacccacgcgtttccaccccacccccacccccaagccagatccgaacgccacacgcgatcccccgccggcgtcgccgtcgcactccgtccgcacccgatccccactgtcacaactcgcaagtcgcaacgcgcgcctcgtcacgcgataaccgcagcggcgggtcgcggtcgcccctcggtcgtctccgcggagcgcgtctactactcgtgcgcttctgcttcctg

SEQ ID NO: 5183 - DNA, 1501 bp, Oryza sativa
tcccggtcggcgaggtcgtcgacgcgaccaacctcgtcgacctcgcccgcgtggaggtcgggcgggagtacgaggtggtgatcaccacctacgccggtctgagccggtaccgcgtcggcgacgtcctccgcgtgacggggttccacaacgcggcaccgcagttccggttcgtgcgccgccaaagcgtgctgctatccgtcgagttagacaagaccgacgaggccgagctgcaccgcgcggtggagcgcgcctcctcggcgctcctccgcccgcgcggcgtgtccgtcgcggagtacaccagccgcgcgtgcaccgaacgcatcccgggacattatgtggtctactgggagctactgaccgagtcacccgtcggcgccggcgacggtgacacggtggacggggagacgctcggcaggtgctgcctcgagatggaggaggcactcagcgcggtgtacaggcagggcagggttgcggacggctcgatcgggccactcgagatccggatcgtccgtcccggcacgttcgaggaggtcatggacttggccgtctcccgcggcacgtccattgggcagtacaaggtgccccagtgcgtgactgtcccatccgtggtggagctgctggactcgcgcgtcgtgtctagccaattcagccctgccctgccgcattggatcccgactccacgatccgactagcaatgcatcctgtttggcatctttattttaggaaaggaaaacgtacaccgaaggtccctcaacttgtcatccaatcacaaaattatccttgaatcgcaaaccagatacaacacgtcccccaacttataaaaccaatgcaaactaagtccttggcggttttgactctggttttgtccgacgtggcagctgactcagcgtgggacccatatgggtcccacatgtcagcctcttcttcccctcctctctcttctcttcctctctcatccctttccacggcgacggtgatggagagcagcgatctgggagtagacgacgttcggtgggggaggagctgggcccgaccggcgaccggcggggaaagagcggggcacggccggtgagggcggagatgggcgcggccggcagccgacggggaggagctggaggcggcggtggggacgccgcggcgacggcagcggtggaggcgggggcggcggcggaggcaggggcgggggcgccgcggcggcggcgcgggagcgcaaggccgggagctaggttccgcagggcggggaggacgacaaggtggtttggcggcgaggcgggggagagcaaggagaggacgtcgatggtggtggccccggccgcgacggccgtggcatcgacgccgctctccctcatccacgcgaacgcccctgcagcgctctggaacgagccgcacgcggtcttgatcccgacgtcggtggcccggtccacggcgagcgcgatctgggcataggcaaggagcacgtcccacctctgctcgagggaggggtccgggagcgacggctgct

SEQ ID NO: 5184 - DNA, 1501 bp, Oryza sativa
atcttggattcatcctcctcgtcctccaactccatgtccaaggcaggggagcagagcaagccgccgccaccagcagcagcagcaggaggaggatataaatattggtcgtcgtagtagccgggatgatgaagtagaggaggcggcctgtgcaggtgaagctgatgctgcagggtggtggtggtgggcttgtgaaacgcgcggcacaccacccagcagctgccgtccggctgctgatggtgggcgacgaggcggtactcgtggatgatccagtcggtcttgcagccgttgggcgcgcggccgcggtagaagacgagcgtcttcctcatgccgatcaccgccggcgacgatgatgatcgagaggaggagagcaccggcttgtcacggcccgtggccttccagaagcccgccgccgtggcgcggttggtccgcgtccccgtccctcgcgcgctggggtacttgcggtccttgtagctgaagaagtagcagtagtactcctgatcatgctgctgagcttgcagcaggtcccatggctcgatgctgttaagatccacctcctggatgatcccgtcgtcctgctgcccgaccaccttccgtgccaggtagtaaccaaccagttcctcctccgtcgggtggaacctgaatcccggcgccacacaacaccactcctcctccatccttcactgttcactgggatattatatatatgccacaacccacaataagaagaagtaggaagtagaagaagatgataccagcttgctagttagctacctatgcatggtatgggtatttatactggaattaatctttgttgggagctgacgacattgacatttatactgaaattaattaatctttcggagcctgtccatatattctgctttcggtaaaggagatgacagaaatagaccattcttttaaaaaaaagttttaaataagatggacgattaaagttaaacacggaaaatcatagttaaaatgggatggatgaagcaattgattcttcgtgaaacggaaggaaggtatagagagttagtgacagactgtgtagtccgaggtatctagtctgtgggcctttccatcgtccgatgggattattattgggctgaaggcctaaagttaccatatgatatgggatgggcgcgggcccaattaatagcaggtcttgtcgtctggtatgcctaatttgtggtggatcgtggactcgttcgttggtctgaaatatctccatccgaatcatcaccatcagaagaggattggaaaagggaaggatcctggatggtttgatttggccatgtgcaactggagcaggagcaggagcaggagcagaagcaagccgcattaattaattaatcctctgagccttgtcaattcaattggccgatttgtagttgccaccatcatcctacctacgagcagagcagagcgcaccgattcagcgaggaaaggaaaggaagagaaaagcaaagcgatcgatcgaggaggaatccgaatacgatgg

SEQ ID NO: 5185 - DNA, 1501 bp, Oryza sativa
attactatactggtggttgagtaatgagtaggagtatactcctagtagtggttggaggagtattagtagcacaagtatcacatggcagacaacaggctgttacgttccattgattagagtagtccattggagtattattcatcaagaatactaataactaaggtagcgaaatgtaaaagaaacgagtaataacaacaaggcaaatgataagtgaaaaagaagaaaaggggtaaaattggaaccaggaggtaaagggtgcaggcgaggaggatggatgggtagcggccgaggaaggagtcggcgaggaaggcgccgaggagaggaagcatgcaggccgcccccgaccaggcgttcaccgccgccgccgccgacgcgttggattgccccatcggccccgtcagatacgtgatcaggttcgccgacacgccgaagtaggcgaagctgccggccaactccaacactgtccatggaatgaattagctagcctgatcgatctatagactatagctatcctgcctcgccggactaaaatgatgaacagcatacatatacataccggcgacgaagagggcggagcgccagccgcctgaggtggcgcggtaaacggggcgcccgcggaagtcggacacgccggggagcgcctcctcctcctcctcattcggaagcaagggacgaccgtccatcgtattcggattcctcctcgatcgatcgctttgcttttctcttcctttcctttcctcgctgaatcggtgcgctctgctctgctcgtaggtaggatgatggtggcaactacaaatcggccaattgaattgacaaggctcagaggattaattaattaatgcggcttgcttctgctcctgctcctgctcctgctccagttgcacatggccaaatcaaaccatccaggatccttcccttttccaatcctcttctgatggtgatgattcggatggagatatttcagaccaacgaacgagtccacgatccaccacaaattaggcataccagacgacaagacctgctattaattgggcccgcgcccatcccatatcatatggtaactttaggccttcagcccaataataatcccatcggacgatggaaaggcccacagactagatacctcggactacacagtctgtcactaactctctataccttccttccgtttcacgaagaatcaattgcttcatccatcccattttaactatgattttccgtgtttaactttaatcgtccatcttatttaaaacttttttttaaaagaatggtctatttctgtcatctcctttaccgaaagcagaatatatggacaggctccgaaagattaattaatttcagtataaatgtcaatgtcgtcagctcccaacaaagattaattccagtataaatacccataccatgcataggtagctaactagcaagctggtatcatcttcttctacttcctacttcttcttattgtgggttgtggcatatatataatatcccagtgaacagt

SEQ ID NO: 5186 - DNA, 1501 bp, Oryza sativa
ctttaagaaaacttgcctttttcagtggaatgtgctgcaattaatactatgtttatcatgtttgtcgtggcatgtgtgcccttgtatcatttgcacttaatcgaatggtatttataaaaatataatgttgattattccataatttattcataaaaatataactatttacagagaggtacaaattttttaggtaacggacaatataaaccataaaaaaatccttgcctttttctcacttagtaggtgccatctaatgcccttgattgaattaatcatagagtcaccacacaacaaaatgagtagttagcgaaatactacaagatgcacaataaaaaaacttatgaacaatatgcaaaaataataattctctcacctagtactgtaatttattgccccccgattgaattaaagatagaactcaaatgttgggatagctagaagaaactagccatttaatggtattaagataggagaagccacattttttccaacccttcatttcgtttaatccagatggaatatgagcaggttaagaggtcgaacctggatttgctggacgaaagcaatcaacccgtaccaattaatgatagagctaccactgaacaaaacgatgagcagtccagtgaaaatagcaacaatggactggcaagttgtacaattatttatgacccattaatttatttctcccccacaaaagaaaagataggaaaaaaaataaaaccagggaccaaactctaccaacttgggctgctgctaggcggcagcatatttgtcttctggcagttgtgctgagaagccaggcagaggggagtttagcctgaaagtgagctctctagggagatagagagagaagagggccaaagaagaagaagaaatcaaagctaggagaggtccaagattcccactaggaccctttcttggttctcttctttttctttggctgattggaaggtctagagtcaatcacttggtttcttttgtttcttttctttggctccattggttcttcttgccttccaatcgttctaaggggtggatagaatttgtaagtgtcatgttcttcttcttcttgtcctttttagtttgttggtttggagttcacttctccattttcgcttcttcgagatgttataatcaactgtgttctaagttctaacatgtggtcaaaatgctgattttttttcctcagttggagtatcacctatcaggcactctgttcatggcccaatgattttgattggtgggcagattttcacagaccccccattccagtttttttttcccaaggggatgcgcgaatcttgctgctaatgttcttgtgaatcaaagccaggagatttctggaaagtgaggaattcttttcttagattgcaatatcaatcacagcgctttctccacaagttgcaatctctgagcgcttttgatctctccacaccaaccaaaagcaacagaaatttaccttggattccgcggttttgaagaatctgttctgatttggaga

SEQ ID NO: 5187 - DNA, 1501 bp, Oryza sativa
tcaaggaggctatggctagggccctggtggccttctacccactggcaggtcgtctccatgtagatggcggcagtaggcccaagattgagtgcaatgccgagggtgcactcttcgtcgtggccccatatctaccaagatcttcaccatctctgtgcaccagcttgtagcccttaaacgaatctgttgtggcatgagcacattttgtgccgtgagcgcccttgtatggcagtgcatgtgtgttgctcggcagctgcctctagacgccgagacacgcgtcaccttcccagtcaacatccgacgccgtgtaacgccacctctcccagaccgctacttcggcaatgcacttgtcatcatgaaagtggcctccacggtgagggacgttgtcttggggacattggctgcaagtgctggccaaataaagagcacattgggccgccttgatggtgagatgttgcagtcagtgatagactacaatgagatagcagggatgtccaacaagcctgcgaaaggaaacctaccagatacagaactgcgaatgattggttggctaggcatgcctgtttacgacgtggattttgggtgggggaagccggagatgatgtctcgtgcagagtctgtgcgcagcggtttcgtttatatgatggatggcaccgacaacgatgggggtggcgtgcgcgtgctcatgtgtatggaggcacgaaagatggaggagttcgagcgactgctttatgccaagtttgtgcaatgaggaaactagctatctagctacaaacataatgcatgttttctgttttattatcaataatggatatttcatgtaataatataatcaaatacctccatatattttggtggcatggttgtttcagacatgacaaattcctatgtttctaggaatgttgcattcctatgtttgataaaaccaccaggaacgtttaaaactaatcctaatgccgcgtattaattctcagaatgttagttagccccctaactaacattcctggtggttttatcaaacataggaatcaactagaatttctccacgatttatgggaatatatataatcaacattcttgcaaccacacacattggacgaatggaatttttttttaaaaaaaatcatccaagtctcagttgttgctttatatatatatatatatatatatatgtgtatacatatatatatgtatatatgtgtatatatatatatatgtatacatgtatatatatacatatgtatatgtatacatatatatatgtatacatatatatatgtatacatatatatgtatatatatatatatatatgtatacatatatatgtatatgtacatatgtatgtatatatatgtatgtatacgtatatatgtatatatgtacatatgtatgtatatatatgtatgtatatgtatatatgtatatatgtatatatatatgtatacatacatatgtacatatgtatatgtatgtgtatatgtagatatgtatatatatgtgtgt

SEQ ID NO: 5188 - DNA, 1501 bp, Oryza sativa
agggcgtgacatgagcgagggatgaggaggggctccatgtcgtgtgctcgctcaccgtcgccatcgccgctgccgccggcacgcgccgatcgatgggatgccggatgcgagtaagcggccagcaaaggccgcgtgagatgagctaatggagcctgaaaacattggaaattatagaactgaactgttcacgttgggcctcatcctcctctcttcggcttggcccaagccttctccttccctctccgtcactttctgttggaattttgaggcctcatctttccaccgagtttaaacctcatccttaaatcgcaccagaaatcttaacccccaacttataaatccggtgtaaaagaaatcctacggcagtatggaggctggtgagggagcagcgaggtcattgccgatgtcgatggcctcttcggccccgcttacctctctattctccattgtcaccgagctggttgcttgatggagacgtgacggtggcaggatgggtgtcgtggcgctgccgagctcgtcgacgtactaggggtgttgtcgtcggtatcagctgccctattcttggtcatcctcgagccgtccccacccccgcctcctcaccgccatggctacggcgggcaccaccacattgtgcttcctccgccactacctcccactcccactcactaaattttgatgtaatattttagttcttttatatatgagttgacggttaaagtttatacttaacgaccgttaacatcgtgctaatcatctaagcttgtatggagagggctttcccttgttcttctccaagagcatggaactgcaagatggatatatccatgcttataatctaaatttacatgcttccttcgattcaaattatttgtcatgtttgtcctaagttaagcatgtctatctttaatcattattttttttctttaaccgtcttaaacatacgaattattatatatactatgtaagtatttctcaatgtgaatctgaaaatataaatcttatgataatagagaatttaagtgtatagaaactgatggtcaaagattgaaacatttaatttgactcaggaattatgaacaataaataatttgacacgggggaagtatatgcttgataaatatgcaatccagacacaagcattaattctagagaaaagaaatgatatccgatatgcctacactagatcatgttgcatgtaaattaaattacaaacaccagagtagtgtttgtaattaaattaatcctgccacaaaacaggcgaatggcatcccatacaatataattatggtgtgtctgctgttttcagtaatggtactctgcagcagcaatacaagctaggtcccccaagcattaatgcatttaattgatatatgtagcttgtcgatatatatttatgtgtggatctttgccaaaggagctagcccgaaaagtttagtacattccagccaacattttctcatgggcaaggctgcgcgctgtcaaagatagaagaagaggttga

SEQ ID NO: 5189 - DNA, 1501 bp, Oryza sativa
gagcaccagcagaatgcagcaatggcctcagctcctcccatttatgttcctcctcattccaaacatcatcaagaacaagtagataccttttgcggcctaccacctcatgtagacggctgcgcaatagttcgattctgtctggcaaggtgcaatttcccctggtagccaattcaataatggatctgactagagaaacaacattgaaatcatctgagacacagagccacatgggcaactcaaagcgttgttgaacccttgtgtcgttgtacaccatcttcgcaagtgtggtcttgcccaatccccccatccctacgattgatagcacctcaaccatccgcttggatcgctgctcaagtaacaaattcaccaccatctccttgtcgtcgtctctgccaacgatctccatcaagctatcgaggccggagtgcgtctgaggatggatcacatgtactgttgcctgatctgcacgctccactaggccaaacttgttcatctcttcaaccagctcgttgatcttcttgaggacactgttcagcttcttgctcatggcaacacggaacaggagggggctgtgcggcgtgaagtagccgagtaccttgtcggtggtggagtcgccgatctgggcgtcgcggcgcagtgcctcgtagtggaagtcgtcgaggacgtcgtcggcctcgtacgcgacggccttgaggtccttcatccacctcttcacggcggggctggtctcgctcttcgcctcggcgtcggacagcttgcactggacggccagaagctggcgctccagcttgtggcgatcgccgtcgacgccgcacatgcgagtgacgctctggacgagcgcgccggccgccttgccgaccaccccgcgcaccaccgggaggagcagcgattctgccatgcttctaccactactcagctcgcactagctgacagtgacaacgggccttctttacttctgtgctgtctctgtctatctcaggatatctgattgctggatgtgcgaaggaaattagtagcgaataagaggacgagtgatcgatgatctgaatcgtaatgtaagtcaaggcaaagtcaaggtgatagtattattttggcaaaattatttttggccgtccagctagcctggctaagcacgctttactactgttgttatatactccctccgtttcgaaatgtttgaccgttcgtcttattcaagaaatttaagtaattattaattcttttcctatcatttgattcattgttaaatatatttttatgtaggcatataattttacatattttacaagaagtttttgaataagacgaacggtcaaacatgcaccggcggatctgtagggtggtccgggtggtcccaaaaaaattgcggcgcaactaggtagtataagtttctttaaaaaaaagaaaagaaaaaacttgtacgataccagatcagaccgaagcgccagcgtcaagactcgagcgacgagccgtcttccttctagcgatcaaaacaatcacg

SEQ ID NO: 5190 - DNA, 1501 bp, Oryza sativa
cgagaagaccatatactaggagggggtttctcgcaaaaagtcgtggacaagtgttgaattttccgaatatcttaaccgtctggatcagatcggacggcccttatccttcagaagtttgcaaaaagttcagggtttcagactcttaagaagttcagatttttctaagattttagggtgtctggtttctataatcttcagagtcttctcctgtcatcgacatcgctatcgcagtgtacttctgatttctgaaccaccacggcgatctacccgattgcaagctcatcgatgtcgatttcattcatcgaaaccaggtgcatgctgggctgtaattaagccgatatgcagttggtgattgaatatgcagttatcatgtcatgcataatttgttgattctgagccattccttggtgagttctccttctgtgggttgttgcgtgttacgatgacggttgcaaatcgtgttgtactgcaaatggggcgttgaaattcttgttattattggctattcataaagcctgagatcatagagtgcatggtttttctttttcttttacaacaaagtagacaataccccatttaagtagtctacatcaagatagaacatggtatctctgtgacgggactaatcagaaggaacaaaaatctagtgcaatcagctgaaaatcctggtaagtactaatatgacaacccacaaagaaactaagatttgaatgtacaatgcaaaaaaaaaaaaagtcaactatcaacatgctcgatcaattcaaatgaacaattgaagactgtgacagccaaaaatataagcttaattgcctctttgctttctttcgcgcatcgagcaatcaaagagcctgagagaaaaagcgagagaagttgcagctaattagtgagcagcatagagccatggcggaatcgctaatcctccccatggtgcgcggggtggcggcgaaggccgccgatgcactcgtacagagagtcaccggcgcgtgcggcgccgtcgacgacgaccgccgcaagctgcaacgccagctgctggccgtccagcgcgcgctggccgacgccgaggcgaagagcgagaccaacctcgccgtcaggcgctggatgaaggacctcaacgccgccgcctacgaggccgacgacgtcctcgacgacttccgctacgaggcgctgcgccgcgacggcgacgccaccgccggcaaggtactcggctacttcaccccgcacaacccactcctgttccgcgtaaccatgagcaagaagctgagcaatgtcctcgagaagatgaacaagctggttgacaagatgaacgagcttggcttgtcagtggatcgcacagaatcaccacaagaactgaaacctccttatctccagatgcattctgctgcactggatgaatcaagtgacattgttggcagagacgacgacaaggaggtggtggttaagctgttgctggatcagcgatatgagcagagattgcaggttctccctgtcatcgggatcgggg

SEQ ID NO: 5191 - DNA, 1501 bp, Oryza sativa
gggtaggggctacctcaccgcacagcaagtgaaaagtgtgcgtctctggcctccatcaatcgaccaaagctgctaggagggacctgtccacagtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagactggtgtcggtgatctatcgccgggtccaacaactgaggtgtatcctgatgtgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattaccaggtagaaaacatgtatgcttggtaacgactgacactgtccaataatccttccatttccccttatacgcgtgcactctccagggacaaccatctttttccttaacacaccgaacttcatattgcgaccggttcgacttggcaaccctaaactctctatgaagtgacactgcaaaatgttttaccgcctccttcatatcttctgctctactataaatcgctccctgaataacatcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacttgcgttgcaatgcattttccaaataccatctccacactcgagagttttgaactggcattagttcccaataaaaacccttagttgtccgacttactataacattgattgttatgtcacttgtctgtggatcaactctcaagcccctcattaaccatccttttatagaaggtacactcctctcagctggtctatcaattcccctttctgatacaataaaatctgacagatctaccccagttggcccgtaacggacgtttcctggtccatggtaaacttggaata

SEQ ID NO: 5192 - DNA, 1501 bp, Oryza sativa
tgattgttttgttctatcatcaaattttagttttagatttactaccaatagaaaagtctttggtatacaaattttagatatcgaataaggggtatctaaaaaattaccataagttttttttttaagttttctgagtgaaaaactttcaaatgtaactatagtataattaaagtgtaactgtattgtaactatactttaactatgatataacttatataaaacttggatttaaccatgttttggttggttagaaccgagatcttacgcatgacatatttgaaacatgcaaaaatcttgaggaagtccgatggctagaaatcagcaaatttgaggataaaaacttatggaagttctcaagcaattctgttgaacaaaacctcataacttagactaagggtgtgtttagttggggaaaagaaaatttttgggtgtcacatcgaacgtttgaccggatgtcggaaggggttttcggacacgaatgaaaaaactaatttcagaactcgtctagaaaccgcgagacgaatcttttgagactaattaagccgttattagcacatgtgggttactgtagcacttatggctaatcacggactaattaggcttaaaagattcgtctcgtgatttcctccataactgtgcaattagtttttctatttatctatatttaatgcttcatgcatgtgtccaaagattcgatgtgatgtttttgggaaaaaattttggggaactaaacgggccctaaaggcatgccaaaagtcacaccaaaactgaaagaacacaactttgctagcctgggccctatttggttccatttgctaatgtttagccctcaccttttagccttaaattagccctcaaggatccaaacaggtgggctaattttgagctaatgtgaattagcccccctcaaaacattagccgctaatggggctaattttgtgtggggaccattaaaaagcagctttctctctccttctctctcctccctttctactctctctccaccttttagccttgaattagtctatggatccaaacataccaccctaggctaatgtttagcatatcaattcatgactaaacattagctcttaaaattagctatgggctaatcttccacacagggcgctgatactagtgagaactgagaagtgcaaattgcatcttccaacctcctaatcttgattattacatcccaaaattactgaatcccctcctcttattgcttcacagttcccaaaagtgtaccacactggtatataaaaaacaccccatcctgtgtgcctgccgactcgcccacgcaactccgactctttccttccccaattctcccgtccaccggccgcggacctcgccggaaccctagccccgccgcccccctcccctccccgatcgcccgattcggtggtcggggtgatggactccgacgccgagatgcccatgtccagcgacgaagagatgttggatgacgaggactattacgactacagtgatgacatgg

SEQ ID NO: 5193 - DNA, 1501 bp, Oryza sativa
agggataaaaatatgactatctagaaattaaatttaatcagcacagatcaacacatgaaagtttaacaatttttaaaaataacttcaatgttaaatggaagtaacttttgcatggttcagaagtaactctctataaatatatcttaaaaacaatatgtgatttaaaagatataagttattaaagagattaaaaaagatacatactattgcatttttcaagttgaaatgagacactagaaggaatacaaaccggctaccactagctgtgtagtcacgtccaaaataaaaaaaaaggcatgcattaaagttatttttttgttataagttacttctataatatatgtaaattacttttaggctttattgaatttacttttatatatccaagaagtaatttagtgaaatctaaaagtaatttagatatattataaaagtaatttatatttttttatcaaaatataatcatgtgagatcttgttataaagatttactgcctccgttttttaatagatgacaccgttgactttttctcacatgttttatcatttgtcttattcaaagattttatgcaaatatataagatataaatcacacttaaagtactatgagtgataaaacaactcataacaaaataaattataattacgtaaattttttgaataagacgaatggtcaaacatgtaaaaaaaagtcaatggcatcatctattaaaaaacggagggagtaattattacgaacacaacggtgtaatcggatcgtcgatcgaatgagtagtttaagagaaaattttatttgaaatatatgtggatagggtctaacatagatggagctaccactacctgtatagtcacgtccctctaagatgtgtacttccaatgttaaatcaccatctttctatctatatgacctttttaatattctgcacggtttgggtttggataattgggttcaaaaagaaaaaaaatccacaataaatttcatagcaaaagattggattccacgaaaaataaatgcacacaaacatttgggttcctgaggaaaatacaatgaagtcctcaagaaaattggaatttctagggggtgaaggcaataaattcattaaagatacatacactaaattcttccaaatagtattaaattcctcaaattggatgctcaaaggcattactcctatttggattccataagagcaggtacaatagcaggctataagctggctataaccatatatcgagaaaaaaagagaagagagaagaaagcgggctacagatttgtagtcggctgtaacacggactccaagatattatgtgtgtatgagaggtgggaccaggtattaatgatgtagtatatttttatagttagctattgtatgaatagactattagattgactatagatgttttggagtcagtagttggctatactattgaccttgctctaagggaaaaaaacattaaatgcttcaattaatgagtttttttatatttgggattcttttcaa

SEQ ID NO: 5194 - DNA, 711 bp, Oryza sativa
gccgctccccacactcacagtcgccgccactccccttcgcctcatccccaccgccgcctctccccttcccctcgtccccaccgccgccgctccccttcacctcgtccccaccgccactgctccccttcgcctcgtccccactgccgcctctccccatcgccgccgctctccaccgccactcccagaccgccgccgccgccgctcccgaccgccatagccgccgccgctccccgacctctgcctcgaccccaccgccatcgccgccgccaccactccccttcgcctcgtccccatcgccacagccgtcggcccgccgccgctcccgagagctataagggagagagagggggaggaagaagggaatgagggaggatgacatatgggttccacatgtcagtgggtcccacaatatttttttgtgtgaatgacatatgtgtcctacattttttttaattattgtttttattttaatgccacgtaagctccatgtaggacaaagattcagtcaagaccaccacgtaggcgccacgtcagccaaaaccacctccaaaaccaccgagggacattgtttgcaccggttatatacccggtttgtggttggaggatatgaatcatactcgggcgatagttgagggagtcaaagtatactttttccaagtagaaactgcttaacttgaaggcccatgaacgggaagcccaatatcgaatagt

SEQ ID NO: 5195 - DNA, 1490 bp, Oryza sativa
ctatagggcgaattcgagctcggtaccctaacactttatgttgagattcctttaacattaattgttggcttttggaatttattaggattaagaatttattaggattaaattgggcctagtgcatttaatctaaaaatttgaatgacatgctacatgataaaatcagggttttcaatttcagttggaaatttcgctcccctctagcaactaaaaatgttgcacaagatttttggttttctgcaaacttttttgaatattggtcaaaatttattaaattttcaaatgattttgggtaaaaaagttcaaaaattcccaaaagtgttagttgcaccgaaattccaaaatttctgtgcaaatcgaaattgaaaaccctggatgagatcaacccaacgtggaaagaggactagtccgggtaacattgcttaagaaaataatcgaatccaccctattataagccctgttcatgtgctttattgatggaaaaatcttttacttttggtatgaacaattgtagcttcattccagcttgatagcatcttcaaagcttgcatcacttcatgagtcaactgatcccggcaccaaaaggatataaaaatatgacaagcattccatcctggcttagatttttttttcctcacaaatgctccaaagttctgttgttttcagtgtaatcgttccagttgattatgttatctttttatgtctaacaaattatttgctccatgattaaaaaggtattttctcaagactttctttagttatactgcttagacttgttttaagctaattattaagtttctatactctttttttttttataaaaaaatgatggtggcaataaatctgccaatcaccaactctattttcttaccaactactgtacgtactttaatgttgtaaaaaaatatccttttacaaatttttaatatcttatttcatctctatgatttaagtttatcatgtaaagacctctatagagaactgggaatgaaattgttcttaaaaaccttataattaacttgttccaaacataagtttaccacatgtataattcaactttccagtagcaaactacgggtatttagctagtattttttaaaatatttaatttatctttataatgaaccaaatgaccgtaacaataatccgcttaataattttttcaacttacccctcttgtttttatcgagggaatagcctctcatgttttgtgagagcaaattttcattgtcgacgatggccattggaggtaagcaactggctgtgttcggcggcctgtgttctcaactcctatccttcgtgttccacgcgcatgttttttaaattgctaaacggtacgtattttataaaaaatttctatacgaaagtttctttaaacaatcatattgatcattttttttaaatagctaatacttaattaatcacgtagtaataaatcgctctgtttttcatgcactggatatttgttcccttctcttaacgaacacagc

SEQ ID NO: 5196 - DNA, 1501 bp, Oryza sativa
tcaatgcgattttcgggcaccgcgcgttcgtacacgtacgcgcgcgtgctgcatgcacagaaaattttgcgcgtctcgatcgccctagcgcgttaaacaggacgttcgagctgccggtctgccccttccaagatgcatggataaagaccaataaatagataccgtgcctatccacgttccaacaattgcatgcacgcccttcccggtctgatcgttgtttttcttttcgtccaggggcggagaaaccatctttcgtcagtcggccgaatttcacaatagtcctggttgcaataaaaaccggggctaaagatgatctttagtcccaatcatctttagtcttggttcaaatgctgtcagggtctgtcaggccctcccgggatctttagtcccgattggtatcggttccgtcatttggtccacggcaaatgacgagaaagacttaggcggaagttcaattttcttgtgagtacacatgctctatatttatattcaatctccaattcaaatacatacaagtgtatattaattagatctctcgcagtttatcatttatttatagtgcgcaaagcaaaagcagggaactaacttgtgcggctactacgtgtgcgagtattgccattgccttgcagaccaaatcatcaccacaagagagctcgatgtacgtacaaataaattcaaaatttcattgcgtacgtatcgatttgttgtttaattactaattaatttcatacattcatatagtttattcgcatgagggataacctgatcacacacaaggaatttatcgcggcggttcaagaacaactaatgggattcatcaacgaataaatccttgatcccaagggtgaattctactacgacggaaatacaattcaaaggtccttagcttctgagataacgactactactacgtcgaaatcgtagctagctaagacatcataatagattgtaattaatacatgtctatttttctatatgcatgtacacattttctttaatgtaaatatatattttggtcatatatatatatatatatgtatatatgtatatatgtatatatgtatatatatatgtatatatatatatatatgtatatatatatatatatgtatatatatatatatatgtgtatttatacatatatatgcatggtttatatatatatatatatatatatatatataaaccatgcagcaacagggccatgaaaaaaaaaaggtcagctcgatctttagtcccggtatttcacccgggacaaaagatagcgatctatctttagtcccggattggtagtcccggttttcaaaccgggactaaagggggttatgaaccgggactacaaacgctttctccaccagtggtcttattattgtttgatttttttttcaaaatgttgcgagtatttctatatagcgtagtccctctgtccctaaatagtaaatatgggacgtcgtggactttttttaagcatgtttgaccattcgacttatttaaatttttt

SEQ ID NO: 5197 - DNA, 1501 bp, Oryza sativa
cacacgtagtagccgcacaagttagttccctgcttttgctttgcgcactataaataaatgataaactgcgagagatctaattaatatacacttgtatgtatttgaattggagattgaatataaatatagagcatgtgtactcacaagaaaattgaacttccgcctaagtctttctcgtcatttgccgtggaccaaatgacggaaccgataccaatcgggactaaagatcccgggagggcctgacagaccctgacagcatttgaaccaagactaaagatgattgggactaaagatcatctttagccccggtttttattgcaaccaggactattgtgaaattcggccgactgacgaaagatggtttctccgcccctggacgaaaagaaaaacaacgatcagaccgggaagggcgtgcatgcaattgttggaacgtggataggcacggtatctatttattggtctttatccatgcatcttggaaggggcagaccggcagctcgaacgtcctgtttaacgcgctagggcgatcgagacgcgcaaaattttctgtgcatgcagcacgcgcgcgtacgtgtacgaacgcgcggtgcccgaaaatcgcattgagtatagcagcagcatcgttcagattgatcgatttccatctcaaaagaaacaggagcctttgctatttcctcggccccgaccaacaaacaaacaaacagcggatgagcggagagtagtcaagccgcgtcgtcgcgcgtggtcgtcgatcgcatcgcgctctctcgcggttgtcgtccaaacgcgttgaaattaaccaccgatcgatcgagatggccgtgcgtgtaaagccctacgagtgatcgccccggccggcgctctctcttccctcgtcatggggagggaggcgtcctcgccaccgcccccgccgccgccgccggcggtggtgcatggagccggctcgtcgttgtccggacagaagaggaaggccgccatggacgatggcagcggcgaggacgacaacgtgccaccatggctgaaactgtctctcggtccggtggcctacggggtcgccacgggcgtcgtcgacgacgactcctcttcttgcgctccggcagtgacgacgtcgatcgaggtgcggccgccggtggccactggtgtggtctccggatcggcggcccaaccatcgattgaacatgttcctgccgatgatgcggtggtcacgccgtcttttgtggcctcggcagccggtgtgctgttcaccggctgcgcgagtggtttgatccccaatggtgcagtctcggtatttccatgctttaattttcttggaccttcaatgtcatcatcaatcctatcgcacctccatcaacaattctcctcgactcgacgtcaaagcaacgcgtccatggcaagatctagccgcacctgtggcggggacgacgacatggcacttagcaacatcgctgcgccgaacgtcacaaacggtggcggcaacaacaacaacgacggtaatgctctt

SEQ ID NO: 5198 - DNA, 1501 bp, Oryza sativa
gccgaccgatgttcgtttcgactttctaccagttgagccatatggaaatggtaatcgaccaaaataaaaatggaaatggtaaaaaatatggaaatgaaaacggaaatggttttgctattataccaatcgtttccgtatttaccgtattcttgtggaaattaccgtttcttataatatgataattaccgtattctaaatatgtcgatatttatagggcatgtctctacttacagattgattgactcttcaatcaaatatctaacttttgtgcatggctaaaatggagttaatttataatttatattgtataagcttaaatttatgtatacatataacatacttatgtaaagttaaatatatgtttttatagtttaatgttttcgtatttaataccggtttccgatctgtaccgacattctgtccgtattgttctgtttccggttttccgatatttccgatatcgttttcgtttctgactttaccgttttcgatttcgtttccgagaaaggttacggaaatggttgaggctgttttccgatcatttccgaccgttttcatacctacctgtaagcttagccaataaaaaaggactttgcacaatcattgtacttaccgtaaacagaatctgaaatagagtttgccttctgttctgtcaaagaagcaagtattctagaagccgtcttgacctaacgtggaccagggagacttgaagacttctgcaacgcaagcttggaaaggactcaggaggtactgattccaattgaccagttcaatgttcaaaatatatgttgctacttgctaccatggtttcataagagtttcattctaattaaattagatagacggacatcattagtcaatgtgtcctagctccccttgaatggagcactgacgttgcgtggtagaaatggctaaaacatatattaggccatttttagtgcaggtttcatgcataagagttttattctgattaaattaaatgccacagggacattgtcaaaaaacaataccatctatatgaaactgtaaattggaggtctatatgtttcatccattaatccgagcttatttagattaggtgacttttggaaacctcaaaatgaacctcccagtaggaatggccttacgatcagcaaagcaggttctggctctgtcaaaaaaaacctgatcaattaatgttacagtgtactcctatattatgatgataagattaaacctgggttgaccataacctaagctggtcaaaactgttcttctgaaacgcggtaggaaagaccagcaaggatcatgtcaggagaacccagcatggttaatgcattcaaagccgacattttctaaagttctgataatgaaatgtgaactaatctccctctcatgtctatcatattgacagctttgtaattgcttttgacaggttcaaccgttgcctcacaggtctcaagactaacaaatgccgttctccaagggctataagttttgttgtcatcagtacgagcaaaag

SEQ ID NO: 5199 - DNA, 1501 bp, Oryza sativa
atatacttgacctattttatcagatccaacccatgttatccatgcatctcgtagataagtgcattataaattatatattttgaacaaacaaagtatgaaccacagcaacacattattcatcaatccctatacatcatccacatcacacttgagctttccctatgcagtagggtaggaaggctccatggcgaggccacacatgccccttttgtcagaaatgtccttttccatcctcaagaaaccattctcaccccaagtcatgccccaggagttcttcagcaaccaatacttggtaccatcactagccttgccatagccaatggccacaataccatggtccaagtcagtgccacatgagccggtcatcacaccacctttgtagaactggaatgtcatgtcgcctccatcgacggccacagacacaggttggttagccaccgccttcataagggcagcctcattgttggctggcacatcctcatagcccttgatcgatgcgacgctgttggatacactcttgaacttgtcgtctactgctgcgtatgggtagttggactcggtggtgaggccaccattcttgatgatgaatttgaaggcatcatccatgagcccaccctcgcagccctggtcctcaccatggacatcacagtcaacaagctcttgttcagagagtgagagataagtttgcccgtgcttagcttgacaataccttccatggctgccacggccgaaaacgcccaacaacaacctgcaataatcattcatgttcaatgcattggacacaatagatgttatcacaaaactctatcataaaagatactgaagaatgtcatctgagtagcctgaattttcttaccacattggccttgatccttgatgggagtgaccacgcccttggttctccagtccatggtcgccggcagcgcatcaatgttaacattctcattcctgaatccagtaggaaccctagtcgtgctaggaatgaatcccttgttggtcttcgtcgacctgaactcgtcattggtgaggtcggcgaactggttgacgccgagccagaacttgtgattaccagcattgaacgactcgatgaaggcgacattggccttgaacacctcgaaccggcgtgccttctcggcatcgtccttgtacatgcgcccgtactgcgccatccacctctcgtgcctcgccgccatggccgcgtcatcgctcagctcacgagctgctagaacagcgctgcagaggcagaggcatccgaggatggcgaagagcagagccttggccatggccatgatcgatcaggctttgtgtgaccttgatcctgctgctgttggttgctgctctgctgctgcttctgtgaactctactttggtttggtgaattggaattaggatgcattggtatatatagtcagtggtacgaacttatgtaagcacatacggtgcgtgtacgatgttgtgtttctgtgtaaacggcagtctgcgtagccgtgaagtatatacgc

SEQ ID NO: 5200 - DNA, 1501 bp, Oryza sativa
aggccggcggagtggcgatgggcaggcagcaggcccgtgcagcagcggagtggcgatgggcggtggcaggcagagcggcgccgggctgtgggcggagcggaggcgggcgaagctcatcttggggcagctcgcgggatcatggggcggggcgcatccaaagcgcacattcagatcactatttgtggaatgatattttgcacaaatctggtttgcgatggaatgaactgagaaacgagcatcatctcccctgtgtcgtcctctgtgccaccgtgagagcacacgacacacctacaagagttcagacattcatggaagcagctgcaagggacccatcatatctgctggaagaagacaactaacatatttcggctgggcagaataacattcgtatcaaatccaattcttgggtgcaaactctaacatattttggcttggtttgatcgcaagtataggttttggacaactgacagatttttttttatcatagaccagagactgacagatgtgctctctatgagggagaacaatacaggaggctgccctccacctgctgctggcccaaatatccaacagcgagagaacaaaatctacattaattttattacggcaaggagaaattcactttgagtacatcgatttggtggactcatgtagagttaaaagtactctactaatttggttgggagtaacgttaatctggttaatttcgattaagagcaaccaaaatactgtattttctatctataaaaaaactccaaaaatacaattttttttatttgagaaatgcattacaaacgtagatactcacaatacacatacacccatataaacgcacacatacacccaacctttattagcgcctcgaaaagaccgaacttgcatattttgagagtgacaaagtcatcactggtacctcgttatcgataagtacgttgtctagaattgaaaaaaataattagctgtaaatatgagtactaaaaaatatattgtactcctctatgttctatctattatatgcaatacaaatattttcagttctgttatcctaaattcgattgccccaatgtgcaaaactctccataggatacacacatcactctaatcctccattacctatgacaaacacattcattccgtgtgaaccacgtttgatttagccaatcacattcaccaaggcaaatttggagcactcaaattccaattttgtattcatattcccattcaacaaacccccacagcataatttaaaatgtaggcgtctgtgtgctgcaggaaacgtacgtccaatccacaataatttatacacgcgtatatacttcacggctacgcagactgccgtttacacagaaacacaacatcgtacacgcaccgtatgtgcttacataagttcgtaccactgactatatataccaatgcatcctaattccaattcaccaaaccaaagtagagttcacagaagcagcagcagagcagcaaccaacagcagcaggatcaaggtcac

SEQ ID NO: 5201 - DNA, 1501 bp, Oryza sativa
ctttgtagctttttattataatcacattgataactggcagtgttttaaatatggccatatgacttcttgtataaaattaaaagaatacattcatcatcgtgggtggtatctatatttcaacaagatgcatgctaaacggaggaatctcagtacattagtactatctaattaaaggatgattaatcatctgagtcagcacatgatgcattaaatcttgttgacagaaggtgccatttacgcccgccgacaggttgctatttattttgtgttctagtaagtggtaaagaaaaggatgaagtttctcaaattctataaagtatatatatatattttttagaaacatagtacaaacgcaagcactcacaacgcacgcacactaactcctatggacgcacatacgcacaccctacccctttgagcacttccggaagacttgctggcatatcttgagaatgacgaagccaccatgggtgccatgctgttaacggttacatcacctaccactaaaagaataattagccgtaaatgcgagtaccgtggcaaatctaggatttgaacccgggttggctagttccaccacaaggaacctaaccagttgagctatgctcacttcgcatatgatagatatagtgagacactgaccgtactcgagtatattgaagatctatatttcggcataatttaatcgagaataacgtgagaataaatatgaaaactatggaaaagagtaagctattgttaatcacaaccttaccagcagagattatagcatcaagtaacatgttcaacactagagtgagcactactacagaaaatggaataggtgccggttgggaaccgtccataggtgccgaattttctaaccggcacctagtaggcggcacctttgaggaggactcaaaggtgttggttcctaaactgacacctttagtttctagaaatgcaaaaaaataataataaaaaaagcggcttgacgagcagatcccttcagctcgatcagattccatcaatattaataattggcatccaagaacatcaacaacatccaaaaacacatgaacacgtcaacaacattgaagaacaatacaatattgaacacatcaagaacatccaccaccgcggccgtgggaaagccgccgccgacgtggtcgctgtcggatcggccgtgggaagccgctaacgcccatccgtgatctacgccagatccaaattgtcggcgccgctccgcctcctctgtgggcgccacccatagtagcacctcgtgcgcggtggcctcagtggctcgtaccgcctctgggcagatcgacgctggtcgcggtgccctcgtggccaggtgatgagtggagagagagagatggcggaggtgactagagtggataaggacacccactctgcccttccctctccatatccgctcgcgattagccggctcggctcagcttggttattacgggtgtctgttttttaattaaatagcacctatttaactcagcacatgtag

SEQ ID NO: 5202 - DNA, 803 bp, Oryza sativa
ttttttttaaaaaaaaagaaacataaaattgtacgcatgaaacataggcaagctggcaaacggtgttctgtacacgtttaatgttgatactctaataatgaagtatttctgttcacccgtagtaaggttagaatgaagagtctcccttggaggaaatttttatataaaattacaggaatagagaaaacacacataactccgtcccaaaatataacaacttttagcctcagaatttatcccaaaatataataacttcttcaccacattatcttcccaaccaatcacaaccctccaccattcactttttctatatacctccactactcatccaatcacaaccctccaccattcacttctacctactttattaataaccgtatcaaactctaaaacttattatattatgggacggagggagtagaattttaaagtttgattttctaagaatgaagtagggagtttaattgtcctctcataatcatgaaaaaaaagaaatagacaaggaagtaacacagaaaaccccaaagggcctattcattttggaggaatttcaacgcataggaataggaaaaataaacgaataggattgcatacacgctttaatccataggaatttttccatgaggtttgtgtggatgaaaaattccctttgttttctgtataggaaaggaaaacttcctttggttttcctatatttacattcctatgaccccaatgacattcatatgaattagtatttaggaatctaaatgctttgaaattcctccaaaacgaataggcctaaaattaattatcaaaccaaa

SEQ ID NO: 5203 - DNA, 1501 bp, Oryza sativa
aatgataggaggaaatgtgtgattggttgaaaagaaaaagtaggtggaggagaatggttgtgattggtcgagatgaggaggtaggtggataaatagtttcattttgggacaaggtattgtgctagaaatagctacattttgagacagagtaatatgaaccctagatcgatccattcatgggcgtcgacggcggtttctgatgagtagggagttgtagctgcgtcctagagaacaagggcagaatggtaattaccccagtcaaacgtgttgactaacagaattatttgatcctaacgacagagtgccattttggcgtgcccaactgtgaaaccagtggcattctaccaattgaccaaaaaccagtggcagaatgacaaatacggtaaaccctagtggcatttgtgtaattggccctattattaaaggtatagaaaacttggaaagtcgactcatgatacccacaccaagggtcggttcactacaaccgctctttgatagtttcctgtctatttatatatattttaaaaaaaaacacagtacaaacgtgatgttgtttatatgccagaggaaacccaccgtctcttgtccgagtgcgtcaaatttgtacaatttctttcaagcaacatgtttaaaagatatggatccatattatttacttttgtgcatgtctgagttggttagctctgcggctgtactactcatctactcgtatctcctgcggtaatccaagatacagtgcatcttatttttctttttgctgatagatatttaatttcttttttcattgtaacaatggggtctcgcaaaaaaaatgtcgaaatacctaattggtgctgcctcgcaaaaaaaaaagtcaaagttaattacataaaaccactcaggatcgaacaaatgcatatcccgctgaattttaattttttaaaatgatttttcttctgatattattttccataattttggggattttatttttttcaacccccatttctcttctttcttcttgtttatccccaattcgaaaatcctacgcgcgcgggtcttttggacgagcaggccttcggaactacatcctctagagtatctgcacggggtagggaagcgtgtttctttgcacgactactctttgtttcgacaaatttgactacttcatctactttgtgttcatgttcgagatgtcgacgaaatagaatggcaacacagacactggcaatgctaatgccaacaccaaccactagtgcacctggatcaaatgtttctggtttattctctgggtatcactactacagaaacacaaaaaggatacggcactataggtgctagaatagctaaaccagcacctatagtgctttttacctctaacgcacgcccacagagcgccatcggctagaaccgacatctttgtgaagaaataggtgtcgtttctagagaaaaaccaaaacaaatactacatgtgctgatttatcaagaaaaaccaacacctataatttattaatctacatgt

SEQ ID NO: 5204 - DNA, 1501 bp, Oryza sativa
tggagataaattatattcctatatgaactcttataaatatttttctattttcagaatttattttatttgttattccgaattttaattaatctctctatatacggtctcttctttcaatagttcttttttattgcaaattttagttatttatataatgtattccactctcatttttatttttgtattctcatttttttattttgaatttcaattactcttgtgttgggtttttatttggactcttctttcaacattgcttatttttttaatttcgaattttagttattttactacttgaaatcttctttttgttaaaaaaaaattcggattttattttatttatattttaaattttaattaatctcatattggattcttatatatatagactctcctttcaatattgtttatttttaattccgaattttagttacttttaaattgtatttttacttgaaaattattttttgggttaatgtgggaatttctatccctcataacaggagtagagtacaaagagttagccgaggtaattgaataaatggaccagccatcaaatacatctatttctctcgtgtactggtcgtaccttctctttctctggctcctatttcttcgttattttgttggagacggcagatgggaaactgtacgtgctgtgattgctttgtagtatctttttttttttggtagctagccaccatagcaatcggacacaaaatcatacacggacatagcttttttccctagattcctattacaatttttgtttcctagtgctagtttggtaagaaaagtctaactgctgctggccaatttctataatacacgtatctgtatctgattaccatattaaaacttctatgctattaaatctcagcccttaaaatttagacaactaagatctaatggtgtaaagttttctctttttctccgattaatgtgagaatttctagccgccacagcgaacgtggtgttgataatataatagatagatattgaatcatgcatatgcatgtcaaccacaaaaaaggtttggaccaattgctttcgctattgtagagttgtagtagaccggtacgaatgtgtgatagcttggttgcttacgtgctcgacggctgctacagaaaccagaatagtgtcatgcgtatgcacataacgaataatcatgaggcgttgctccacgtcgcgttcgccgctgtgttgcgctgggccgtggcctctccgatctccatgcctccgccgcgaccgcgcgctggacgatcgaaatccgagggtaaaactaaattttttacggtcaactaaatggtcaattaacaaaaaaaagtaagtctctctctctctctctctctctctctctctatatatatatatatatatatatatatatatatgcttcggacaaaaaacactgttcaaaaacactatttagtttactgtttaaattactgttcaatactgttcacttcgagagatattttaactttaggatctttgcagg

SEQ ID NO: 5205 - DNA, 1501 bp, Oryza sativa
tatattattaaattagttttattaaattaataattaaatatatttttataataaaaatttatcatgggtcgaaaatattacttttttctataaatttggtcaaacttaaagcagtttgactttgaccaaacttaaaatatcttataattaacctgaaacgaagggaatacatatttcttttcactgttaaaaacacattgtggtgcatatcgtaaggttaataagacgacaacgaaccattacaaaataaaattttgcggaaagaaaatttacattggaagctcattcatttcgctccccctgatcaatgatcatcattatgttaagctttttacttcttcggtctgatattaaatttatttatagttacttccattttttaaaaaataaatttttaaagtaatcattgtatcatgctttgtgaaaataggaaacagttgtattagaagaagataagatgagaaatagttctattgagatttgataaagtacttttagttttgtattcatacgtgtaaaatataaaaagtaaagagtaaaatacaccagcggtctttaaacttgtcatgaggtttcacttaggtccacgaacttgtaaaacacacatcgagatctctaaacttggtttattgtatcatcccggtccaaagcctcgtttgaccgtgatgttgcctacgtggcacgccctgtgaacgatgacatgtaatttttatttatttttctcccttctctatttttttccactttgcctccctcctctcccatctgccgctgagggccggcgcccacctgtcagggccttcttccacctctccaccgcacgtgcgcgctctctgtctcgcaagtggtgtgcacgcaataacgtcgacgtcgtctcgtggttgtgttctcggagttttgccatctattgacgcgacgccgaccattgcagcggcggcgacggcgatgatggaggtggctgccaggtcgtcgtcatcgttgtcattgtcgatctcgactcgtcttgcttcgggttatttcgcggacaccgatggcgtcggccgtgcggcttcctcgccagacaaaggcgatgtcgagaagccgctgcaggaagacgagtgatcagatgacggtgagttcatcgagctggaatccttttgattatagagagagatgcgttctgttttgtttttttggaggagatcatcaacagaaaaaaggagcgaacccgaggatccctcgtgccgaaacagaatcagcatgaaccctaatgatcgtccattatatgacccacctgatgctaaactacattgtcgtcaacaattaattggcggccattatttcatcatactgcctctaattgtcaccgctctaaaccccaaaaagaaaaaaaaagagaagaaaacatatgcttccaatggattctagaaaaaagagaacaaaaatctcatagtggactaaccgtgcatatgcatggatcttgcatacagatgctggtggaattaacgggtggatcatggct

SEQ ID NO: 5206 - DNA, 1501 bp, Oryza sativa
tatgcacggacatacccaaatatttcagagaaaatataggatgtagtattcattcgtggcctaaatatttggtagatgcccttgttcctaaacaaacggaagaccaaaaggcttacctgatctcgttctctagttgttgtgggcatttctgttggtcagttggtggtgcaagaaaagtagcggaagcaatggccatacagtatgttgtggtggtcggccacggtgaggctgagaccatcgcacaacgcagtccatgttacgccgacgccaatggcctggagccttgaggccctaaagccatcaccgaactagtagtcttttacccttctataatttactttctctgaatatctgattcttggaccagtgttacttgattcaaattcatcaaaactaaaatgcaaaatcaagcatgggttgcgacaacggaccaagcatgggtgaaatgggttctttcataaattgtgtacattttaccaacttttcatgaattaattgaactaaattttgatcaaatttcataaaacttttgctacctataacctgacatgttttagttaaagaatggtattatacatcctagcgtgggcacacccaatatgatttttctgggtccgccactgtccctaatagacaaatatcaatgtctttagtactctcacatccttcttggagtttgtgtggaagccacctcttcatttaggggtggttttatcatctctcacctcacttctctcctccacctcatcacctaattctatgtgttatttctagaggtagcatatgaagcattatagtaattgcccttacagtactgtagttttaaaggggtccacaaaatacagaagtcccttctctcctctttctgaattctgatgggctagccgatggcctgctgtaggtgaactgggccgcacggtgtgcgagtaaaggaagaaagatgcacgtgtgccgttggatgaattggtcgccagagatgaagcgaactgcaaaaccgtgactttccacgcatcgtcgtcgtcggctcgttgcggcattttgtcgaacgggtggcgcgcgccgcccaaaaccccctcggctccagcctcatccaaaaccctactccccccgccccgcgctatgctccactccggcctcaccaaatcccagcccctcccgctcctcgcggcggcgtcctcgccgcgacgcatcctcctcgccggccttctccgcgcagcgtgcttctccaggcccacggcctcctcgcccgcgcttcatccggtaaccaccgtcaccaaccgtgcgagcgccagagccgcggttagcccgggcggcccctcgcagctggggctgggaggtagggtttcgttctccaccgcacctgatggtaccgcatcgcccgacggcgggagcgcgctcccttggctcgccgccgcgagccgcgatggcggcgccgcccccgcggcgagggctagcgccggccgctcctcctcgtgggagacctccgcggagaagtttttct

SEQ ID NO: 5207 - DNA, 1501 bp, Oryza sativa
ttgatcttctgtcttgatatattattctgtagattgtggtgggtgtcgattatctcgtgtctactctcctcttagagggccttgtatttatacccataggtgtccctttgtcaaggtagaactagggaaaccaatatggatacaatccgagtagtccttgtcgtttccatgtagaactctgattgtctttccttatccggaactccctccatatctaaagttagttctcgtataagacatggtatatggtgggtcctgctgagattaagtcaactactattaggtatgtggtatccataaccctgacacacgtaaactggcgacactaaacaaatgggagtccaaccagttgaaacaaaatttcaatattgcttacttccttcgtctcataataagtttatttttagctcattacatttgttccaaaataagtttatttttagagtaattgttgcataagtagggaataattgtattgggggttgttagagaaatgaaaactagagttaccatcaccaactactcgggcgcatcttacctccggatacgaaccccccgtgggctgtgctcggggcactcctttcctcgggcgcggcaccccgcggattgtgcttggggcacatccgcccatagcgtgcccccctcctgggttatgcttggggcacatccgttgtagctcttgcaagctcatatacagctaagatagaatcaaagattacacaaaccacgtaagaacactcttcatgcccaagcagtggcccgagcgcgccacctgccttaggcaccccatgaaaagcgcagtcgcatcgatgatgttttgataggcgagggggttgctcaacaccccccccccctaattaatagtgatgtggcgcatgcataccatcccgtcttgttgagaatgggggggagcgtggtgagtcctgcaccacgcgtcgctaggcagggctgtaacacagtctaaaaaacttgcctccctcatttttatcgtgcgagcgtcgcgttgtttatctgtcagaggaatttcacactccgacaggagcaataaagtagaggaatgcattgagatttgataaagtaagggtattctagtctttcaggttttctattggtatgtgtgagataggtgaaaaataaatttattttaggacggagaaagtattagaatagatttagataattggagtaacttatttacaagggtaaattggaaccatgccattataattttgcaaagtttgagatatgccatcggtatctcaatgaatataggacccacatgtgtcaatgacatgtgggtttggatggcatatctcaatttttgcaaaattataatggcatggttccaattttccctatttaagaatggttattattgagcctgggatgggaaaatattttcccaccatcctgttcgaatccacgacaaagagtggataaacttttgaattttcgtggcacgcttttcaaactgctaaacggtgtgtttcgtgcgaaaact

SEQ ID NO: 5208 - DNA, 1501 bp, Oryza sativa
tcaaatttaaatcgggtatgtaaacttttgacttataaactttgggtctataaattttagttgtataaactttagatgtatagaaatgctatatatagaaaatatttgaattcaaattcaaatttgaatcagatataatttaaatttaaatttgaatcgggtatgtaaacttttgacttataaactttggatctaaactttagatgtatagaaatactatatatagaaaatatttgaattcaaatttgaattagatataatttaaattcaaatttgaagcgggtatataaacttttgacttataaactttaggtgtataaactttagatgtatagaaatactatatataaaaaaaaatatttgaattcaaattcaaatttgaatcggatatataaacctttgacttataaacttttggtctctaaactttaaatgtgtaaacttgaggtgtataaactttaggtgtataaatttactaaaatagaaaagtaatgcggtgacaaaaaaagaaaaccaggtggagggtggggggaggggatcgatcgctgtcctaacccgaacagcatttccgcatataatatcgtcttgcacctgtggctctgaactcaattgctcttgggctgcaccgaaaactattcagcccaagatttgttttcttctcattttgttatgtttagcccaggggaaaaggtacacccaaggtccctcaaccttgtcatcgagttacaaaatcgtcccctaaccacaaaaccagatatctagcgtcccttgactagttaaaaccggtcacaatagatccttcggtgattttgaccccggttttgtcctacgtggcaactgagacagcgtgggacccacatggtgcctaaatgtcaggctgagtcatttctctccccctcctctctagtctctagtctcttcctcggttcctcctctctctctctatgtgggtctgtaggccggtcggaggtgcgaggcgggagaggagggcggtgccgcgacggcggccggcggcggccgcggtggggaagcacggcggcagcccggtggagaggaggaggaggctggtctgccggcgccggagctgtgcggtttggtttggttggttggtgaggggattcagggattggtttggtgtttagtactgtacgtgcacgatggcgacgtggaggagcttgccgcggaggccgacggcgatggagatggcggccatgacggccgggccggtcaggaacctcaccgtcatggcgaacgtcgccaccttgttccggcacgcgatgatccgcggttgcagcgccatgaacagccctgagagtgaagaaacgtgtttgtgttggtaagttgcaagaactgtgttgtgaggtaaggtgaggaggagaatgaaccgaggctgaacatggccatgccatggccggcgtcggagaggatggagatggatttcaggagattgatttcccattgtgattatcgatggcctgcattgctccatcgattctacagt

SEQ ID NO: 5209 - DNA, 1501 bp, Oryza sativa
agtctggacaataggtactcgagcaagattgtttttttttttggaaaaaaaaacaatattcagaggaaaggatgtccttccgaatatttttgtaagaagaaaatgcaaatgtattgaggtttgaacactgaactttaaggttgaaattatatatcccttaatactgcactatcaagtgcatctcaagattgcaagtttgcaaccgttccagctaagggcacccgtaatggttatctatatgctctctacaagagatccatgtcagcatatttttctatttgaaagagattaaatggagagagagagagcaaagctatctactaacctggagatagtttatagagaaaaacgagacaatgtattagatagctatagatacccatgtaaacatactattgaggtggtttactattatctagtctattgctgagatgtacatgttttacagagaacaccttagagcacccacaatggtaaagtaaggtgctctctataaaacatgtacatctcaacaatagactagattaatagtaaaccacctcaatagtatgtctatatgggtatctatagctctctaatccattgcctcgtttttctctatagactatctctaggttagtagatagctttgctctctctctccatttaatctcttccatgtaagaaaacatgttgacatggatctcttgtagatagcctataaataaccattgcgggtgtccttactggtgctctaacaaagacacattatatgataacagcactaacaaatatgttcatgaatgcaacttagaactggctgattagatcggttccagaactacaaagcggcagccgcatccacagccaatctgcgaccggtcagccacgacaatcgccggatcgggctggagggttgcacgtacgcacgctctctcaagtctcacacaaccttccaccattgatcgagcgaagcatttgttgggaaacgcagccgtccaccgagcatcacgatccgaccggcccagaacgtttcggatcacgcaaatcgatcgtacatccggcgcccgatcgcgaacgaccaccacccatgcatgcatggccctccgcatgcacctcggtctcgaaccgatgtaaccaccaccacaggtccaagcgcgcggcggatggggcgccccaatccagtggcgctaccaacctcggtcaaaccggcggccaaccgaccggaggcgggccagccatcgccgggcacatgcgctgcgtgtaccgctgtgcgcgaggcgttgcacgcacctaacgcgcgcacccacatgcgccgatgcgccgttcgctcggtcgagaggcgagcgaacccggcctatctcgtccgagcgagcgatcgatctagcggaggggccccggacccggcggatcggagtagcagatcgacatgcgtatctcgctgcggattacggtgcctcggctgccgtcgcgcacgagctgcaagcacgccattggatgcttatataaaactttccgatcg

SEQ ID NO: 5210 - DNA, 1501 bp, Oryza sativa
gctggcccccgccgcacggaggatgggggcgtcggcggcggcggtgatggaggacggaggcaactggatcgagtgggcggaggaggacaaggagaaggtgtgggcgcgggagtcggcgcccgtcacagagatgcgccccaccggcgacgagcgaagccggcaggcgagaggagaaggaggtgggacggtgacggttgcaaggtcgacggtttggtcgccgttgacgaagacgacgggcagcatggccttgggccgcggtggcagtgggggggaggcacgtggacgcgcccgtgcaaaccttcgcctccgaggacgcaaggacgcaagcggccgtgactagcagcgccgacgcgggagcagggcggcggcggcgctcgggtctacacggcgctagctctagcggcggcggcatcgaggagggtgtcggcggcgcgcggggccccagggcgcaagcggaggatgccgtcgcccccgtctctgtcttctccgctggcacccccaactcgccaccggggcagcctcgccccctcgaactcgtcggcagtgtccgcatctgaccctaccccgtcctggtgggagacggcgaggtcccacatcctcgcgctctccaacatcctcccgccgccggccgattccgacgtcgcggcgctcgccgactccgactgcccggcgcacgcgcttcttcggtcacccgcgcgcctacgccgcgctgtccacggcgctccggtcggggggtagcaccgaccacgctcgccgcagccgccggagctcgcctgctccgccgcccacacacaccgtccgctgcccagaaggagagagagaggggaaagggaagagaagagagaatggagagggaaggaaagagaagtgaggctgacatgtggggcccacatgggccccaccattttaaaattattttttgtgtgcagctgacatgtggggccacgttttttattattttgctgggatataattgccacgtaagcgccacgtcaatgccacgtggggtgaagacctagtcaaaaaagccacataggcgccacatcagccaaaaccgccgaaggacctcgtttgcccggttttcgtaagttgagggatgtgtcgtacccggttttgcagtcaagggacgaaaatcggactggacgactgtggggacacccaatttaggcttgatgccccaaaaatccactcgtgatcgtccaggatttcaatcacgcacagattgatgtacagaacagctttcgattatttacacaggtttattcatacaagctaattatactactgttaaaaggtgaaaagatccaaactaaagaaaggatatttaaagatatttaaagaaaggatatttaaaggaaataaagaaaaggtaattaaataaagaaagaaaggatatataaagatatttaaagataatttaatttaaaaatggttttaaataaaataagaaattttaaaattaaagggatttaagataaatcaaataggtttaaattaaaag

SEQ ID NO: 5211 - DNA, 1501 bp, Oryza sativa
gcgaaataacccgaagcaagacgagtcgagatcgacaatgacaacgatgacgacgacctggcagccacctccatcatcgccgtcgccgccgctgcaatggtcggcgtcgcgtcaatagatggcaaaactccgagaacacaaccacgagacgacgtcgacgttattgcgtgcacaccacttgcgagacagagagcgcgcacgtgcggtggagaggtggaagaaggccctgacaggtgggcgccggccctcagcggcagatgggagaggagggaggcaaagtggaaaaaaatagagaagggagaaaaataaataaaaattacatgtcatcgttcacagggcgtgccacgtaggcaacatcacggtcaaacgaggctttggaccgggatgatacaataaaccaagtttagagatctcgatgtgtgttttacaagttcgtggacctaagtgaaacctcatgacaagtttaaagaccgctggtgtattttactctttactttttatattttacacgtatgaatacaaaactaaaagtactttatcaaatctcaatagaactatttctcatcttatcttcttctaatacaactgtttcctattttcacaaagcatgatacaatgattactttaaaaatttattttttaaaaaatggaagtaactataaataaatttaatatcagaccgaagaagtaaaaagcttaacataatgatgatcattgatcagggggagcgaaatgaatgagcttccaatgtaaattttctttccgcaaaattttattttgtaatggttcgttgtcgtcttattaaccttacgatatgcaccacaatgtgtttttaacagtgaaaagaaatatgtattcccttcgtttcaggttaattataagatattttaagtttggtcaaagtcaaactgctttaagtttgaccaaatttatagaaaaaagtaatattttcgacccatgataaatttttattataaaaatatatttaattattaatttaataaaactaatttaataatataaatattattatatttgtatataaatttagacaaacttaaagcagccttataatctaaaacggagggagtagttgtgatacagcaacattggcgtgtgttggtgttcaaaatcaaaaactaaggcttagggtagcatctctggataaattactactggaagtgtggttatattacaaaaactggatcattggatgatggatccaactatcacaacatcgaaaatccccccggttacatctatcaacaaatgttggtttctgacagttcccttcatatcgatcaatcgtccgattgcaccaaattaacaacagtgataaaatttggtaagaactaaagataggctagtaagctacgataatataataaacttaaaacttactaacaaattatggcatgtataatatcgtctttcatgataatcttctaatgcgaattaaacaggtatttgattaattagttaatcaatatatatcataaca

SEQ ID NO: 5212 - DNA, 1501 bp, Oryza sativa
cctcgcccgcagctcacaaagcctgccgccgtgcgtgcatgcgggctgcgcaccagcaccagctttgcgagaaatataagatggttttcttgattatacggcggggtttgcgtgtgctacgtgctgtccgaatatttccgtggatacggtggatgtatagtggttacagtattatcccgtactactactactgtgtcctactgtccttgtttagtactccgtaggaatttagggcaaagctcaacacagaaacagaaaagtaggtgaccgaattgacgcacgcggtgctgttgctgttgctgaacgttagtaaggccgagtttagttcaaaactttttttaaaaaacttttaacttttttatcacatcaaaacttttctacataaacttttaattttttcttcacatcgtttcaatttaaaccaaacttttaattttgacgtgaactaaacacaccctaataagcagtcccggattgaagtggaactaaattggcagtgacacctaggggggacaagaaaaatctcgcctcccatgtcgtgacagctgtgccaatgcttaattcatgcgtcggtaatgcaaaacagaagtactacatgaaattcaggggaaactatgataatactcgtaagcacctgctgttgtgatcgatcaaatcatcaactgatgattaggccgcttccacgcggacgggcacctcacgggtgatgtgcgattagtgcgaacgtccggtgccccgcgtatgccgcgcgcgctatccgtcgtacaggacgcgagagtagctgttacgtctcccggccggactgttccagtgtcctgtgtccacgcgcacggtaccgggcggggcggccggtataaacgccgaaaatacacgacagattccataaaacaaccccgcacatgagctctatttagaagagaacatggcctgcttcgatggacgcaataatggagatggcccagacgccagtgggtgagccccatcaccgtggagttcgagtgaaacactgaaacgtaaccaagccgatcgataagacgaggccatcgatcacagcttcacgtacacctttcacggccacgatctgcacgaaaagggaggagtccaaaacatccgaggtgggggctactgattgacgtggtggaccattttaagactttgcagaccgcaccacgtatatggcgtatatcctcaatattggaccttggtccaccactccagcctggggacaggcccgaaatctttttatcagctacagtaggtagctttcatacacaaaaagatgatactgtagatgatctcccgtttgcaattcagagtacagaccgaacctcggtttgcgatgataagtagcagtctagcagaaacagtgatccactgcttagctttacctggcctatgttagaccgtgatatcgtttggaatacattcttgcttgctgctagaagaaaggctacctacacaaggtcacacctaatggcaactggagggtgggagacacaga

SEQ ID NO: 5213 - DNA, 1501 bp, Oryza sativa
gttttcgcacgaaacacaccgtttagcagtttgaaaagcgtgccacgaaaattcaaaagtttatccactctttgtcgtggattcgaacaggatggtgggaaaatattttcccatcccaggctcaataataaccattcttaaatagggaaaattggaaccatgccattataattttgcaaaaattgagatatgccatccaaacccacatgtcattgacacatgtgggtcctatattcattgagataccgatggcatatctcaaactttgcaaaattataatggcatggttccaatttacccttgtaaataagttactccaattatctaaatctattctaatactttctccgtcctaaaataaatttatttttcacctatctcacacataccaatagaaaacctgaaagactagaatacccttactttatcaaatctcaatgcattcctctactttattgctcctgtcggagtgtgaaattcctctgacagataaacaacgcgacgctcgcacgataaaaatgagggaggcaagttttttagactgtgttacagccctgcctagcgacgcgtggtgcaggactcaccacgctcccccccattctcaacaagacgggatggtatgcatgcgccacatcactattaattagggggggggggtgttgagcaaccccctcgcctatcaaaacatcatcgatgcgactgcgcttttcatggggtgcctaaggcaggtggcgcgctcgggccactgcttgggcatgaagagtgttcttacgtggtttgtgtaatctttgattctatcttagctgtatatgagcttgcaagagctacaacggatgtgccccaagcataacccaggaggggggcacgctatgggcggatgtgccccaagcacaatccgcggggtgccgcgcccgaggaaaggagtgccccgagcacagcccacggggggttcgtatccggaggtaagatgcgcccgagtagttggtgatggtaactctagttttcatttctctaacaacccccaatacaattattccctacttatgcaacaattactctaaaaataaacttattttggaacaaatgtaatgagctaaaaataaacttattatgagacgaaggaagtaagcaatattgaaattttgtttcaactggttggactcccatttgtttagtgtcgccagtttacgtgtgtcagggttatggataccacatacctaatagtagttgacttaatctcagcaggacccaccatataccatgtcttatacgagaactaactttagatatggagggagttccggataaggaaagacaatcagagttctacatggaaacgacaaggactactcggattgtatccatattggtttccctagttctaccttgacaaagggacacctatgggtataaatacaaggccctctaagaggagagtagacacgagataatcgacacccaccacaatctacagaataatatatcaagacagaagatcaac

SEQ ID NO: 5214 - DNA, 667 bp, Oryza sativa
cctcctgagccattgtttgaatggaaatacccaaccttctacatattttatacgcagatgttcttgaactaaagatcataatggtactactactacctaatatctagtgagcatatacactgaaaactgtaaagttacaatttgatgtatttatttccatacatcatatcataaggataagtgggtattattttaaccgtgagtcacaacaaatttgatggtgcatcagctctttgctcttaaagcttgtctgtggttactccttccagttccataattcttgacgttttggatgaggttgaggtcaaacaattagaaccttgactatcactaacttttaaaatatttaatttgaagacactagaacatgatgcatatattagtttaaaaatattttttaaaagctaaatatttacttattttttgtatatattataatagaaaatcatagccaaagattttggagatcatgttgttgtccaaaacgacaagaattatggaactggagggagtacgtgctatttttctgttgggatatatttatacttgccttgatcatttgaaagacaatacaaatgtgtagcagtctagggccatcttatctatatagctcatctgacaatatagtctaagctgtttcttgtgatcttaacaatgtccttgttaa

SEQ ID NO: 5215 - DNA, 1501 bp, Oryza sativa
gtttcaactgcctcatgccggccggttgctcaagtgaataaaatgtcaactcttctatacaaatttaagaaaactcatatataattgtaatataatgattattctcgtaacaaaccttgaccatacattatttttgaatcaaactatgagagtcaaactatctttggtcaaaatttgacttattgggatgatatttttgttgttgtttcagggatcgatttcactagctccacctgtttaaaatgcaaaagaacccacctcttgaacaaatcttagtttaggtttggggttccctatgttctaaagctttagatcagaagaggcaaaacaattttttgacttttatctagttaaatttatgtccttttgactttttagttaaattttgattgggtttgattaaattaatttatagaaaaatatagtagaattttcaacataaaagaaacatattatcaaaatatattcaatattagattcaatgagactgattcggtgttttagatattgctaaatttttctctaaacttgtttaaacttaaaaagttttgactagaaaaaaaatcctagcgacttataatatgaaacggaggaaatagcattttaggccgtttcgatttgaagaaaaaacatagtaaggaatttatagaattttattctaaaaaatgttcttccttaaatagccatttgaaataaaatattggataatattgaatcctacaaattcctcattccgtgcatattatataagaaatttaacatgatatccaatctcatgaaaagttttatttgagtctttatttcttcttaaatttcggtattttcccaccatctaactaaacaaacatgttttttcttaatgtttttcaattatctattttacacaagtattattgttaaaatcctatatttttttacgctgaaatcatatattctttattattatttttttaatcctatgtttccaagaagtgctatacgtacaaatggttggaaaatgatggttttatcatccgatggtcctggtttttatcatccaatggtcctgagttctataatgaaactatgaaattaattaatcatctacattaatcaatgaaaaaccttgcgtagaaagggaaacaaaaggctttttaacataccctgccccacctcaagaaagcaaggccgcgcgactatttatagccagaggcactcactcgctcactcgccgcagaccgcacttccatcgatctctctcctcgccacgggccacggccttctcctaacgggagccatggaagcagacgcgagccatacacccaccacctcctcctccgtctccgtctccttctcctcctcgtcgctgtccacttcctcctccacctcctccctcgtcgacaatggcgcgcaagaccggcccaagagctccaagcccaaacacgccgccaagaagcgcaagagagcggccgcggaggaacctgccaatgccgcccacggcgcaggggaggataccagcagc

SEQ ID NO: 5216 - DNA, 971 bp, Oryza sativa
ccccagctcgagtaccagcatggtggtgcctatctgcttcacgaatccccttttcttccgacggattaaggttccatctcaagctcctccgtcctctgcccctcctccacacggcgccctttcttgtaattagttcaagtgttgctgcttgcgttgcaacgagttgtagagttgcttgcgtatatatcaacttttcctgtagaaaaacatcccagttattaatttactcgttattattggatactagttgagtttattggatactcggtattaatttactcgttattatttacatcccagtttttcctgaagaaaaacgagttgtagagttgcttgcgtatttttctcgttattattggatactagttgagtttatgattttttttttgcatttactaattttccatggcaattcctgtccaacgttaacttggatgggagctctccttgtcgacaatttggacaatccttatcaggagtaggttttttttaaaatataaaaaagaacaaaagttgattttagtgaacagcattacgtatattcctataaatacaattgcagcttgtatacaattatacaattgtgttgatcaatcatgaacatcttgatctggacattctacaattgaatatggtactccttccatccaaaaatatcccaaaatataagagatcatatgattgttttaagtattaaatgagcctcattagattagattcactttgaaatatgttgttattgttttcaaacttacaatagttgacttaggataaatctagaatctcttatattttttgacaaagagagtgtaaatctagtatctcttgtattcagcacggtgggagcaatttctagataaagataacgacttctttttccttaagcttcttctaaccataataaataggtgatcataatttttgtattaggaagaaaattgacagttttggcttgctttcgaatctccagc

SEQ ID NO: 5217 - DNA, 1501 bp, Oryza sativa
actaaaatatattttaatccgcttaatagtccgatcagacattttccaatctagtaaaaaatcgcagctgatatagaatatgtgttctttcatgtaacctccaagcaaaagtaacagcttgcccacatggttaggaaaggaaatctgccaccagggttcaattcccaccgtcccctcctttacgcctattattatttgcacgctgtatggttaaaaaatcaaaaaagttttgccacgctgtatggttaaaaaataaactattattatttgcacgctctatgagcctctcctaggccagattaccatatcaaaaatttttgtacttattattactcagaataagtctactttacgtcccacatctcaaatcctattttcgcgtaattttttttctctccgccactagcacggaccatgcacatccgatggttaaaaaatcaaaaaagttttgcctctcctaagccagattacccactcggaataagtctactttgcgtcccacatctcaaatcctatttccgcgcaatctttttctctccgccactagcacagaccatgcacatcccatggttaaaaaatcaaaaaagttttgcctctcctaggccagattaccctatcaaaaaacttttgtacttattattactcggaataagtctactttgtgtcccatgtctcaaatcctatttgcgcgtatttttttctctccgccactcgcacggaccatatatatccgatggttaaaaaaacaaaaaagttttgcacctctttcttcaacatatatttattttttctctccgccactagcacagaccatacacatccgatggttaaaaatcaaaaaagttttacacctctttcttcaacagatattaagtgccactagcacggaccatgcacatccgatggttaaaaaatcaaaagttttacacctctttcttcaactgatttttagtgattctgaaatcttgtaatgaaccagtttttaattcgaaaattaaacataattaatgaaccagtttttaattcaaaaattaaacataattattattttcttttcgtcatctgcaaaagacgatatattagagttcgcaccatctatcgttcacgcatgagccgtgaaacgatctgtctccacgcgagtccgtgttcgattttagaaattatatcagacgcttgccatgcaaaagttgagagcgtgtgttatgacaatataaatatatcaatatgcaatagttgtttcttatcagtcctgattatcattaacaatgcattaaacaatttatctatgttggaatattataacatatatgttaactgtgtatttatagcatttaactttcattatacccgtagcgaagcacgaagcacgggcattttgctagtacaagaagaatcacgtaaaaataaaaaacagataattagaaaggaaataacggataccgaatcgcgtaaaagaaaagaaaaagggataataagaaagaaaataacggatatctccggt

SEQ ID NO: 5218 - DNA, 1501 bp, Oryza sativa
gttccccacgtggtatgcttctctaggactacttttcctcgaccaaatggttcatatatatgtatctttgtatttctgaacatcttagttttcatcttgcctctcgacagttatcatgctttaaccttccgttaccaacctaccacattaatgttatgatcgaccgatattatcacatgtagaaaccagagtattgctcatgtccgtcatgtggtaaacactgaaaccttaactaatagtattaagcaatagattattggctaacctctctatattcatgaccaattcaactatggtaaaacaaaatttaaaatgaaaaagaccaagactacttcaaaataaccatattaaccttttcttaaaaacaagctatctgagttaattaacaagagttgcaaccacatgaaccaacaacttactattgcttagtaatatgaccttgtatggcactgataatcaaagctttacattgaaaattgtaatacactggattcacaccgtataaaaagaacttcatatgaaagacttatcatgaagatcaaataatgcatgtcctaggttcaggtgccagtacttgcttatacgctactccctccgtcctataatataagagattttgactttttacttgcagtgtttaaccattcgtcttattcaaaaatttttggaatttatttattttgtttatgacttactttattatccaaagtactttaagcacaacttttcgttttctatatttgcacaaattttttgaataagacgagtggtcaaacagtacaagcaaaaaagtcaaaatcccttatattatgggacggagggagtacctgttaattttaaaaacaatattttatcatatatataacaaaataaataatttgtgacagtaatctatattgaacattgtcgttctcaccattctgggctggctgttaaaaggccgactgacggaggtccaaccctatgcccgctggtgtccactgtccacagaagcacggagtccgtgcagcggggcgaacagccgcctccgcccgagataactcactccgcctccccacacgcatattctctctcctctctgcgccgttcgcctagctctcctcccccccttctcttctttctcctcacggttctcacctcctccccccttgacagtgcacacgccaaaaccaccgctaactcccacctctcgcccacacctccctgatccgatcccttcccccctacaaccctagccgaattccgcctccgccgcgatccgctcgtcccgcgctccaattccgtccttcatccgctctttgttttttttgcgattgtttttttgggtgcgattggtttggtgatccgcgtgttagggttcgggagtcgccggggcgggggtttgggtggtggattggaccggtaggtggccgggagggttggcccttgtggtttcggggtttggtttcacccgccgcatgtggagaatcggaggacctgggagaggttagggttagggtta

SEQ ID NO: 5219 - DNA, 1501 bp, Oryza sativa
agcatgagctaactgggtatagcttacatgtaggaccctgcgttgatctgcatgatgacgcgcacggtgttgttctccggcacggagttgacggcctgctggatggagaggaagtcgccgccgccgctcgcgtccaccacgatccgccgcacgcccaccggctgcctgtactggtggtgcccgcgcgtcgggcgctcgcacggcgccggcgccgcctggcacgccagcggcggcaggaggctcgtcgcgagcgtcgccaccgcgaacgccatcaccaccaccacccgctcacgaaccatatcgatcggtttgcgtgtgtatcccccccgtgtatcgatcactcaaaagcgtgacaacgttttcgcgcgtacgtgcgtctttgtcactcaaactttcgctagctctcctctctatatctctctcttcacatgcacgcggaatatgtggtgagagagaccgagactgtgaggcaggggttcggaatttatagggctgtgaggggggaggaaacggccatgcaaataatggaggagagagctaagctatagccgcccgacgggaacactccaagagctaagctagctgctggcgctgcggccccggtttggaatttctgctttggtcggacgccaacggtcatgcatgcagctagctagcatgctttcgatcgctagctttcacctggtagtttagctaccgtagctaacgtataataattctgcgttaatgtttcagaaaaagagagatatttacggacactgatgagtgatgactgatatatcaaaatcatacaatgtacggatacctcgtccatatgtttattcactgagataccaggttgagttcctgcacttagctgatattttaacatttttcttgtcatagaacaattgcaacgtcatcgacggagctctaaacacacaatagacttaccgatctctccaaaatgtcgtcgcccagctagcttttgtgtataccccaagtacaattttcagtccgtagcatctgagtatatctgcgtaccaaaacccgagtcacatcgcgtatcaacattgcatcaaaatatgtgttggacatatacaccagcttttccgaatccctagacgcgagagagcgatggtcctgatataccgtgggccaacaccggatagagacacggcgtgtacatggataggagcgtaactgtgatcagagcatgcatggccaaccataagtctcccttcgctgcaaattaatatgccgtgaaacttggctagattacaaactggggacaccgagagatgccaccactacgcacgagatagaacagtacgatccctctgctaccttcctatcggttagctgcaggcttttacagtcacagcatgcatgatactccaacgacatatacaaggtacggagtatatagtatatatcactatatatactaatgcaagaagcctaattgattagctgggtgtctgcagtgtaccggtaggattaagttaaactaacgcaggga

SEQ ID NO: 5220 - DNA, 1501 bp, Oryza sativa
cacatactgcaggttgcataatcgtcaaacagtacatatattcctacactgttgccgtaccatgattgggcgagtccgcattctgttggactgctgcgagcgcgagcacgcgacgagtatcacagtgacacgggaacgtcgaaacggccccgcccataacgctatcatttaagaacaaacgtacgcttccaatctccatgtctcctcattcccgcgtcctgtatatgaccatgtactactgtactattctcctctctgctcttcacacgctgtaattctaccggccatatgagacataagaggaggcgtaccactgatcaatcgaacactgcttccgtttggttatgataattaattagggtgagtttgaggaataggggattgagaagattaggaaaatatgaaaaatgaggtgagccattagcatgtgattaattgagtattaactattttaaattgtaaaaatggattaatatgattttttaaagcaattttcctatagaatttttttgcaaaaaacacaccgtttaatagtttaaaaagtgtgcgcgtggaaaacgatatgctatctcactcattgtctatggaactaacgcacccttagagcaagtataatagtgagctataagcttactgtaaacttatgtggaggagagaggtaacaaaaaatcaaaggggttggctctcatgcaagagctagcttaacacaatctccaagacaaatacattaaatgtataagtgagagataaagagaggagaagaaaattatagccaaccttatagctaatattattatatatgttggctttaagatgaggtgagctatactattatccttgctcggatgggggagatgggaacccaactcctgcgcacggaaaacagaatagtccattaacgcgtgattaattaagtattagctaatttattttaaaaaaaatggattaatttgatttttttaagcaactttcgtatacaaactttttttaaaaaatacaccgtttaatagtttgaaaagcgtgcgcgtggaaaaacgagagagaggggacgggaaaaaggtgcatgcgaacacagcattagttaacctgtcgccgatgatgatgtaacatgtgtgctacaggtagccgtgtgtcctctgcaaacgtactgtactaccctcgctaggctccggcttgtgcattacacgctgtgatgactgatgagtaacccgtctgcaacgatcgtcgctttaccagctgtatctaaccgttcatcccatacgtctgtttctaggattcttgcaaggaacattgttgggtagcccagcaattaatgatggtaccatgtacttggagtagttttgatttaaccccgtgtctcaaagcttcaaaaggaatagcaaggccaccatcttctaactcgagtacatgtgtaaatagcttcctcttttggtttgtcgagagcaggattttctcagcatgtcgacggtaaacccagcattttcaatcacgaaaacttata

SEQ ID NO: 5221 - DNA, 1084 bp, Oryza sativa
tccaactagtttatagaaaacaatagaaagttcggaggatttcaatcctattaaaataattttctatgaatatctttataataaagattataaagaattaaatcttatcgtatcatttgaaatttctatggaatgaagatccaatagagatagagaaaacttagcaagagttataacctcttgaaaaattttctttgagtctacctcttcatcttatttctacgtttttcatacggtccaatcaaacggttatttctatattttctccatattttacaatcgtatatgaattcaatgttttttctatttctactattcaaaatggctcttaagatttaggaaaaggggatgacgtggttcccattgttgaaagaaggtatggatgagaacacgttatattagataattaaatagaactaaggctgcgctcgtctcatattagagggaaaatttttacgcacgtgaaacaagaaagttcattagcatacgatttattaaatattaattattataaacttgaaaaaatagatttatttaatttgttttaaacaacttctacatatatttttttgcaaaaaaatattatttaatagtttgaaaatcgtgctaacataaatgagtaagttgaagtttagagttaaagaaaagaacatgtccttaattgttcataaaacttttagtaagaaaatcttatatgtaccgttccacttctaaactaggacagtaccattcctttactcgatggactataaattccaaacatgtataacaagaagaaaaaatacagcaagttagtattacctaactaatcaggggtggagccctgcgcatgtttccgtcgtccctttgacagaaaaaaaaagatgaataaaaacatataaatatatctactattataaaaattaaagatattttttacggtcctttggtacgtcatccgtgtatgggtcgggttttaagttcgttcacttttgaaaatacagaaggagtcatataaaaaatttctctaaaaaaaaactcgcatgctaatttgagacgaccagactcctactacaggattttctctctctctctctctctctct

SEQ ID NO: 5222 - DNA, 1501 bp, Oryza sativa
caccgttggccgcgcctctcgcgccaagctggcctcctccaccggacgcgcctctcgtgccattccggtcttcctccatcggccacgcctctcgcaccaagccggcctctatcttcgccgcctgagcctctcgcgctgagctggcctccgctgccatcggctgcgcctctctgcgccaagctggtctccgacccctccaccaaacgatgtcgcgccggccagaagcagtcgtctgccacgccctcggctagccatccgagtccgccatgcctccgctgacccagacacggtcacctcgccaccgccatcctcatctcgcacccgactccttccccgcctccagttgttgtcgctagcaacccgcatccgccggcatcgccaccgcctccacagccacggccgcagtcgccgctgccaccgacgctagcctccgcctccgcaaaccgctgcaccgtcgccctccaccaccaagcagccagcccgacgccgccgccatgtcctccgccgctgttgtcagctgacgccgccgccaactgccacgagcaccacggcaggcacgtccgcgccatcatcgccaattgccgtccagccggtcagccttcgctgcgtgccggccgagctgctcctccgagccgtgatgccgtgccgtcgtggccgctgccgtcgcgagctgtcccaccgaggcgcgccgccgctgccgcaagctcgaggtcccgccgccgtcaccgcgagcgtgaggccgcccgccgtcttgccgcgccaccatcggcgcgagctcgaggccgtcctccgtctcggagcgccgccgctgcacttctcccgatctggccgccagggggccagatcctccaccggggaggccggatccgccccgccggccgctctggccgccgccttccaccttgcgtgcgtcacgctgcctcccacgccgaggggatgctccgccgctggcgcgttttccccaccgccgccttcccggccagccgcacggtttccggcgacggcgaggcagctggaggcgttgggagggggtggcgctggcggctagggtttcgctcctgagccacctgcatgagagcggcgcgagagcgtgtatgtctcttactccctctatttcatattataagttgtttttgaccaaagttataaaaaaaatttcagcaacttatacaacaccaaattagcttcattgaatatattttgataatatgtttgttttgtgttaaaaatattgatatatttttctataaagttagacaaacattaaaaagtcaaaacgacttataatatgaaacgagtagtttttttttaatatggtatgttgcatatgtggtgcttacatgacattccataatgaagaaaataaaacttaaactttaaatataggtgggatccacatgcaagctcagagataaaacattaaaattaatagggcccacatgtaattatccttccttcactcccctctttctctctctcttgggctcttggtgaaaaggcc

SEQ ID NO: 5223 - DNA, 1501 bp, Oryza sativa
tctgtttgtcacagctctagctccaagtccacctttcctgagctagagtccagccaaacagttctagctccacctaaaataagagcggagctgggtggagtgctctcacaaaatgaaccagttccagcagttctagcttcatctaaaataagagcggagctgggtggagtgctctcacaaaatgaaccagttccagctccacctaaaatgggagcgaagctgggtggagtgctctcacaaaatgaactagaaaggtggagatgggtttaggaagctccacaactccactccagactcaactcttggagctaaatttaagagttggagctctactaaacaagtcctaaataatgctcgagttggactgctggagtgttcccacaaaatgaaagatatagagcgcgattcaactacttcacaactccacttcgaactagttcttcaagttaaatttaagagctaaaattccgataagaatccatacaagtacaactatacctgatctgtatccattcgtgttgctcgcacagtagcactgaacataaagtaaaaatgccagctcgaaacaactccacagttcacaatgacatactaatagatgatactattgactttttttctatgttagaccattcattttatttaaaaaattatgtaattataatttattttgttgtgagttgttttatcacttaaaatactttaagtacgatttatatcttatatatttacacataatttttaaataagataaataattaaatatatatttaaaagtcaacaatattatctattgaaaaatagagggagtactctcagttacaaaatgtagctatttctgcgacaatcccctcaaggcctcaacgaatcaccacgttcgttaggagttcaaagtttcaaaccggtctcgctcaccacattcgccgggtcaccaatcaccatcgggaaaaggccaggggaaacggaccccacaccgcctcgtctcgtgaaccggcgctactacttctcctgtgctttgaccacgacctctcatttggccacttccatttccattccccccaccaccgcgcagcggcgcaggcagcgatggtgaccaacgctcgccgccgccgccgcctcaggtgagcacgacgccccgcgcgcgtccccgcaccctggaaggaagagcagcagaagacgactccgacgcccacgcccgccatggatccggcgtccgaggagctcgagcagcgcagccgctacctcagctcgctcatccgccgcaccaagctccacgccgcgccggcgctcgccccgcccccgcccacgcctcccccggagcccgagacgaagctgcagctggagatggagccgcagccggagcgagtcgaggaggccgccaagaagccggcggcggtggccgccgtggtggagaagagggaggtcaagggagggggtggcggtggcggccaagctgggaaggggaaggggaaggagaaggagatggagaaggggaaggagg

SEQ ID NO: 5224 - DNA, 930 bp, Oryza sativa
caagaaatatgcattaaactcaaagtgagataaagagagaggatgaaaaaaataaagctaaccttatagttaatctattatacatgttagctctaacattgacttataataagtagtgaattgtactattaaacttgctcttagggcaagtactataggcattttaggcatccaagcacagacccaagataccacatagcactaagggcaagtactacgggcatctaagcacaatctcctagtgccacataagcttaaatagtgaggtggaggagagaaaaaatgagagagataaggagccacccctcatgcaagaggcaactactacacaaaattcaagacaaagagagcgagagaggaagagtagatagggcaaacaaatattggggctagtgtattataattagtatagatgtgatatattgtacatgttacctctatatttattagttgatgatgtggtcaagattagatgtaacatccacctcttttataaaacttgccctaaatgatgagatggaggagagaataaagataaaaaagaaatagtcacctctcatgcaaggggcaactcctacacaaacttcaataaatatgtgagattgctagaaatattggggatgtgtggtagagacaatctattacacatgttacctcttaatttaatggtgtatgacatgcataaaattagatgtggtactcacctctaccataaaacttgcccttagagcaagtttaatagtatagccaaatcatctatagtcaatttaatagctcatttatataatatagttaactataaatatactatatcattaataattggtcacacatatcatacacacgtagcgttttagaatccgtgctgcagctggctacaaatatatagtccgcttatcttctctcttttcttatcttccgtaccgcagc

SEQ ID NO: 5225 - DNA, 1501 bp, Oryza sativa
catcaagaaatgaaaattgcatacatgcataatacaactaccggctggtaggtatatataaaaagggaccttggaaaaccaacaagaacaagttccccatctgctaagcctggctacgtgatctatgaaccatcaaattcttctagcagattgcattacgcgtactatagttatagaccttttgtattgttttggtgcaaacccgcaagagaaatctcgctcgtatgtaggcacgtagtaagctgccctgccctgccctgtcctgcccatctctagcagagaagacaacgaccgagcagggcagcagccagcatcacccactgattagccgatcgatcagcgtgtcatcccagggtacatctccggcgccatggtcgccgccgggttttgcccttgcttctccatgtttgcgtgccatcctgcacaaaaccaacgaaatcgtcatcgtcacgatcatcaacacgcacgacagccaaccattccattagaaaatcgatggctatgctataaacatattttaacatattttaagaagataaaagagtagagagacgagcagtggactacagatttgtagccagctgcagcacagactcaaatacgcaatgtgtgtataacatgtgggaccaggaattaatagtgcagtagataactattgtatcaattaactattaaattaattataaatgatttggagttggtagttggctgtactgttaaacttcctgttaccgaggctcatgtcgaagccgcgcttcttgagctcgcggtactcctggcagagggcgcagggctcgcaccacaagtggacgaggcagtcggggcagggcgtctcctgcaggccgtactgggaccgcagcttggagcggtagatgcaggagtagatacagctgcagcccgtgacgagaaacaccagcgcgtacagcgacccgctcgtcccgcacgacgacgacccccggtcgacgatctccgcgatctgcccgaacgtgatgcacgggcacaaccacgtcataaaacctgcgcccgacaacaatcgatcagcacacacgtaccacgccaagcagagaacacacaatcgtagcccggcttgcttattttacagttgctgctgtcgtcgaagcagtcaaagaggtcggtggaccatgggacgggggcggcctggtcctgcatggcgaagggtggtggtggtggtggcgcctccaccgtcctcctccggcttctgagtatatatatgctggcccgacgtacggggcgccttcgtcgatccctcactctccggcccgcgagggtgaggctttctctccgacgaggctaatgatgagcgcgcggtgtggtggtacaagtagtagagggtaaccggccgaatcgcggactggtcgtccgcgcgcatttatcgggcgaggccgcgaatgttggcctatcgatcataattttaaggacgtaactacgcatcgggtgctcgatttaacgctaaaaatcgggtgcccacccctacaaaaca

SEQ ID NO: 5226 - DNA, 1501 bp, Oryza sativa
gtctcagcttcttctttatttgattgctcgatctaccactatttctattcattcttattggaacctttaaaaattggattttatagtttttagagtttattgtcacgttgggtttcatttttataatttctagatgtcccgtcaaacgttgctattatactcctctacgacacgtctactgtcttatctctttattgtcattgagaatttaaaaatcgaacgtaattatcgttttaagttcatttttactttttaaaagtcccgccaaaccgttagcggctttgccattgtaatcctctacggctcgcccgctgcctcccttctttatttcattttgattttaaaatcgaacatgattatcattggtttttttacttttcagaagttccgaacctttaaaaattgaacttgtagttttatttttaataatttttagaagtgccaccaaacgatgtcactgtgtccctgatctacagcccgtctgtcacctactctttattgtcattgtgattctaaaaattatttttttttactttctagaagtcccggcaaccgtcttattcgtttgcttcacggcctccctgacgtctctccttttaatcgtcattagactctatttggtgttttattaacaatttttatatgtcatatcaaccgccaccactctactcctttatagtcatgttacttaatatatctcgtcatatattttagatggtattttattttaataatctttatttttatcaaaaaatttagttatttataaattgtattcctaattgaaatcttatttttcttgctctaatttcagaatttatttttttcaaattttaattaatatcgtattgtgttctttttttttcaatctcagttgtttcaaaattgtattcctacttgaactctcttttaatttttctaattttgaatattattttattttttactttgaattttaattaatcttgtattgggttctgttgacagaaaacacgaggcctgggagatctgcttaactccagtgcaggtccaaagctcgccttcggatgtatgagcgtgctagttgatttgatcttgaaatcaacaagaaatagaacaaagaaaccgcaattaatcctataaatgatagccgatcggctaagtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgagatagatcggtcgccttgccgagacagtataaatcacttagatcgaaatatatattaatagtaggattatatacattcatgtaacatcccggtctagggcttaataggattaatagaatactcatatcaacaagttgcaacttcttttccggaagccaatctccaaagaactccagctccagggttaagcgtgcttggcgtggagc

SEQ ID NO: 5227 - DNA, 1501 bp, Oryza sativa
agctatctcattatcttaagactttgaaagaccaaaccatatcattctcgtgtttttaattatatagtttttaaaagtcacaccaattactaccccttatgtcatcttcttctttatttgcttgctcgatctatcactatttctattcatacttcttggaacctttaaaaaatagattttatagtttttagagtttattgtcacgttgggttttatttttataatttctagatgtctcgtcaaacgttgccattatactcctctacggcccatcaactatctcatctctttattgtcattgagattttaaaaatcgaacataattatcgttttggttcatttttactttctagaagtcccaccaaaccgtcagcggctttgccattgtactcctctacggctcgcccgctgcctcccttctttattgtcattgagattttagaattgaacatgattatcattgttttttttactttttagaagttccgaacctttaaaaattagacttgtagtttcattttttataattttgagaagtcccatcaaacaatgccactatgcccctctacaacccgtccgccgcctactctttattgtcctcgtgattctaaaagtcgaacataactatcgttggaattcattttttattttctagaagtcccgtcgacggctctgcaactatactcttatacaccccacccgctgcttctcctttttattgtcattgagattttaaaaatcgaatatgattatcaatggggtttgtttttttactttctagaagtcccggcaaccgccttactcatttgcttcgcggcctacctgacgttcctcctttgcggcaattgtgttttattaacaatttttatatgtcgtatcaaccgccaccactctactcctttacaggcctgttacttaacttatctcgtcatgtgttttagatggtcttttctttcaataatctttatttttatcaaaaaattgagttacttatatgcaccccgcgcaccgcttctcatttttattgccattgagattttaaaaatcgaatattactatcaatggtttttttttactttctagaagtcccggcaaccgccttatttgtttgcttcacggtctgcttgacgtctctcaatttaatcgtcattaggattctatttgatattttattaacaatttttatatgtcgtatcaactatcaaccgccaccactctactcctttataggcttgttacttaatttatctcgtcatgtgttttagatggtcttttctttcaatagtctttatttttatcacaaattttagttatttataaattgtattcctaattgaaatcttatttttctttttctaatttcagaatttattttttttaaaaaaattagttaataccgtgttgtgttcttttaatgtttttatttttaattttcaatttcagttgtttcaacattgtattcctacttgaactctcttttaatttttctaattttggatat

SEQ ID NO: 5228 - DNA, 446 bp, Oryza sativa
taggaaaaagtccatctagactccctcgactataggcacgtttgattcgtgtccctccactgcaaaacagggtgtaaaattgggtaaaggtaaaggctccctcaaccgttaaaaaaaaagagatacattttactccctcgatgtttttgatagtggtttcgttctatgtgtcactttaatctactccctctattttttttgaacgactcgcacaagacgatacgaagttctgttgatagcgcaagaaaaaaaaatacaagattacaaccttggagggtcgtaaccaggaaaaaggaaaaaaattccaccaaccacacaccgacatcgccaacacacaagcccaggagaaggctggcaccggaccgaccgccgctaagcgtaaccgaccgccactaaaccaacaaagggacacagacgagatcgctcccctaggggatgccaaacga

SEQ ID NO: 5229 - DNA, 1501 bp, Oryza sativa
tgcagaagcaagcaagaatcctacgtgccacttggagtacgctagatcttccagtcctactaacagtagctcctcaacagtctgcaggccctagctgcaccaaccaaaaacttcaagaattcaggatgcatatatccatccatccatctgtgcgttcgtgtgtatgacggttagcagcgaccactctgtgctagctagctccatggaggagagggacttagctctcattgatgcgcacacacctccgtgcgcatggagtagtatagtagtaccacactgctccataatacacatgcccgatcgatcgtcggcagcggcagcagggcctcgatcgcgagctagctgttggtatttattacacacctcggcctttttgggacagggatactggagaaagtaaacgattacattcaactcacggggatgtgtacaacccgatctattgatctagatattatgttcgatcttgtacgttctagcttgccgaaaaaccaaaccaaaacttgcatcaggtctctctctaccgggtataagcgtgtggtaaaggtaaaaagaacattgtcttcttccacgcctcagttgcaccatgcatgcattatgcgtaaatccagcctctaattaagccattggtgaacccatggagccatcgagcccgtacgactagcgttattctgagcctcttcttacggaaaacctcctcctccagagcgcacacgaacgacgccgcgcactgtgcacgcaagtgcgaaacggatggtcgttaaactgcccgcggcgcgcgctctgttcaggggcgtgggattcaccagacagccaccagtggcgccggtgcgtaagctagaccacccaatcaacagcgactccgtagtcaatcgtacaggctacttgcccccttcgcgcgcgcggtgcgcggaacagtcatagccacagcggttaccatcgcccgaatttaccgtcgagtcgctttgacccgtgcaacttaaccggtttaccattggtgagaacaactgagagaaggataagatcgtagagcaaaggttgctattgctactacaccattcagtagtgccgcgagttttgggtggattagccggtcgccttttgagtgccagtgggagaccggtccaaactccaaaggcgaggaaattctagccggggatgggacggctatggcgtgaaccatggtgcagaaggactgcatgccgtggcttagcttacctggaagggttctcttcgactcacgaaagtcttgcgtgctagtgaccccatcgcgcagcaaaagtgaaggggaaaaaaagaaaagagagcgctaaaaacacttgtggtacttttcagcgattctttcctgagctgccactctccccgtaaaaagaaaagaggtgaacgaatgcttcttgtacgaattccacttttttgctaagataatttaggtgcggcttaacagcggcaagaaaagtacaagcagagagcgcgagaaggagggagggagatcacctgcctc

SEQ ID NO: 5230 - DNA, 1501 bp, Oryza sativa
tttcccgctcttgcacttaaggaccgtttccttggaatttcatccaaacataagacaagtacgaccacatgggtggaatgggacacccctggctgagtaactagcttatcaggggagccatgatgccgagagacatgtggattcgccggggtggtgtcggagaggacccccctgggcttcctggcacagtatggtctgggacctagcctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgtagaggttaactaactgttcgaacagccgtgcccacggtcatgggcggatgtgaggtgattcttagcgtagttttgtttgactactgcttgtgaaattgctgttgtgaaaaggggtttgatgtttgaaaaatctgtagctgacgggatcagctaggcccgggtgggcgtttgaaagtggttggcccgggtggccgtttgaaaagttgttggcccgggtggccgttgaaaagctgttggccgggtgccaaccttgtttcaaaatctaaagactgatacattgcacatactccgttcggacaagacgcactgtctcatccgtgtcgtttgagaagcactcacttagttgtttcagaaaagagttcaaataaaatcaattacgaaaacaacagcctttccttgaagcctgcattaaacacttatttcccctggcttgctgagtactcctgtactcacctttgctctatataaataacccccccagttgctgaagaagatgaagcggatcctgctgatgaagagttcttccaggagcaagccggcttcgatgagttttagggtttcgacctagttcccaagtcgcgcctatgatgtttggtccaagccctggcttccgtttcccttttgtaatgcagttgtgagctcgggatctgtccgcagcccaacatgactgtacttctactctataataaagagacctctgttgctgtgatattctgtctctctatgataccagcactgttttcctgggactggtatcgattaacaggttaatttggagcgtcacgggctaattccagtcaggactagctcggggcgtgacacttcaacaactgacctagtactctcttaatatcgacaatgtgagaataaaaaaggttagatgttgggtaggttgaacctgagaactcctcagtggctgcatgaatgacagaaagggcatcattgacttcacaatatagattccattcctctggtgttggcagccacctatagtttgcatctcctgcagcatatacatccaaggcagacctataaaaaaatgcagattgcagcattttgaaggttgagccccaccttgtgcaggaatcaatagccaaacccatgtcacttttaaggttgagagaatcaatat

SEQ ID NO: 5231 - DNA, 1501 bp, Oryza sativa
agagtccaagtaggaatacaatttaaaaatagctgaaattcagaattaaaaaaagcaatattgaaagaagattccatataagaacccaatacgagattaatcaaaattcgaaataaaagtaaaaaaaatacaaaattagaaaaggaaaggagagtccaagtagaaatacaatttaaaaatagctgaaattcgaagtcaaaaataaggaatattaaaagaagagtccatataagaacccaatacgaaattaattaaaatttagaataaaaataaatccaaagttagcaaaagaaaataaaagaagagttcaagtaggaatacaatttaaaattagctgaaattcggaattaaaaataagcaatattgaaagaagaatccatataagaacccaatatgagattaattaaaattttaaataaaaaataaaataatatccaaaattagaaaaattaaaagagagttcaagtaggaatacaatgttgaaacaactgaaattgaaaattaaaaataaaaacattaaaagaacacaacacggtattaactaatttttttaaaaaaaataaattctgaaattagaaaaagaaaaataagatttcaattaggaatacaatttataaataactaaaatttgtgataaaaataaagactattgaaagaaaagaccatctaaaacacatgacgagataaattaagtaacaagcctataaaggagtagagtggtggcggttgatagttgatacgacatataaaaattgttaataaaatatcaaatagaatcctaatgacgattaaattgagagacgtcaagcagaccgtgaagcaaacaaataaggcggttgccgggacttctagaaagtaaaaaaaaaccattgatagtaatattcgatttttaaaatctcaatggcaataaaaatgagaagcggtgcgcggggtgcatataagtaactcaattttttgataaaaataaagattattgaaagaaaagaccatctaaaacacatgacgagataagttaagtaacaggcctgtaaaggagtagagtggtggcggttgatacgacatataaaaattgttaataaaacacaattgccgcaaaggaggaacgtcaggtaggccgcgaagcaaatgagtaaggcggttgccgggacttctagaaagtaaaaaaacaaaccccattgataatcatattcgatttttaaaatctcaatgacaataaaaaggagaagcagcgggtggggtgtataagagtatagttgcagagccgtcgacgggacttctagaaaataaaaaatgaattccaacgatagttatgttcgacttttagaatcacgaggacaataaagagtaggcggcggacgggttgtagaggggcatagtggcattgtttgatgggacttctcaaaattataaaaaatgaaactacaagtctaatttttaaaggttcggaacttctaaaaagtaaaaaaaacaatgataatcatgttcaattctaaaatctcaa

SEQ ID NO: 5232 - DNA, 1501 bp, Oryza sativa
ggaggaacgtcaggtaggccgcgaagcaaatgagtaaggcggttgccgggacttctagaaagtaaaaaaacaaaccccattgataatcatattcgatttttaaaatctcaatgacaataaaaaggagaagcagcgggtggggtgtataagagtatagttgcagagccgtcgacgggacttctagaaaataaaaaatgaattccaacgatagttatgttcgacttttagaatcacgaggacaataaagagtaggcggcggacgggttgtagaggggcatagtggcattgtttgatgggacttctcaaaattataaaaaatgaaactacaagtctaatttttaaaggttcggaacttctaaaaagtaaaaaaaacaatgataatcatgttcaattctaaaatctcaatgacaataaagaagggaggcagcgggcgagccgtagaggagtacaatggcaaagccgctgacggtttggtgggacttctagaaagtaaaaatgaaccaaaacgataattatgttcgatttttaaaatctcaatgacaataaagagatgagatagttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaacaatcccagctacctaaccgattgcccaacaagaaaatagcaa

SEQ ID NO: 5233 - DNA, 1501 bp, Oryza sativa
ctcacgtggcgacacgtgatggatcatggttggacggctgcgatcaggtggcgcttacccttgcgctttttttagacgaggcaggtgatctccctccctccttctcgcgctctctgcttgtacttttcttgccgctgttaagccgcacctaaattatcttagcaaaaaagtggaattcgtacaagaagcattcgttcacctcttttctttttacggggagagtggcagctcaggaaagaatcgctgaaaagtaccacaagtgtttttagcgctctcttttctttttttccccttcacttttgctgcgcgatggggtcactagcacgcaagactttcgtgagtcgaagagaacccttccaggtaagctaagccacggcatgcagtccttctgcaccatggttcacgccatagccgtcccatccccggctagaatttcctcgcctttggagtttggaccggtctcccactggcactcaaaaggcgaccggctaatccacccaaaactcgcggcactactgaatggtgtagtagcaatagcaacctttgctctacgatcttatccttctctcagttgttctcaccaatggtaaaccggttaagttgcacgggtcaaagcgactcgacggtaaattcgggcgatggtaaccgctgtggctatgactgttccgcgcaccgcgcgcgcgaagggggcaagtagcctgtacgattgactacggagtcgctgttgattgggtggtctagcttacgcaccggcgccactggtggctgtctggtgaatcccacgcccctgaacagagcgcgcgccgcgggcagtttaacgaccatccgtttcgcacttgcgtgcacagtgcgcggcgtcgttcgtgtgcgctctggaggaggaggttttccgtaagaagaggctcagaataacgctagtcgtacgggctcgatggctccatgggttcaccaatggcttaattagaggctggatttacgcataatgcatgcatggtgcaactgaggcgtggaagaagacaatgttctttttacctttaccacacgcttatacccggtagagagagacctgatgcaagttttggtttggtttttcggcaagctagaacgtacaagatcgaacataatatctagatcaatagatcgggttgtacacatccccgtgagttgaatgtaatcgtttactttctccagtatccctgtcccaaaaaggccgaggtgtgtaataaataccaacagctagctcgcgatcgaggccctgctgccgctgccgacgatcgatcgggcatgtgtattatggagcagtgtggtactactatactactccatgcgcacggaggtgtgtgcgcatcaatgagagctaagtccctctcctccatggagctagctagcacagagtggtcgctgctaaccgtcatacacacgaacgcacagatggatggatggatatatgcatcctgaattcttgaagtttttggttggtgcagctagggcctgcagactg

SEQ ID NO: 5234 - DNA, 1501 bp, Oryza sativa
catgagcatgagctaactgggtatagcttacatgtaggaccctgcgttgatctgcatgatgacgcgcacggtgttgttctccggcacggagttgacggcctgctggatggagaggaagtcgccgccgccgctcgcgtccaccacgatccgccgcacgcccaccggctgcctgtactggtggtgcccgcgcgtcgggcgctcgcacggcgccggcgccgcctggcacgccagcggcggcaggaggctcgtcgcgagcgtcgccaccgcgaacgccatcaccaccaccacccgctcacgaaccatatcgatcggtttgcgtgtgtatcccccccgtgtatcgatcactcaaaagcgtgacaacgttttcgcgcgtacgtgcgtctttgtcactcaaactttcgctagctctcctctctatatctctctcttcacatgcacgcggaatatgtggtgagagagaccgagactgtgaggcagggggtcggaatttataggcctgtgagggggaagaaaccgcccatgcaaataatggaggagaagagttaagctataccgcccgacgggaccactccaaaagttaagctagctgctggcgctgcggccccggtttggaatttctgctttggtcggacgccaacggtcatgcatgcagctagctagcatgctttcgatcgctagctttcacctggtagtttagctaccgtagctaacgtataataattctgcgttaatgtttcagaaaaagagagatatttacggacactgatgagtgatgactgatatatcaaaatcatacaatgtacggatacctcgtccatatgtttattcactgagataccaggttgagttcctgcacttagctgatattttaacatttttcttgtcatagaacaattgcaacgtcatcgacggagctctaaacacacaatagacttaccgatctctccaaaatgtcgtcgcccagctagcttttgtgtataccccaagtacaattttcagtccgtagcatctgagtatatctgcgtaccaaaacccgagtcacatcgcgtatcaacattgcatcaaaatatgtgttggacatatacaccagcttttccgaatccctagacgcgagagagcgatggtcctgatataccgtgggccaacaccggatagagacacggcgtgtacatggataggagcgtaactgtgatcagagcatgcatggccaaccataagtctcccttcgctgcaaattaatatgccgtgaaacttggctagattacaaactggggacaccgagagatgccaccactacgcacgagatagaacagtacgatccctctgctaccttcctatcggttagctgcaggcttttacagtcacagcatgcatgatactccaacgacatatacaaggtacggagtatatagtatatatcactatatatactaatgcaagaagcctaattgattagctgggtgtctgcagtgtaccggtaggattaagttaaactaacgca

SEQ ID NO: 5235 - DNA, 1024 bp, Oryza sativa
acccgacccattgccatccctatgcccatgatgtacgtacctgtacttgcccaaaggattgcagatttgcagtgtctgtacctattagcttggcatcgatcgctgttgcaacttgcaagcagttgaacacggcaaactaacgcatgtgcgactctgccctgacatgcaagccccattattgagatagtaagtcaatagcgagatagccacagcttcactactgccactaatctttcgtgtacgtgaattaattctcaggttgaattttgcatgggaggatgaagatgcaagtaaggattaatggaggcttatacccgtgtgttaatggtgttctgttccggatcgggtggctgcgtgtgcgcccgttccgtattgtgtttgtgattagttgttgcgccgctatggtacaaagcatgaaaagttaaacgaaccaataaaaataatttataaataatatttttccaataaaaataatttataaataatattttttctaaacaactaaaagtcagcaataaaaaataaactacgaaaaacaaaatcaaaaccatcatgctaaaattaagttttaaaacatagattaacttttgtcaaagttgacttatcttgggccttggcccagtgatcccatcacatgagagctcagaaagcccaacatcaagaagcccacaagaacaaccactaccttcccgcagcacgaagccatccccatcacctccgtccgtccgacccacccaatcgcccaccacccacccaccgccaccgtcccgatctccggccaccgtcatgccgtccgccggtgccggcgccgccttcctactccgtccaatctccgctaccacccaccctctcatcagcttatcctgtaccggcgccggcgacagcgcgaaccacaagtctcacctcctcttccgcctccaccattcgtgccgccgcctgcccgtgccccgcctctccctcaccccggcccccaccggcagcaataattctccgccctcgcctccgccggcgtccccggagcccc

SEQ ID NO: 5236 - DNA, 1501 bp, Oryza sativa
ctcttatttatatttgtccaatcaatctcaatggttaaattatagatctatcataattcaatggtatagatttttctctttttttttcgattaatgtggtaatatgtagccttcatagcaaatatggtgcctcctttcaaagatgcttcgggttatcattgagattttaaaatcgagcatgattatcattgttttttttactttttagaagttccgaacctttaaaaataagaccttgtagtttatagagtttattgccttgttgggttttattttttataatttttagaagtcccataaaacgatgcctctatcctcctctacggcacatccgccgcctactctttattatcattgtgattctagaaatcgaacataactatcgttagaattttttttttattttctagaagtcccatcaaccgttggcggctctgcaactatactcctatacaccccgctcattgcttctccttagtcattgagattttaaaaatcaaatatgatattcaacgggttttttttactttctagaagtcctggcaaccgccttgctcgtttgcttcacggcccgccgatcgtccctccttttaatcatcattaggatctattggtgttttattaacagttttttatatgtcgtatcaaccgccaccactctactcctttataggcatgttacttaatttatctcgtcatgtgttttagatggtattttctttcaatagtttttatttttatcacaaattttagttatttataaattatattcctaattgaaatcttatttttctttctctaatttcagaatttatttttttcaaattttaattaatatcgtattgtgttctttttttttcaatttcagttgtttcaaaattgtattcctacttgaactctcttttaatttttctaattttgaatattattttattttttactttgaattttaattaatcttgtattgggttctgttgacagaaaacacgaggcctgggagatctgcttaactccagtgcaggtccaaagctcgccttcggatgtatgagcgtgctagttgatttgatcttgaaatcaacaagaaatagaacaaagaaaccgcaattaatcctataaatgatagccgatcggctaagtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgagatagatcggtcgccttgccgagacagtataaatcacttagatcgaaatatatattaatagtaggattatatacattcatgtaacatcccggctagggcttaataggattaatagaatactcatatcaacaagttgcaacttcttttccggaagccaatctccaaagaactccagctccagggttaagcgtgcttggcgtggagcaatttgg

SEQ ID NO: 5237 - DNA, 1501 bp, Oryza sativa
cagtccacacccacgcacacaagcaagcggcctcatctgttttattgtttttcttgatccccttccctccatatctctctcgcgccgatcgagaggggggcgggcggcgggcggcggcgcgcggcgggagcatgcgcgagtaggttggtagatgagggcggcacccttcagtgccgacgggaacggggcggcggagctcgcggggagcatagcggcgctgctttggccggaggacaaaggcggcggcggcgggggcgcgggggggtcgttgctggtggagccgaggtcggtgctggactgcagggggagcccgagcccgcccaactccacatcgacgctgtcttcgtcccatggtagcggcgcggcggattctatatctaccggcgtggcggcggtttcggagagcagcgcagccgccgccgaagccaccagatgggcggcccccggcgaacacggcggcggcggtggcggtgagctgccgcccataccgggggccctggatgtgggcttcgtcgcggaggagagctgggacgccatgctcggcgacgccgcggcggcggcaggccaggagcagacatttttgaactggatcatggctgcccccggcgacatggaaccccaggcgccggggctctcgcagcagcagctctcgccaatgccgccgggttcgggttcccgctgcagcatcaccccggtggcgtctcctcgccagccgccctcgcctccgacctgtcgtcctccggcgggaggtcgctcacaagcagcagcggcagcaatagcaaggccacctccgctttcggcctcctgtcgcccgaagcggcgctccagccgccgccggcgactactgcgcctttccacaacggcgctgacatgaagccccctctccttggcttgccatcacccacactactcctcaaccagcatcagccgacgccggcctccaccttgttcatgccgttcccctccttctccgaccatcaacaacagccactgctccagccaccgccgaagcgccaccactccgtgcccgacaatctcttcctcctccacaaccagccccagccaccgccgccggcgcccgcgcaatgcctcccgtttccaacgctacatagcgcggtacccttccagctccagccttcgatgcagcatccgcgcaacgcgatgaagtcaaccgcggcggcggcggcggcgcagcagcaacacctcctggacgagcttgcagcggcggcgaaggcaaccgaagtcggcaactccataggcgcgcgagagatattggcgcggctcaatcagcagcttcccccaattgggaagcctttcctccgctccgcctcctacctaaaggacgccctcctcctcgcgctcgccgacggccaccacgccgccacccgtctcacgtctccgctcgacgtcgccctgaagctcaccgcttacaaatccttctccgacctctcccccgtgctccagtttgccaacttcacggtaactcaggcgcttctggatg

SEQ ID NO: 5238 - DNA, 1501 bp, Oryza sativa
cttccctcctccccttgtttccatcacaagtcacaatcagggatgaatataaagtattaggttcagtgtctggtgataccgataacttttagcaaaacctatggttaaattgtttactcatataggataacgccattgcttaagcatgattagcatgctatgataccagtatgtatgttatgacactagtaaaccaattttctagatcgccagtggtctcaatcaagtcacatgccacctccttctgcaccgccacctctcctagccaacgtcccctccaccctcccccccccccccaaaaaaaaaaagccttgctagcgcaggcaaggccccaccagccttcttgttttccattgttccaagctaggcgacagttaggtgcccccaccctactgtattcatggtctctgacagcttctaaccctattgttttccttgtcttgcctccaacaccaatccatagctctcatccatctcgatggctcaatcgacatcgccattgcctagcgacctcctcgcatccttcgcccactgctagtcctctgccacttgcggtcatccctccaagcttgggaaagcccgccctttcacctcccccatccacccctaccaaccttataatctgcaaccttagctcgtcaagtggattaaaaaagtcaaccatgtcatatattaaaaaaatactggtggtaacatttaatatgtaaagtttattttattatgtttggcagcttataatttgaaacctctaattctaataccatatcaagctgaatataccaactatttcacataaattcctaagctaagtaataagacgtacaaacaattcactcatactccaataaaagtgttattccgaagatgaattctcaatccacgaggggacatccccttatttcttgtatattacctaaatagttaaagaaaaatgataggataaattaatatggatatatcatttcagaaacatgtaaggtcaaattcgacttttactataacacttcacaattatatttattgttttgttacaacttgtagaagtcgaaattaaactttatgtttgtggagtgattatctcatattaacttatcttattattcattttttttaaaaaaaataatgactactcttactatttcaaaatatagcaaactagtaccggattagatacaactagtaaaacaaatcttgatagacttctaggttgtgtcaaatctcatactagttgctgtattttaggatgaatgcagtttttatgtaagatgggagaaatgatatgatgtttcctctaaagatgaaaacaactttccgtgttactgctagacaatataaccacgaaagagagaggttagggtttgtcctttgcaggtttaccttctataaatatacccacataaccctctcactagaccatccccatctctcactagctagctagctctgatatcctacaccggccttagcaaatagccatatatacccttaaggataagctcca

SEQ ID NO: 5239 - DNA, 1501 bp, Oryza sativa
gaaaccaaattttaactccttctttaacttatataaatcgaacttgattttttttaacttataggaattgaattttaaccaacatgtttcagagtgatatatcacatattaacatatcttgccattttctttcataattatttggatgatttgcaaacaacgagggaatatttcctcaacagtttaaaatccattcatgactattagtaccatcgaaatttactttagaaaacaatcgacgcacctacggatcgggtgctcgattttttttaaaaaaaaacaagaccacacatggatataatccgatgaaaaaatatttagcttattattgaattatttttaaatgttgcacgttgttccaccaagtagatcggaattgtttcactaaatagatcgaaaatgtttcaatcgtttaaaaagctgaaacacaacaaaatcacctcataaaacattttgctacaacgtatgaaaacggttttttaaaaaatcaggcgttgtttcaccttatataaaaataatatttcagcaaatagcgaaataatgttttaattcactgcaacatttgatctatacatagtgaaacattatgagtacacttactgaaacattgttggtggaacaaaaattgaaacggattctctaaataaagcgtttccataatatgtgggtaatttgttgcaaaagaatatttcaattcactgcaacatttcacatttcatccatacataattaaccattataagtacactagttgagaaaaaaaatgaaacgtattctcttaacagagagtttccgtaatatgtgggagatttgttgcaacggagggcattgagtggtggggacgtgtgggaggcaggcggagacgcgcgtggaggagggcgcctttttttcgcggagaggcgcgcgtgggggagagggcgtccgattttttttcccgccggatcgggcgcctgccctagcattttccgaaaaaaccgaaatatgggctggagtggtggttgtctggaaagctcaagcaagttagcatgatatgattcctcctgctttgattccagtacatgtcgacgtcccttccgtgatctatcaaccgatcacgccaaaaaacattcctaattaattcggtttttcgccattggtgcatgttacgaggtacagtgcagccatgccatacgccaagattgtgtgctaaactatcatcaatcaccgaacagaaacaaacgtcagcatgttcctcaaatgcagcatctgggtcactataatgttctaccaaaatatattcaggccaatccagatcaaccagcaaatcatcctcacatgcaagctcacagctgcacccactaatcatccagcattgcaccaaaatttctcctataaatactcaagccacaaatgccatcaaaccatcacaaccacacagcaatcgagctagtaatcaggagctcctgaaactccagagagctaatcgctcgtcagcttagtgcgcgtgatccagcggcagcaa

SEQ ID NO: 5240 - DNA, 1501 bp, Oryza sativa
acggaaaatcgagtagctccatggtacgtgtgcatgcttaatttgcaggtgcacgcatgcatatttgtcgatcgatccatgcatgcgcgcaaatgttgcaagctaagctagcacgtagtagcaatcaaacagtccagataaaatagccagcggaacaaatgcgcagtagcgccgccgcctatcgatgcttagcatttgaagccggtgggcacgcgcttgccgcagtagttgaggatgaggctgaggtcgacggggaggttgaggttgatgccgaggatgttgcctctgatggccgtgcagaggcataccgccgcctcgaggtcgacgagcccctccagcagcgggcagcacggctccgccggcggcacgcccaccttggccttgatgaggcccagcacgttggcgcacacgcccagcttcagcgcgtcgcgtgggcacttaccgaacgccgccggcgtcggggtgggcgtcgatggggtcgacggcgtcggcgtcgggcagcggccgccgcaggcgctggccaacgagaacaccaccaggttgacggcgaggaacagcgcgatcgaggccttgcctgccattgctgccgctggatcacgcgcactaagctgacgagcgattagctctctggagtttcaggagctcctgattactagctcgattgctgtgtggttgtgatggtttgatggcatttgtggcttgagtatttataggagaaattttggtgcaatgctggatgattagtgggtgcagctgtgagcttgcatgtgaggatgatttgctggttgatctggattggcctgaatatattttggtagaacattatagtgacccagatgctgcatttgaggaacatgctgacgtttgtttctgttcggtgattgatgatagtttagcacacaatcttggcgtatggcatggctgcactgtacctcgtaacatgcaccaatggcgaaaaaccgaattaattaggaatgttttttggcgtgatcggttgatagatcacggaagggacgtcgacatgtactggaatcaaagcaggaggaatcatatcatgctaacttgcttgagctttccagacaaccaccactccagcccatatttcggttttttcggaaaatgctagggcaggcgcccgatccggcgggaaaaaaaatcggacgccctctcccccacgcgcgcctctccgcgaaaaaaaggcgccctcctccacgcgcgtctccgcctgcctcccacacgtccccaccactcaatgccctccgttgcaacaaatctcccacatattacggaaactctctgttaagagaatacgtttcattttttttctcaactagtgtacttataatggttaattatgtatggatgaaatgtgaaatgttgcagtgaattgaaatattcttttgcaacaaattacccacatattatggaaacgctttatttagagaatccgtttcaatttttgttccaccaacaatgtttcagtaagtgtactcataatgtt

SEQ ID NO: 5241 - DNA, 1501 bp, Oryza sativa
gcattgtaactacaccgatttcacaatttcagtaacgacatgaacacaacagaccgatcggcaagtcgagcaaattaactaattaagcactgtaatagtgtaatcatgtagagcaaatcaagcaaacctcacctgtgatatcgcacgagctccggggcggcagtataccgcaggcgtgccgcacagagtacttccttgggttcgtcgttttcacctacggattgtcagttttgcagaacgaaaatccgtcaccctttcctccaaacgcatcacatgctcacagcagcatcagctcagagcgagaagaagaacagagtattcattcaccttgaacgccacgtactggttggtcttgttcgtcagctgcatgcagcaagacctcttcctcttgtactcatcttatcaaaccaccgcataaacaagaaatcaagaagaaaatcagtcaagaaaagcttgaagccaacgctgcgaacaatcaagagtttggttctggaaagcacttacaggggatcttgagctcggaagggtgcacacgaagcagcgtattactcatggctccgatcggacagagcgagagcgagaaaggaggagcagcaacagcggaaaagattcggccttttgctccctttcccgttccaaagaacctgtgtgacctggacgtcgcggcgcgggaagtggctaagcggttgctgcctcttgaagtaaagtatacgggcaaaatggcgatggtatgatgagcggatggtgatctggaattctggattccgtggagcagctcggggatcggaggaataggatattggcctgaactttatggtgggatcgttgcggcaaatatcatatttaagggataggattagaatgctcgtcatggtaattgcaaaaacctccaatccaatcgcattcgttggatgcgacatcaacgttgccgatgtgagtcctctggattttctttttggtgtcagctttgggtatgcccttttttatatactagtatattactactactactaatctaggatttttttccccctggaatgtgtagcctatttcagttaactaactgcctaatgcagaaatttatagaactcataatgggcacactagtttgttgcaaaattggctaaaatttccatctgcaaagtgcatttgcagttctctactctgaatcaacatcacctgtcaaacaacctccacaaaggataatgtatcatgtagctagaactgggtaatccaagatttggtagagtgtggtagggtaagcctaactaaaggcctcctcaactgcctgcctctgcagctgaaacctgaaacattcagctaattgatattcctgagttttgtttccttcttatcttaaaagtgcacattcggtagtggttgggcaatcaattattgttgagatatcagcttccaagactatacgagtgcgaaattgtttgggcttgtttagatatcgactggatttaccataaattgcagaagcacaacgttcaaatgc

SEQ ID NO: 5242 - DNA, 1501 bp, Oryza sativa
ggaacttaaattaacaagtgtatgcaatttattgtcataaagttttttgagtcgtaaaaggacatatatgtattctataaactcgtttatttatgagtaaagtgaaaggtcggtccctaaacttgttagcctttctagatttccataattttaaaatgcagatttaggtcacaaaatttaaagtatgtcattttggttaggtctgtaaaaagctcgaggcttgcgagctactcgagctcgacttgtcctaggctcgattcgagcttaacaatatatgtgtttttttaatcttttatataataggttagttgggtccatgccgatataaatctcatcgttttgaaatctaccaatactattcgcataatgagaaccatgtctcaaaaaaacatccaaaatcagatccatgccacccgcctgatacgtgtgaaacacattttgaggccctcacagatcttgacgagcgcggtaaagcaaatcgggcgagtcaggcgacgagcttgatcgaccacaccgagatcatcatcaagggcgtcaacatctacagcaccttcggcaccgtccattgcgatgtctatgaaagccacgccgccctccatgtctatgaagtcgatggccgagcagatccacgctgcccttcgtcctccaccaccaagatcttggcctcttcccacatcagtccggggagttgtggccaagcccattggaagacaaccacccgtgctccccctcgccatcttcctctctttgccatccgaagcctctctagctcgcctcgccacgctgtcatcgccttgtggagctcagcctccccgaccacaccggtgagcttgcatcctccgccacgtcgtgccatacccagccccacaatggagaggcggtgatggccttttcaccaagagcccaagagagagagaaagaggggagtgaaggaaggataattacatgtgggccctattaattttaatgttttatctctgagcttgcatgtggatcccacctatatttaaagtttaagttttattttcttcattatggaatgtcatgtaagcaccacatatgcaacataccatattaaaaaaaaactactcgtttcatattataagtcgttttgactttttaatgtttgtctaactttatagaaaaatatatcaatatttttaacacaaaacaaacatattatcaaaatatattcaatgaagctaatttggtgttgtataagttgctgaaattttttttataactttggtcaaaaacaacttataatatgaaatagagggagtaagagacatacacgctctcgcgccgctctcatgcaggtggctcaggagcgaaaccctagccgccagcgccaccccctcccaacgcctccagctgcctcgccgtcgccggaaaccgtgcggctggccgggaaggcggcggtggggaaaacgcgccagcggcggagcatcccctcggcgtgggaggcagcgtgacgcacgcaaggtggaaggcggcggcc

SEQ ID NO: 5243 - DNA, 1501 bp, Oryza sativa; identical to SEQ ID NO: 5233

SEQ ID NO: 5244 - DNA, 1501 bp, Oryza sativa
ctcctctctgtagtctcatatacgatactccctccatcttaaaaataatacaagctaatcataggtacaatcgaacatagttagagcaatattatcaacaaatagagtaatatggttaattagtgtatgcatggctaattaattcttctctaccacatttagatagccgtacttctctgctgtatattataattcaacttgaaaaaagttttgctaatgaaagattaacttgtttaagcgtctataagtacctttggacaaatactttggaagatgtgtcttttgaattagtataatttacagaatttgttaacctataggaaaattacgaaatttatgtaaggcataattttttaggctaatgactctaattgtcagcttaatatccaaagccagtctttgtattaaaagattactctttgtattaaaagttaaaaccagtcttaaaaagttaaagcatcaaaggtcttggaaatcaatatgtgactatgtgagtactgacatagtttgtgcgtataaatacacgtgaagaaccatgttatattttaatttttctagagacttcggaagggttacatatccaacttctatcttaatttttctagagacttcggaagggttacatatccaacttcttcacaagggttaggcaaggtgatttattgactcctgacttttcctgagagttaagtggacagaagaatgcagtttaattatgtatacgggaggacacgtggcataatttcagagtagccctggaaaattttgtagagtgccacgtgggccaatggcagcctggatgctgcaccctgaaatcgttatttaagatatgaatttttgaagctgtatgcctgcatgaccagaaaatagaaaatcaaaaatttccgttgccgggactcgaacccgggtctctcgggtgagagccgagtatcctaaccagctagactacaacgaatttatccgtcgatgtgtaaaaaggtctttcacatcacctagttttactttccctcacgtcaaactaccgaatatatttaccgttcttatatcagtagctatatttatgacgccatatttttcaccaaaaaatagtcgatatgtatttacatcgtaagttcttaaattacatatgtaattttagtgtatttataatgtaagtctcaaaattacatatgtaagtcccaaaattacatatgtaattttagtgtatttacaatgtaagtttcaaaattgtatatgtaagtcataaaatagtatgtaattatagtgtaattagtatgtaatcgtctatcatcacgcgatatatgtgtgaaaataatcttctctctcatggaagcacatgcagtgggaagcctgtgcggctgtgtgaccaataggcatgtataccgactgtaatcaacgaaaatttatggcgacataaatgtagcaaatccgtctcaaaaagaccaagtaaacatgtaggaatatcataaaccctctttaacgaaactttccgaaccaaccc

SEQ ID NO: 5245 - DNA, 1501 bp, Oryza sativa; identical to SEQ ID NO: 5232

SEQ ID NO: 5246 - DNA, 1501 bp, Oryza sativa
gagtccaagtaggaatacaatttaaaaatagctgaaattcagaattaaaaaaagcaatattgaaagaagattccatataagaacccaatacgagattaatcaaaattcgaaataaaagtaaaagaaaatacaaaattagaaaaggaaaggagagtccaagtagaaatacaatttaaaaatagctgaaattcgaagtcaaaaataaggaatattaaaagaagagtccatataagaacccaatacgaaattaattaaaatttagaataaaaataaatccaaagttagcaaaagaaaataaaagaagagttcaagtaggaatacaatttaaaattagctgaaattcggaattaaaaataagcaatattgaaagaagaatccatataagaacccaatatgagattaattaaaattttaaataaaaaataaaataatatccaaaattagaaaaattaaaagagagttcaagtaggaatacaatgttgaaacaactgaaattgaaaattaaaaataaaaacattaaaagaacacaacacggtattaactaatttttttaaaaaaaataaattctgaaattagaaaaagaaaaataagatttcaattaggaatacaatttataaataactaaaatttgtgataaaaataaagactattgaaagaaaagaccatctaaaacacatgacgagataaattaagtaacaagcctataaaggagtagagtggtggcggttgatagttgatacgacatataaaaattgttaataaaatatcaaatagaatcctaatgacgattaaattgagagacgtcaagcagaccgtgaagcaaacaaataaggcggttgccgggacttctagaaagtaaaaaaaaaccattgatagtaatattcgatttttaaaatctcaatggcaataaaaatgagaagcggtgcgcggggtgcatataagtaactcaattttttgataaaaataaagattattgaaagaaaagaccatctaaaacacatgacgagataagttaagtaacaggcctgtaaaggagtagagtggtggcggttgatacgacatataaaaattgttaataaaacacaattgccgcaaaggaggaacgtcaggtaggccgcgaagcaaatgagtaaggcggttgccgggacttctagaaagtaaaaaaacaaaccccattgataatcatattcgatttttaaaatctcaatgacaataaaaaggagaagcagcgggtggggtgtataagagtatagttgcagagccgtcgacgggacttctagaaaataaaaaatgaattccaacgatagttatgttcgacttttagaatcacgaggacaataaagagtaggcggcggacgggttgtagaggggcatagtggcattgtttgatgggacttctcaaaattataaaaaatgaaactacaagtctaatttttaaaggttcggaacttctaaaaagtaaaaaaaacaatgataatcatgttcaattctaaaatctcaa

SEQ ID NO: 5247 - DNA, 1501 bp, Oryza sativa
cctggtaggcttaggccccaaagctcctgtttcggcctggggaggttaaatgttaatgggctagaatggaaggcccttcagagcaggccggttcacacctgtgattacgtcatgccatacgtgccgtgcagattcaccgggatggcgggatcctcgggttaatggcagaaatcaaggcggacaaaattagccacccgggcactccatcgatttttgacgcgaccacagtactcaaaacagctatcccccgcagttaacactgcacgacgactcgtgcaagttacatgcaaccgtgcctttcgtcatcccacacactttcatgcatatgcattgcacatcgatcgccaacgccaagtcgttgccaccaaccgatcgactgtgtgcagcctacctacattcacgcgtggcacccggagctcgcccgccctcccgccggccaagcgcacatgttggccgccgatggcgtacgtacgaccgcctaattctcgctgatgtagagagccgtagcccgggaggccatggcccggcaaagctgccccgaatcccggtgtttgctcgcgggagccgacggtgcgctcgctcgtcaggagagttgacggggacgagattggcggatttggggatgcggccggggatgaaacggtcgatcggttgacccgggaggaggaagaatgaagctggtgtggtgagagcgaggctaggggagacgtctcgggatgcgcaagcttaagcggtcaccatcgcatcacgcgcgcgggcgtgcgggcgtgcagtgatcaaccgaaataacggccaatctcctgtgcacttttgactttccattttgccaatagtagtaggcaggattcgcaaacgtaagcgtcgtcgtccagcaagttattgacaatgttatgcacaaattataatcatgtacagttaccctctgttgcagattaacacaagctatgcacattaattgtattagcacctttctctcatgcatgccgccctggaggttcagggtgcaatgacacatagcatgtatgctacattcacgagtttgttaaccaaagatgggctccagccaaatggtatggcttcattcactagcttgccagatctagccaggcaggcagaaactgaaagctagtaataataccggtaaaactgccatggtcccgataccgatcgaattgaggattggacaagtgaactacacacaaaaggaccggcctactactacgtaaatagctaattacttttcgactgtacttaaacatgttgaccctagccatgtgcattagcatggatatggaactatccaacagagcaagcaagcagagcgatttgtctgcatacgcatgcatgcacggagggatatgcccacacaaacccatcgtctgctgcctataaatagatcacctcctttccctagctacctcacacacagcccacaccacctctcatcgactcatttgcttgcatcttccaaatccttgcaaagcaacaacaatcctagcaa

SEQ ID NO: 5248 - DNA, 1501 bp, Oryza sativa
aaatttgatacggtcaaaatgacaataatacggacaagcctatatttagacgctaggaaaccaagcaaaagtgagaggatttgcattagatggtgtaaagcgtctttaggagggcgctacgatcgtacgatatgcttgcatgggaggaggtatccactttattatacgctacgatctcatcctgttggacacttctacaccacgcctcttgtcctactcccactagtaactgcacaacgtgttactacacgtcacgaaggctgatctgccatctgaaaaagcgatgcatacgcatgcagtgcacagcacagctgttccgatcatcgtctgggcacacatacatctgccaccctaacagcaggcaccggaggcagctagcagccgcttgcaacttgcaacgaatccacccaacttgcaacggagttcttgcagcctgcattgctgcacatgcgtaaaagtaaagagaacatctaggggtagtaaaacgtatagtacagtactgtaaaatgaagaaaggaaacagaacactggtgtcagcggcagtagtacagtgcgcgggcgcgagtaaccaaggacgtgaggtgaggcagccaaaggcagcagcaccgtcgcagggaatggcgcaggaagcggccaaaataggcgtacccgtacgtgctgcaccgtatcctccccaacgcccagcacggggatgttatttcccccaaagcacagacataccccccattccccagccaataggcactgggccgccctgtagctgacactgacaactggaccaccgccgtactgggccccacccccgcccgtcgcgctgcatgcatgtacacacccacgacctgcctcgcaggcttttttttttcactgcccaccaggtacgtaccccatgtcccatgtactccaccgcgtagctctgtggatgcctctatgacatgtggggccatggatagaatgggcccgtcgacaggtgggctgctgcgcggttgtcaactggtgcgttggctgggagaatctatcgtgccgtccggttccggatatgggtgggatctttgcgcaagtggctcccgtgatccgtacggacgcggggcacggctcgccgacaggtggggctcgtccggtggcaccagaggtgttggcccggcgtgtcagtgtcgggggaggcgcgcgctattggttggttggttgacgcgcggtgcgcggatgagcgtattgtcacacagcgcgcggcgtttaatgccgtggcagtcatgtcacggcgcagcagcagcggcagaggcagcggcagcgggcgagggggggcccgccttcgattgaacctgtcaatgacacagctccatgtggcggtggccccacatgtcacgagccacgctcgtgaccccaccacacaccccaatcctgacgggagatcccacatgtcagtacggcgcgtgcttcctcgccagtaggctgctcctccccgggggtgcgcttcgcttcacaaaccctcgctgcctggctgctt

SEQ ID NO: 5249 - DNA, 1501 bp, Oryza sativa
gttgggctgcggacagatcccgagctcacaactgcattacaaaagggaaacggaagccagggcttggaccaaacatcataggcgcgacttgggaattaggccgaaaccctaaaactcatcgaagccggcttgctcctggaagaactcttcatcagcaggatccgcttcatcttcttcagcaactgggggggttatttatatagagcaaaggtgagtacaggagtactcagcaagccaggggaaataagtgtttaatgcaggcttcaaggaaaggctgttgttttcgtaattgattttatttgaactcttttctgaaacaactaagtgagtgcttctcaaacgacacggatgagacagtgcgtcttgtccgaacggagtatgtgcaatgtatcagtctttagattttgaaacaaggttggcacccggccaacagcttttcaacggccacccgggccaacaacttttcaaacggccacccgggccaaccactttcaaacggccacccgggcctagctgatcccgtcagctacagatttttcaaacatcaaaccccttttcacaacagcaatttcacaagcagtagtcaaacaaaactacgctaagaatcacctcacatccgcccatgaccgtgggcacggctgttcgaacagttagttaacctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggctaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttagaaattcatttagttcgcaagcaccgacccaggtgtcgggttttccaagtcttttgtaaaacccaagttttacccaagttgtttttcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaaccgattaagtgcgatcctatcaatgcataatattttgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaac

SEQ ID NO: 5250 - DNA, 1501 bp, Oryza sativa
cctggcttgctgagtactcctgtactcacctttgctctatataaataacccccccagttgctgaagaagatgaagcggatcctgctgatgaagagttcttccaggagcaagccggcttcgatgagttttagggtttcgacctagttcccaagtcgcgcctatgatgtttggtccaagccctggcttccgtttcccttttgtaatgcagttgtgagctcgggatctgtccgcagcccaacatgactgtacttctactctataataaagagacctctgttgctgtgatattctgtctctctatgataccagcactgttttcctgggactggtatcgattaacaggttaatttggagcgtcacgggctaattccagtcaggactagctcggggcgtgacacttcaacaactgacctagtactctcttaatatcgacaatgtgagaataaaaaaggttagatgttgggtaggttgaacctgagaactcctcagtggctgcatgaatgacagaaagggcatcattgacttcacaatatagattccattcctctggtgttggcagccacctatagtttgcatctcctgcagcatatacatccaaggcagacctataaaaaaatgcagattgcagcattttgaaggttgagccccaccttgtgcaggaatcaatagccaaacccatgtcacttttaaggttgagagaatcaatatcagcactgaacttgtatgctcgattgtttgatttcttgatgtacttgatagtgtccctaactttgtcaattatatgcttaatcacagccagaccatcttggacaattaagttcagaatgtgagcacaacatcggatatgaaggaattttccataaaaccaaagtgaaccacgttttgtaaacttggcaagcaacaggttagcagcactatcattacttgaggcattgtcaaatgtgatgctagctatcttgtcctcaattctccatgaagcaagacaatcagaaatggcattagcaataactacaccagtatgtggaggctccaactcaagaaagttaataacacgacaatgcattgaccaatcagcatctatgtagtgggcaacaaggctcatgtagcaaattgtttggttagaggtccaaagatcacatgtgaggcttatctttctaacatctttgaaagtcctcttcagtttttctttttcagattcataaagcctcatacaatcacttctaatggtatttctagagacctttttgtaagaagggtttagcctctttagcaaaacattaaaccatgtatactccacaaggtaaaatggcaactcatggacaatgatcattttgcaaataagctcacgtatctttgtaggatcataataaccagggacagaaacacaaggagcatcaagatcaacatcaccttcatcaaggctagggaaattgatattctgttgttttatggatttttgttgaagcttgtgataatcacactgctctaaatgcctccgcca

SEQ ID NO: 5251 - DNA, 1501 bp, Oryza sativa; identical to SEQ ID NO: 5229

SEQ ID NO: 5252 - DNA, 1501 bp, Oryza sativa
atagctatctcattatcttaagactttgaaagaccaaaccatatcattctcgtgtttttaattatatagtttttaaaagtcacaccaattactaccccttatgtcatcttcttctttatttgcttgctcgatctatcactatttctattcatacttcttggaacctttaaaaaatagattttatagtttttagagtttattgtcacgttgggttttatttttataatttctagatgtctcgtcaaacgttgccattatactcctctacggcccatcaactatctcatctctttattgtcattgagattttaaaaatcgaacataattatcgttttggttcatttttactttctagaagtcccaccaaaccgtcagcggctttgccattgtactcctctacggctcgcccgctgcctcccttctttattgtcattgagattttagaattgaacatgattatcattgttttttttactttttagaagttccgaacctttaaaaattagacttgtagtttcattttttataattttgagaagtcccatcaaacaatgccactatgcccctctacaacccgtccgccgcctactctttattgtcctcgtgattctaaaagtcgaacataactatcgttggaattcattttttattttctagaagtcccgtcgacggctctgcaactatactcttatacaccccacccgctgcttctcctttttattgtcattgagattttaaaaatcgaatatgattatcaatggggtttgtttttttactttctagaagtcccggcaaccgccttactcatttgcttcgcggcctacctgacgttcctcctttgcggcaattgtgttttattaacaatttttatatgtcgtatcaaccgccaccactctactcctttacaggcctgttacttaacttatctcgtcatgtgttttagatggtcttttctttcaataatctttatttttatcaaaaaattgagttacttatatgcaccccgcgcaccgcttctcatttttattgccattgagattttaaaaatcgaatattactatcaatggtttttttttactttctagaagtcccggcaaccgccttatttgtttgcttcacggtctgcttgacgtctctcaatttaatcgtcattaggattctatttgatattttattaacaatttttatatgtcgtatcaactatcaaccgccaccactctactcctttataggcttgttacttaatttatctcgtcatgtgttttagatggtcttttctttcaatagtctttatttttatcacaaattttagttatttataaattgtattcctaattgaaatcttatttttctttttctaatttcagaatttattttttttaaaaaaattagttaataccgtgttgtgttcttttaatgtttttatttttaattttcaatttcagttgtttcaacattgtattcctacttgaactctcttttaatttttctaattttggat

SEQ ID NO: 5253 - DNA, 1501 bp, Oryza sativa
ttaaattttaatctacatatttgtagagtgttatactgcatattaatctatctatttgattttttctatattttttcataactatttagataccatgtaaataacgagagaatgttttctcgagagcatgaatcaactatgagttgttttgttgttttcacgtacggggcatttcccattttagacgttcacgtggggggcattttctaatattagtgttaagcatctactattacctaactaagcatctactactatgaaagaactctactcgaatacaagcatatatattcctctggttgcttaaattggagataagtacaatattcatttgtaagaggcccctacctagatactacgtacgtatcagactagccatctctaaaaatagctaaccaagtaattaaaaataagtgttcagtggatttatcaggctagctagctcttccctagctgatcaaagtttagccatctccctaaccaaccatctcttgctaagaaaaggctaaaagacgtgtctggttacttgcataaagcctgattggcatgcacaagtgcaaacgaatagcgttaataatttggttacccgcatagccttccgagctacactaactcgaaatgcaaggtgagagcttcatccctcgtccaggctaagcccgtacatgtatggggatggacaggtacaacttacaagcacgaggacacgcggttggaggattgagctagaggggtcgagaatccggtcaccttcctctcccattttcttgcttgcttgctgccaccctattcacggattcaccattattgtcccgtcgccgtctactataacccctcagctggtggaacccgagtcctcttcttcggtggtagactacaaacacgacctatactaaattatttagaatgataagtattttaagatggaggaagtagacacaaacatgatcttgaatgtgagtctcgatagaagtgctcgaggttctcactcgaggaaaatgttcaatgatttgtatccctcagctacttaacaataagaactcgtgtaaaataacttaccacccccgttacataataaaagaagatttagagttggacattgttgttaataaagtaggtagaattaaataggaggatgttgtgattggttgggaagagaatgttggtaaaaaagttgttatattttggaacggatggaatatatcttgagggacttaaattggacgtcacaaagcatcgaccggaggaggcccacggcccatcaggcctgagcacgaatctcaatgcgagtgccctgccacctgccaaccatcgacgcccacgcactggaagtttcgttcttcttcccttccaagaaatgcggaaacccgtgcacggctttaaaaccaaaccccaccagatcaaccaaatccccccccccccccccccaaaaaaaaacccaaacccctttcccaaacaatcccccaccgggaaaagcaggcgaacccccatccattgggatcca

SEQ ID NO: 5254 - DNA, 1501 bp, Oryza sativa
caaccaacatttgggcagagtacggaaccgcgaaaccccctctaattcgaactccaaatccccgcattcaaacgcaaaatctgcatccaccagaattccgagaaataccaccacccaaaaacctccctaaatcgcggaaactcgcaatccccgaaagggggccgaaatcgcaaccacacctacgaacaaccaaacccgaaggaaacacccaaccaaccaaccaactaaccaacgaaaggagcaagcgaaaaaaaaacctaaggagcggaaggggaggaggaggggcgtggcgtaccctggcctccatgatggccttgagcctgacgagcgcggagacgccgtccttcctcgccgtcgccaaaccccccgcgagcgccgccgcccgccgctccgccgccagcacccgcgccgccgactcctgcgccatgttcagcatgatctccgcgtacgccttcctcatcccctccacctgcaaacaaacacccacccacccacccaaaaaccccccacacaaccacaatcaatcaatcaatcagcgcgcccaaaaccagattacaccaccacccgcggcggcggcggagtagaacggaagagggaggcctgggaattccaccccactcacctgcgactccgccattctcgaggagaggtgggggatttgggggggagagtggcggttggggagggaagaagagaagggaagggggggaatcgaatgggggtggaggcggagggagggagggagggtgggcgcggccgcgctcccgctctcgcctttttcactactcgcgtccgttggggacttggggtggggtgaaggggggctcgtttccgttttttcctcctcctccgctgctgctgctgcggcttcgagtctcgggagggcggaagtggaaagcggaagcccaacttccctaatgtttctccgcgtcgcggagaggaccctgtggtttggagatattgcgtgcagcgtgcagcgtgcatatatcgacagatgtttagcaggtcgggcgaccagtcgggttccatcgctagcatcttcactacagattatcgtcggtgtataaacaaattggtaggtcatataaaaacatcattaatcacccaggttcagatattgtgtgtgtatcaatggaagttggttgggtgatatgtagtggcggagacagctctcaggtaggtcgggagatcgtctggctccatcgtcgccaccttcactacatattgtctttggcgtataaagaagtggtaggtcatgaagaaacactattagtcgcttatgctcgataatgtcgctagctctgtgaacgttatgagttgtagtgcttgagatttcggtataacgtagatttaaaatcctgtaattgaaagtgttggtttaaatgcaatgataactttagatttagataagatgtagcattttttttatgaaccaagagaaatatgccgtaccaccatctacaagtaaacgattcatgaagagaagtgtagttgaatgact

SEQ ID NO: 5255 - DNA, 1501 bp, Oryza sativa
gagcaatgttcttggcagcaggtggttgctataacaatagcattatcgtctgcggtgctgctatcgatctcgaggatgatgaagctggttgtgtcggctgcactggtggagtcgacgatgacgtcgatgagtagggtggtcggccgcctcagctacagcggtgggagatgcactagtgtcggagttgtgcctgcaaagagcagagattgacgcggtggtgcggatggagaacgagtggatgcacgccaggctggagaagctacgtcggtgagccacttggtggagcgaatacagaggtcgacgtggtggtgtagagcaggcctggaagcagtagtgccaggcgttggtgcacgtggcgtcaacagcgcgacggttgtggtgagaaggaagttgagctcaacactgcccaccgccgtgcccgacaatgcccagtcctactgtttcgagatgaaggcggacgccgctgcagtacccaatgacgacaccaccaccacggcctggtggtcatgcaagtcgtgcggcaaggacaacaccactgtgcttcttctccgtgttgccacctcatcgccatcgctcaagggaagaagacagaagaaaacggaaaaaaaaatagatggatgaaaaacgtgatgatagtgacatggctacaaatagatgagttataaagtattcatctaaataagtatatttgcaatgacatgaatccaatttactgtagataataaaagacacggaaaccaaacacctccattcaattcaccggggccgcacatgcagaggatcccagccctgcaatccgtggcccaaaatccccctcacccagagattttgccaggccaccctccacacgacacaactcgccagcaggtcatcacctacttgtcctttccgcgccaaaggcgggggcaggcagcgtgcgtacgtacgtacgtacgtgcagcaatcatctcgtccacctcaccttacccgaaaccaacaagcggaaaaggaaaaaagttgcgagagaaaatctcgcgatcaaaacctctccacctctgcacgcctccactctataaatcctccgatcgatcaggccggcctcctcatcctcactgcacaaacgttttctctcctcactatcctgtgcctgctgccttctcttctcatctgcttgcagcagcggtagacagtgcatctcagcagcagaagaaaatggtaacataaacaatgcttgcttgtgctgtatctgtgcatgcagcaggatgcatgtattttttttatacgaagttctattagagcaggaaaaaaataacaagattacaatcctgtaagcctataaagccgtaactagaaaaaaaatatataccaccacgcacacaccgacagtgcatgcatgttttcattggtggtttggtttggtgattgagttgttaagctggatgtatgtttgtgcaggttgctgccggaggaggtcatggtggtggcgccgacgacggcatggttgtcgactaccggggtaacc

SEQ ID NO: 5256 - DNA, 1501 bp, Oryza sativa
tgtgcagactctgaaggtgaagacgagcatgaagattgattgctgaaccatctggtttctatcttctcatgatgctaggaacgccaatatctcagcttatgatgaattcttttcctggatgagggaacatgtgcagattgtttggatatgagtattattgttcatgcgaattcgctacagagccgagcaatcatttcctctgtcccggtaggatatttgtgtgttgatgcattgtatgcacgagaggtcgcactccgaaccttccctctggctgatcatcacagaagatattctttgacttctcagttcttgtagagattgaaatgtaccgaaaggtgtaccagtagcgaaaatgtagtatataattccagaaatgcagtctacatatactaaaaccctttcttggtcatttgtgtaagatacgtataccatatgaccattatatgaaattgtgtactattactatcgttctatcagtattaaactacattacagctgcccacgatcactttgtatgctgggaggtgcagtttgcatcttgcgagatgaactgcgaatcgtgaagtgtgaagcgataattatttcacttcccaggttccatattgtaaccagtcttatgtgaagaatgaagccacatggatttgtatagtaaagcacacgagctactccctctggtcgataatactctgatttgaataagactattgtcaaattttaagatctttataacatctaaaatatttatcttagaaatatggaaaccatatttatagataagtcttaaaaaaatacttcaataaattattgatatttatatatatatattataaaatagtgaccatttgttgtttcttggagactgtccttatataaaacgacaaatattattaacttagagagaagtcgatatgaactaagagaaatatcgtcaatatctattttatatactaaaagtactttaaacttcctcaaaacgctcttatgttatcacgtggctttctcaaaacactcccaaactgtcacgtatatactaaaagtccattaatcttctccaaaaggatttcaagcagccacatagcttcttcatagcagtagtatgtgtcacattattctcttctagattaacttattttagaatggaggtagcatcctttaattatctactatcttcttcgtcatctctaaaaagaaagtagacttcgtttgtctagaaaaatgtctaacagattattaagagggtacaatgtgcatgttgtgcgttcataaagatgactgtgcgcacgtttacaatattattaaaaatatataatattcaaatattatccaaattattcaaaataattttaatacaaatattaaaattatcaaaaaaatattcaaaataatacaatatcataatggtcaaaatgccaatagcaaaaaattatgacaatttcaataaggtgtccgtgagaatgtgtgagctacatttctagtttagaataataggggtagtttagaa

SEQ ID NO: 5257 - DNA, 1501 bp, Oryza sativa
gggccctcacgtacgcacgcctactcacgcgcgggtggtagcctctctcgctgccacgttgggccccaccgttgataaagctggactccagtgtagtaccacccgctaccgccactgccagcgtgggccttcaccttgacccgagccaagcgaaaccaaccgcggtcaaagggtgggcccacagccgcctgtttttctatacctcccctgctgctggccgtccgatccgttctcatctcaaatttttgagccgtcggatgtagtaatggggccttcgcgtaaccaccgccgtagcggaatgggagcgaggcgaggggcgcgcgcacacacagcgcgaggcaactgaaacgaaacggcggaaaaaaaaatcagcccaacaaatccagacgttttacccggagggaccttgcatttcctcgtaattacaagttcgtatccgttggttggacctagtaataacgacttgacagtagcatgccatcctgtttctttcctctctttcgagtgttgaaatgggggatttaaatgggttgccatatacattgatgctaagtttagcatcttgacaacaaaggatagttcttatttagtacttcaaatttctttaaccctaaacgtgagccgtcaacagtcttttcattttctcactataataaaagaacatcacttgttaacagcgtgataatttatttttatcgtcctcgtttgatattatgaaaacttattttatttttccacgtaacacctgtatgtagattcttaagtattgtttgtaataaaatgcaacacacaaaaaactattaatctaaagctaataacatccttctcgtatcggtctcttttcggtttttttaattgtttggatccttctagaaattggcgcgtgttagactactttgtaaaaaactcctcaggtatatataaaatcttatataggctctctaccacctaacgtgtatatagtataggtaatagatacacccgcacaacaacgcttgttcattggagagcaatgaaatagtagcaagttagcaacgttgataacaatgttagctttttaagattcacatatagcagtgtcaccacatatgtgcctatcaattcatccgtctgtcatgaatgatagaaatgttatgagtacgatgacacattaaaacacagtcattcaactacacttctcttcatgaatcgtttacttgtagatggtggtacggcatatttctcttggttcataaaaaaaatgctacatcttatctaaatctaaagttatcattgcatttaaaccaacactttcaattacaggattttaaatctacgttataccgaaatctcaagcactacaactcataacgttcacagagctagcgacattatcgagcataagcgactaatagtgtttcttcatgacctaccacttctttatacgccaaagacaatatgtagtgaaggtggcgacgatggagccagacgatctcccgacctacctgagagctgtctccgc

SEQ ID NO: 5258 - DNA, 1501 bp, Oryza sativa
gcgtcttctgaaccgcacgatcgccggctaattccacgccgtgtactggtgtgtaactactcctacgtggtaatgcatgatgcaaactacagaacttcatttgttccaaaataaataaatttaatataaaatatgatacattctaataccataaattcagcatctgtaatactataccaatcttaatatcttatactccctccgtattttaatgtataacgtcgttgactttttgacaaacgtttgacatttcgtcttatttaaaaaatttatgtaattataatttattttattgtgacttgatttatcatcaaatgttctttaaacatgacataagtatttttatatttgtataaaatttttaaataagacgagtggtcaaacgttggttaaaaagtcaacggcgtcatacattaaaatatggaggcagtattaaatttgtttactttaatatgacttaatatagaagaaaaaactccactaggcatgattatgccatgtgtcacttgatgctgcctagtcgtgaccatttttgaaaggatccatttgtcgtattgaagtaggagcaactgaggaaggcacaacggcagattttttctgtctccttttttgctgatatttttgttctcataagcagcatatgcgagctttatgattaggcccggtcgattcacgataagtagataagaacacacaccaaaacatttatcttcattttattacaaagagacggcacagcagcacaacgcacaaagagatgaaacgatagctcgtggaacacttgtaagcaaaccgatcgaccgatcatcgatcgttagcactgcagcacggtcactcgtttataccttccaacatctcttgtcccaatctttatcacgatatctttgttttatgctttcccctttgggtcatcctaaaagaagaaaatatagatatggcctaatcatgatatgttcttgaatattctcaaaatggacacattaccccatctagaattctagatgatcaggtcggcacatgcctatggattaaagcatatgctttgattttggaatatgatatgcatggatgcttcaattaaccagcctatcacaggggtgaacagtagtggacgataaaaatgaaaaaacttcaccccagaacaaatagcaaagaaattccacttgattatttgactcacacaacctgattgaccgtccggatgtttattagttattactttctccgttctagaatataaaaaattttagagttggacacgaataaagtaggtagagttaaatgaaaaaagttgtgatggttgagaaatggatgtagatgaaaaaagtgaatagtggagggttatgattggttgggaagagaatattggtagagaagttattatattttaggataatttttaagtgttagaagttgttatattttgggacggagagagtacctctaatccttgattcttttaaccacgactacgatttcacaaaatgtcacacctaatgac

SEQ ID NO: 5259 - DNA, 1501 bp, Oryza sativa
aagctgattcatatgttgcgacttattgcagatgtacatttagtgccataaccaaggttgtacgtataccacggctgggctgttatttccttgtaatactgctgtctgatgtaatgacgattcatttctttttcctggtatgtgttcttttcccctgtgtactttgaattatcctttatagtactttgtgctgtagctcttgcttgtacagaaaattgtaagccaaatgttcttcattttacccacaggttcgaaatacggggagttggatggaaattggcaatagcatcagccatttcggaatcgtgagtgcccaagtagtttttgtgttgctgcttttcgccctcacaaatatattcacaaaagatattgaggtctcatctcggcaactaagctcaaggaaagttatgtaattgttccatttgtttggagatcgacattatactttcagttttgttagagtttaacttttgggcgtggtttcgatttttctgcccaagttttgtaacttagctagtagatggtgaactttgtattagatggttccagttatcatcttctttacatgtaagagcattaggagcatagaaaattttctcgtcgagaatttagttcaggtttgtcttcatgggctcacggctaccgtagtcgtcaacacgcatttttttcctccgatatatttcacggctcgctcagtttgtaaacatgcagtagtgtagtgttggggaggcgagcagagattggcctcctgcattgattcaagatttccaaatggtaattgctgtaacttgagtgatttctaagcaagattagcactaccggttttgtatgtaaatgttgttgttttgtgatttcttgctctgctatcgctcgacaaataaaatgagtagttactactgatcgcatgtttgtaacttggcgtaatccttcacggcgagctatgcttttgcccccacgagaccacgaccagtggaagcatcactgcctcactggctcactgcatcagttgatcgcctccgtgcggtccgcccgttcgttatccgaatccacccaaacatcccgcgttatccagccacgcccccctcccgccccgccacgtcaccacccaccgccacgtggctcctctccactggctgagcggcgcccacgcgggataaggcatttctccctccccgaaatcctcaccttaataaccaagcatacacacccccgcgccgccaaaagccgccaccacccagctcaccgcatcacacgcagcagcggaagaagcagcagcagcagcagcagcagcaatggcgtcgctcaccatgatggcgtccctctccgccgtggcgccggggcgcgcggcggcggcggcgccgcggcgcggctcgctggcggtggcgagggcggccgccggcagggccgagtgccagcacgaggcgcaccactgcggcgaggggtgcgggtgcaggggcggcgccggcgccgagggccgccgcgccgtgatgttcgcggccgc

SEQ ID NO: 5260 - DNA, 1501 bp, Oryza sativa
caacattacggggttaagaaaaagctatcatttgtatcatgtcctttccgtattctatatcgatgtcgttttccaccgcttgaccaaagtatttgcaacaacaatactgacactggaattatccaatgcattcctaaatatgaaaaaaagaaaacaaatttcttctcgcaaaaaaaaagagagaaagaaacaaacaaaatgaatttggcgaatataaacaaagcagagagcagagcaatctccaaaaaggaaaaggtaaaagcgaaaaataaccaaaggggaaaaaaaaaagaagaagcagaggagtgaagaagaagagggtggataaaaacggatttacctttttttccgagtctcccaaacacacaatctcctccttcccactctctccgttgcccacttccttcgcatctcctctccctctccactcctccgccgcggcggcgccggagctgtgcccgccgccgtcggaagcgtagcagcaggggatggcaatgcccccccgggtcaccgatccccggcggtgaatttcagcgggcggggagccgcgccgccgccgtcgacgacgactctggtccgacctcctcactggtatggtatgggggggggggtgttcctcgatttggcctctgtgtgctcgtccttgttgtgtcggggtaatcggtgaagctggctcgtcgccggggaaagtggaaggtggctccccggcgacgggggacggcggaggccggttgaatccaatcggctcggtgcgtggagggaggggaggggagggaaaactcgggtagattcgcagacctgtggttcatggacttctgtgaattgtcctaccatgaaaaatggtttacatctaccgaatctgtaattcgctatgttctcatgtctcctggggaaagggagaacctgtaattttcacttttcagaagaagaaaaaaaattgtcaacgtgattgtataaactctagttgtttttctcttttttttttctttaaaaaaaactctagctgattcctttgtgagttcagtgtttgttagtctatgaatatatatatcatcatggtgtagatgtttagaaggcaacctaaactgaaccctaaatagccaggcacaatgcaaagccattttaggggtagtagcgtattgttactgtcattttccttggtatactgtttctaaagataattcctctgtatacttgaatatgaaggtgtcgctgttatcttcgaaagccagattttttatgttatttaccgattcattttgatcttttttcttttgcaacttgcaaggacaatgaagtcatatggttcagtttcaattttaactgtacttttttatggaacatacattttctagaactcttactatgaatgtctttataactgaaaattctgtactgatatgggagctgttgtgcttattgcgtttttatacatgtcttctaggtcaagctactgcatttgtacagttcgctgaagatcggtagttcgtacaagctggga

SEQ ID NO: 5261 - DNA, 1501 bp, Oryza sativa
gccgtaataagaggagagagtacggattgagagaagaattatatcgttatccgtgcccacgctttcttacctattaaacagggtgttctttaaaaaaaattatatagaaaagttgctttaaatgatcatattactttttaaaaaaatttaaatgagttactccctccgtttcagaatggaagtcattctagcatttcccacattctatctagattcattaacatcaatatgaatgtgagaaatgctagaatgacttatattgtgaaaaggaggaagtaatactcaattaatcatgtgttaataactcacgtcgttttacatatattctccatattctttttttcctctcgtctcaaacacaaccgaggaaacaattattggtgacgtagctaaatcttaggtgtccatttctagatcccaaagtattttccgtaacgcgcgtgcactcacctctatgagcgtatacacacagataggtacatcgcatactactgaaagaataattagctataaatgcaagtaccatgtgggttggtttcaccacaagaaaaataaccgattgagttatgctcacttcacataaaatgtagcgtaaacttgaaatacgtaggatatagaaatggattgggcaaatgtcaagtgctcatttctttgtcctacgatagtttctatatttgtaatacatatgaagtttgcgctacatattttttttttatagaacctccattcgtaattcatacagtactttacatcgttgcttcatgtaatacattaatttataccaggtttaaaatcaaaactctatccattttttaaaaataaatctacaaaggaatgtgacacatttttatatgaatctcggcagaaaatagttgctcccgaaattggaatctgaaaatcgcttccgttggtggtgttccttgcgcaaatctcgaagcaggggcagcgtcaagccgtcaacccggctcctggcaaaggagcagagccgagatcccccagcaatggcggcggcgcagtgagctcgccgccgattgccaacatgcgggcgacgccaccgccgccgccgcgtcccccggctcgcgcgtacccaggaacgtctcccatgggctcgtctccagccttgccgcgctccaccaacccggcggcgctcctcgcccacctcgccgccgtcctcacctcgcccgactggttcctcaacccttccctgccccgcctccctgccctgctcacgccgtccctgccggagtcgctccccgtcccgctccccgtccgcctcgccgccgcggcggccagggtggccgcgccgtcccgccacctcctcgccgtcgcgctcccggtcgtcctccgcctccactccctctcgcccccgccgctccgcccgctcttcgaccgccccttcgcctccctcctcgcccacctctcccgcttcgccctcgcgccgctcgccctccgcctcttcgcccacatgcaccgccacgccccgccggcgccgacagccccc

SEQ ID NO: 5262 - DNA, 1501 bp, Oryza sativa
aaatacaatttagaaatagttgaaattcggaattaaaaaataaggaatattagaagaggagactagactccatatagaaatacaattaggaaataactgaaattcggaattaaaaataaggaatattagaagtagagtatagagtccatatataaatacaattaagaaaaatatagaaattcggaattaaaaaataatgaatattagaaatagagtatagagtccatataggaatttaaaactaagtaaaattcggaataaacataataaaattaaaagtagagttttagtccgtataaaaatacaatttacaaataactaaaattcgaaattaagaaaaacatgggaagaagagtttaaagtcaatataggaatataattagaagtaactgaaattcgaaattaaaaattaaagaatattgaaagatgagtttagagtccacatagaaatacaattagaaataataaaaattcagaaataaaaataaataatattggaagaagagcctagagtctatatagaaatacaatttacagaaaattcggaattaaaaaaatatattaaaagatgagtctagagtccatataggaatatatataatttacaaataactaaaatttgatattaaaaataattaataactaacacatatgtaaaatacaatatgaatattacacatttgtagtttcgtaaagttattgaaaaatttaaaattatgatgttattttaatatatttgaataatataatgagaaaacatatatgctattatatgagaaaaatataatgatgctagccgcgcaatctgcgcgggccaccatgctagttaggtgttaagagaagcaaattttgaggatggtcgtgattacattcaaagccaataatacaaccgtttgatcttaatgtttgatgagcatgatctcttcctctgttgttacattttcattttcaaattgaactatttgcatattgctgtgctcatcacagtaacacaacttattatatatactgccataagcgtatctttcatgggagtaacttttatactccaatcataaaaacctaagggcctctttgttttggaggaaaaatatagaaatttcctataggattttaggaaaatttcttatgaagccctttgaaacaaagaattgaatcctatccaatactttgaaattcctatggaatggacaatcctatagagattttggagaaaatttagcaagagcttcaacctcttgctaactttcctttgagtctatctctcatccaattcctgtatttttcatgtggtttaatcaaacggtcattcctgtgtttttcctgcgttttgcaatcctctattttacacttacatttctatcaaaatcctacgtttttcctattcatacgttttctcaatcctgcgattcaaagggccctaaattcatacgtttcataaccaattttgttcacggtgacgtgaacaaatccaagaaacttttatatgctgtaaaatata

SEQ ID NO: 5263 - DNA, 1501 bp, Oryza sativa
atgctaagactggtctgaaatggaaaaaaaaaatctgaacctgtcattgaaaccataggccgaccaaccacaaaattgcaatagtttttttagcgaggagatatttcaagcttcattcctacaataacgctttcaaagaaagggtacaacttgtacaatcgtcatcaaaatccaatcagtacaaaattttcaccttagtgtatatgtaccattctcctgtacacatcttcaagactaggacatccaatatatccaatgtttttggacatccaatccaatgtttgatgctttcactgtctccaaccagtgaatgccaaaaccagtttttccacctcaagaagagcatcaaaagactatgcctgggtatgggcttcttttacaattacacgacatacacacacgcagacacatcactgcacacgtaagatgatactcagtagtacatccataatctcactacaatctcgttagaaacctatctgcataaacgtaatatttgtgggtaccagaatttaaactccgacgaatgaagtcattcgcccatgactccacgcccccgactattcgctaaattcaaccaatagtaacttatcctcactaattaggaagccaatataaaccctatgtttcaatctattatattattaaaggaatagaaaaatgagcctccacgttcgctctcatggcctagaaattgtcacattaatcggagaaaaagaaaaagcagagtccatatagaaatacaatttagaaatagctgaaattcggaattgaaaaataaggaatattagaagaggagactagagtccatatagaaatacaatttagaaatagttgaaattcggaattaaaaaataaggaatattagaagaggagactagactccatatagaaatacaattaggaaataactgaaattcggaattaaaaataaggaatattagaagtagagtatagagtccatatataaatacaattaagaaaaatatagaaattcggaattaaaaaataatgaatattagaaatagagtatagagtccatataggaatttaaaactaagtaaaattcggaataaacataataaaattaaaagtagagttttagtccgtataaaaatacaatttacaaataactaaaattcgaaattaagaaaaacatgggaagaagagtttaaagtcaatataggaatataattagaagtaactgaaattcgaaattaaaaattaaagaatattgaaagatgagtttagagtccacatagaaatacaattagaaataataaaaattcagaaataaaaataaataatattggaagaagagcctagagtctatatagaaatacaatttacagaaaattcggaattaaaaaaatatattaaaagatgagtctagagtccatataggaatatatataatttacaaataactaaaatttgatattaaaaataattaataactaacacatatgtaaaatacaatatgaatattacacatttgtag

SEQ ID NO: 5264 - DNA, 1501 bp, Oryza sativa
ccccggcgccgccgccgccgccgttgcagctccccaccagcacgtcggagcacgcgtagctgctcgcgctcgcatcggtgctcatgtcctgatcagcgtgctgcggcggcgatggctgcggctgcgggtggttgctccagagccacgtcttaatcatggacagttctatggttccgccgccgcatccgccgttactgtaaccaccggcgccgttgacagtgcttccggagtagaggtatccgctggcggcttggccgtgcacgtcggagaataagttgccgtcgaggaagttctccagcttcggcgcctcgccaccgccgtcgcccaccgtcctcctcccgccgccgctcgagccgacgagcatcgagaggtcggaggagccaccgccgtagtccaaacccctcagcgcccaatctgcaaagcacgccagggagatcaccatgcacgactcccccaaaattcgctgcttgcggctgcaaaatccccatcaaatagctatacgggtattctcccctgccaacaattaataaaacagttttctctgctcaccaccaagaacggagattgcgaaacgaaagaaaatacaagaaccaccaaaaaagaaacacagctcgctggctaatacggagactcattcgaacagcacggggaagagaacacttacgagatttccaccatgggagatccggtggacgagccgcagctgaggatgagatctgtgtaggacatcgagctcgtaaggtggtgtgcagctgtgcgcgggcaagtggttggacacaccaatcacatccgccgccgtgtttccatcgcggatgggatcttggggaacagacggcttccagttagactgccgattgcacgccatggccgccgcgtcggcgagcggggcgggtggtgggtggggggagaaagtggccattgagctcgcacgatcttgttgcgcgagcatgttgttggtcaccacacccccatccaccgtcgtgcatacctcgccggtgggatgttggagaacagccggcgtgcaccccatcgccgcaggagcggcgaggcggcgtggttggggcgggggtgaaagggggaaacagccggcactgcgcgtcgtcgaacacaccggcgagatttgtgttcggcaataattgggaggggccaatagtactctctctccaacgtgacgcgctggcccacggagcgtaaaagtagtactttgtatacccaatacatacggtcagcgcaatatatagattgaaatacgtcccgaccactttacaaccggcaccaatcgcgggatgcatctgacggctcccagcctactcctctttcagtttcacctgctgctcctcctctttcaccggctcctccattttcatcttcatcttcctccattttcattttcatcttcatctcacattccaactccaacccctccacacatccactcccttgtagtcgtagtagatgtcataaatcttccattcactttgggattttttttttaaaagac

SEQ ID NO: 5265 - DNA, 1501 bp, Oryza sativa
gaattttgctttcatatgacatatatatttgatgcaaatgggcatgcctatggcgtgattagttgttgacattggtggccgggccatcgtaaagttgaccttttatgaataatgtactcctcccactcatttctcgtgtggttctgattttccgcacccaacatttaaccatccgtcttatttaaaaattttattaaaaaaaattaaaaataagttgagcataaagtactatttatattttatcatctaataacaattaaaatactaattataaaaaagtttaataagacaagcgatcaaatgttagacataaaaatttataactgcaattaattaaaatggaacaatggaacggagggagtaatcggcaaccggggattaatgcggtaatcagaatggcaaaacggttagggcacccacaatggttatctataggctctctacaagagatccatgtcagcatattttcctacttgaaaggtattaaatgaagagagagagagagcaaagctatctactaacttaaagatagtctatagagaaaaacgaggcaatgaatgagagagatatagataccaatatagacatactattaaggtggtttactattaatcgagtctattgctgaaatatacatgttttatagagagcaccttactttactattgtggatgctcttatagctggtcgctagtcagcttaattatatatgttctgctatacgtataaccttgaatcggtcgacatgagaagacgcagtgtgtcatcaactagtaactaacgcactactaccagaaccctaaatctcataagaaggcttcatcctgcctataaatacgcttggtttgcacgcataggcttctcaccacactcgagattgtgcgatccagtcctaattaattataccgtgagttgaaaattaattaagatcacttaaggtcttaaagctagcagccatggcggcatcgtccaagttggctttactggtgttcactctcctgctcgccgccgctgctttcatccacgtcgcctccgccgaagaaacacgtacgtgagctagctagctagctagcacacaccctgcatgcatatatatacatacaatttttcgttaaattttctcctgcacatacacatatatactgcttcctccgtttcacaatataaattattctagtatttctcacatttatataaattattctagtatttgttacatttatattgatattaatgaatctagacatatatatctatttagattcattaacaataatattaatatggatattaaaaatactagaatgacttacattatgaaacggagggactacgatacgatatactactacatgtattgtgttcatgcatgccttcttcatagtattcatttagtattaattagtatttgatatgtcgtctatatgcatgcagatgacgatcacgacggcggcgatcacgacccgtcgccatcgccgccggaccacgaggacccgtcgcc

SEQ ID NO: 5266 - DNA, 1501 bp, Oryza sativa
tccctaacttccagatctggcccgaggggggtggtggcccgcggcgctcccctccctcgctccctcccagatctggcctgagggggcggggggagggcggtgaccactcgtgcggcggtggcggcggcgggaggttggcggcagcgggaggaagggggccgcgtgtcacgccagaaactcacgaaccataatttctaagctgaatgtgcattaaacccctgtccaggaccagccagggtacacaaacgacaattgttgacatacagctccacgtcttacaaaaatataaaagattacagatgcagcggaaaagataaaagcgagctaagcctgaagacttgactcctgcagcgggcgactccattccacaggcaatacttgacggcagcgacaaaaccaacctcaacgagacagctccaactaggaagatcttcagctctgttatgggggaaaagagagcaagactgagtactacccactatactcagcaagtcataccggaagaggaggtatgatgcaggatatatccaagggaggctaaaggtccttttgcataaagctagcatttaaaagcagtagttgaaagcagtaaaacagttgtagtaattaatcaatattaaccaatcattgtctaacgctacaccacgttgcaacaggcccaaccaaccacctgaactacaccagttcgatagctaactaggggtaagactaatcacggttgtcggtgatatgggaccgggagtatcatgaccagaggcttgaggcagacgcaatcgcccacgtggcctggcaccttcgggaacgtcgggcccgagggtgaggtgtccgccctcctcctgatttcccccgaggttgcgcttgccccggccccgagggccgaggcaccccgaccccttaaggaagtttgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggggcatgtggtatccccttgagatataaaaggaggaccttgcccatt

SEQ ID NO: 5267 - DNA, 1501 bp, Oryza sativa
aacattaatcaaagtgaggataaactgtataggtatatagcatattataaaaatgatggagagatatattaaaatattatttgaattaattgggatgatgatttaacatgcttgcattctaaagttctaaaatttaataaattatataattatagataatatagcatgtttatatgatttttaagatataataattgttagtagatgacggcgttgcgtctttgcatgctgaattttaggatttagtgggttataactttatagtcgatgtttaaaataataattgttagtggatgatgacgtgtggcatttctgtatgctgagttttaggatttagtgggctgtaactttataataagataggatcagtgtaagattaattaagtattagagtaactactgtaaatttataaactttatttgattttttttaaaaaaacttttaccgttaaatattttagagaacagacaccggacgcttagtaatttgaaaaattaaacgtgcttagttaaaattgagaaaacagataatccattaatgtgattagaacttagcctaagggcttgttctgatgggtggtttggcagaaattttggtggcatgccaagcgagataacctattaaggcaagttctaagcacaaactctaaagtgacatgtatgtttaaatgatgatgtagagaagagaagagaagagagaggggatgagccacctctcatgtaaggggcaaaacttaaagaaacatgagaaaatgagatggctgattggtgggactagtgtataaaatgcaatgcatttatataagttaattttaattttttagatggatgatgtggataaaattggaggtgactaccacatctattgtaaaacttgccctaatcaagtactccatccgtctcattttaggtgcagccatgatttccctgtacagctttgaccgtccatcttatctgaatttgtttttaaaaaaaaataaaaaacataagtcacgtataaagtactattcatgttttatcatctcatgacaataaaaatactaattataaaaattttcaaataagacagatggtcaaagttgggcacggaaacttacggttgcacttaaaatgagacggaggaggtattaattattaaaaacttgaaaacaatatttatttgatttttgaagaactttgatatagaaaacttgtatatacaacacacgatttagctatataaaaaatgtggcaataaaatcgagtaagctataccgatatgtgagatggcgaaaaatactgagccgtatacgttgaccaagaacagcgatgcatgtcgccgtattattatcatgtcttcgtatatgttgtcaaatatatatatatatatactagtgctctcttccttctataatatagcaatataaagtccaatgatatgctataacgaatctagatatgtcatatgattctatgctactgtattatgggacgaagggattagcaaattatggtttagttg

SEQ ID NO: 5268 - DNA, 1501 bp, Oryza sativa
accggcgacgcgatagggtgcgatcggcggggcagaggttgcagcggcggagaaatcgcgatggagcagcggatgggcggagaaatcgtggtggagtgcgcggcggcggcggcggcggatggggaagacctcggctccatggggggctggggaagacctcgcctccggttcagtgcgtggcggcggaagaaagcgacgacctcgagggtagcggtgcattgcggcggcggcggcggcggatggggacgacgtcggctcctgctgcggccggccgcggcggatggggaagaccacggctccggcggtggttgggaagacctcgcctcggttcagtgcgcagcggaggcggtggagtgcacggcggcggcggcggaatgggacgacgacgcgaggaggagcgagtcgcgtgttaagagggtgatgaggcgtattctttgcgcggagaccgcgcgtggagagggtgaaatcatgcgtcggagatgggtggatggtacggattacacctgaggtgcgaatggacggtagggatttaacccgttgatttggcatgtaggggtgaactcttttttatattagtacttcttccgtcctaaaatgtaagtatttttgaggttagcacggatattaagaaaataggtgagaataattaaagaaggtgtgtgattggttgaaaagagaaagtaggtgaaaaagaatggttgtgattggttgagaggagaaggtagttagaaaaatagcttcattttggaacaaagtactgtgctagaaatagctatatttttggacggaggtagtacatatgagtgttgacgcgttgccgtatttgttaatctcatgcacaaagcaagcagaaatacgtggaaaggatacatagaagaaagaaacaagtaaaaataattttgcaaaatctttggatagataaacatagtatgggttcaacttaaaaattgagtcgggtcacatcgatattctatacttatacaaaattaaaacaataattatgaaaagtaaattgtataaataatataaaagttggataaaactttataatcctgaaaaatattatttttacaatatttattttctcctaatactacaatctgtaatgaattatacacaattttttaggttttatgaagtcgctacaattttaagaaaacatacattttctctatttttttcctaatatcgtcaaaattaaatagtatatcctgaatccaaaataattattgacaatcaaatcctatttcagttcatttctacaaacacaattaaaatccactaacatgtccttttaaaaattaaaaggctatgtcctttgaaaggttatgggcattaaagaactcatgtaaagtaactttttatattatatgtagtttgcacgagtataaactagccggcgcgtcaactggcacgttgattttcttgtggagtactaattttcttccatcagtttagaattcttctgttttccaaagaatctgaagatcatttttttttc

SEQ ID NO: 5269 - DNA, 1501 bp, Oryza sativa
gatttttactaataccacgtgataccttgagagcggtttaaggattaccacgtggtagtgtgagagtattttaaggaagtttaatggacttttaatatataatagaagatagatttgtataagttaatttttaacttagatgttcgtggagtgatatattttatattaatctatcttactatttttttaatcttttttatgattatttacgtgatatgcacgaaacaagaggatatacgggatgaaatcaccttccctttgtttaacatacactactggaaaactgatcttcgctcggtcgccccaaaaccataatagtcccggttataaaaagaacctggactaaatatgatctttagtcccagtttaaaaccccatagccattctacgatctttagtcggactaaagatgatctttagtcccgattcatcccctgtcagtcccttgtcagaggggcggggatctttagtcccggttggtgtcacaaaccgggactaaagatcaccactttagtcctggttggtattaataaccgggactaaagatctcctatatctttactcccggttggtaataccaaccgggactaaaatcacgcgtagtatataatccctattccctgtcatctcccccaaaaccggcttcaatctcctcaacaaccggcctctcctctcctcagatccatctccctctcctccccttcctcctcccatcccagccctctcctccccctcctccattcctgtcacaccccgaagttctcctcccaagcctaaatttaatttttaaaacgaccccaagaaaatgcaggtgcaaatcaagagaaaaccctaagaaagtaatgcaaataataatcggatttggcatgtggaatttttcttgagttctacatgtcgaaattcattaacaggatttttagtggaattttcagagctctagaaataatttgaaccaattaaaattgagcaagcaatattttaattccagggaaaatcctttttcctttttctttttctttttcctctctttttcctcctttttttcaaatgggccgtcggcccattttttcccttccttcccccctccctgcagggccggctgcaggccgaggcccagccaggccgccgccgccctcctctcccggggtcgccgacaggtggggcctacctgtcgggtccttcccccacctccggccgacgccgagccagcaaccgccgcgcccgaaaccgccggcgcgttcacgccttcgtcttctccgggccacgtcgaccacgcccgcgcgtgcgccgcgttccccgcgcccactcccctctctctcccgctcgcacccgcgcccgagatggtcgggattcgattttcgaatctcctcccccactcccccacgtcagccggcgattcccgcctctcccggccacgtccggccctctctctccctacttaagctcccccgtcgctccctctcgctttttccccatttcgcctccctctcccgagctcccc

SEQ ID NO: 5270 - DNA, 1501 bp, Oryza sativa
tccactagtgataacaagaaacttgtttagagcgtacctgcttcccaagcgtgtcgcccttatccggctgcctcgtgtccagacacctggcacaacacacatcgcccatcttacacgtgcacatgctcccgtgtcacctcctcaacacttgcacgagttcttcgttgcttgccgctctataaatttccagcttcctttcgatcctcttcaacaattacaataatcatcaagcttcttcttatgttcatccaaatccacagccataaaagtagccatacttgagtttaggtagccagcatgcaggccgggaagaacgcgatgcagtcgaccaaggaggccgcggcgaacgtgggcgcgtcggcgcgcgccgggatggacaagtcccgcgccgccgtgcagggccaggtggagaaggcgacggcgcgcaacgcggccgacaaggacgcggcggaggtgaggcggcaggagcgcctgcaggccgccgaggaggagaagcagcacgccatggccgccaacgcagccgccaaggagcgcgccacgggcggcgccggcgcgtaccacccgtcgcagggcgcccccggggtggacccgcgtgcggcgcagccgacgggagggcacgtccaggacggcgtcgccgagagccggccggtcgggacggccaccggcacggcgaggcccagcgccgcccacaacccgcacgtcggcagcgacttctcgcaggcccacggcaccggcggccagtaccagtgatctcattctcatatcaatgtgacaatttatgatctactagtagctgttcatcagttcatgtagagttcacttcgctactatgagttgatggggaataaaattgtacgtgttagaagtggtatcatgttgtgggagatgcttaattatgaaataaaacagagtactctcttcgtttcacaatgtaaataatgtaaatataagtccttatagtattttttatattcatattgatgttaattttctatatttatattgatattaataaatttagattaataaatttagagacatcaatagtacctgaaaatatggttacttcgatatgtgtatgcttgattgtgtttgttcatttctatccaaatatgactacttcgatgtgtatgattgattgcgttcgttcatttccatgcactcagtgacgtctgtgtttaataattactttctgatggataagcagaggtactggatttggtactagatttatcccgtgtgggaagtttttatatgttagtcgtgtgagacgtactccctccgtccttaaaacctaaaaaaagacagcttatttttagtctaaatttagtctaaaaaaaggacaaaccttgttttcgtgcttaacgtttaaccgtccgttttagtccgtcttatttgaaaaaattatgaaaaaaataaaaagacaagtcacatataaaatattaatcatgttttatcatctaataacaataaaaatatgaattatagaaattttaaattt

SEQ ID NO: 5271 - DNA, 1501 bp, Oryza sativa
actccacgtacgcgaacgggagcaaggtcgccgcccgcctcacccgccttctccgccgttctcctcgccgccccggtgcgctcgtctgccgtgggcccgcagccgctccgcccaccggccgccggcttagatccctcactgaagaagaagaaagaagaagagaagagagaagagaaaagaggagaaggggaagaaatgtgcagctgacatatcggcttcacgtatatattttttttcctgactatatgccacgtcagtgaaaccacccatatatacctcacgtatatatatattttttcctgactaggatgccacgtaagtgaaaccacctataaattcggccggcttagatccctcactgaagaagaagaaagaagaagagaagagagaagagaaaagaggagaaggggaagaaatgtgcagctgacatatcggcttcacgtatatattttttttcctgactatatgccacgtcagtgaaaccacccatatatacctcacgtatatatatattttttcctgactaggatgccacgtaagtgaaaccacctataaatgtaaaaagttagggtggtgggaatcgaacccagctggccaaagcaaagtttcactccgctaaccaagttggcaagctgctagttgtgttcaataattcaatcaattaatacatattctatatcaatcgtgattttgaagtagattgaaaatggtccgactcgactattgagccgattaaaaatgattttagcaacgtttgaacaggatgacggacggaaaaaaaatccggaaaccttacgtattttttattaggggtgtgtgtgtctatatatatatatatatatatatatatatatatatacatacatgtatatatatatatatatatatatatatatatatatatatacatatatatatatatatatgtatatatatatatatatacatatatatatacatatatatatacatatatatatatatatatattgtcagggttacggataaggtataccctctatccttagacgtacgatgagtattgatacggtatacccacgcgtatacggatagttccagtatatgttaaggaaatctatcacgtgatagaaacagaatccacggatgtaaggagtcctactcgggcaagaccgggtctttaccatatcgtgagaggtccgatatctccgagttctacttggagatcaactaacccgcggtataaaagggaccccctgggcaggacctagggcatcgaatctcaccgcaaacacatccaccacagctacgaagccggagcgcataggagccaagtcgccgggagatctagtcgaaccaactcgactactctctcgtcggtaccatcgagttctgttattccctttgtattatgtgatttccatcatataatcccataccaactggattagggctattacctatcaaggggcctgaaccagtataatcattgctttctgtttgcttgatgccgtactacgta

SEQ ID NO: 5272 - DNA, 861 bp, Oryza sativa
tccccctagccacctcagcatcgccccgccacgtcggcggtgggacggcgccaaagaggctggcgccgtcctattgaacgacggcgccagccactctggcgcctcaaaaaggaccatttttgggataagtttttctagagatctacttgcgaaataagtttttcaaaaggaccaaaatatgaaaaatccagtatatttgtcgcatacttaattagccacggttatatatataacgaaaggatttttcaaactatgttatactgataagtgaagcgctagttttgcatgtgtgggagatgctatatatacagatacatgtcaatacattaactaaagtagatatagaatacataatctgtagtacttaaacataagttctacggctctattgtatactttaatttagacgtggtcaaaattaaatttacctaagctatatgttatctgaaaaatcaatttttatcacgcgcatttagacaggtgtgtacccaactagaaatgggtatttttccaaaatatgcatttcagtgggtatatgcacgtactcaaatcttgatttcctggaaccatgaggtcccaattcatcttccttgcctaatttattagtttgtactctacaatatattatacctagtttaatagtatatatatatatatgtgtctatatatatatatagtgaatctattctacacccccctcccatgggccaatcccacctccccacccttcctagggcccaaatcccctctcccatatcagtcaaaggctggtcaaaaccccctcccgccggtcagacctcggtcaaacccgcccattgactccctcccccgcccaccacttcgttgttcacgtctcgcagg

SEQ ID NO: 5273 - DNA, 1501 bp, Oryza sativa
ctctctctctctcgcattcaaacggccggatttgcccacgcaaatttcgccggcgccattgatggcagccggacctcccggccggtttccttcctctcccggccgccctctcccccttccaaccctatttaaaccctccccgcacctccttcgcccgtttccaccctttgccgcgccttctcctcgccggaatcgagctcgcgtcgttgccctctctctcctccgtcgccgacgacctccggccggccttctccgctcgccaggaccgtctcccgccccggcgtcgcctcctccggcttagccgcaccgccgtcgaccccgtccacccccacgccgagctcgctgaccgccggaacgccgccgaccccgtcgacccgagccgcgccgccgccttcctccgctctggccgcctttttcgtcgtcgccgtcgacctagggtgagccgtggaccaccgcctcttttcccccttcccttcccctctctcgaccgctgctccgccgtgcctatggccgctgccggcgaccataggggcgcgggtgccgcctgccgccgaccgcgccgtcgtggccgccttcgggcgcgccgagtggccgccgcgtggggcccggccgtcagccgcccgtgccctcgagtgaggctgacgcgtggggcccacggctccggccggtgtgagcccgggtgcacccagtccaccgtggaccgtgaggctgccgcgtgggccccacccccgtggacccggtccgcgcgcgctctcccctcggctgacgcaataaatcctttttaaattaaaatttaaatgaagaaattcgcaaatattcacttaaagagcatataaacttcaaatggccataacttggccatttgaactcggaattggaccgttcaagtctctaatttttcctcaagaagtcaagaacccatttttgtactttgttcctgcttgttatatggagtttattagagtaaaatactttttccttttctttggtcgtgtagacgctgtagcttcggaagatccgctctacgtggaggttgaagccgacgtttggaaaagcgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattaccttgttcaccctaggaaaataaaaccccaactagtgggtactctatttatggttccactagtatgaacttaggtagatgcttcgctggttaattaggcaacattaggtggttttataactttagactttgggaattctcatatcacttagacactatggaatggttggattatggtggaattggacacatacctccccctctattcaaaacccccaaaatggttttaggctgggctcgaggtgcgtggttgggttttgtttgtcgtaccttgggtactataaggattaa

SEQ ID NO: 5274 - DNA, 1501 bp, Oryza sativa
tcttttagcaatagtacgcataatttataagtaaatattttatatgtatgttatgatttaaatatcaatattgaaaattaaatttatataaattcctttttaaaattcaaaatttgacagcagctgattctaaacgaagcaaatcattggggcctctgaacagagtgacaatagtgtgcaactgttgacgtactagtagaaggagagtagtaccactaccgtggtagcagctgcttaactttgcccaccggccaccgttcaggggccattaatggcgtgcagggccgctgctgctgctgcttgctcttgctcttgctgctgggtggagtgagcgagagatcccatgtggcattggagcgctgtctcctgctgctgcacagtctactctcacctgctccgcctctcccctcgttaattcttggcggctgtgtggcgaggaagaagaagcggtgatggcatgctgatgggctgcgggttcttggatgcatttgggtggatatgcggacatggtggtgagttcgctgcctctcgcgcttctctgagcctgtattgattttagaaatttcttgtatttcgttctaactctagatggcattgatgctctgcttgcttggttcttgttatcttcttgtactctgtgtatgtgtgtgtgtgagagagatatttgaactgaagattctgcagtttcagattttctttggcctgtttctctctctcccccgagcggtagccattctctctttcttgttcttctgccaatttccagctgtttccagtagctggaaacttcgaattgcttaaagttcagttgtttgcttgctatgacttcgtttccccttcaagtttcactgcatttcctttccagtttttccttcaaagctcggatttgtttcttgcctcttcagcattcttttttccggcctcgattttgtataaagccgtttgtttgtgtcaaaatgttcaccaatatgcctttctcatgagcctcatctgttcggtttactgtacatatgctcttaatggtctgtcaatagtctgtccagaatgtcattttctatgtcgggaccgtacagatttttaaggctgcagcttccatattttttaatttgaacaaatgacaactactgccttgttttttctgttcaatctggagtaaaacttgttcgcgatgttcttgcatccggtctccaaattgtttttttttttttggtttttggaaataagtatgattcagtcccgtggcattcacatcttgcttctccttagtttcttcattgatttgggctgtaaatttaatctttttcctttgcaggaagctgtaatttgagagcgatgggagcatcttcttagggatcctcttccactggctagcctacagctgtttttctccttcattggtactccaatcttggctggaattttgaatcttttgtccgggaagtgataaaatttagaaagacaacacaaccattggcacttcttacagttgtgagcgctaagc

SEQ ID NO: 5275 - DNA, 1501 bp, Oryza sativa
gcatatcccacccatcattttaagaatttagattctaggcaagtgtaacacatgtcccggtgctcaatatccacgcgcacagctattcgaatatgttggtttactcacactgtagtggatatacactccacctgtacgccgtgacttgcccaacacatgagccaaagtccgaacgaatgagatgcgtcatggcaaagcctttcaataacctcactttggcagtacccgctccatgaacttgagccctcatgcactctaggcatacatggtttctagtagtgagaggagttctggcgttcccgaggagggaaaaactcacacatgcgttaagttatagttaagttaggttttaatttggttgcccacagatggttacccaccgtaggctccccgcctattcacacacctagatgaaaaccagtgcacttgggtaccacctctgctcggctatttactccgctaggtctatacccatacgagaagtatggttgtactagggtcatttcatgcttagcttcaaggcacggtccttaacagaccaaggacggcactagcctttaccggacaccacccaagtcatccagccactagtctaaaaacatttgtttagtttagatttcctttcacaaaccattttgttcatgttatatcaaagtggcgctcatgtctccacatgccgtatatcaactagcttccccaaagtagatgcccaagcatttaggggctgtttggatgggactaaaaatttagttcctatcatatcggatgcttggatactaattagaagtattaaatgtagattattgacaaaacctattccataaccctagactaattcgtgaaacgaatctattgagcctaattaatccatgacagtaaacttgtgctaattatggattaattagacttaaaaaatttgtcatgtgaattagatctcatttttgtaattagttttgtaagtagtctatgtttaatactccaaattaatgtctaaacatccgataagtccctggatccaaacaccaccatagcatttgataaacatggatgtgcatgaatctaagtggcattgactaagcagttattagatttacgagacacaatattgcggatacaaataattgcagggaatcaacatcaaagtatggtgtgtgtgtatatatatatagcatgcaaattttacttaaatcaacataacttcacaataggtttaacatgctcaaagattagagatgacttgccttgctcacagccttgctgaccctggtcttcactcaactcatcaacttcctagggatctagatttagacacgaaagattttatttgaattcgaatagaattcaaataaaatcaccataaattcatataatacaaaataaatgataaaagtgataccatcagatagatcttgatcttagataaatttaggtttaagtttcattcaaatccaagctatgctagtttaaagattcaactttgaattaattcgaataattgtga

SEQ ID NO: 5276 - DNA, 1501 bp, Oryza sativa
ccgaccgtggggacctccgagcgaaaccactgagagcgaatgccaccgaagaaggtcgtgaaggagaaggttgcaaggtggaaggaaagcaacgccggaccggacatggccgccgaggagggagcagagccttcggcgcccgtggccgaagatggaggaggaccattcgcttccacatctgcgccatcacaaccgccttcggccctcgccacctctgtgcaagtgccgaacgcggccgacgtggcgaaggcggctgcggtggcaagggcactccagactagggcggagatcctttcgacaagccaactggtggtgccccaagccgcaccatcgcagccgacagcggccccgactgcgctcgccgctgtgcaggcccaagtcagccctgaccccaaaacacaagccgaagccgacatggaagccatgcgacagaacatgacacggctccaagacatgcttcgccaaatacaagaacaacaacaagcatacgaggcggcaaggcggaccaaggtcacgtcggctccaatccttcagtattgaacaggttatgtcccacctcaagtccatccgcaagtgacgacccagccctttccgcctcaagtcgcacaagcgccaatgtacttcgccgggcaggaatcagccgcagtcgctgcccgagtacaccatcaaccacccggccaagcgccacaaacagtggcggaaggggctttggctctgcaggcgcaactccaagctttccttcagcaactcaaccaaccccactgcatttcaagtacaaccccatcggcccacccggaggggaatactgtcacgtcctgataaattcatccgaaaataaaaatcattttctaaaaggaataatagaattaattaaaattcgaaaagaaattggcaaacactaaaatacgtacaagaaaaattcgaatgtggtccggagaatttttgttaaattctcctaggtctaaaaggagccctcaaattttacttgaattttcagagcaccggaaatatttattaaacaacaacaacaattaacaaagtttattaaaaagaaaacctaaaaataatccccctcctccctttgggccaagtctggcccaaagtcctctctctctctcggcccgcggccaaagtcctctcttcctccctctctttctctcccactccctcctcctccctctctcccccaggccgcctccccctcctctcctcctgggccggccgcccggcccaagccgcgcccctgcccaagccgagcggcgccctcccgcccgtgccgcgcacgtgcgtgcgctgacgacgcgtgcctgaccggtgggtcccacctgcccggtcgtctccttcctcccgcccggcatcctctctctctcttctctcccgtgaaacctagcgtcgattcctcccctaaatccacgcgattcaaaccgggaattccaaaattgattagggggaattaatcccctttccttcctcttcaatttcccccgttttcccccttgaa

SEQ ID NO: 5277 - DNA, 1501 bp, Oryza sativa
acaggatctcgacgatagtggttggtacggaggaggtggtgtcgagattgtcggcgtgctcgccaaggacgaagggttgccgatcaggggaggagaggaggggtggtgcgctagcgagcagcaggctagatctggccaccccgccgccgtcgcctgatactccgctttcgccaccccgccgctgctccgcctggcgtcgttgccgtcgccgcttgggatgcctcgccaccacgccactcatcaccatcgctgtcgtcgcttgggacacttttgccctaggccaaagctggcaccgtcaccccctcgatttctccacacgacgccttggctcgctcggccggtgaggaaagatatagagtcgcagacatgagagagagagagagggggagagacaggagagagattgaaagtaaaagaggtgggatataccagaagtaacctgcactgtcaagcatgcacagtttcaggggcttgggtctactctagcgtaacctaagactcaaaaaatgcaaaaatgctctcggtcgtgcaaccggcgcggggggagccagatcgggcgctccccccgcacgcccctccttccacgtggacccacccatttctctctccctttttttcacaaaagatgtttcacctaatctatctataatgtttcgctatttatagatctaatgttacagtgaattaaaatactcatttgcaacaaaaatcccacatattttggaaattctctattaaggaaatttggtttattttttgttctagtatactcacaatgttttactatgtatagatctagtgttgcagtaaacgaaatattctagtgcaacaaaaaacccacatattttggaaacccctattaagggaattcgttttattttttgtgccaccaaaaaatgtttcacctagtgtacttataatgtttcactatgtatggattaaatattgcaatgaactgaaataattttttgctatttactgaaccattgtttttatataagatgaaacaacacccaatttaaacaagtgaaacatttttgatcaacctagtgaaacaattctaatatacctggtggaacatcgtgcaaaatttaaaaataattcaataataagctaattttttttcgtcggaatacatccatgtgcggtcttgttttgaaaatttaattataatgaatttaatggtgcaatcggatcatgatttgaataagtaatttaagagaaaaatcagtttaaaatagttttgtacgtaaatcgggcgcgacgtcatgctgacgttagcgtccgattttttcccacctaccatcgggcacctgatttgtagggggatcccaaaaaatgctgtacatttgttccctcaaaaaaaagaaaaaattgcgatacatctgcactgctatcgcctaaacgtcggagacgctctcggatctcaatccctcggtaattagctctgtggaaatacttgtagagattcttatccattcagcaggcagaccaacacctt

SEQ ID NO: 5278 - DNA, 1501 bp, Oryza sativa
aaacttagtccattataaacatgactcaaactttcctaaagataaaatacaaacaagaccatacggaggtctcttaccatatctctaacaaaaaccaacataaatatcctaattaatagatataattgccttaatcgagctctatgtctaattggcaatggcggttatctcaatctaggctcataccgagccgaagccatatcatataggccacttgccatatcggctaaatcaagcttcattccagctgacacgatgtccagccgatgcgcagtccgacttcaaatctaactcgatcttgcatcaaatccgcttcgatctgcttcctttttctctgagtttggtgtaaaattccattgttagcaccaacttaaccaaaaacaaagtctaaaactactcaaaggataggttaaagcttgggtttctcctatggtagcactatgataggtcactctgagcaccgagacatacgcaaacatatcgacgttgcatccctcttaatagtacagcattcctatactcaaatgtaaataggaagagaattataccaataggaatgccttctttccatcttttctttgtcttaaggaatgccaacgtcgaaaccgtttcaccatatattcttgaaatgattgatgtggttacttgtagcttcaaatggctccgcatggtccatcatgacaaagtcgtcactcgtccttcaccattggatttggttcttcagcaccaagccccttgcttgcccttcaccaccacatggtccatcgcggcctagcattgcttgcccttcactgtcttgccatagtagccactttgtattccacatctacaatatattcattctgccatccttgatatctttaggtgtaataatatcacttgagcatcaacacctttgcaatccttgggacctatttctctcattcaacacaataaaattattagcctcaataatctggttgtcaacctttacttgttgaccaaccaatcgcatgtataaaaagatatgaataaatgataagtattaatcaacagtacaagtgtcatatactcaaatatatgcttaaatgttaagatcccaattaaatgaaagtgaacaacttgcatcaattacatgcataaataaggtataggatttgctccccctaaatgcatgcatacaaaatatttgtgtgaagcaagagtatgcataaaatgaatgaaacattaggaacttatcctatacaagaatagaaggcatttatcaaatataggcattaaaataaatgtataccttcatcatcttcatgttcttaatgtaaagagactaaacaaaagaaaaggctcaaacaaaacattagtctcacatgtatattgttattcacgtggaaatattatatatgaacatgtcaatatgtacatggtgagaaatagtgatatatatagattgatctccatgcattttatcattgtgatttaggtccaccatcaatgaatgtttctatctcaactaatatgaagt

SEQ ID NO: 5279 - DNA, 1501 bp, Oryza sativa
tggctttgacttgcggtgtcaagctccaagtggcagtgcacggcctcggcaagcggcggaagcttggcggcggccctcaccggcaaggcgcttgggtgtccgggtgttgagggagccaggaaatcgacgaaggcgacaaaccatgaggcaattcctcgcagcggcggctcccacgagcggcgatgtcgaggaagtaggcgacggcggtaacttcgggaggcgggatgaagtatgcttggaagtcggctagaactaagacgccggatacacgcccttgagcctccctcaccaccagatccgccgcccaccagcctcgccaccgcccgcccacctcccccgccgcccaccatcctcgccacagcctgcgcgcctcccaacaccgaatccactgcccaccagccccaccgtcgccctcgagcctccccaccgccggatccgccgcccacacgcctaccactgctcaccagtatcgtggccgcctgcacgccttggccgtcgcagctgtcgcggggctgtcaccgccatggccaccttcgccaacgccatcgcggccactgccgccttggccattgcctccatggccgccgtaagaaggctgaggttgagttggcggcgacgctgatggaggatgcagtcgactcagggaggtggcccagggcggaggccaaggtggagttgggggcagcacgtcggacgtcgtggttgaggcagggaggtggcacgagtggagggtgaggttgagggggaggcgccggtgaggttgagggggaggcgccgatggccgagagggagaaggctacgatgagaagggaggggtggagggtgaggttgagggggaggcgccgatggccgagagggagaaggctacgatgagaaaggagaggaaacgaggacaggaaagaggagaggaaaggggatcgacctgatcccgatctaaacgggatgggatctcgatcgggttgactaggaaaaaaacatatcattattgatttttttactaggaaaaaaactgaccggtatttttaaaaaacatggaaacagaatacagtgtgtgttttactgggaaaagaaaattcgactggtaatttttaaaaaacatggaaactgaatatgtgcatggtgtgaaacttcacacaatatctccgttccttttatctcgatttttgtcaccacgcttttcaaactttctatagaaaatttgttttgaaatatctaataaatctatttttaagtttactagcaaaatgctcgtgcttcgctacggtgtattaagactaaaattatttgtttttaaccaaagttattttcacactgctttggtacttttgctcgctagaaaaaagtctcaaatgatagagagaaatatagtagctcataataaattatactctctactaggctactactataaaaattgaagatgtttttaccggtattttggtacatcatccgtgtatgagtcggttttatattcgttcgctttggaaatatatatccgtat

SEQ ID NO: 5280 - DNA, 1501 bp, Oryza sativa
ttcttcttgcgctccccctcgggctgcgatgttggcgcggccccctccgggcgcctgttactggcacgcgccgccccgccccctcggggaggagatgggggaggtgttcctccctgcttcctcttcacccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctgctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaaaattaagagcgagcgcgtgtggcgaaggtagggcacaggaaagaaggagttagggcgcaagcggcgaagacaaggggaataatggcgaaaggaaggaaacagatcccttcctcagtgcctttatacttttgccaacgctgtgcccggctcctcgcttctcgcgcccactatttcgccccctcatttctcgcgcccacgcttccactaatcccattcgcccgcttgcggcgcatgaggtggatatgcggttgtggcagtcgagatagatcatatcgtgcgcgcgttaattacgctcgccgaccgaagcga

SEQ ID NO: 5281 - DNA, 1501 bp, Oryza sativa
gtggacctaaatcacaatgataaaatgcatggagatcaatctatatatatcactatttctcaccatgtacatattgacatgttcatatataatatttccacgtgaataacaatatacatgtgagactaatgttttgtttgagccttttcttttgtttagtctctttacattaagaacatgaagatgatgaaggtatacatttattttaatgcctatatttgataaatgccttctattcttgtataggataagttcctaatgtttcattcattttatgcatactcttgcttcacacaaatattttgtatgcatgcatttagggggagcaaatcctataccttatttatgcatgtaattgatgcaagttgttcactttcatttaattgggatcttaacatttaagcatatatttgagtatatgacacttgtactgttgattaatacttatcatttattcatatctttttatacatgcgattggttggtcaacaagtaaaggttgacaaccagattattgaggctaataattttattgtgttgaatgagagaaataggtcccaaggattgcaaaggtgttgatgctcaagtgatattattacacctaaagatatcaaggatggcagaatgaatatattgtagatgtggaatacaaagtggctactatggcaagacagtgaagggcaagcaatgctaggccgcgatggaccatgtggtggtgaagggcaagcaaggggcttggtgctgaagaaccaaatccaatggtgaaggacgagtgacgactttgtcatgatggaccatgcggagccatttgaagctacaagtaaccacatcaatcatttcaagaatatatggtgaaacggtttcgacgttggcattccttaagacaaagaaaagatggaaagaaggcattcctattggtataattctcttcctatttacatttgagtataggaatgctgtactattaagagggatgcaacgtcgatatgtttgcgtatgtctcggtgctcagagtgacctatcatagtgctaccataggagaaacccaagctttaacctatcctttgagtagttttagactttgtttttggttaagttggtgctaacaatggaattttacaccaaactcagagaaaaaggaagcagatcgaagcggatttgatgcaagatcgagttagatttgaagtcggactgcgcatcggctggacatcgtgtcagctggaatgaagcttgatttagccgatatggcaagtggcctatatgatatggcttcggctcggtatgagcctagattgagataaccgccattgccaattagacatagagctcgattaaggcaattatatctattaattaggatatttatgttggtttttgttagagatatggtaagagacctccgtatggtcttgtttgtattttatctttaggaaagtttgagtcatgtttataatggactaagtttgtacttgaggtataaatataaaccccagatcatcta

SEQ ID NO: 5282 - DNA, 1501 bp, Oryza sativa; identical to SEQ ID NO: 5274

SEQ ID NO: 5283 - DNA, 1501 bp, Oryza sativa
ttagcttgattaaaaaagttaatgaactgatgtaaccggaatggtgccattgatcttgtcgccttgcaaatttaaaatgggaagattggacaggttgccgatttctctcgttatttctccagttaatgaattatgactaagatgcacatgtttgctagctagcatgggtagattagtcatttttttgcgtaggttccatgttggcatgcacatgtaccggccgtggcactctacagtgaaaaaaagtgaaaaaaaattacaaaagcttctctctccaatggtaaattcataagtgtaaacctaaaaaggtatttggctaattaccaaacggaaaagtagcaaataattaaattttccgctgcctctctagttttgctctgcggacatgattagtaaaaaaactaatgaaacgataaagatgtgtgagttcttttacagtgctataaaagtgctcccagccccaccgtttcgcgtattactagtacctacggagactatcaacgcaaccgaaacttttggtttcaaattccaactgattataatttgaaatgagtataaacatgcaacaaagtaagttttctgtacttgaaagagaaaaaatagattttaaggttattgggtgcccttgcatgaaacgcaaagcgtgcaaatatacttagaaagttcaaattattttcgaacttccattatgaccggaaagtaaaatgccagataaatttgaaattttacaattagttttcttattatattacgaaatttcaatgctcaggttaggaacatacttctcttttttttagtgcaatatttaccatcaatagacaataataaacactaattaataaatgttcatcctactaccctccggttccgtacttgtaacgcttagtacgagtttgagattaattaaataattaaacttctgaccatccgtaatttctaaaatacttcaaacttaaatatcaactactctaatctcacattaagtttatttttacaaaaggtgaatttattttattttagagtaaaagttttactttttatatattataatcgagcgtaactcaagtgcttaaatggttagatttcttatgatagaacttgctcagtgattggtcggatttaacatgagcccctatttaataatatgagtgttcctatttacgattagttatttttttaacagtcgattgtgataactttgtctatgttcgttaatcttaaaataggattgtctaatctttcgaaagtgcacatagcgatatgatgtgcatttataaacataagtgcgcgagcgtgtgtgttgtaagcgtttatttttctactttgtttgcagaaaaaatatttggaatttcgaaaacatatggcatatttagaggagctcctgtcagttgagaagcgacagttataaaatgtagaattaaaagacaaaagctgaaaaagtttagttaatacttactccgtccaaaacgatcatcatatatatttattcactaagaccaat

SEQ ID NO: 5284 - DNA, 1501 bp, Oryza sativa
tccaaggagagaagggattacctatgggccaatagatgaaggtggtttggattgattgaactgagcctcaccacatccttccatggccgcacgcccgtcgctggatggggatcatggatgggtaggtagcttgccgagggtttcgtatgcatggaacggggaggggttttgcgattgagctaatgtaagggcaatcgttgcgactctttcggtgctttgtttgtaggtttttatatttatgtgtgttaatgtaggagattggttttggccattaatgtgcttaggggataaggcgacgacatgcccctccgtgggctgttctcgcgccatatgtatttatttatggggggaggcaggcaatgtttcttgcttagccccctttaagagttggaataacataattggaatccttggatcggatgacaagaatggatagagacaaacggaattagctaataaagtgggtatggtgcccaatagcgaaacactaccatcagttatagctgtgatgatatgtcagcgcggtagcacacactggtatggcggttcgactccagtgatgcgtggggacggtttcactcttcatggcttttattgcatcatgtgtccaataggggccattggctgtgattctatctagtatgctgctatgagacaaatatttaaatgtgttctgttgcgctcatctcatagtcgacaaaatagagtgtgggtaaaagacacctacattagttgtcacgggaaggtgcaacccccttcccgctattgtgcttatacactaccgaagtgcatgcctagtgaccctccttgtgctgattcgctatctttgccatcctgtaaatgcatggctatcttgttccttttcccttctagaaagtgatttttttatcaaatgactctaatctatagcagtcacaaggtgttattctcaggaaacttttggttatcttaaatgatctaattattaacaagcatcattattctttgttttacgtgcaaaatggtctccacccatctaattatcaacaagtgtcgttattattatttctatttttaacttgttgcgacaaaataggaatctgtttctaatcttagcttcatgtaaaatatctattcaatctcttccgctagttgataatcttctaatgggatgttctattgatttagtctttgcatgttgatttttatcatgctttagtaattcttagtcttctcatatcgatgtttacacatatctcttgtgttgcagttggttagctcaagatctgtgatgaacgaccaagcttccttttagatcttctgtttattctccttggtcagtaaaacagatgacttaaaaaatgctgcattaaataaacatagctttaatttcttgctcaattgtatactgataggtctcctttttacccctatccagcttaacctaaactatgactggtaaacaaacctagagaagatacaaaggaaataacggcataaacttttgttttgcaaaagatta

SEQ ID NO: 5285 - DNA, 1501 bp, Oryza sativa
ggaccacatatgccccaccttttcttattatttttgtgtagctgacttgtgggtcccacattttttattatttcctgagatccaattgccacgtaagcgccacgtcaatgccacgtgggacgaggaccaagacaaagggagccacgtaggcgccacgtcatccaaaaccgggcacaatactgctgagagacctcttttgcacggttttgtaagttgagggacccgtcatacctggttttgcgaccgagggatgaaaatcggactggacgacaaatagagggaccaaatgtgaacttattccattttaaaaaacgagccaagcgtgctagtcacaactttttatttccagcctagtcaccatctaagctaccgggccggagcccatggcacaaaactaggcacgtgtttaagcctagcccagaaagcatagcacattagcacacgagcatagtcatactagtactagcaggtacgagacgcggaagaaaattacacaagactgagggtccctacagtcctccgaaagacctcgtccctctacatatgacacctgtccactacgaatctcaaagtaggcagcctctgtcttcttcctatctccccaatctcctgtgttctgccgttcttcctcaacacgaccaagtagagcttacgcacgaccaacgcacgcggtggcggccgccggtgtcgagcggcaacactcacccagccaattgacaattcgatggtgactaatggtgaacacttagattttgctcgttgctttcaatctccattactgctaagtgctaattattaatggtgattgaatttatccgagcatttgatgattcttttggacagtgaaccttggaaaatcacatcgttgtctgctttctcatcaagaggcttggtgtacatcaactcccgaatacatattgtggagcggaccaacggagttcacacgctacagcaaacatgatgcaagccgactggcagcggcagttgagcacgatgtcatcgtcgcactctcccgacagtcatccatgagcccgaagccactcgccgtcgcgcccgctttggtcgggttcgagggatgcctcaccgagcggaggaagaagaatggggattagaggggagagaggttgtctctttgagattcgtaatggacacttgtcacgtaaggggacgaagtcctttagatgagtgtaggacttcagtcctatgtaattttcttccacgagacgctccaactgtccaagcagaagtcgtcttctcgcgagaaaaacactgaaaaactgatgacgcgagtacactcgtcgagcggttagcgacggagccctgcagcgtcgacacgcgttccaccacgcaccccacggacgtgtcggccgccagaagctccggctcgcctgtatttagcacgtacgacgacgagcgatcccactcctaacacagtacagcgacgacgacagattaaccgagagcgatcgatcaaccaaatcagaatcagggcaagaaacaa

SEQ ID NO: 5286 - DNA, 1501 bp, Oryza sativa
gtctctttgagattcgtaatggacacttgtcacgtaaggggacgaagtcctttagatgagtgtaggacttcagtcctatgtaattttcttccacgagacgctccaactgtccaagcagaagtcgtcttctcgcgagaaaaacactgaaaaactgatgacgcgagtacactcgtcgagcggttagcgacggagccctgcagcgtcgacacgcgttccaccacgcaccccacggacgtgtcggccgccagaagctccggctcgcctgtatttagcacgtacgacgacgagcgatcccactcctaacacagtacagcgacgacgacagattaaccgagagcgatcgatcaaccaaatcagaatcagggcaagaaacaatggcgcagctggtggacaaggcgaaggggttcgtggcggacaaggtggcgcgggtggagaagccggaggcggagctggccgagctgtcgttccagagcgtgggccgcggcggcgccaccctcgcggggcgcgtggacgtgcgcaacccctactcccactccatcccgatctgcgaggtgagctactcgctgaagagcgccgggagggaggtggcgtcggggacgatgcccgacccggggtcgctcaccgccggcgacaccacgcggctggacatcccggtgaaggtgccgtacgacttcctggtgagcctcgccagggacgccggcagggactgggacatcgactacgagatgagggtcggcctcaccgtcgacctccccatcctcggcaacttcaccctgccgctcaccaagtccggcgagctcaagctccccaccctctccgacgtcttctaaatcggcatcgtgcacacgtacgggccgagtgtacgagaacttgtgtatttccagacttctggagtaataataaagaacacgagtggttggttaatcgcgaatcgtatgcgcggtgtctgtaacgtacgtttatgtgtggacgttatgctacggcgccatatgtccatatgcgtgccgacgcgcgggccgggggccataggcggctaaatcaagtaattagtcaaccgcggcgatttggtgagatcgctccttaaaggctcgcgccatattgcccacatgcgttccaccaggccacgaggctcacgagcaaacgacgcgcccggcaacggcacgatcgcccatgagcgcgctcgccctgccgtgctgcggtgtacccatgccgctcatgcgattgggatttgagagaggttcggagttatttagaggagctcaatattatgagaaaagctgttatttgagaagctgttagcctctagttttaagaggatctggaaaagccggattgtacttccttcttcacagattgatcattatatgatagaatttaaattttttcacagattaatcattatatgatagaatttaaatttttttaaattgatcatcatgtaaccatattgaaaacggattttatcgaaatataattaatggacacgaattttattgtaata

SEQ ID NO: 5287 - DNA, 1501 bp, Oryza sativa
ctatccattaattattataacaaaacagcacaaaattattataacaatgttactgtagcattaatttagaccttccattgaaaaattgaatgaacaagatcttgtgtaagctcctaacgagagcccgatcccaatgtcgcgttagggcacccgcaatagttatttataggctctctacaagaaatccatgtcagcatattttcctacttggaagagattaaatgaagagggagaggaaagctatctactaacctggagatagtctatagagaaaaacgaggcaatagattagagagctatagatacccatgtagacataccattgaagtggtttactattaatctagtctattgctgagatgtacatgttttatagatagcaccttactttaccattgtgggtgctcttaggagcagctgtagttgagaatgcacctgatcccaatgtcgcgcgctccatgcgctgggcgcacgggttaactgccgttgggttgcacagagacagaggccgcggacttcagctgcgggtgaagccgccacccggcacgtcgggtcgggactccgggagcgagtacgcgctctctcaggtgtcttcggtggtcgcatcgaaagccctgtttagtttcaaagttttttcctaaatttttaactttccatccatcaaatctttcatacacaacttttcagcacatcattccaatttcaatcatatttccaaactttcaaatatcagtgtaaactaaacacaaacataaagtggattttttctttcatctctctcgtttgccacacgtcctctctcgccggagcacgcggtgacgagactcatcgctggataaaatgcccaaagcctcagatgcagaattgagaaagaagaagaacgctctagtaaccgccagtccttcattagttcatgtgcttcaaaaccaagctataaaagataaatatttttttctgtgctttggacgatgacaacctagcgcgacgtggcagcgcgccactggctcggagaggatacgtggcacgcatgcacacgcctcgggacgcgagcgagacgcagaaagaaaaatatctctcacccggcggcacgcgtcctcgcggcacgggccttcttcttgcggcccaccaaggggaggaggcgaaacgtacgtgggccactgggccgtgcgtttcgtttcctggactccaccgagcgagcccgcggcttcctcctcctcctcccctctccctccgctccggcggagcgccgcgaaacgcccgccgcaaccgagcccaccgtcgaggcgatcggcggcggaggcgagggccgccgccttccgtcgcaggggtcaccttcttcgtcctcccccggtctccccctggtaagactcgatttcccctgagcctgattccgcccgttcctcgcctcaactgcagcgtggtgaactgacctaagggaggggattttgagggaagctgcccgccatgttccgaccaccgggtgctttcggggtcgcacccc

SEQ ID NO: 5288 - DNA, 1501 bp, Oryza sativa
ggattatcttttgtcactgaacaattttgatggtataacctcaaacaagtttttttgttctaaagagagaagttcattgtgacaatctagtattctactataatcgatagcaaagtttaaataaatactcctccatatctaaaagattgtctttttattgtgaatctagagtcctcaatagtgatgtccaggtttatagctaaaaagctatccaaattcatagccaaaatgatactatcttcgtcccaaaataagtttacttttgacacaacccacacataccaaacaaaaccagaaagacaagaatatccatactatcaaatctcaatacaagtattccttactttatcttcttccaatacatcaattttgtactttcacaaactttgatgcaatgatagctttaaaaatgaacttattttggtacaaatggaagaaactaaaaatatgggacggaggaagtactcatttaggagtaacattcaagttcatagcttttttttttgagacggagctagttgtactcaatatagagaaaatatatttgattttgagaaaatgtctttcaacgttaaacaaatttgagataagggagcatgtggaaaacccaaatcgtcactaacatgatcttaaccaactttataacctcaaacaagttcttttttttaaaaaaaaaggaaaaaacattgtaacaatatactagcattctactataattgatagcatagtttaaaaaggtactccctccgccctaaaagaatgttttttttactatgaatagtgtctaggttcaaacaagatataattaggtatctaggttcaaacaagtagatagaaaatactattttagctatgaatttggataatattcattatctaggttctattgtccatgttaattgctaaaaatacattcttttggggatggatagtgttatactcactatagagaaaaatagtcgacgtcgagaaaattgaactcggataatcaacctcaaataaatttgacagaagggagtacctgaaaaaaaaacccaaatcagctccgctcggcgtcagctgatttggaggaaaatctctacgctcaagcttcctaaagtactaaatgttgctcttttttttaaaaaaaagaaaaatcacttaaaaaatcaaatcaaatcattttttaatttaaaataattaataattaattaatcatgtgtttatctttttttccctccttccaaacacactcgagtaccccaagcatttccccattccaaccctgcgtagccagtaggacatgcgtattgtggtccactcctccgcaaaaagcgccccccaccgtccacccccatcgctttccaccgtccaatccaaatccaacgtccacgattcccccatctgccctaaacccccacccccactataaaacccccatccccttccacaccgttccacgtctcctcaactcagatctcccccatttcaactccctcctcctccactttcccccccgcat

SEQ ID NO: 5289 - DNA, 1501 bp, Oryza sativa
actcgggccacccagctagttataatcaaaccatcccgtcacggcattcccggcatgctttccaacgcgtcgtcgtgtcgtcgttgccgtcttggctttagccttcgtacgcgtccctccctccctccctcggtccctccccgcggcgcgcgcgtactgcacgcgcgcacacacacacacaccgtgccgtaaccacccatcgcgcgcgcgcgcgccatgcatgccaaccaaggagctcgacgcggcgaacacatcacatgccaagaggggcacacacgacgactaccggtcgatcgcctattcgcctgtagtagcaaatgattcaggcgggtacgtacgcgcctccggccttggcaccagcaggcacgcgcgctatcagctggtccagccgcggcggcgagccaccaccaggccgtcgggtctccctcacgtacgtaccgtgctcgtctcatctgtgtgcctaccttggccgtatgcatcgcccgctaataatattctcccgctgggaccgacgcggcgcttgtctactaacagtgtttattaggcgcttgattggtgcaatgcaagagggatggaataaaatcacgcgtcctctgagcgagacgggtggatggtggatgcacggagcccacggccatggcgacggaatgaattgcggtggacgtgctgtggtaaatgctcaactggccggtgctgcagcagctttaacttcggctcggatcggacgagcggtgaaacagataaccactccatcatcggtggacacggactaggaaggctagcgcttgcgttgctcgcggcattggattccccgactcgtggatcggtggatacggttcacgtttatgctattctgacattatctaaagtgcagtgattagtctatgcttcactcatctactagagatctaagaaagtcaatgcggttaatgagcgagtggatgcctgcgtcaggctgacggacatggcccacggcaacgaatgtgcaagcttccgagggagggtgaagacgtatggtacgtccaaaaaggcttaagagcaagtttaatagtatagctcactaggttctaattcatctatagctaattttgtcggtgacatgggaccgggggtatcttgactagaggtttggggcagctgcagtcacccacgtggcctgaccccctcgggggggggggggggtcgggcccaagggtggtgtggccgcccctccctctgtctccccgaggggtcgggccgctcccgtttcggccccgaggactggggcgccccgaccccctgtgggtttggcgccacgtgtgtgggttaggtgagcacaacggcgctcacctaaccgcgtttattgcgggttggacgagcgccccacgccgcatttaatgcagcacagcacactcgttcggtccgtgacaggtcacagtgtgtgaccggtcacagaccggtcagatcacgggttaggtggcaacatgcggcctgacacacgcctcgccccgtcccgtcggaa

SEQ ID NO: 5290 - DNA, 1501 bp, Oryza sativa
ggctgctcacggtggagatggcggcggcggctttggacgaaggaggggaaaaagagggcggcgaccagcgctatttatagaggagggagtagctagggttagggcgacgcacggcttcgatttatggaagggcggcgccggttcttgcggggtttagcggcggccgattgggcttgtggcgcggccggcgcgggctcggtcggcggcggcttgggccggcgatgcagagaggaggaggaggccgggccgaggcggcacgtgggctcggggcttggtctccccgggcctgcggctcaagaaggagagagagagctggaggtagaaggtggggaaaaaggaaaaagagagaagaataagggctaaactgaaaaagggcagaatagagaaagagagaaaggaaaaagggaaaaaaaacagggacttctctggaaaattccaattataaagtatttggaatttttggaaaggatttaggatttgaattagaatattggatttggatggaatttgaattagggattgagctccacttccgaaatacgaattaaatccaactaactccaattaagaaccacaaagcaaacaacgtattaattaattaatcacattaaaacccttttgatttaacgaaattttcattaagctattttagacgaataaaccaaatgtgaattttcgcaaataggcgagcagaacagaaagcgaaaaatcaggacgtgacatggtggcatcctcgccgtcctcgcagtacccaagaactccgagaagggcgcggcgagcccatcgaaggacctccgatgatcatggaacccgaacaagccgggcatcatgtcgtccccgctgccctaccccgccccgccccaccggcttcgcatcgctgtgcaccggaagaagatgacgacgaggctggcgccccttcggcttcgcgctgccgccctattcatctgcccgcctagcgctcccgccgtcagccgccgccgtcgccggagctcgcctgctccgccacccacccgctccgtcccctgcctgggaaggagagagagagggagaggggaaagggaagaagagatgagtgaggctgacatgtggggcccacgtgggccccaccatttaaaaactatttttgtttgtgcagctgacatgtgaggccacgctttttattatttttccgagatataattgccatgtaaacaccacgtcaatgccacgtgggacgaagaccaagacaaacaagccacgtaggcgcaacgtaagccaaaaccgtcttcaaaacagccgagggaccacgtttacccggttttcgtaagttgggggacgggtcatacccagttttgcggttaagggacgaaaatcggactaggcgacaaatagagggacccaaagtgaacttattccttttaaaattgttaacgtgctaagacaagattttatctcgttatagatattccctccttcccaaattgatcatcatataatgaaattcaaaatttctcaaatcgat

SEQ ID NO: 5291 - DNA, 1501 bp, Oryza sativa
gtaaaagttttactttttatatattataatcgagcgtaactcaagtgcttaaatggttagatttcttatgatagaacttgctcagtgattggtcggatttaacatgagcccctatttaataatatgagtgttcctatttacgattagttatttttttaacagtcgattgtgataactttgtctatgttcgttaatcttaaaataggattgtctaatctttcgaaagtgcacatagcgatatgatgtgcatttataaacataagtgcgcgagcgtgtgtgttgtaagcgtttatttttctactttgtttgcagaaaaaatatttggaatttcgaaaacatatggcatatttagaggagctcctgtcagttgagaagcgacagttataaaatgtagaattaaaagacaaaagctgaaaaagtttagttaatacttactccgtccaaaacgatcatcatatatatttattcactaagaccaataataatttaaatcgcattaactaagacaccatacacacattctcctaaaaaaatcgataaaacaccatgccaattatacatcctaaaaaaatcgataaaacaccatgccaattatacatcctagcacatatatatatattctcctatgatgtattaattgtattacaataaaattcgtgtccattaattatatttcgataaaatccgttttcaatatggttacatgatgatcaatttaaaaaaatttaaattctatcatataatgattaatctgtgaaaaaatttaaattctatcatataatgatcaatctgtgaagaaggaagtacaatccggcttttccagatcctcttaaaactagaggctaacagcttctcaaataacagcttttctcataatattgagctcctctaaataactccgaacctctctcaaatcccaatcgcatgagcggcatgggtacaccgcagcacggcagggcgagcgcgctcatgggcgatcgtgccgttgccgggcgcgtcgtttgctcgtgagcctcgtggcctggtggaacgcatgtgggcaatatggcgcgagcctttaaggagcgatctcaccaaatcgccgcggttgactaattacttgatttagccgcctatggcccccggcccgcgcgtcggcacgcatatggacatatggcgccgtagcataacgtccacacataaacgtacgttacagacaccgcgcatacgattcgcgattaaccaaccactcgtgttctttattattactccagaagtctggaaatacacaagttctcgtacactcggcccgtacgtgtgcacgatgccgatttagaagacgtcggagagggtggggagcttgagctcgccggacttggtgagcggcagggtgaagttgccgaggatggggaggtcgacggtgaggccgaccctcatctcgtagtcgatgtcccagtccctgccggcgtccctggcgaggctcaccaggaagtcgtacggcaccttcaccgggatgtccagc

SEQ ID NO: 5292 - DNA, 1501 bp, Oryza sativa
tgaaggagttacaaagagccggagagccagagagttcaggctccagaacccctctagcctccttttttctttttttttctctccccttttggtgggcaaggtcctccttttatatctcaaagggataccacatgcaccacttctacctacttttcttttgggtggggacctaccctatcttgaccaaaacttggctcgcgccttcgcctggaagctaaatcacagcttgtccttgagtgaggcccagcgccatcactcgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgccgatgacgtgaccggcgtcagaccagtcacagaccggtcattcttgtccaccgcatgtcagtttagcatgccgcacgtctacccttcttcatacaatgacttccttgccatggttgcgatgaagcctggaatgaatctggccgggactgacataccaactccaggagttagcacaccggctctggctagggacgagtgcctggaggctctcatcattccgacgggacggggcgaggcgtgtgtcaggccgcatgttgccacctaacccgtgatctgaccggtctgtgaccggtcacacactgtgacctgtcacggaccgaacgagtgtgctgtgctgcattaaatgcggcgtggggcgctcgtccaacccgcaataaacgcggttaggtgagcgccgttgtgctcacctaacccacacacgtggcgccaaacccacagggggtcggggcgccccagtcctcggggccgaaacgggagcggcccgacccctcggggagacagagggaggggcggccacaccacccttgggcccgacccccccccccccccgagggggtcaggccacgtgggtgactgcagctgccccaaacctctagtcaagatacccccggtcccatgtcaccgacaaaattagctatagatgaattagaacctagtgagctatactattaaacttgctcttaagcctttttggacgtaccatacgtcttcaccctccctcggaagcttgcacattcgttgccgtgggccatgtccgtcagcctgacgcaggcatccactcgctcattaaccgcattgactttcttagatctctagtagatgagtgaagcatagactaatcactgcactttagataatgtcagaatagcataaacgtgaaccgtatccaccgatccacgagtcggggaatccaatgccgcgagcaacgcaagcgctagccttcctagtccgtgtccaccgatgatggagtggttatctgtttcaccgctcgtccgatccgagccgaagttaaagctgctgcagcaccggccagttgagcatttaccacagcacgtccaccgcaattcattccgtcgccatggccgtgggctccgtg

SEQ ID NO: 5293 - DNA, 1501 bp, Oryza sativa
atcatatctctcctcgctgtcaacgtaccatgcgggtcagatcagctcacagagtcatcgtttatgagaattgagggcttgcaaaactgccactggtggcaaaactgcggtcacatactgaacggcatgagagttactgccactgtttggtggccgcttcatgagagagcttgatcgatcatgataagctattttcagggatggaatgctcctggtggctactaaatgtatactaatataaggtgggggctcggctctgattgatgatttgatggtgactctgccgccttgctccaaactgctaatgatttcagagaaacaaaaagggtcccaggatgctggatttgtctctaagaggttataaaattctcagcctttatctcttactacttactccgtatcaaaatataagcatttttagctataaataactgtatgtttagatttataactaaaaattgttatattttggaacgaggtagtagtagctgctcaatagtcaagagtctccttcctgtttcagaatacagtatccggtacagattttaattgttgctcctgaaggtgcaatatcatgctactattagtaacgctgtgctcaggcgtcagaggagattacaacagtaggaaacacagtagtaatattaggccattaaaaatgtacagtcccccctatgggacccataactttcattcacattaagttctgatgtgctatcacctaaacctcctcctagttaacgagcactgtgcctgctctgccctgcagctttgtaatgctactgtactagcgtacagtacgtgtgtgctcggacgacatgtgctaactggcaggaacagagaacagatgaacttgctctatcagatgatgggattctgatttgcatgcatgtgcattgtttactttgatctgggaatgatcagccgagttgcactgagattgacaaagatacatggacgcagtacacacctcaacgagttagagtaaccttaaggacagatggcatatggagtggctatggctgtgtttagtttgtgtgctgatttttttttatatacgaacacatatttgaagtattaaatgtagactaataataaaataaattacagattctgcttgtaaactgcgagacgaatcttttaaacctaattaatttatcattagcaaatgtttactgtagcaccacattgtcaaatcatggcgcaattaggctcaaaagattcatctcgcaatttacaatcggactgtgcaattggttttttcctccacatttgatgctccatacatgtgtctaaacatttaatgtgacggaaaagttagaagttcgaagaaaaaaagttagaatctaaacacggcctataccgatcttggactgttgtacataattgttttagccattaagatcagatcaagaaatgagcaagtttaatagtatagcccactactagctccaaatcatatatagccaatgtaatagctaattcatacaatagttgctta

SEQ ID NO: 5294 - DNA, 1501 bp, Oryza sativa
tacatcataggagaatatatatatatgtgctaggatgtataattggcatggtgttttatcgatttttttaggatgtataattggcatggtgttttatcgatttttttaggagaatgtgtgtatggtgtcttagttaatgcgatttaaattattattggtcttagtgaataaatatatatgatgatcgttttggacggagtaagtattaactaaactttttcagcttttgtcttttaattctacattttataactgtcgcttctcaactgacaggagctcctctaaatatgccatatgttttcgaaattccaaatattttttctgcaaacaaagtagaaaaataaacgcttacaacacacacgctcgcgcacttatgtttataaatgcacatcatatcgctatgtgcactttcgaaagattagacaatcctattttaagattaacgaacatagacaaagttatcacaatcgactgttaaaaaaataactaatcgtaaataggaacactcatattattaaataggggctcatgttaaatccgaccaatcactgagcaagttctatcataagaaatctaaccatttaagcacttgagttacgctcgattataatatataaaaagtaaaacttttactctaaaataaaataaattcaccttttgtaaaaataaacttaatgtgagattagagtagttgatatttaagtttgaagtattttagaaattacggatggtcagaagtttaattatttaattaatctcaaactcgtactaagcgttacaagtacggaaccggagggtagtaggatgaacatttattaattagtgtttattattgtctattgatggtaaatattgcactaaaaaaaagagaagtatgttcctaacctgagcattgaaatttcgtaatataataagaaaactaattgtaaaatttcaaatttatctggcattttactttccggtcataatggaagttcgaaaataatttgaactttctaagtatatttgcacgctttgcgtttcatgcaagggcacccaataaccttaaaatctattttttctctttcaagtacagaaaacttactttgttgcatgtttatactcatttcaaattataatcagttggaatttgaaaccaaaagtttcggttgcgttgatagtctccgtaggtactagtaatacgcgaaacggtggggctgggagcacttttatagcactgtaaaagaactcacacatctttatcgtttcattagtttttttactaatcatgtccgcagagcaaaactagagaggcagcggaaaatttaattatttgctacttttccgtttggtaattagccaaatacctttttaggtttacacttatgaatttaccattggagagagaagcttttgtaattttttttcactttttttcactgtagagtgccacggccggtacatgtgcatgccaacatggaaccttcgcaaaaaaatgactaatctacccatgctagctagc

SEQ ID NO: 5295 - DNA, 1501 bp, Oryza sativa
acaccaacaccatcgcctttgaatccggagcgttctccgcatatcactctattcactttagtgttaacatgttactagatgatattattcttgttattagcatgtttgtgtttagtactatcacttgatcatcctcctgttattcacatgtcatgtttagtatcttgttttttattaaaatatgccgaatctatctatctattatattattaaaacagctttaaaagtagccactgcgttcactctgggagctagaaattctcacattaatcggaaaaaagaaaaagaaagaaaaggagagttcaagtagaaatacaatttaaaaatagctaaaattaggaattaaaataagcaatattgaaagaagttttcatataagaacccaatacgagattaatcaaaattcgaaataaaaataaaataaaatccaaaattagaaaagaaaggatagttcatgtaggaatacaattttaaaaaagttgaaattcggaattaaaaataaggaatattaaaaagaagagtccatataagaacccaatacgagattaattaaaattgggaataaaaataaaataaaaattcgaaattagcaaaaaaataaaagaagagtttcaagtaggaatacaatttaaaattagctggaattcagaattaaaaataagcaatattgaaagaagaatccatataagaacctaatacaagattaatgaaaattcagaataaaaaataaaataatatctgaaattagaaaaattaaaagagagttcaactaggaatacaattttgaaacaactgaaattgaaaataaaaaaataaaaaaattaaaagaacacaatatgatattaattaaaatttgaaaaaaaaataaattctaaaattggaaaaataaaaataagatttcaattaggaataaaatttataaataactaaaatttgtgataaaaataaagactattgaaagaaaagaccatctaaaacacatgacgagataaattaagtaacatacctataaaagagtagagtggtgacggttgatacaacatataaaaactgttgataaaacaccaaatagatcctaatgacgattaaaaggagggacgaccagcaggccatgaagaaaacgagcaaggcggttgccaggacttctagatagtaaaaaaaaataaaccccatttgattatcatattcgatttttaaaatctcaatgactataaaaaggagaagcaacgagcggggtttataggagtatagttgcagagcagccaacggttgacaggacttctagaaaataaaaataaattccaacgatagttatgtttgatttctagaatcacaatgacaataaagagtaggtggcggacgggccatagagaagcatagtggcatcattttacgggacttctaaaaattataaaaaatgaaaccctaatttttaaaggttcggaacttctaaaaagtaaaaaaaaaacaatgataatcatgttcgattttaaaatctcaa

SEQ ID NO: 5296 - DNA, 1501 bp, Oryza sativa
aaaaaaatattctaactatttattttcaataaatgttccaggatacactttaaaaaaatagctccagttgttattaagtgtgtatggatttcagttcagttcagtgtggggtacatggtacccagatacccatagcaaggcgttttgggccatgcggcatgaggtgggccgagtgccctaggcccacatggttaacttgtaaactaagaaagagataagggataagttggccaatcctatcccttgtaaatagatggtaggtacccggattatgaaggctacactaccatatctagccggttgcctccgcacctatataaggagcaccgggaaaccctcattcttccataagcgccacgtgctattcctacgccgtgctgcgcactccaatacagatctaatccactcatctggactagggtattatctcacgtcgagggtctgaaccagtataaacaattgtctccatctctcctagatctagtgcaccctataaattatattgccgatcataagaatcgacattcggctttacagcttcagccttatgaaaaatcaccgtgtaaagatagcacacaaaatctcaaacagtccagcacaaagcccacattttcagaccattgaaaaaccaagagaagacccgcacattcaagcataaccacaaccagaaaaacatccgatcttagccccatcatgatgctccagcacaatgaaaagagaaaaaaaaaggaaccactctacttccatgaaagtttatcccatggcactctattaatcgctgccacacattcagtgatcgaaattaacaacaatctataccctcaaggccacaacatatccagaaaaaaaacagtactaagaacagatgctatgtgctaaacgcacgctaatttcccacagcatttcattgcactcccccaagccatctaccacgggccacgtactacgaaatgctaaaagaaaaaaaaaacctagaccatggaactcgcacagatgcaccaaaaccgctggatggatggatcaagaaccaccaccaccaacccacccaccaagaaccgaaacgggttacaggtacccctgatctgagattgcaggccctcctccgctactgtagcgacggaacgaggcgtaggaagtgcgggaggagcagccggtcaccttactcgccggggaaacgcgccgccgccgccgccaccgccgccgacctccgcttcggagcggaggagaggttggagaaagcgagcaaaatcttcgggaggggaaggaagaaagaaagaaagagagagagaaaagcttatcgagtgcgccccccaccctccctctgccaggtgggccccacacctctcccccgcaacccccatgtgggccccgcgcgtcagcgtcccgagcaccccgcggagccagccagccagacggttcgagccggaccgggtcaagggcttcctctttcctcttccgagttccgaccccgtcgcgttaaaaccctagccaccacaaccac

SEQ ID NO: 5297 - DNA, 1501 bp, Oryza sativa
cgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccaggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaatggagagtcagagcacaagtggcaaaggcaaagggaagagtgacgagaggaaggaaacaaatcccttccttgatgtcttagtacccttgccaacgctatgcccggctcctcgatccccgcgcccactacctcgccccctcgtctttcgcgcccacgcctccactaatcccgctcgcccgtttgcggcgcacgaggcggatgtgcggccgtggcagtcgagatgggacatatcgtgcgcgcgttaactacgctcgccgaccgatgcaccgtcatcacatctccaggcgaaacgaactggctcgtcccggttcgcgcgctacttaagtaatgtagcggtcttaaagaaagccgctcattattgtcggtcggtttttccttgccgatgtgcgcgatttgcgaccgctgggtttctgctgcctgtagagaccggccccatctgtcaccaggtctaaggagtggcgtcacgcccgagcgcttccctcgaggggggcgatcgccctggcgtaacgccgggggctactgtcggtgacatgggaccgggggtatcttgactagaggtttggggcagctgcagtcacccacgtggcctgaccccctcggggggggggtcgggcccgagggtgatgtggccgcccctccctctgtctccccgaggggtcgggccgctcccgtttcggccccgagagctggggcgccccgaccccctatgggtttggcgccacgtgtgtgggttaggtgagcacagcggcgctcacctaaccgcgtttattgcgggttggacgagcgccccacgccgcatttaatgcagcgtagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagt

SEQ ID NO: 5298 - DNA, 1501 bp, Oryza sativa
gtacagagggacggggagaagaaactatcattagttttatcacattgtgaatgaattaattacttattagtcttggtgccaaaagaaataggtcttagatgctgacggagcgtggggctcctcaccgggagaccgcgcaggcccctctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttttttctttctctttggtgggcaaggtcctccttttatatctcaaggggatactacatgcaccacttctacctacttttcttctgggtggggacctaccctctcttgaccaaaacttggcttacaccttcgcctggaagctaaatcacaacttgtccttgagtgaggctcagcgccgtctctcgcctgacaccggggatctccctgttaccccctcattaatgggcggagatttgccatggctgctttccaaatgaccatccgacgagatgggtcatacctacctccactccaccggaggcagatgcatcgtgggagcacggttatctgccgatgacgcgaccggcgtcagaccagtcacagatcggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctacgctgcattaaatgcggcgtggggcgctcgtccaacccgcaataaacgcggttaggtgagcgccgctgtgctcacctaacccacacacgtggcgccaaacccatagggggtcggggcgccccagctctcggggccgaaacgggagcggcccgacccctcggggagacagagggaggggcggccacatcaccctcgggcccgaccccccccccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcagcagaaacccagcggtcgcaaatcgcgcacatcggcaaggaaaaaccgaccgacaataa

SEQ ID NO: 5299 - DNA, 1501 bp, Oryza sativa
ctccatcttcgactcccacactatcaccaacactgccaccgcaccgtcgccaacaccactcctgggcccctcctcgttgttgccaccttacatgaagggaatggcgatctcgatctctccagttcccttgcctcccatttcctcgccacggatcgctgcgtccctcctcctcgctggctgcccaccgccactactaccttaccgtggaggggatggcgaggaggaggatggaggtgacgaggatgttggtgatggagtaagagggccaagaagttgtcggtgccctaccattttcatgcccagccatatctctgtcccgatcagttgacactcgtcgtcgcccttctcttcgccacctgcgtccagcctccctacctcctccctctccgcctggcttcggctcaccggtgaagagaggagatagaggtagagagggtgaggtggaggaaattgaacccactgacatatgggtcccattatttttatctttttgtttgactggtatgtgggtcccacatattttgttttaactttttagtcttttattttttttatcaaattgtcacataagcgccacgtcattgccacagggcaggggcggatccaggaacaaaaaattggagggggggctcaattacatagtttcttcaacctctaaccatctagagacctttagcttattatttatggtgaaaaaaatcgaaggggatgctccgggggtatccatgagtcttgtgggtgtaggggggactcgagtctccattgcacccacgttggatccgcccttgcacatgggacgaagatctagtcaaaggagccatgtaggcgtcacgtcagttaaaaccggggacatttgcactggttttgtaagttggaaaagcgttgtattcggttttataactttggggaccaattccagattggaagacaaattgagggatctaaagtgagcttgtttccttgctagttctttcggcccaataacgggacagcccgtttgccagttctaggctttctcgtagcctcacccagctacaggtggataagcccccaacgtggactcctccacgccatcacccccaccgcattatcaatcaattctccaacttccacgtgggccccagaacaaaaatccatccttccaagaagaaatcgaacagaaaaaaaaatccatcgcgttttcccatggctcgcctcttcccccaaaacccccggtgagaaatcaccccgcaaaatccaacccccccaaccattcccctcccctcgcctcgccgccgcgggggatagagagatcctccaatggtgctcctcccccaaatcctcccctccccgcgcctcgccgccgcggccgcctcccccaacagcgcattccgcccggcgccccgcctccactcctccgccccggcccgacgcgggcgaggggcccgcctcgccaccgcggcgagcgcgtcggggtcggggtcggggtcgtcgccgtcgtcgccggagccgtaccagccgg

SEQ ID NO: 5300 - DNA, 1501 bp, Oryza sativa
gaacctgcgaggaggtcggctaaacgaccaccttgggggggagatgaggtttccccggcatggttcggtcccccccatcttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccatcacggggcccagaagcacgaccccctcccggggtagattgttcccccctgcggctcccgcccgcgccatcgtggcctcgaggagcccgctcccctgacgccccgaccgcttgcatgatggtcaggatgttggcgcgctctggatcgctgcagagggagaggacaccttgggggatgagggatgcctccacggagctgagattcagcacccgttggaccaccatcttgaaatcctcaggggcccagtcccatctgcccccctggtgggtcctcatgtagtcctcggacccggtgtactcccaggcgccccgggcgcgccgctggagtggcgcgatccggcgacgaaggtagtcgccgaacaccatggcccccgtgagcccctgggatcgcagacccgccaggcggtcaagaacggcgtcgtagccatctcccagatctaccggcgcccgccagctggaggcctgcgccgggggctggctcggaagtcggaggcgcgcttcgtcggcgagaggggtgtagaaccagtcgctcttccagtcgtcctacttcttgcgaaggacgcagggaatgtagcggttcagcaccggcccccgcggctggaagtagcagccaccgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaatggagagtcagagcacaagtggcaaaggcaaagggaagagtgacgagaggaaggaaacaagtcccttccttgatgtcttagtacccttgccaacgctatgcccggctcctcgatccccgcgcccactacctcgccccctcgtctctcgcgcccgcgcctccactaatcccgctcg

SEQ ID NO: 5301 - DNA, 1501 bp, Oryza sativa
gaatgatgaagcaccctccctttgatctcatcaggaactatgttcttactaatagatatattcaaatagctgtacatcagtgccataaacttagcaatagcctacatagtgaaacaaagagagaaggttagtgaatctcggcattgggtgcaagaatgtggttaacccaaaaggactcaccagtgcctcgtagcattctttgacagcatccaagaaagtgaaaaatgttttgcttcccttgatatccagaagaccaacaaaggaatttatagcatataagggagccatgagaacgataataagtatagccttctgctccttgggattcttccaatagaaaagatgctgcgacaccaactgtactgtaaaatgcatcgatagcattacacagcaggctgctccaaggagggtaagagtaggagcatccattttcgtaagatccatcccagggaacagtgacatcgacatggcgcctgtagatagatatattcaagtttattcaccaggaggaaggaacatatattttgagataacaattggtcaaaaacaggtcacataagaaaacaaaagcaccaacaaaatgaaattagaaagtatgtattaccataatcaagattttcatggaattgttttaatacaacttgcattttggtttcaaaatttaagctgctttagatattggtgtttctgtgattaaattggttagtcattagcgaatggatatctgaagcagatgccagaaaactcaaacaatatttagcagattttacctacgaaagggaatccaaatatgcctcagctttctacataaacataggttggttgcagcactatcaagccaagtgatgacacgtaggtggacaaactgtttgttcattagtactgaaatggcataacagaactaacctaacagggaaatgtaattaataaccttccatgaaattgtatgctttccattgttcaaagggatccaaacaattgacaaaggaacagcagacatttcacagcctgaggcactacttcgcggtacagagtacagtgttatacactaactagaccctttgaggcctcctatcgcaaacatttgaaagacataggaataggcaaaatttggatggagcaatggagaaaaacaggaattcacggggaaaatcttgggcttcctgtaacaaagctttgcgtattagtactattagttaagtataaagtacattcatcagctagacatcataaccattacttccatcctacttgctctctccaatccgtctccattcagatccacccaaccatggatgtccatcgggctaaggcctacgggtagcggctgcggcgtgtactccaagagcaatagaggagcaacctaaggattccccggcggggtacggagtcctacggacgccatccgcgccgccgattaaaccgcccccctcccaaaacccatctacggggtcggagatctacacggactcgctcgtcgccgtcgctgtcgccggagaga

SEQ ID NO: 5302 - DNA, 1501 bp, Oryza sativa
cagagggacggggagaagaaactatcattagttttatcacattgtgaatgaattaattacttattagtcttggtgccaaaagaaataggtcttagatgctgacggagcgtggggctcctcaccgggagaccgcgcaggcccctctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttttttctttctctttggtgggcaaggtcctccttttatatctcaaggggatactacatgcaccacttctacctacttttcttctgggtggggacctaccctctcttgaccaaaacttggcttacaccttcgcctggaagctaaatcacaacttgtccttgagtgaggctcagcgccgtctctcgcctgacaccggggatctccctgttaccccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagttcggcatgctacacgtctgcccttcttcatacaatgacttccttgcaatggttgcgatgaagcctggaatgtatctggccggggctgacatgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccatagggggtcggggcgccccagccctcggggccgaaacgggagcggcccgacccctcgggaagacagagggaggggcggccacatcaccctcgggcccgacccccccgagggggtcaggccacgtgggtgactgcagctgctccaaacctctagtcaagatacccccggtcccatgtcactgacagtagcccccggcgttacgccagggcgatcgcccccccccccccgagggaagcgctcgggcatgacgccactccttagacctggtgacaggtggggccggtctccacaggcggcagaaacccagcggtcgcaaatcgcgcacatcgtcaaggaaaaaaccgaccgataataa

SEQ ID NO: 5303 - DNA, 1501 bp, Oryza sativa
ggcgtaacgccgggggctactgtcggtgacatgggaccgggggtatcttgactagaggtttggggcagctgcagtcacccacgtggcctgaccccctcggggggggggtcgggcccgagggtgatgtggccgcccctccctctgtctccccgaggggtcgggccgctcccgtttcggccccgagagctggggcgccccgaccccctatgggtttggcgccacgtgtgtgggttaggtgagcacagcggcgctcacctaaccgcgtttattgcgggttggacgagcgccccacgccgcatttaatgcagcgtagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtggacaagaatgaccggtctgtgactggtctgacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacatggagatccccgatgtcaggcgagtgacggcgctgagcctcactcaaggacaagttgtgatttaacttccaggcgaaggtgcaagccaagttttggtcaagatagggtaggtccccacccaaaagaaaagtaggtagaagtggtgcatgtggtatccccttgagatataaaaggaggaccttgcccaccaaaaaggaggaggaaagaaaaaaagaagaaaaaaggaggctagaggggttctggagcctgaactctctggctctccggctctctgtaactccttcacacacagatccaccagaacacaggagtagggtattacgcttctcagcagcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagctccacgctccgtcagggatgataaggtttagtccttcaaagttttaagacaattagatagctatttaataaattttaagtaaaatcatattaaaaaaatatatgattttgtttgggtgctacccgcgcaattgcgcgggtcacccagttagttatgattatattttcaacatttgcactattaagggcccctttgaatcgtaggaataaaaaaacggaggaataggaaaaacataggattctgacaggaatgtaagt

SEQ ID NO: 5304 - DNA, 1501 bp, Oryza sativa
tcatgtttagtatcttgttttttattaaaatatgccgaatctatctatctattatattattaaaacagctttaaaagtagccactgcgttcactctgggagctagaaattctcacattaatcggaaaaaagaaaaagaaagaaaaggagagttcaagtagaaatacaatttaaaaatagctaaaattaggaattaaaataagcaatattgaaagaagttttcatataagaacccaatacgagattaatcaaaattcgaaataaaaataaaataaaatccaaaattagaaaaaaaaggagagtctaagtaaaaaatacaatttaaaaatagctgaaattcggaattaaaaataagcaatatttaaagaagtttccatgtaagaacccaatacgagattaatcaaaatttgaaaaaaataaaataaaatccaaaattagaaaagaaaggatagttcatgtaggaatacaattttaaaaaagttgaaattcggaattaaaaataaggaatattaaaaagaagagtccatataagaacccaatacgagattaattaaaattgggaataaaaataaaataaaaattcgaaattagcaaaaaaataaaagaagagtttcaagtaggaatacaatttaaaattagctggaattcagaattaaaaataagcaatattgaaagaagaatccatataagaacctaatacaagattaatgaaaattcagaataaaaaataaaataatatctgaaattagaaaaattaaaagagagttcaactaggaatacaattttgaaacaactgaaattgaaaataaaaaaataaaaaaattaaaagaacacaatatgatattaattaaaatttgaaaaaaaaataaattctaaaattggaaaaataaaaataagatttcaattaggaataaaatttataaataactaaaatttgtgataaaaataaagactattgaaagaaaagaccatctaaaacacatgacgagataaattaagtaacatacctataaaagagtagagtggtgacggttgatacaacatataaaaactgttgataaaacaccaaatagatcctaatgacgattaaaaggagggacgaccagcaggccatgaagaaaacgagcaaggcggttgccaggacttctagatagtaaaaaaaaataaaccccatttgattatcatattcgatttttaaaatctcaatgactataaaaaggagaagcaacgagcggggtttataggagtatagttgcagagcagccaacggttgacaggacttctagaaaataaaaataaattccaacgatagttatgtttgatttctagaatcacaatgacaataaagagtaggtggcggacgggccatagagaagcatagtggcatcattttacgggacttctaaaaattataaaaaatgaaaccctaatttttaaaggttcggaacttctaaaaagtaaaaaaaaaacaatgataatcatgttcgattttaaaatctcaa

SEQ ID NO: 5305 - DNA, 1501 bp, Oryza sativa
aacaaaatcatatatttttttaatatgattttacttaaaatttattaaatagctatctaattgtcttaaaactttgaaggactaaaccttatcatccctgacggagcgtggagctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggctgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttggcttgcaccttcgcctggaagttaaatcacaacttgtccttgagtgaggctcagcgccgtcactcgcctgacatcggggatctccatgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctacgctgcattaaatgcggcgtggggcgctcgtccaacccgcaataaacgcggttaggtgagcgccgctgtgctcacctaacccacacacgtggcgccaaacccatagggggtcggggcgccccagctctcggggccgaaacgggagcggcccgacccctcggggagacagagggaggggcggccacatcaccctcgggcccgaccccccccccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcagcagaaacccagcggtcgcaaatcgcgcacatcggcaaggaaaaaccgaccgacaataa

SEQ ID NO: 5306 - DNA, 1501 bp, Oryza sativa
aaacaaaatcatatatttttttaatatgattttacttaaaatttattaaatagctatctaattgtcttaaaactttgaaggactaaaccttatcatccctgacggagcgtggagctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggctgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttagcttgcaccttcgcctggaagttaaatcacaacttgtccttgagtgaggctcagcgccgtcactcgcctgacaccggggatctccctgttactcccttattaatgggcggagatttgccatggctgctttccaaatgaccatccgacgagatgggtcatacctacctccactccaccggaagcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctacgctgcattaaatgcggcgtggggcgctcgtccaacccgcaataaacgcggttaggtgagcgccgctgtgctcacctaacccacacacgtggcgccaaacccataggggtcggggcgccccagctctcggggccgaaacgggagcggcccgacccctcggggagacagagggaggggcggccacatcaccctcgggcccgaccccccccccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcagcagaaacccagcggtcgcaaatcgcgcacatcggcaaggaaaaaccgaccgacaataa

SEQ ID NO: 5307 - DNA, 1501 bp, Oryza sativa
ccgttcggccatggggctgagcaggagaagcttggcgcacacgaaagaggacgagggcttagaaagacacacgcgccccctacctggcgcgccagatgacggagcgtggagctcctcaccgggagaccgcgcaggcccccctttgccggttcggccgggggcgctaagtgaggttcttcgccctcgatcgatctggagaatgttcgtgagagagcaagtgcacgagacacgggcgatgtagacaggttcgggccgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttggcttgcaccttcgcctggaagttaaatcacaacttgtccttgagtgaggctcagcgccgtcactcgcctgacatcggggatctccatgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacatgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcgggaagacagagggaggggcggccacatcaccctcgggcccgacccccccgaggggtcaggccacgtgggtgactgcagctgctccaaacctctagtcaagatacccccggtcccatgtcactgacagtagcccccggcgttacgccagggcgatcgcccccccccccccgagggaagcgctcgggcatgacgccactccttagacctggtgacaggtggggccggtctccacaggcggcagaaacccagcggtcgcaaatcgcgcacatcgtcaaggaaaaaaccgaccgataataa

SEQ ID NO: 5308 - DNA, 1501 bp, Oryza sativa
cttcaaccaaacacctacaaaaatgggttggccccctcccaacccaccaaaatccctccaactaaacacatgcatagagaaaattctggatttatagggagaacgctctgtgctgtttaaatttactcattaattatgatatgcaaatttcagtgtatcactaagaaaatctagaacttagccatgacaggttgcatatttgtcaaatattaaaatgaactttttcccttgtggacaaatgttgtgcaaacttggcatccgaaggggaaagttattgtgcttggcatcgaaaaggcataaacatgcgccttgtctactctagcttgctgccatctcccctctattcttagtttctcactcgtcattatctccctccctgccgcatttccattgcttaccaatcttgcaagagggagaagaataagatgacttcaaatgaagtgagcagttcacggttcaccttgtatgtgaataaaatccatacccaggattcatgaatgtggatattcacacatcttatggagttacgggcattgcacttctaagtgctgacctccagctccgtgcattatcagcatagggggagacggatggaaacaacactaaggtggatgaagactaccaaaacaagaatatgatggattgtagtggttctgcttgcaagactaccaaaacaagaatacgatggattgtagtggctctgcttgcaagcccagcccttaaccctaccgtacctacactgccctctttccaattttcttctcactgaatccctcacctttgcaaacaaaggcacaatgcaaggcaaatacagtataccactggctccgactatcatgcagtatttcccaacgcaaaatttagagggttccaaaatagacaacataagttcttatgctaacataatcgcttcaaacagacccgcattatcatgcacctaatatttcacaaagcaaaatttggagggttccaaaatagacgacattggttattatgcttgcataatcacttcaaacagacccaccgcaataaaattttagcgcaattgagtcaggaagtcaaagttggaactaaatttgcaagaggaatttatagttttgccgaactaaacagaccaaatatatgcaagggataagcatcaggattctgtgctatagatcgatttttctcataaggatttagtgggaaaaaaaacagagacaaaatcagcgcatcagaaaagcatcgcacctcgcgaagacggagttcgccttcctcctgggcagcggcaaggccgcgagcggtgcggccgagctcgtgccgcacggcggagacctcctgcacgagcgccacgtgcgtcgcggccagccgctggttctggccaagcagcacgtgcgcctcctcgatctccgcgccgagccgctcctccagcgccgccacgacgtgcggcgccggggggggcccggcgccgccgccgtggcccgcgaacacgtggtggcgcggcggctcgccgaattcgtcg

SEQ ID NO: 5309 - DNA, 1501 bp, Oryza sativa
aagtgtattctaaaaatttaaatttcaaactgcgataaaaaaattatttttaaaaatttaaatttcacattgggataaaaaaaattaagagtaaattgtattggtggtacacaaacttattaggtaggtgcaatttagtacatgaacttgcaaaatgctcgttttgatacacaaacttatctgatccgtgcgaactaggtctaaaatagcttggcaaggttaattttacatagctgatgttgattaagatgtggcgtggatacatatagtgagtataaatatttataaatttgttctctactttattttgaatttcgtttgtttctaatccttgtatcattgctcggtttttttatatctttctctacatcactatatctcattctatctttttattgaacatgtgtatgtctaagtagcaaccttctcatacacttcatccatttcacagtgtaagtcattctagcatttatatctgtttaaattcattaacatcaatatgaatgtggaaaatgctagaatgacttgcattgcgaaatggagggagtatatgtttacgtagtatcctaattagcacataaatcaacaaaattagttatgtaatgtccttttgaccttagtttgcacgtgcaagataactttatgtaccaaaacgagtattttataagttcatacactagattacactcacctaacaagctcgtgtaccgctgatgcaatttacttcaaaattaaagtactagtagcaccttttcaaataaattttgtaaatattttctttattttcaataactttgtactactagtatatctgtaaatggtttagtactactccctccgtttcaggttataagacgttttaactttattcaaagtcaaactactctaagtttgaggaaaaaaatagtaatatttataataccatcatagtttcattaaatctataattgaataaattttcataatatattagtcttgggttaaaaatatgagtactactttttctataaaattagttaaacttagagtagtttgactttcactaaaatcaaaacgtgttaaaacctggaatggagggagtattaaaatttgttttctttctagttctaccaaaaagaaaaaagaaaaattgtttggttggtggccatcccatccacccatccgggctgactccggcccaactgctcctctctctcgcatcggggtcgctccctctctcggctctcgcgctcgctttctgtctgtctctgctctcgctccgccgccccgcctcctccgttcgccgagcgcccgccgcgtcgccggccgccacacggccaacctcttccttcctcgccgccccctcgcgcttccagttcctcctcctcctccgtttctaactagcgaggattagggttagccctactaccttcgcgctcttcccccaacccccgcttcgcttcttcctcgtctcggtcgcagcacgacgtccgcttcagtgagggaaggggagggagaggga

SEQ ID NO: 5310 - DNA, 1501 bp, Oryza sativa
tccatgcagtcggtcgatcgatcgattgaaattgaacccggccttgctagctagctgctgcttcttacatttgccacccttgcatgcgtactactgtactctcgccatcctaaaaaaaaccaattctatagatataacatcttctagtataatgaatacggacaagagcatgtctaaattcgttgtactagaaaatatctcattcaatactatgttggtttttttatgggacggagggagtactaagtaattggaactagctagccgtagagaataatcaatcatctccaaagttggcataatactccctccgtttcaaaatgtttgacgccgttgactttttatcacatgtttgaccgttcgtcttattcaaaaaatttaagtaattattaattattttcctatcatttgatttattgttaaatatatttttatgtaggcatataattttacatatctcacagaagtttttgaataagacgaacggttaaacatgtgctaaaaagttaatggtgtcaaacatttcgaaacggagggaatataaggcatggtcaaagttggcacggtctccaaaactaatgtttaacttataatttcttatatactataaggtttgtagcaacaaaattataaccatatgaaagtaatttaaatctcaatctaataatatattttttaacaaataaaatttatttaatattatactaagtgttagtcaagtgttttaaaggttgaatcttaaaatatgtgcgcgtcttatattatgagatggagggagtagtatgtactctttatattctcctgatttcctttttgatgtggctaacctatgaatctacaaccttactaatgacttcgattatttttcacgtatttaattagaacgagtctgttgctgctacaagcatatagtgcatgctagctagcagattgattaattcccgagttatcagttcaaaaaaaaatccctatggtcccaaaatataacaaattttattcctcagaatttatcccaaaatataataacttcaccaacattctcttcccaaccaatcacaatcctccaccattcatttttcccacctacctctactactcatccaatgacaacccttcaccactcacttctacctgctttcttaataaccgtgttcaacactaaaacttcgacggagagagtacgtaacactgcaaagaataacccaccgagacgtacacgtggatatattggatcgacactagtaaagaaaccatctttggccggtcgactaaaaaccacaatagtctcggatgcagtaaaaaccgggactaaagatggtttttagtcccggtttataagtagaacgagactacatgatctttagtcccggttcacatgctgtcaggtgttgtcaggcccctccaggatctttagtcccggttagagttacgaacaggaagtaaagatcggatctctttagtcccggttggtgttacaaaccggaattaaagatcaaaacgc

SEQ ID NO: 5311 - DNA, 1501 bp, Oryza sativa
ttcattttccaaaattcagggacgaaagaaatatggagtttaaaattcagggacgaaagaaatatgaaattcagggacgaaagaaatataatgttagtgagatacttctacataaaatggcgcccacaaatatttcatgtttgaattgtctaagatgacatctaatttggaattgatttagtacaaaacacaaatattcgaggctttttctgaatctatgatgtaagaataaagtagtcgcaatccaaattctacttttgtgcgtaacaattagtaatacacaaaaaataactaccctcacatgccaccgacaccaagtatatataaccatagtgcaaattaattaattaattaatataattattaatatatatatatatatatatatgtgtgtgtgtgtgtgtgtgtgtgtgtgtgtgtgtgtgtgtgtgtgtgtgtgtatatgtactcaacataatgctgcacttaatacgaacacaaaaaggggagtcccttgcatcacaaaccagtgatattttggactatgatgcttcctcaagggattgccaagaccacaaattaacctttgtaacaaaattggtagttacatgtcaaactttacctgctatatatgtaaaacaacctcccattttatcatttgcgtgcttccgacacaacgcatgtccatatacacacacgtaccctcacactcgatataacgctatcaaagttaacacggctcgacgccacgcacatacgcaccacacaaaaattcgctactagctagcacagtactagtagcagttagtacaagctaaaacacacttgatcaataacccaagcccccccaggctagctaagctaagctaaccagggaccacggcacacacacttgcataccgtcagtttgttgacaagctagcacgcacaaatggtttgtagcaaccgcggcgggcatggccagatgctatcacgactcgaccaccacaccactggtgctatatacaaatatatactaactccaactccgctcgatcaatccccgttatcgatcgaccacgctttctacgacgacggcatcgctatataactaggttttaaggctacctctcaatcttcctcttcttcttgttcgtctccccctcctcacccaccctgttcatctcgcgtgtgtggcggtggtggtggtattctctctctctctctctctctctctctctacttggtgaggaggaggaggagagtggtggtatcgccatcagagctcaataatactagtgcacgctcgccttgttttctagctcttgtcagcgaaccttcccccctgaaaaccccacccaccccctcccctcctcctcgtctgcttctcgctaccctctgtgtttgtgtttgggtttgtttgtttctctctctaggcctcgcgcgccgtgatcgatcgatttctggagtgatctgttgtttttttgtggagttgtgtgatctgggagatggctggagcggggggtgcggctacggctgcagc

SEQ ID NO: 5312 - DNA, 1501 bp, Oryza sativa
cattttaccacaccatccctaccactgatatttagatcccacaatctatattattacaccatcctccaatgagttctctcctgtttcattgctagatctctctaaaatcttaaaatcgcctacttgtttaacaagaaaaatagtaaaagtactgcttgcactaaatacgtgcttgattgagttaataagctataaactcaatttgttttttgttgcaaagcatggcctcttggctagtatatttaaattcagtgtcacaagctggtgagttgcgagtgatttatccagtgttgttaacttgtgaactgtgatcctatcatttagtaagaaatgactatcattcagggtttcaaaggaaacttttatcattatgttagatttcattgttgtcatcacctctatcattatcacaatttcgagtgcgtaccaaaaaaaatacactagtgatacatagcaaaattccttaaatatattgcattattaaatattatgcatgcaaaattttgaaaccttgatcactaataattctcaaatatttagcttgaaaaaaaaccatattggtagatttttacaagtacttttgttaggctacctttgattggtagaaaaaacataggattcttagaggattttaaatcatttgtggaaaatttctaggaaaagctctaatctcttagattgtttttctaaagtttctcctcccatttgcttcctatatttttccaacggtctattcagatgttttttttccttttagcattttttatgtgttatgcagttatatttctttctaaatcttgtgtatttttcttatttatcttttttttctatccttcatttcaaaataagtgttcatccgaataagtgcgcacgcgttatagtcttactaagtagtggtatccattttaccacaccatccctaccactgatatttagatcccacaatctatattattacaccatcctccaatgagttctctcctgtttcattgctagatctctctaaaatcttaaaatcgcctacttgtttaacaagaaaaatagtaaaagtactgcttgcactaaatacgtgcttgattgagttaataagctataaactcaatttgttttttgttgcaaagcatggcctcttggctagtatatttaaattcagtgtcacaagctggtgagttgcgagtgatttatccagtgttgttaacttgtgaactgtgatcctatcatttagtaagaaatgactatcaatcaaggtttcaaaggaaacctttatcattatgttagatttcattgttgtcatcacctctatcattatcacaatttcgagtgcgtaccaaaaaaaatacactagtgatacatagcaaaattccttaaatatattgcattattaaatattatgcatgcaaaattttgaaaccttgatcactaataattctcaaatatttagcttgaaaaaaaaccatattggtagatttttacaagtacttttgttaggctacctttgatt

SEQ ID NO: 5313 - DNA, 1336 bp, Oryza sativa
tgggcttcctggcacagtatggtctgggacataacctgttgttggtctgggacccctctcgtcggcatatggtaaacctgtatcggctttcgaaatgccttgtcatgaaagcttggaggtctcccgacgtggctgatccccacgggctgggtgatcctggttagtaatgtcgtgtgggtaaagtgtacccccctctgcagaggttaacaaactgttcgaacagccgtgcccacggtcatgggcggatgtgaggtgattcctagcgtagtttggtttgactactgcttgtgaaattgttgtgtgaaactgggttcgatgtttgaaaaatcagcagctgacgggatcagctaggcccgggtggccgtttgaaaagttgttggcccaggtggccgtttgaaaagttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagactttttagaaaagagttcaaacaaaatcaattacgaaaacaacatcctttccttgaagcctgcattaaacacttatttcccctggcttgctgagtactcccgtactcacccttgctctatataaataacccccctagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagcttgggatctgtccgcagcccaacatgactgtacttctactctataataaagagacctctgttgctgtgatactctgtctccctgtgataccagcactgtttcctgggactggtatcgattaacaggttaatttggggcgtcacgggctagttccggtcgggactagttcggggcgtgacaagagatggtatcagagcacaggcttggccctagggcgaaacccgacgcttaggacgaccctaaggatactaagttcaaaactacttgcgaaaagctaaggtttcttttgttttctttattttcaatagtttgtttctaaaacagttactgatctttctccctctttcaaaattgtagatggcagtgaacgccagcttcagttcccacgattttggtgagggtcaccacgtcgctcagcttcgtgacctcgcccgtttccttggcttgtcgtgtcccgagtacacggggtactccgtggaccgtgttccccctcactg

SEQ ID NO: 5314 - DNA, 1501 bp, Oryza sativa
gaaggaggacgacgcgctggaggagctgcaggccaagatcctcgccggactcaggaaggacggctactacctcgtcgacgagagtttcctcgagaagtcggcggcgatgcgggcttacgtgagtgaagaatgggccaagatggactgggcaggcagcggcatcatcttcggctactgggactacgacgatccgcaatgcgttcagtacctgtgatttgatttcagttttgatcttaattaggctggcgtttgccatatatttgtaagctagaatcttttgtttcatgttggcaaagacaaacagcgaagtataattattacttttttgttttaggctaatatagtttcgaattcaccacaatgaaaaaaaatactcctccggactaataatacttgtccttttagataagggtgagcttaaagtttagaatatttgattatgaatcatttttaaaatatttatcttttgactatatatacatatatatatatatattagttttaaaaagtactttaataaaatcatatagtatttgttaacacttttatacatcttataatggaaaataatgataaagttgttttttttaaaaccgtactgttatctaaaacgataagtattatcaatccgtagggagtatgatctaatggttaaaaagagaaagactgatcggtagataaagggaaataaattaaaattttgaaaccctacttttcatatcaaaattaaaaagaaatcacacataatcataggtgctatggtcgacgtgtttttataaagctgccaccttattcaagccttaattaatttcagcatacctgaaaccatgtttttcaagtagtaaagcgaagatttaaaccaacaacatggactaaaagtttcacactatatttttaaaatttaagtaaatatgtgctcaacatgtatagggataggattttgtaaaactctagaaccataattcctaaggttatgcatcgttatctgagggtatatacaactttgatcataaaaatacagggtttcctatttttcttttaaaaaaatcagccctttgacaacaaacagatcaccaagaaatttccacatcgattactgaaaacatgcaaaggaagtaataaaatttgcttagacaagtttctcaaatctttatctctactattataaaaatcaaagatgtttttgccggtaatttggtaagttatcttatataagtcggtttttaagttcgatcacttttagaaatacaaatccgtatttgagtcggtttttaagttcgttcgcttttgaaaataaagaaagagtcatataagaattctttttaaaaaaaactcgcatgctaagacgatcatacttctaattacagttcatgattttctaaaaaaattatatccaacaaaattcccacagtgaatttcaccttaactagaccgtataataacaataaaattaaaatagccttcacctattgcaacgcacgggcattttttctagtcttaa

SEQ ID NO: 5315 - DNA, 953 bp, Oryza sativa
ggcatggccgccttcgggcgcaccgagtggctgccgcgtggggcccagccgtcagccgcccgcgccctcgggtgcggctgacgtgtggggcccacggcgtcggcaggtgtgagcccgggtgcacctggtccaccgtggaccgtgaggctgccgcgtgggtcccactcccatggacccggtccgcgcgcccctccccctcggctgatgcaataaaccctttttaaattaaaatttaaatgaagaaattcgcaaatattcatttaaagagcatataaacttcaaatggccataacttggccatttgaactcggaattggaccgttcaagtctctaattattccttaagaagtcaagaacccatttttgtgctttgttcctgcttgttatatggagtttattagagtaaaagccttttcttttccgttggtcatgtagacgctgcagcttcggaagatccgctcttcgtggaggttgaagccgacgttttggaaagcgagcaaggcaagtcacatcatccttgaacatattgaatcccaatttataaaattattttgatttaaattattgcattatcgctttatttaaattcccgtgttatcactgttttatttagccatgcctatttacctttgttatgaccttattattattgctattgttattattaccttgttcaccctagaataaacaaaaccccaactagtggacactctactcatggtaccactagtatgaatttaggtagatgtttcgccgcttaattaggcaacattaggtggttttacaactctagactttgggaatattcatatcacctggacattatggaatggttggattattgtggaattggattcacacctccccctctattcaaaaccctcaaaatggttttaggctgggctcggggtgcatggttttgatagtagcacctcggccatataaggaccggt

SEQ ID NO: 5316 - DNA, 1501 bp, Oryza sativa
aacatgctgcacgtgagctcctccatgctgccaggaaagccatcaatgccatgagctcgaggttcagattggttttggtggcatattgctgcttgctgctgttattttccttttccgatcagagatcggtttgcgtcgcccacgccgtcgtttcaccgagatcaaggatgttgttgttttgctgtcccaagctacaacgacattgttcgacatcgtcgtctgtccgtcatcacgtcttcgcgccgtggtcaccatagtgtttttttaatttatccttttggtcgtcgtgtttgttggcttctcgcctgcacctgcgcactctcgcgcctgacgccgcgatccctgccacgaaccgcaaccacacactattgggtgacttgtgctgcatcgatatcggcgacgactggctactacgactacgacaacttcatctcgactacatcgactatggcacaaagggctatcatccatgttaagcactcttgccggtttcttctccagtccaagtgtccgcgctgctcacgcttggactgcggggggatgttagagtatatggtagttagagatgtattaggataggattgatttatgtggattccttccttatctgtaatccttccttatctcctccacatgtactcctatatataccggccccctgaggctcaatacaatcatccaacgtttcatagtatatctctcctatactatccaacaatggcatggcgcggtgcacggcgcggggcacagtgatgggacggcgcgcggcgacgggacgtggcacggggcttggtgtggtgcgacgcgacggacgacggcgcagcagtggcacatggcttggcggtgcgtgtctcagggcggcgacgcgacgggcaacggcgatgggacggcgggcgcgacggcaacggtacgcggcgcgggcggtgctcgaggtggtgatagcgatggcggcgacacgacgacgtgcactagtagagatcggtacatctatgatgatctacttttgtcatggaagatgcaataatcgtcgtaaaataacatctatgatgaacttatgacgaaataggattagtcatagaactcgcgtcacataagtttctctatgacaaaatggtagatttcgtcatagaaatgcttctatccatgacgaaggtgctcgtcacagaattgctttccagctggctagtgacatgcgtcgtccaagccacgtggctgccatatgtggaatccacgttggatgtgacgtggcagatgacgtgtactccatgttatgcgtggaatccacgttggatgttgtcacgcccagaaattcccgaatagaattccaagcagaatgtgcatgaaaatccccgtccaggaccggccggggtacacaaatgacaatgttgacattcagatccacgtcttacaaacatcataaaagtcttacataaatacagcggaaaaacgaaagataactggagctgagccttgacttgatctgcagcgggaacaccactcc

SEQ ID NO: 5317 - DNA, 1501 bp, Oryza sativa
gtcctcgcctcccccctccatcgcgcgcgctggtgaagccggcgtgcgcgcgaggagctgacgcgggactccaggcgccgtctccttccccttccccggcccgaggccagagagctcgctcccgcgtcatcggccgctcgtcacagcgcccgtctcggctcggtagtgcatctcccgttctccctcctcgctccctctcctctccttagctctgggcagtagtgcgagtagccttccagtagcaagctggcgccgccccgaccgccgccgctgctcgtcgtaggctcgccaccgtcgctgcccaaactcggtagtagccgctcgtcgccggccttcctcggtgtagctccacccaatccgactctagaaatgaactctggaggtcgcgtagatgctcaagtacctaggaatcgagctctcgtcgcatcgtcgtcgtttccctcttttgccgccgccggcaagcaccaccgcgattcgtcgtcgccggcctccttccggtgaatccgagccagtggatcaaccccctttcttctatctcgtcgttccggtgtactccctccctcttgaatcgtcgggtcgtgctcccggtgaagccgccgccgtccgccatccgtctcggccggcctccttcttcctcctctcgccggcccgcgtggctgccacgaaggcgccacgtcggcgccacatcggccgcgaccgggtcaagcacctagtcagccgcccccaccgccctttcttctgtgcgcgcggtccacggagagcccttaggctgcgcatgggccctccacctcttggtccacccgcgtgccgcgccgtgagccgcgtccgcaaaaccctagcgccccgcgccgcatgaacccttccaccgtgcgccgagtcgctgactcgtgggcccgtcccgggacccggcatgatggatccggtccacccggacccatccccctctctcctcccgcgcgccccgcccgcttgggccgcgccttgcccggccatgggccgcctcctcgtgcccgcacccggcccattggctcggccgcgccgcgcttatcccttgggccgtacccgagccgcccaaggaagtctaaatccgatccatccttccttttcttttccaaggaaattaataattccttttcctttagacagaaaatcaaataatctttagaaaatccatatcttctcaaccgctcacccgattgcctccattcaacttccaataattccgtaaaattgagatctatataatggcactactaattagtctaaataggatctttcttttggtcttttgtttaggctttcgattgtttgcatatagttgcggttaccggattttcgtcaatcgcgggatttcttgaagattcgtgaagcacagtgaagaccttgagcaaggcaagtcaccctttgaccaattgctcctataattggaaaatcattattattttgtttgcaacttgcattagtagaatcacacacttaacttgcttggcctcggtttgcg

SEQ ID NO: 5318 - DNA, 1501 bp, Oryza sativa
catcatagatgtaccgatctctactagtgcacgtcgtcgtgtcgccgccatcgctatcaccacctcgagcaccgcccgcgccgcgtaccgttgccgtcgcgcccgccgtcccatcgccgttgcccgtcgcgtcgccgccctgagacacgcaccgccaagccatgtgccactgctgcgccgtcgtccgtcgcgtcgcaccacaccaagccccgtgccacgtcccgtcgccgcgcgccgtcccatcactgtgccccgcgccgtgcaccgcgccatgccattgttggatagtataggagagatatactatgaaacgttggatgattgtattgagcctcagggggccggtatatataggagtacatgtggaggagataaggaaggattacagataaggaaggaatccacataaatcaatcctatcctaatacatctctaactaccatatactctaacatccccccgcagtccaagcgtgagcagcgcggacacttggactggagaagaaaccggcaagagtgcttaacatggatgatagccctttgtgccatagtcgatgtagtcgagatgaagttgtcgtagtcgtagtagccagtcgtcgccgatatcgatgcagcacaagtcacccaatagtgtgtggttgcggttcgtggcagggatcgcggcgtcaggcgcgagagtgcgcaggtgcaggcgagaagccaacaaacacgacgaccaaaaggataaattaaaaaaacactatggtgaccacggcgcgaagacgtgatgacggacagacgacgatgtcgaacaatgtcgttgtagcttgggacagcaaaacaacaacatccttgatctcggtgaaacgacggcgtgggcgacgcaaaccgatctctgatcggaaaaggaaaataacagcagcaagcagcaatatgccaccaaaaccaatctgaacctcgagctcatggcattgatggctttcctggcagcatggaggagctcacgtgcagcatgttgactcaacccatgcatgcatatgtgccactgcagacgtcgagcatgtatgctcgtagcgtgcatacacaggtgcagaacagccagagccacgagtagacggtaacgatgagactgctgttggtgctgcttgacgcgaacgacgaacgtcgccgcccaaggagattgagacatcctcccacacagcaacaaaacacgaggccgcgtcgagatcaagattgatccttcggtggcaaaccatgatgatgacatgacgccaggagatcgatctctccgaggagaacaatgacgacgactggaagaaaaaaaggtggccgcccccgggagcgagatcgcctcccgggggcgacggcagccgaagcgattagcatcactctgataccatgttggatagaataggagagatatactatataacgtgagatgattgtattgagcctcaagtgactggaatatataggagtacatgtggaggagataaggaaggattacagataagaaaggaatc

SEQ ID NO: 5319 - DNA, 1501 bp, Oryza sativa
tcccggctccaccgccgccgcggaacttcgtcgttccgccgtccctcggtaagtcctcactcctgttactcctcctattcctctaggaactacctcccccaactatttcgtcgattagggccataatcgtgacaagcccgagctccgaagctccgcccaaggaggtcaccgtggacatgccatcccgggggctctcccttcgatttttctagaaaaacggaaccctcatgcgccataaatgctcacgccctcaccaatttggtcggaaaccctccgtatcgccctagcacctagctacccgtgcccggccatggcggccatgcggcgcctctcgcccccgcgccgtcctgtgccgtgactgccggcaggaggacaccggagtcttgccgctccctcccctggtcaccgtcgggtcgccctcggccggccttgctgcgcgcgccgcgtctcccctgctgctcccgctcggtctggaggtagaagacgatagagagaacgagaaaagagaagagaataggttgtgggccccacctgtcattagcaccatccaatttcctttagaaaataattcggtagaaaaaggaataaacccggggtcccacttgtcagtcggtacaaaggctaaagatatactgtatttcggattaaaaataaatgaattatgaacagtagcttttcacaatttctccgattaattcgaaattgaatctttaaactagtataacttgctcattttaactcggatttgagtgaaacttgaacctaaattcatctaaattcataagatttctaatggtatataattcactatttaataaaatacatttataattataaaataattaatatcaagtaattagataatggtcaacttaaatatgtgctcataaataggattgatattttacagtagagtagatgtaataatataggcctttaacatgttttgtcactatagcaaccccataaattagttataatcaatattttaaattaatggatgtataggaaaataatagtgctgtttattaatctatgtcactactcgaaaatcgatttttcatggcgtttggaaaatatttttcatggcggccatgtggaaaaaccgccagcacagaaaatcgtgggggtggggggtcaagggccgccagcggaaacacatcttcgctagcggtgtacttaagaaggccgccagcgaagataggatatcttctttggcggctttcttaagctcacgccagtgaaggtattgtatgttcgctggcggtaaggggatgcggcccaccaacgaagatgtaggtgtctttgctggtggccctcttaacttaacgtcagcgaagatatcttaacttaacgccaatcttcgctagcggtgtggtgacgtggaccgccagcgaagatacctacatcttcactagcggcgtcctcaaccctccgccacctcaaatcattttgaatggaggttcaaacaaaccgacatatgacgaccgccagggaaaac

SEQ ID NO: 5320 - DNA, 1501 bp, Oryza sativa
gcccacacgggacctctggtcgatcccaaccactcgttctccgccgccgcctccccgtttccgcccgaagccccgcacacacgctttatcaccccctctttccccgatcgccaccgccgcaccaacccctaccctgagaagagctaggttttttaccctcctcactctccctcgcgtcggcggccgcgcgcaactttccctgaagccccggatccactcaacccccctccccctccgcgccagatcgttgtgtttatgaggtacttgccgtcgtcccgcttctgcggtagccttagatctcgctttcttccttccctttgttgcctgtatggcggcggatctgtgggctgtcggttgtaggggtgctggatcggagtgggagggggttcgagctgctgtttgctgctttcttgtttggaagctggattttcgtttggtgattcttggtgacgcgctcttgatttgggtaatcttggatgtgcgattttccggcgagttttgatggttgaagcttggggattccgagcgctcagtatgatcggatctggtagctgtgagtaagcgaggttccctttgatgtgccttggtttgattcctgcgttgtaggtctatcaaattcgttgcgtactggtagatttgtccgatttgttcgtctcattgaaatggtataaggaattagctatgtttatccagacgtttatcgtgtcaatattttcgttgtttgggtaatttgatagtcttttcttaaatcttcaatgatttgatgggtttgatggagctgccttttctgcttttagtcagttaggttccttgattcctcacagatttggcggttgtcagatgtttgagtttttcttgattagtaagttctgtgaattttaccctgagatgagcatgaagattcttgagttgtccgttgttatttatgaagattctggaattctccgtcgatatttttagaaagtttcacaaaaccacatatcagtatgttatgttttatgactgtagctgcataaaggtttctcggccagagtctggatactccatcataaccaagttcttttttacttacacattctttacacattttttttacttaccttacacattttttttgacatgttttggaatgtcccgatggccttttccagtgccaataaaataacatctggttaagggaggggttctatgaatgtgttaggaccataaagcatggggagcctcgtacaaaaaacctttcgtgatttctgcaacaatggcaataaaacatttgattttttttttggccatttagtgcataccattattttaccttttgtcctatttaagttcaattttcttttgataggtgacttatgttttagacacatagggacacttgatccattttaagtatgcaggggtaacgggttattgaattattagcagtccctgctttgttgtttaacattttatacgccttatgccatgatcacttgaatttcatccaaattggagatga

SEQ ID NO: 5321 - DNA, 1501 bp, Oryza sativa
atggagtattttatttaaggcaaaatttgttataggacatccaaaatttgtgtaattggctgtaggacattgtaaaatcgtgtcattgctgagggacaccataaaaatggtgtaattggctgctgggcactagatctattattttattatatttgatgctaatggagagagaaaaaccgtggaaagtacgaatgtgcccctggcactgttcttcttcttgcttcagctcaatattgagcaacaaacgggatgggtttttggggtcggtgtaggccgacctgatggtggagcgtcggcggacagggttagggagaggaagcggtggaggtgggggccgcgtcagggagaggaagggcagcgacggcggggtggccggacgcgaggaggcaatggtccaatgcaagcggcagcggcggcgatgcggaaaatttggtatcgagctttacattttgtttcccctttgcaacccgagctcctgctccatcatcagcagctctactcacaatcgcacgcggcgttcttctgcgcccacccatcattcgacttggcttcgtgctcaccttgaagccaaatacggaggcggcgaacgacatggtggtcgcaacgctggaaaagctttcatggcggcggtgctggccgagacacccccacgtttgggatactactgctctgcgctgccttgtacttcaagttgaaagaggttaattttgggcctagcgctcttccccaccggcaatgatgcccctgactgtcggcaatgacgcacctcacctcacacctgctcaagcggcagctcatccacaataagtgtgtacttggctgtgaaccagcgcttggattgtgcaattaagaggcaggggcaaacttgtatttttaaaatttctctctccactttttgctcgaaaatgataaaataatgcttccagtgtccaacagccaattacatcatttttgtagtgtcccttagcagtgacacgattttgcagtgtccttcagccaattacacaaattttagatgttctttagcaaattttgcctttatttaaagttccactaatttttggttttgaacaaaaactaactccatctcttccaacatgaacagattttgagatattaacattcctatgcaacccattcttgtgacaagagctgggccattctagccaataatggtcttcctttgcataagatttaaagctggatatccagtttttcagaaggtaacaattatctataggatctgcttgcttgctgaaagctttcaattctttttaatcaatcaatgtgcagtttgagtcacttattattgtagagattagaacaacgcgcctcctgtacatattctgtttagtaacttgtacggagtttgggtataacttgtaagcaatataaactcaatatggcagctttatatgttggatggataaaacagaatatacatattcaattgttgagaaaacatcattggtccttaatgcctcattgcaaggtgaagtcc

SEQ ID NO: 5322 - DNA, 1501 bp, Oryza sativa
cgccaacctcatccgttcgatgaacgaaacagttatatatatgtatgccccgccaccgttcgtctgctgccggcgaagtcctccgactcgctgctgccaccagtgtcatcctcacatgaatcctcacctcaccgtctagtgatcacgaactcggcatccccaccggtgcctctatcactccgcagcgcccatacacatgacggcttcttcatggccgccatcggcgcactcccgagtcaagtcactacgatcggagacggctcaacatcatttgagttcagccccgattgtcggcgcatatacaagagggccacccagctcctggaacgcatctcatcgttcccaggctaggctatgcccctaacatcccataaaaccactcaatactaagtgcgtgctgcagcgatcagtaggctgactcatgtaccatgataatggtcgaccagtgccatctaggctagatgggtgattctaccccaaccgcaagtgaccacaagcttggaatctccactggtgtctctgttactcctagcaatatcaagatgacttctttgtgaccaccgatgtcatttgtgctttcgctgatgacctcttcatggccaccatgaacatactcgagctcagcaccactaccgacaccgtcatcttattctcaccccagccaatgccatgctagtccccactacgagcaccatctttacctccaccgacgaggctaaatggcagggcgggaagagtctatatgaagatgacgtcaccaacaccggcgcacggaccaacgaggccgtggaccgttgtcgatgcccacacacatctacaccaccatcaccgtcatgcatgggacactagtacagatccttccatctgtgacggcccataacaagactggaatttgcgggccgtcacaaggaagtaatctcaatcgggccgaagtttcgctcgattgagatatggtcgcacagccatagtatatcggcataaaactaaagcccgtcacggatgacacttatctgtgacgggttatagttgatgcccgattgagatgagggttccatatctcaatcgggccctaaaagaagcccgtcacagatgagggtcatctgtgatgggctccaactagaggcccaattgagataagtttattgcctgtcacagatgacactattttttgatggccttttattaaggcccgatagagattacttgtatgcccgtcacggttgattgttttagggccgttacagatatttgttgcacagtataaataccccccaccacctagtgtaactgtatcccactgttcactattttggtgggaggctgttgggggcattttttgtcctttttccaaggaaaacagaaattaaattcccaaaagtgatcaaaatggatcaatcaagtgagtaatataaatcattaattgagcaatttcatcacgtcttacttttgcaatactgatcttataatatgtgcctctaatttgttttttttattttgtagc

SEQ ID NO: 5323 - DNA, 1501 bp, Oryza sativa
ggcataccatatcagtcttctcaacttgttcaatcttcggccactgtttccagccaatgtggtatgcagcgatgcgtagtccaattctgagtccaacttggttcaacaccaaatccgcttcgatcttcttctttcttctccgaatctaatgcccgcaagttccgttgttaacaccaagaaatcaccgaagagcttgaatcgttggagaaatcaataagggctaacaaagttgttgaagcagtggcggaaaaggtgatggagtgaagttttcgagggggttcttgctatttatgagctaacggttgaaatggaaagccctaggattttgcgggattgaaagagatagtttcgccgcgtcatataacacagcggaattggggggcaagtgttaacaacaaaatttgacaagatagattcagattgggagttggatatcaaagcggatttgaaagaaattggatcttgccaaaacagattgtacatcggctgacagcatatcggctagaaatagagtcgaagtttgattgagccgatatggaaagcagccgatatagttcgacttgggcacgattgagattactgtcattgccatatagagatagagctaatttaagacaattgtattcattaattaggatactaatgtcgttttgagttagaggtatggtaagagtccaccatgtagacttgtttgtttttatctttaggaaagtttgagttgtgtccataatgcttgaattttgtactctaggtataaatataaaccttagatcattgtaaaaagggacgacaatccaatcaatataactttcggtgcatcaccaccatttacttttactttttcgacgagttcttacttcgagtcgggcatcgacagcgatctctcaacaagaagtaaattgtctcgatggcttgcactatcgggcctattatgtagctttagatgcattggtctttttattgtcggataaggccttgttggatcctgtagagacaaaagaccatgtaagatctgccgtgtaagagttttcgccgtgcgtattaaccaagccatgtgatcagaaattgagttttccaacttcacggctgggggctaggatcagtgcttgttcaaccaaggcaggtcaagggtccaagagccttctcctccgagaacgattctctgacgacaaggctgggggctagggagagtgtatgactcaacaaactgactgatcgaagtcggtaagagagaagacgctcatatacaaaacattggacccaccacataccatgtcttatacggaaactgacttcagatatggagggagttccggataaggaaagacaactagagttctacatggaaacgacaaggactactcggattgtatccatattggtttccctagttctacttggacaaggggacacctatgtgtataaatacaaggccccctaggaggagaggggagataatcaacacccaccacaatctacagaacaacagaagccacaacat

SEQ ID NO: 5324 - DNA, 1501 bp, Oryza sativa
gctaggatcagtgcttgttcaaccaaggcaggtcaagggtccaagagccttctcctccgagaacgattctctgacgacaaggctgggggctagggagagtgtatgactcaacaaactgactgatcgaagtcggtaagagagaagacgctcatatacaaaacattggacccaccacataccatgtcttatacggaaactgacttcagatatggagggagttccggataaggaaagacaactagagttctacatggaaacgacaaggactactcggattgtatccatattggtttccctagttctacttggacaaggggacacctatgtgtataaatacaaggccccctaggaggagaggggagataatcaacacccaccacaatctacagaacaacagaagccacaacatataagccaacatatgccaagacaagacgtcggatattgacttcagggataagcacggctagtctcctacggtgtctccggatactgtcaggagagacgaaagcgctatccctgatctcgttgggcacggattcgaggaggaagactaccctattgtcgactacgagtcagatcttcagaccgccatgtcgacaacagttagataggctaccccaaatattgtactggtgtgattatgatgaataagagcaacaaccggcttcggccaacaggatgtagggttattacctgacaattcaggggcccgatcctgtataaaaatcctcgtccccatctcttttgcctcaatctcgcatatatcctagtaccaacgatccccatactatgcaaataccggaatcgtgacatcaaacgtcgacaacttgattgtttagactttaggtttctctacatactttgagttgcgtcaaccctagtcttgtctagaaccctaaaaactaacctggaattatacataactagtaacagcattggagtttcagccgatattacctaatatacatgatagtgcatgtctcataatctattttgtgtatatttgccacttatatagatagatcactctaagtaaatatatcaagtttgattgatctcgactaatccatcatatatggtgatcgattattacttgatatatttatctagattaatttgtttatataagtttgtattggagtaatagccaatacattatctattcttgctctaaatattagattatcggctatttctataatattgtctaaaagtgattgataaaaacaaaagagatagtattgcaatcgataggacatatttagggttttgttttacttatctatcataaagccgcaaccgatttggtttatctgtatcggctgggtcctgacgatacgtcgttggctgtattagccgatcggctatcgttcatctaattacgtttggtgtctttcttgctggttgcaggatcaaaccagctggcacgttcttgtcactcaaggaaagccttggacctgcactggagtgaagcaaatctcctaggctgttgtgtttc

SEQ ID NO: 5325 - DNA, 1501 bp, Oryza sativa
gttttgtccttatttctgttaggaactctgtttaacacataatttgaggtcaacaatgcctccccccaccatgccttaggtagtcccgcagtgtccaacatggcattcaccaagtcagtcagtgtgcggttcttccttttagcaatcccattagactcgggagaataggggggcgtcctctcatgtatgatgtcctgttcctcacagaataagtcaaactcgtttgagaaaaactctccactacgatcagacataagtctttttatctttctgtcaagttgattttcaacttctgccttataaattttaaaatagtctagagcttcgtctttcgttttcaacaagtacacatagcaaaatctagtagcatcatcaatcaaagtcatgaaatatcgttttccaccctttgtcaacaccccattcatttcacaaagatctgaatgtaagagttctagtggtgccaagtttctttcctcggcaaccttgtgaggcttgcgaggttgcttcgattgcacacaactatggcacttagaacctttgacaatggaaaacttaggaattaaacacatgctggaaagccgagacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttggacacgactactttattagactcaaaaaccaacttaaatccagctctagtcagacgggagccactaacaagattcctgtcgatagaagggacatgctgcacgttcttcagctgcacgatctttcccgaagtaaacttcagatctaccgtgccaacaccatgaacagaaacatgtgacccattccccattaggacggtggaaccccgtgcgacctgataagaagaaaataatgagatgtcagcacaaacatgtacattggacctagtatcaacccaccaattagtagactgattaactgaaaaaatagcaggtaaattaccatacccgcttccatctccagtgttgctaatggtcacattagcagacttagaagtctgccctgtaggtgccttcatccccttgcgctgtggacacttcctagccagatgaccaagttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatggaggtagtttcgcaataatgcacctggccacaaatttgtcgggta

SEQ ID NO: 5326 - DNA, 1501 bp, Oryza sativa
gtggattccgacggaggaggggtggacgggacggcccgcacaacggcgaacgcaacggcgcggctcagcacggcggctagcggcgaccggagcggcgatggcggcggcggagaggagggcgacggcgctagggcgatagagggcacggggaagcttggcaaaatggggaaaaagagagaggggagagtggggatgcttaaataggggaaagggagctcggatgtggccgggagaggcgggaatggccggccgacgtgggggaagtgggagaggagagagaggcgggattcgaaaatcgaatcccgtcgtctcgagcgcgggcgcgggcgggagagagagggagtgggcgcgggagacgcgggcgcacgcgcgggcgtggccgacgtggcccggaggaggcgggagcgtgggcgcggcggcggttgcggagcgcggtggcggcggctagaggttgggggaggacccgacaggtgggccccacctgtcggcgaccccgggagaggaagtcgggcgaccggttctgtcggccggcccagcgggaaaaaggagggaaggagagaatgggccggcggcccatcccaaaaagaaaaaggaagggaaaaaagaaagaaaaaggaggaaaagaatttccagggaattaaaaattgcttgtgctcatttttaattggttaaaattatttcttagagctctgaaatttcactaaaaatcttgttagcgtatttcgacatgtaaaactcaagaaaaattccacatgctaattccgattattatttacattaattcctttagggtttcactcttgttcctttagggtttcactcttgcttttacaccggtattttcttaggaccatttataaattcaatttaggcttgagagaagaacttcagggtgtgacagccatgcacactcaaaaagcccatatatcaaacagaattagcccaattaaaatctaaatctgacatcttatagcccaattaacaaaattcagctcacatttaatacataatcacaaaacaggctatcataaattcagaaaaaaaaaagatcacaggttatccgtaaatcagttacatgacaagtcagctaattacatccacaaatcactatccaaagcatgttcaattacatcacaggttcactgaccagatataatacatcactagtacaagtcactgaccaccaaatccagccaaatgccaaatagccgttcacacattgacctaagcaaagtcatatccaaatcacacgaatcaaaagatcttgaattagcaaggtaacattaagagaatagacaaaaaccttattgaggctgacctgagtgttgcggccaatcaaacgacaaaagggcatatgcttccttgttgcttccgattcatctatccatagcaaaagaggtgttacttaggcacaacaaaatcctgatgttatatatagaattaagctttgattatgtgtaaattaagcaagcaaaatgtgagattgtctaatgccagttga

SEQ ID NO: 5327 - DNA, 1501 bp, Oryza sativa
agtattaaaagttaacgcaatttaatcaagtgaattaatgaggaaactaaaattttcctttaaaaatcatggacggaaatattttttgtaatattttacgtggtctaaattattattttaaatttttcgtgaattttcagagctcaataactaattttaataccacaaaacttatttaacctattaaaataaatagaaaacaaattaaaattcctctctatgtacttgggcctttttcagcccaagtattactctatccctccctcagcccgcagcctatctctccctcttcctccctcttcgggccgccggcccagcctttttgctacccctcgccgaaaagtccattttacctccctcctctaaattcaaataacttttcaggtagcaaagatttcaaatgaaaaaattgtcaataataattgtataacttatcaagatctacaacttttttttggtcatttttctatatgactttgtttcaataatttgaatttgaatttcaaattatgacaacttcaaacatcactttcaaatactaaatgatttcaattgaaaaagtcatcaacaacaaagttgtataactcatcaatatctataagttttatttttgtcattttgctatatgactttgtttcgataatttgaatttgaatttcaaattatgacaactttaaacaacattttcaaatactaaacaacctcaactgaaaaagtcatcaacaacaaagttgtataactcattaataactataacttttattttggtcatttattcatccgataaagtgatagtaacattgttcacaaaatttacacacctctcttataatttatgaaaccatatggaagatttgtaaaatttatgaacaatgttaaaaaatactttatcagatgaacaaatgaccaaaataagaattgtagatctagatggattatacaactttgttgttgatgacttttttcagttgaagtcgttcactaataaaattttctatttgaagttctcaaactttgaatttcaaatttcaaattgtttaaatagagttagattgaggaattaccaaaatagaaattttggttcttgatgagttctacaactttaatttaggtgacttttccatttgaaatcatttattaaccccaatttttgttcgaagttgtcaaattctaaaaattcaaaatttgaattgttcaaatgaacttatttgtaaaaaagaccaatacaatagttgtagatctcgatgagttctaaaattttgttgtttgtgatttttgcatttgaaacataaaaagcagcctaaaattaaatttgatgttgttcataaattaaaattaaaaataccataagatcattcatgtttaggcccaaatggcccaactatttctgaccgtccatctccgatctaatagttctcatcgccatccctaaccttagccccatataaaaccctcctctccacccctcccccctctctctctctccaccctcagccgccac

SEQ ID NO: 5328 - DNA, 1501 bp, Oryza sativa
acaagatgcttgaaggaaattaaaccagagacaaaaacgcgttataaaaagggaagatatactctctctctctctctctcaataactgatgataattttcttgtttctattccctccattttatattataaatcgctttaatttttttttaaaatctaacttcgagaaagtgaaaaaatatagcaattggtttcattatgtctaacattaaacatattttgatatcttttatgttgaaaaaatattgctatgtttttttataaatttggtcaaacctaaagtggtttgacttagaaaaaagttaaaatgatttataacatgaaacagaggtagtattattttttatatactcaaaaccatattgttagattcattttgtatagaactttgtaatagggtagagtttcaaaagtatttgcaaatctgaaaatatcaaagttcaacacagccccatccttttcatatgttccctagaatttcatttgcctcgtataattttttttatttttctactatgtctactatattgattagaccacctactttaagttatttgtgaagtttattagaccacctattttaagttatttgtgattttttttaaaaaatatattaatttatcatgttaataaaataaacaatccgcgtcaataatatgaaaaaaaatgtctcaaacagcgtcaacgttatcggtctattctgatagatatagatatagatagagctagatatacatatgcatatagatagatagatatagatatgcatataagatatatatagatataacaatgtcatatatactgccatctgcaaggtcgtcaccctcggctctacaagactattgcaagagtccaacttttgcacgcatagctagtactaggatcatatagctactaagctacaaatggcgatagtaattttgcttaattaatctagtggccgtcctggactcctggtttgaaaaaagtctagatagctcacaaatgtacgcaagatacatgcatgttacctcactctcaaaaaaatatcattttttatccagctcatatacattaatacaaagagcaattttacggtcattgaggtaccaagaggtaccaaatttacaatagaaaaaatggtacctcatggtacctactcaagaatcgtagaattgctctaatacaaaactaacagactagaatacttttaccaacttttatcaaaatacaatacaataattgtttcaaagtcaaagtttttcttaagacaaacgaattgataaaagatgtggctatttgagattgaggatgttacaatactatggccctgtttctttcagtttgggattattataatctagattattaagtcagattactataagctagattgttataatttatataatttatagtagaataaccgttggttgtttctttcctagattattagagcctagattattgggttttgcaagtctaaagagggagtggggtggcatggtgggtaattttgc

SEQ ID NO: 5329 - DNA, 1501 bp, Oryza sativa
ttattagaccacctattttaagttatttgtgattttttttaaaaaatatattaatttatcatgttaataaaataaacaatccgcgtcaataatatgaaaaaaaatgtctcaaacagcgtcaacgttatcggtctattctgatagatatagatatagatagagctagatatacatatgcatatagatagatagatatagatatgcatataagatatatatagatataacaatgtcatatatactgccatctgcaaggtcgtcaccctcggctctacaagactattgcaagagtccaacttttgcacgcatagctagtactaggatcatatagctactaagctacaaatggcgatagtaattttgcttaattaatctagtggccgtcctggactcctggtttgaaaaaagtctagatagctcacaaatgtacgcaagatacatgcatgttacctcactctcaaaaaaatatcattttttatccagctcatatacattaatacaaagagcaattttacggtcattgaggtaccaagaggtaccaaatttacaatagaaaaaatggtacctcatggtacctactcaagaatcgtagaattgctctaatacaaaactaacagactagaatacttttaccaacttttatcaaaatacaatacaataattgtttcaaagtcaaagtttttcttaagacaaacgaattgataaaagatgtggctatttgagattgaggatgttacaatactatggccctgtttctttcagtttgggattattataatctagattattaagtcagattactataagctagattgttataatttatataatttatagtagaataaccgttggttgtttctttcctagattattagagcctagattattgggttttgcaagtctaaagagggagtggggtggcatggtgggtaattttgcacccaataatctggaaaaagctcacctaaatgagcttatcaaattataataagctggactctagattataataagctacttcaataaggcttatttgtttctttcagcttacttcctatatatatatatatatatatatatatatatatatacttttgttattggcgctcacggccttggagattttgtgttgttggcggtaattaggtagatgggctctactaataagaaatcaacgaaggtgcatgcacctcccaaagaggaaacaaatatgaaccagtccagtacttgtactgttcttttttttttccaaaaagggaactgttttgtgttgcttgaatcagtcggctatatatttagctcttattaaatactatctctgtattttaatgtacgacgccgttgattttttatccaatgtttgaccattcgtcttattcaaaaaatttatgtaattatcatttaatttattatgacttgattcatcatcaaaatttatgtaaatattttcatatttgtacaaaaaatttggataaaatgaatggtcaaatgttgataaatt

SEQ ID NO: 5330 - DNA, 662 bp, Oryza sativa
ggttttgggccgactttcgcgccaaagccaaaagagactttttaaaacatttttcaatttaaattatttcttaaatgcaattccatttattaaaaatacttccttagctcaaataaatcccagaaaaatctaggaattatagaattaagcaaagtatttgatgaaattttatctggccccattttatattggaatttattaattaaaactagatcttctcttcaagacttttaaaattatttctaaaaattccatttaaacaacaatttataaattttaaaattttcagggtgtgacagacatcatcaccagcacctctgcttcatcggccctgacatctccgctgttgctaatggatgattatgttttcgccgacttattatttcaccttcatggttgacctactatgcaaatgctgatgagcgtctttgtcattatcattggttgctacactgctattggctggatcaccaacatcgtcatcttcatcaacatactgtcaagcctcttcaacatagcccactctactactgtttgatgagcaatttcgtcatcatagtcgatcatctctgttgctactgacggttgcctttgtcgtcgtcgactattttctttattttcatgattggtggatttcgttattgcctttgatacgtgtctac

SEQ ID NO: 5331 - DNA, 1501 bp, Oryza sativa
ccagcgccacatgtgcgcctacgtaggaccaaaaccacattcaaatcgatttagagagtaatttatccggattacaaagtccacatttaaaagtgtttgtattgttatctaggggtaaatcggatgtgtgcaaaagttcaaaggtaattcggacttttttcaaaattcatttgtacgaattgaatcgaagttatttaaataattaaatagacatgactaaggatcggattgcttatcatttcaattctatggaacgctataatgtttcattggacagtcacatgttttagtacgatcgtgtcatagttacagcagaaaagtgaaacgccgaaaagtgaaacgccgcataaaaacaacaaaatactggtatgtttcactagataattgttccattggaatatttcattctgtgtgtttagtcattggaccaattgtctggaaatattgcattgactcctcaatgtttgcatgcaaatatcaatatatatttgtaaatatgacgaattgttctttcgttattagtcaaaagaaaatgagtgtgttcggctgccatttgtttagcagcggctgcagcaattcaaaattgctgcagcttacagcgactttgaactgccgcagccgcagcggctgcagcagccatacctgccgaacagagccatacctgccgccgaacagagccaatgttggagagaaggactatcatctgttcttaggaccatcgtatttttgtaagtatattcttgcatattcagggagtttgcacttacccctactctaggaatatttggcatcaccaaacatttcaagcatgcttatagcatgcacaggtaatacgagcacgcaagtattgtgatgtgaatgtggcgtgtttaggttttgtacgtacgtctagttgcctaaaagaccaaagagtttgaaaaggggaggtggtcttttgtcactctccttgtcgcttatgcatatatgctttatggaaccgtttattaattactaataactaaagtaaaatagtttaaattctaaaaaaattaatttatgggtataacttatccttactgatttataagcacatactgtaaaaaagactataattaaaaaaatcacaaaaacaccttgaaaattaagttttaataagatggcttataaacataagcgaaatgagactatacatgtcccactttgatttgtcagtaactacatttgattggatcatagatagattaacaggcatccacaaaaaaacagtaactgcaagccacagggctccatgagaaaatggaatataataataaataatgtacataatgtctcatgacattttgcatatttgcaatttcttttttgttatctccttttatctctatggatggcaatgtttgcatccattctcctttttttttttccactggactcttcccagtgaacataaccgacaaagaactactaggaagctagtaaaattgaaagaagaaaaaagaaagaacaaagaaaatttcagagt

SEQ ID NO: 5332 - DNA, 1501 bp, Oryza sativa
atgtgaaatgggcaattcctacaaccaaaatggtgtgtctgtaatataatacaaccctctccaacttgaaacctgatatataaacatactaccactgaactctagtttaaaacagagcttgtgagatagacagataaaaactattttaagaaaaagtggtttatcagaaacaacatcagatctgcagagacaatattttctatgttatttgattataaacattcgatatgaagtacaattatatagttttgaaatcaaatagactgacaaggttctacaatggtgcaagttgagcttttctctattgtcaaaaggtccaaattattactacccaaggtatttcctttgtcaatcctgaaagctagattaaaaaaggtgtaacatcactattgggaacttaggatacaacagaggacaacgtcactagcctaatcaaacatatatgtcccacttatttatgaagatcatttcttttagtcagttggttaggttacaatcagagcaactaataaaaagagctagcactttcacagatggtgaatcagagatgaacgcgtgtcttttatgtctaatccatctttcttctttcagacatctgataatataactaaatgaaataacaccatacaggcactgccaaatgttaggcctaatggctaaagtgagatggactgggtacatatggtcattttcttgataagccagataatatggcacaaaccggtggggtcagtgatgtgactgtgtatcaactcaacaaactgccaagtaacatctactagaagctcattagaagctggaattgtaccttttatctttgtcatagttaattgtataaaccacaaaaaaaagttggtaccttcggacagatgcaaatatcctatgtaactaaagtgtaaaaaaccttaaattcatagggtaccatgctattgtcatattcataaccttcctgccacgaaacttgcatataatacttattttcctcatagtcttaaagcaggaacatccttatttgacctagattctgtcaccaggcagtttttgattggtcaaggggtggaaagatgcagagcaataggttcctttttatgtttggaagaacatgcagagcgacaaatgtaaccaccctttgtgatatagtattaccttccgatcttttgtttatttccatttcccccaacctcgttgggggcaacatgatagtttaagaacaactggacacgtcttagaaactgacttgccaatggagcttcagtggtttagcccaatgatcaagcaaaaccaaaaggctagtgaacaataaacaaatgatatccagagcaactaaactagaatggcaaggcattaccaaccatatataattggtctccctaactccagattatgtgcacaagtacaactcctgactacttctattagagcaagtttaatattatagccaactactagctccaatttatctatagccaatctaatagctcatttatacaatagttacata

SEQ ID NO: 5333 - DNA, 1501 bp, Oryza sativa
tcctaatgtagtatatcttgtataaaattgaaacccgctagtaaatattagatcctaaagttaatatgtaaatataccgcaacatcatccaataataattatgaacttctaaagctcaaaatataaatatatcacatcgtgtactgactaatcatatcatcatgctatatatcctcgacatcatttccataatattaaattttaaaatatatccatataccatatttcaacattatttaacgtataaattcatcattaggttccatagcaaagtgccaggcagcaggcattatatccggtatacatctaccatgacatgattaaatcagagaaatttatttacattattataaatttataatgcactgttgccatgttgtaaattggcgacacctccactagcaggattttgacctgcttgatcattacccatgagaaacttcagtttccacaggaggaacagcacgacgaggcataccatcagccccgcgttgaaagccgtaaaccgcttgctgctcgacgagcccgcgacgaacgcggcgcccaagctggccatgtccagggcgacgagcacgttgaagaccatgacactggtatggctcaggtagaagttggtggcgagcaggacgatgatgcacacggacgacgcgaaggaggtggcgttgcagtagtagaagacgtagtagcgccacggcgacttgtcgaggaggaccgggtagccggcgacgaagtccttggcggcgtcgtcggcttgccagacgccgccgggagggttcagcgccgccgcgtacgtgatggacgccgtcagcgtcgccagcaacatcagccagcctcgtagctcgtcctccccttctttccgatttgcccggcctcctctgttggccatagctgaaccttgctcgcctgccatgatgaacaacggctctgcaaagtttctgcttcttgatcaggaatgtatttattatagtttaataaaattattgtaaacatatatatttaatcaagaagatttatctacgaataatctacaggtttagcaatgaacatgcatatatgtcacgaaactgcaaagccatagcgctgtaagaattctagcatcaaggtcatgacaaaattattgagaattaaaaaaaggttccagcttgacacaattcttcaaaatctataatttaattccattattttatcaaataatctatattatatttacgaaattaactttaacaagacaaagagaacacatacgtacctcgcaaagagaagtgtgtagacgagaactgcaagggttatctagccgtagatgactagctagattaattgctgacctgatgcagccaacacagcctgcaaactgatcgatcaatcgatcaacgagagctaaattaattgaaggttgctgtttcatatatatatactttgatggaagctagacaaatgtagtactccatgtttgggaattgcaagtagttgttctttaaaagaaattacgagtaccaagttg

SEQ ID NO: 5334 - DNA, 1501 bp, Oryza sativa
ttgtacaaatcgagtacacaacggtgaatttgaagaatgtgacgtttcaaccaactcccctagctgatactccctctgtcccaaaatatttaacgccgttggctttttcaaacatatttgacaattcgttttatttaaaaaaattaagtaattgttaattatttttctttcatttaattcattgttaaatatactactactactcaagtttttaaataatattcgcaaaactttttgaataacacgaacggtcaaatatgttttagaaaagtcaacggcgtcaaatatttagggacggagggagtacttccgtcctctgtttaaatataaatacaattgtaactaaaaaaacaaattatacgaaaagttagatctagatgtcctcgttaaatgaggggtgattgagagtgaaaacgtagttagggcaagattgaaagagatttggatgagggtgattaatttagagtatgggataaaattttgattctaaaattgcacgcacttatttattttgagatggagggattatttatcccttaggtttctgatgttgagcataagtattgaactactccctccatttaatattataaatcacttcgaatttttttaagtcaaactatttagaagtttaaccaagtgtagagaaatatagcaacacttatagaacaaaattagttttattagatctgatagtgaacacattttgatagttctttttaaaaaatatatattgctatatttttctagcaaataagtccattatacaccccttaactactcacgttgtctaaaattcaccccttaactttaaaaccgagcatctaacacccccctactatcaaaaccgtttaatttacactcctagaccaaatcagggtggttttcctacttgcgtggcatcaacatatcaatacgggttagtaaaatttttaaaaagaataatggacatacatgtcattgaaatttcctcttctcacaccttctttcctcccccttcttgagattttctcgatacgcctctgccgacgggttcgctccatcacccgtgtcgacgaggcaacgatcacctcagcctcccagccggtaaggttgacctctatctccccaagtgcctccttctccatgcgccggcgagctagaccttcagcttcccatcatatacatgtcttcccaagcgtctccctgactccacgcgccagcgaggtcgaactctggctccaagctacatcttggagtgcctccttctccagggattggtgagctcaagctctcctcccctcgaacccccatcgtctcccgattgccgcaagcttgagctcacgctgtggctcccagctgcgcccccaagtgcctcctccactccatgtgctagcgtggtcgagctcgagctctgcctccttgccgcccggagcacatgctccatgctcaagctggtacgcaagctctagctttgcctacgccttctccccgatttgccggcgagctaaggagcggtcca

SEQ ID NO: 5335 - DNA, 1501 bp, Oryza sativa
tcctaatgtagtatatcttgtataaaattgaaacccgctagtaaatattagatcctaaaggtaatatgtaaatataccgcaacatcatccaataataattatgaacttctaaagctcaaaatataaatatatcacatcgtgtactgactaatcatatcatcatgctatatatcctcgacatcatttccataatattaaattttaaaatatatccatataccatatttcaacattatttaacgtataaattcatcattaggttccatagcaaagtgccaggcagcaggcattatatccggtatacatctaccatgacatgattaaatcagagaaatttatttacattattataaatttataatgcactgttgccatgttgtaaattggcgacacctccactagcaggattttgacctgcttgatcattacccatgagaaacttcagtttccacaggaggaacagcacgacgaggcataccatcagccccgcgttgaaagccgtaaaccgcttgctgctcgacgagcccgcgacgaacgcggcgcccaagctggccatgtccagggcgacgagcacgttgaagaccatgacactggtatggctcaggtagaagttggtggcgagcaggacgatgatgcacacggacgacgcgaaggaggtggcgttgcagtagtagaagacgtagtagcgccacggcgacttgtcgaggaggaccgggtagccggcgacgaagtccttggcggcgtcgtcggcttgccagacgccgccgggagggttcagcgccgccgcgtacgtgatggacgccgtcagcgtcgccagcaacatcagccagcctcgtagctcgtcctccccttctttccgatttgcccggcctcctctgttggccatagctgaaccttgctcgcctgccatgatgaacaacggctctgcaaagtttctgcttcttgatcaggaatgtatttattatagtttaataaaattattgtaaacatatatatttaatcaagaagatttatctacgaataatctacaggtttagcaatgaacatgcatatatgtcacgaaactgcaaagccatagcgctgtaagaattctagcatcaaggtcatgacaaaattattgagaattaaaaaaaggttccagcttgacacaattcttcaaaatctataatttaattccattattttatcaaataatctatattatatttacgaaattaactttaacaagacaaagagaacacatacgtacctcgcaaagagaagtgtgtagacgagaactgcaagggttatctagccgtagatgactagctagattaattgctgacctgatgcagccaacacagcctgcaaactgatcgatcaatcgatcaacgagagctaaattaattgaaggttgctgtttcatatatatatactttgatggaagctagacaaatgtagtactccatgtttgggaattgcaagtagttgttctttaaaagaaattacgagtaccaagttg

SEQ ID NO: 5336 - DNA, 1501 bp, Oryza sativa
acgacgacgacgacgacgacggcggcggcgacctctgcagcggcggccatgagaagccgaagctgcagctccatggccgctgatgctgctgatgaaggtggccatggccatgctctctcgcgctcctgctctccattgatttactgatcgatttgtagtgtggttgtacaatgtgtagagctagcttgacactgagctgagctagaaggccatatataagcaactcaagaacagtgctcacggaaaactgaatagtccattagcgcgtgattaatcaaatattagctaaatttatttttaaatttagatcaatatgaattttttaagcaactttcgtgtagaaacttttttttaaaaaaaacacaacgtttagcagtttgaaaagcgtgtgcgaggaaaacgagagagatgagttgggaaacttggggtaagaacacattctaaagtgcatgacatgtggggtcccaggctacatgtatgacagacatgtgggccactgcatgtcggtcagacacacacaaactatatatatctggttagtgattttcaaagggtagctagctagtgatgcatggaaagggagagagagaagccattgaaagcagctggtttttgccaagatgtacaaacggcatgcaatcgatgtgtcgaccaagataccgtcagagcgatgagagccaatgtggggaagactatgtgacatgtgtttgcaacccctgcagaagctttccctgcaggacaagacacccgtggctatccagccatacatcagatgcaagagattaacctgctggctttagggttagcatccatgcatgcagatgcagtcacacagggcccaccatttttctgagctcttgcaaagctagtcttcgtcctaggagactgcacagttgcatatatatttggatatggattttcatctctcgaggggatgtcttctctttgcatgtcatcagttataaaaaaatttgacaacatagattaatatgaaatataaaactccaaaaacgtgcaagaccaaattcaacttccacaagttgcaacaaaaagaacaaaataaactgaaaatagttatcgtacattcgcaactatatttgttatttttgttacaacttgtagaagttaaattttaacttatgtgttatggagtgatatatttcatattaatctatcttaccaatttttttaaaatattttgatgactatttaggtggcatgcacgatacgaggggttatcacttgagggatgaaatcgctttccacacacacaatttatctaattgcagagatctagctaggtttgcactgtgatctgagctaggttttttgcttgcttctgactcactccagctagctagctgctggctgcatctgcttatatatatgcattgttcagagaggcaaaaggagtagtgatatgttaccgatgccctgaaagcatacttggccttactccatatatatttgcattcaactttggtcagcatatgttagagta

SEQ ID NO: 5337 - DNA, 1501 bp, Oryza sativa
cgtcaaaaaggttggcgttgccaagctcacctcctcccttggagtctcaaacatggggcttcccgtaaacagataccaggtgggttctgttaactccgaccgtgccgtgccgttcggtttcaaaagccgcgagtcgtgcagccaacacgcgccggatcttagtttcaacggccgactgaattcttcggttggtttagtccacttaagtactccagttttgatacttgagcacggcggattcagcttaagggcctgtttgtcacagctccaactctggagtggagttgtggagctgcctaaacccagctccacaactctattacattttgtgagagagctccacccaactccactcctagttttggtggagctaaaactgtttggctgagctccagctccaggaggggtggagttggagctggagctgtgccaaacaggccctaagtgttctaagtaaacaaagcatcttaatataaatatgtttgttttacggtcttatatgctattttcacgttccattaattatgtcataaactgttgttgatttgtgccagttttctcctatttcagttagtagtatcgtattttgcactacgtcggtattttacttacctttggaaattgtaatcgcggaacttgtaaccacaatataccgaatttgccattgttcattggttttctctcgtatctctaagacaatcataattagcatgtgtagctcacgctaaaattaaaagtttagttaaaattgaaacgatgtgatggaaaagttgaaagtttgtgtgtaggtaagttttgatgtgatgaaaaagttgaaagtttaaagaaaaaaattaggaactaaataagacttagcgtaaaaaatcgtcaaattcactcgaacgtactactatagtactatttccgtcaaggtttcaaaaagacattagtcgatcgtaccagtctgactcgaatcgtcggtcgttccagcagcagatgcaattgtttagtacaagttgcatcctagtacagtagaagattcgccaggttcagcgaaaacctcgcacggtttacgtgccagagttggcttcgtgatcctctcgtccagaaaggcaatggaatatactctactgctcgtacgcgcccgtgagatgagcccacgcgcacgcccaacccatcggcaattcggccttgtgctgcccagtttttgcgcgcgcgccgctgaatcctcaaaaatggacgacaaggcgacggcattccgtttcgcgtggtcgcagttgcgcctcccccacccctcacccgatgaccaccctacgctagcaatcttcctcttgtcgtcgtcctcctcgtgctccgtggcatggcggcgcaggtgctcgcagctcgcgtataaatagcggccatgtccatacacggcagactcacacaaccaacattcagagttcgagtgaaagttctctcacaagttcagagtagcatttggctagtgacagtaactggtcagtgtctctcaccatgtcgt

SEQ ID NO: 5338 - DNA, 1436 bp, Oryza sativa
tccctggcgagctccccgcttgcgaagacagcccccgcgcgcagtcgttcgcgcgcgcgcgcccgcgtggttccccgcccgagtcgcgtcgtctgcgtcgtccgcgtcacccggccccgctgctctgccgcgcctgcaaccgctcggccccgcgagccattgcgcgtgcccagccgcgccgcccgttgtttcccgcgcatgcgtgccgagtggccgacctcctggtcgccgccgccgccgtcaccctctgccgcgccagcccgcgcctgtcgcccgtgtcgtcgcgccgctccaaaccgccccgccgtcatcgccgtcgtcatcgcctcggtcccgccactcccgcgctagcctccaagggacggaggcagagcctccctcctccctctgccgcgacgcccccgctccctcctccttttcccgaagaggcaaggggacaagcccccttttctctccctcttttcccctttttcctcccgccggcgtcatcctcctccctcctccctgtcgccgctttggccgcgaccgccgagcgctagccctctcctttgaccgccctaagtcggttcccaaaccgacattgccatcctataaacccgagctccccccctttttcctttcctctcccattcacctccgcgccattgccgcccctctgtttcgccgtcgccgttcgtcgttgcgcgtgtcggaggagccggcacgagcaaggacgtggaaggggacttcggccgcgccctctccttcctcttccccggcccgaggccggagagattactcccgcgccgtcggcctctcgtcacagcaccccgacccgcacggtagtgcctctctccgttcttcctcctcgctccatctcctccccttagacacgggtagtagcacgagtagcctccccgtagctagccggcgccgccccgaccgttgccgtcgctcgccgtgtactcgccgccgttgccgcccgagctccgtagcacccgctcgtcgccggcctcgctcggcgtagctccgcccaatccgacgctagcatcggatttccgtggccgcgtagatgctctcaccgccgggaatcggcccttcgtgacctcgtcgccgtttccctcttccctccccgccggttgccgccgccgcgattcgccgccgtcaagcttcctccggcgaatccgagccgttggctcgtttcccctcgtctcgtgcaaccacccggtgtgctcgctttcgcctgtatcgccgtggttcgctccgccgctcgccgctatcgtccgtcgtccgttccggccggtgtcgtcgtctacctcccgccggcccgcgtggcagccacgtaggcgccacgtcggtgccagctcagccgaggtcgggacgggccgaccccggtcagcccctcccgtgagcgcgttccaccgcgagccgtgaggctgcgcgtgggcccgcgcgca

SEQ ID NO: 5339 - DNA, 1501 bp, Oryza sativa
atgagtttttgttttagggccgaaatccaggccatatttctcgtgttagtggaaaaaggaccaaaattataactgtctctatctgtcaccacggcacacgatggtaatgggtcggcattgtgagcattaacaacaattcttttgatttttcttttgcctatccaaggtgtttgttagttgcacaacttaagctctgtgtttggtggatttgatgaaccattcaatactcatagttgcatatcattgttctctatagcctatgcagtttcctgcttttcattactgcccacatggacagtcatcttcctggcaacttcacgaccgaatggtcgacgcgtctcctcctcctcctctcgccctatcgccgggtgccactctggcccaggcgcccaccccctcctccaccgaccagtccggccctagtgtcctcccccgctagcacaggtttcatcctcggctatcctccctttctagagagagtcagcctcggctccctctctggcagctactcggatggggatctgccagatctgcttcgccctcaattcctcctggcaaatctggtcagtgaggcagcggatgcgcgtccccctggtgccagccaagatccagcaggttcccccctctacaggttctttaagttttcaagcagccccggttttactgcgcagggtgggtgaaggatttactcctcctgtgccctccggcttgaaggtacagggagttactcctcaggatagcttcattcaggcagcaagatgaatggcttcgccctcgcagcttcccaaagcaatcccaaaaaatcttccgtctgaggctgccacccgtcttcaagtttggcagacagtgaagccaaagcattggtggaggaagagacatgcccaacggccttcggcattcatgcaccttcaatccgctgctcctcctcagcttccctccgcattcactggtcgccaccaacctttcctctcgcagtccaagcctcttcaagcaaggatcagcttcctcgagctctttaaaaagaaggcggtgggtcactgcttccgctatctagctcaggaccaccgagttgcttcctgtagagaccccctgaggtgcattctctgtggcagttctggccacaaagcccgctggtgcccgggagacagacgacgggatagggggggtccagcctcctcgccccactcctgctcctccgctagccagtcggctagttttccctccgctcccggcaatgtcgcgcccaggggacccagccaacaggccggacagcatccagcgcgtcctgcccaggacgtcggccatccgtgaggatgaaagtttcctttctcgcaccgcagcggtggtacaggttacaggcaatctcccagtgacgaacatgagacagatcaacaggttactggcgtccaggtttcaggttcctcgtgaggacctcaatgttgtcgtcttctccaaaggaggctacctggtcacctgcacctctcggtcgctcagggacatg

SEQ ID NO: 5340 - DNA, 1501 bp, Oryza sativa
cgtcaaaaaggttggcgttgccaagctcacctcctcccttggagtctcaaacatggggcttcccgtaaacagataccaggtgggttctgttaactccgaccgtgccgtgccgttcggtttcaaaagccgcgagtcgtgcagccaacacgcgccggatcttagtttcaacgcccgactgaattcttcggttggtttagtccacttaagtactccagttttgatacttgagcacggcggattcagcttaagggcctgtttgtcacagctccaactctggagtgaagttgtggagctgcctaaacccagctccacaactctattacattttgtgagagagctccacccaactccactcctagttttggtggagctaaaactgtttggctgagctccagctccaggaggggtggagttggagctggagctgtgccaaacaggccctaagtgttctaagtaaacaaagcatcttaatataaatatgtttgttttacggtcttatatgctattttcacgttccattaattatgtcataaactgttgttgatttgtgccagttttctcctatttcagttagtagtatcgtattttgcactacgtcggtattttacttacctttggaaattgtaatcgcggaacttgtaaccacaatataccgaatttgccattgttcattggttttctctcgtatctctaagacaatcataattagcatgtgtagctcacgctaaaattaaaagtttagttaaaattgaaacgatgtgatggaaaagttgaaagtttgtgtgtaggtaagttttgatgtgatgaaaaagttgaaagtttaaagaaaaaaattaggaactaaataagacttagcgtaaaaaatcgtcaaattcactcgaacgtactactatagtactatttccgtcaaggtttcaaaaagacattagtcgatcgtaccagtctgactcgaatcgtcggtcgttccagcagcagatgcaattgtttagtacaagttgcatcctagtacagtagaagattcgccaggttcagcgaaaacctcgcacggtttacgtgccagagttggcttcgtgatcctctcgtccagaaaggcaatggaatatactctactgctcgtacgcgcccgtgagatgagcccacgcgcacgcccaacccatcggcaattcggccttgtgctgcccagtttttgcgcgcgcgccgctgaatcctcaaaaatggacgacaaggcgacggcattccgtttcgcgtggtcgcagttgcgcctcccccacccctcacccgatgaccaccctacgctagcaatcttcctcttgtcgtcgtcctcctcgtgctccgtggcatggcggcgcaggtgctcgcagctcgcgtataaatagcggccatgtccatacacggcagactcacacaaccaacattcagagttcgagtgaaagttctctcacaagttcagagtagcatttggctagtgacagtaactggtcagtgtctctcaccatgtcgt

SEQ ID NO: 5341 - DNA, 1501 bp, Oryza sativa
cctgggtcggcttgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtgggataggaatcgtaaccagaatcagcctatgtggcagatggatggcctgagtggtcagaaacgaatctgtgtgattcgggatgtctacgggcatcatagactaggcttcccgagtggaagcggaatgttgtgctgctgggcagctggactctgggagtccgagaaaatgaataaggctctgggagccgcttaatcaagtgaaatggctctgggagccgagaagtaatgatctgacccgggaggtcggtcattatcaattgagttgttgaaaaacatctcttaaagttgaatcgagacgcaagtctcttttcgacccaaacctgaaaagaaataaatcacttagtggtttcaaaatggatttcaaataaaagatttgcaaaacaaccttgcctctcttccaagcttgcattaaacacctaaattcccgtggcttgttgagtacgaaagtactcacccttgctctatatatgtatatatagttcctccgtcgtgaagtgaagatgaagtgaagtgaagattagggtttcgtcctggttcccagccgtcgcctgtggcgttgggtgttagtccgttggttccactgctgctgctgttggtgtttcctcatccgtgacgtcggttgcattctcgggctgctcttggttccgctgctgctgctgttgttggtgtttcctcgtccgtgacgtcggttgcattctcgggctgttctaagctgcaacctaagttaaggtaaataagtcctctatttattttaaggatttgcaatgattcatatttgtcaccgtgggtaccagcactatgtcctgggactggtaacgagatcgcggtttcgtaggaagcggttcgcgccgttattcctacgacacgctcctatcaggtgccgttgtacggcggtgccggattggggtgtgacacatgctgcgtgaacgatgacatgaattttttttattttttcttccttcttccctcttttttcccccttcttatcttttttttctccactttgcctccttcctctcccttccgcagtatttttctccacacgaggtgaggaaggagaaaaaagatgggaagaaaaaaaagggaaaaaatttagctatgtcatcgtccacgtggcatgtcacatagagaagaccacggttaaactaggctttggaccgggatgatacattaaaccaagtttaagaatctcgatacgtgttttgcaagttcgtggatctaagtgaaacttcgttgcaagtttaatgaccgctaatgtaattaactcttataaaattgtagcatccggacattaagca

SEQ ID NO: 5342 - DNA, 1501 bp, Oryza sativa
aatgatgcaaaccatacccctacacacaagcaaacaacacacgatctagaaagctaacggaactactcttctgggaaagattgggtttaggtcatctccgagaaaacatcacttgatcttcgcagaacgacgactctgaactgatcttctcgctccttgcacgaagcttgaggctcgaattgacttgacttccgaacagacatgaagctgacagctggtcctctaggtttgacaactaaaagaattggagagactgggaggagaattttgaaaaactgtttgacaaagaattgccgaagggcgagaggagacaatttgcaaatagggttttcagaaaacttgtccttagggtttgaccatttggctcaacctacagtcgagttggctctgataccactttgtcacgcccagaaatttagcccaaatttccagactattttgtgtattaaatccctgtccaggaccagccagggtacacaaaacaacaagtatctcgccgcgccgccgtccgccgtccatctcggcctccccttcttcctcctcccgccggcccgcgtggctgccacgaaggcgccacgtcggcgccagctcggccggaccgggtcaagctgaccccggtaagccgctccctccgtctcccgctcgcgcgcgcggtccaccgcgagccgtgaggctgcgcgtgggcccgacgcgtctcggtccatccggcgcaccgcccgtgcgccatccccaccgaaccctagcgccgccctcacgtgcgcccatcccaccgtgggccgtgtcaccgacaagcgggccccacctgggacccgcgaggtgcactcggtccaccggaccgctccctctctcttccgcgcgccctaatgggccgccttccccgcgcccacgccggcccaaatggctcggccgagcctccttcaacactcgggctgcgcccttgccgcccgaaaaagtctaatatacatccctcgtccatttccttttccataaatcaattccttattattccgaaattccataaatcaattcctttggtcccacacatcagtgaatgtcaataatattcttgagaatattatttctataaattccataaaccattccttacattccagaaaattctgataaatcatttcctagtctggaaaatcccattcgagcttccaaaattcatatctctcaatccgtagctccgattgactccgttcaacttccggtactgccgtaaaattgagatatatttaatggcactattaattagtctaaatagggtctttcttttggtctttcgtttaggttttgattgtttgcgtatagccgcggttaccggattttcgtcgatcagggatttctcgtagattcgtgaagcttcgtgaagaccttgagcaaggaaagtcaccctttgatcaatttctcctataattggaaaatcattattattttgtttgcaacttgcatttttagagtcacacacatataacatgcttggcctcggtttgcg

SEQ ID NO: 5343 - DNA, 1501 bp, Oryza sativa
agtaaatttggtcgaaattcagtcaaaatttatcaaaaaccggtcgaaatttgtcgaaaactgtgttatcaatggaactcaaaatttagtagtcaaccaatagtatacaccctgctaagcatcttatttgtcgacgaagcgcgtgcgtcaaaactcaaacaaacaacctcttcaacgaaagcacctagcatgcaatttttaacccccctcccccctcccaaagaaaaatctccaatcaattaattaattatgagcgtgtacaaatctagatacgtcattttcattttgagaaaaaaaatcctagatatttcacctgccagctatagtctatttataaaatgagtaaattacactagcggtacttaaacttgtaacgaagtttcacttaggtccacgaacttgcaaaacgtgcatcgagatctctaaacttggtttaatatgtgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcgcttagtcctcacaccgaaacaaaagcagcagcagcggggcttcagctccactccacaggcaaaactcaactggggtctgagccttggtcctctaacttcgtcttcagcccagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaaaacagtaaaactgttgagtaattaaagtaacattaaatctccactgatcaacgctacaccacgttgaacaggcccaaccaacccacctgaactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtccttaattgccatgggtgcgactcacaaaaccatgcacccacagcccaccattcagtcgcattttagttggataattacgaccataaaaca

SEQ ID NO: 5344 - DNA, 1501 bp, Oryza sativa
gcgtcgagggagccccaggcttggcggagcgggcacgggcatggcgccggcgggttggggtggccgtagaaggggcacaccggcgtgtgcaccttcgtcttcccgaactggtccatgtacttgaggaactccagcacgtgcgcgccgctgcaccgcgacagggacagcggcggccggtggttccgcaggtactgcccgaacgtgttccagtcccgccgcttctgcgactcgtaccggctcagcgacggcgacgagctggacggcgatggcccgccgccgccgcctcccgccgacgtccccgcgcccgacgacgacgacccggcgccggagaacatggcggccgcggccgggccgaggaagaagctgtcctgcgtggcgccgccggcgccgccgtcccccgccgccgggtcttgcccgccgcccgacatcatgtgatggtggtggtggtggtggtggtgatggtgacgatccatcctcgccctcgcctcgccgccgtaatgcaacctgaatcacaagaagcaagcatcatttcttgctccgacgaaatcaaacaagaagagaagaacctaagcaacgatctatatctatatataacatgtaccggatgaatctgcttcccgatctaggtcaggtagcagccgatctcctcctccactgctccactcgcagcagcagctgggatcgatcgatcttggcatgcacgagcacgagacgaggagaggtgtccgtggatccgggcgacctagctagcgatcctccaatcatccatgaggaattgaacagcagctagccaagtactacgctatgctctcctcgctctcaggtggtcaagccatgcttgacagcaagcaaggcagcagcagcagcagcaagaacctgcagggatcgatggagagagagagagagagagagagagagagagatggagtggatgaacagtggatgatggcgatgctggaggagtggggggaagagatggataggtctagccttttaggcaggcagcctgggaggagtagtgtgggtgtggagtgagagagcctacttgctagctaggtgtgtgaggtagaaatgggtgtagtagagcctagtagggtataggaaggctagacagcttggtgctagctactcagggggtgagaaaatgacaggaaagttaattaaagagaaattaatattcgaaatacaatacagatgcacacgtcgtcgtctgtacatactctgtgacttcggcaatttcagacatgttagccataatttctgtaaagtgtgtatggtgggtgtgtgcatatttatagctagctttctgggaggtgtaatatacaaactcaccatacacacttaccagaaattacagctaatatgtcttgagattgctgaagtcacaaagtgtctcactattggtgatgtcacctaccagttaaagatgtttcttttttgttttatcccatttacctttcactctcttaattccaaagtttgaacaatataaagttaggat

SEQ ID NO: 5345 - DNA, 1501 bp, Oryza sativa
cgacgcagctgcctgttttctggttccatatgcattccgtgcgggctgtgtatctcatggaaggacggcacgatcgatctagggcaggtcgacgcagacgtcggcagtagaagagcctctggcagtctgcctctgcctctggccggcgaagtgacacatcgcgtcagttcaatcgtcgtctccgccccctgctcagcgcagcagcagcagctttctcgatgggtcgcagctctctctctctctctctgcctgcaatggatgactaccgagggatgcagtactccttttgtttgtcactcgtgcggtgtgcacaaaataaatttcttggccagctgccgcagtagagcaagttttactgtgaacaagttactgccgcaggtggtgtttggttcaatgactaaatcctatcaaatcggatgtttaaacattaattagaactattaaatgtaaattaataataaaactaattgtataaatgagagttaatttattagacaattttttttaaacctaattaatccataattagtatatgtttactatagcatcacataggctaatcatggaccgctcgtgatgctactgttggaattaatagatgggctaaggcccattcgaagattaattctttggaaaatcacaaaagcccaactcatgggatggcatgcatgtggagtttagtaccaccttacttattctaggagagggagacctccttaaaagggaggatgtcctcctagccacttgaagcatgtggggtggagagaagagggggaacacatgcttgcgcagatgcagtctccttttgcagttttgttttgctgcaggaaaattcggatttgttttgttgttggaaacattccgaaaaatccggtgcgtgaaaacggcgtggagtccggataagttacgcacgacttatccggatcggttacgcagagtgatgatcgtgcgagcgccctgatcaagcgacctatctctatataaaccgtgcctccgccttcacgcaacacacgcgaaatcaatctagggtttgcctcctcctctgtgttgcgctgtcgctcgtggactactccatcccgctcgccagcgtgcaccggcgatcggaagagcaggtctccggaacctctgccttcgacgtcctgcactgggagaaggcggcaataaggtttttgggaagcgcttcgcgcgactgctccctgttcgtccgcgacggctcgccttcctctccactcgcgtgctgcgcgccttcgtcgacgctcgcaaccgcgagtagttcttgctgagcaaccggtctttccgccacctcggtacttgttcgacatgttgcgcatatttgatctggtcatgttttactgtttagtttacatgtgtagatctaataatgcgttaatactagtatacatctgtaatgtcatgatttatttatggaatatattaaatcattatatgcctatattctcaacaatccaaaaaccttattataggcgctgtgattttacta

SEQ ID NO: 5346 - DNA, 1501 bp, Oryza sativa
taatacaaacaatacagcccgtaagaacatcttattttaagcaggtgaagcatctggcagaaggaatcctactggttctttgaatcagagtgacaattatgcacaacggccgtcaatgtcactaaaggaaatcgtaagttgaatccgtccccgcatgaacttgagataggagtccagttcctatgctgtataatgtcttccccttgtgtatctctcctacgtgtaatttgacgatcatgaaatggttcaccttctcagatgcatagcaccgaccggtccggcgaaaggaccgtggaaagaccccgtacatcctcccgtacaggcagtgcatcaaggagagcggttgcgtcaagcagcaggccaggttcatcggtggaaccaatggagcagcaatacagccggacaagcaggttgttctcaagcagtggaagccgtccttccagcacgcagagggttaatccatcggttggagagacaagggccacttctctctcacgagcagccgttgcaagagggtcccgcgacgagcctctccaccgcagcctggagctgctgtcccttggtggcggtaagaggaaataatatggcaagagaaagaggaatctccacaacggaaagagaaaggaagaaacgctgtttgcgactctgtaaatgacaggattatcacctatttgtcaacagttcaccaggagcatcccataatttcatggtgctccggccctgttgtatcattgcttcatagatagcaataatttgtttttgttgtgtgtgttcgctgttgcgttagggccaagtcctagctttgtgatgattaatttagaggtggtcaagattcaacatatttatgtttctttaccttaccccccctggacttggcaacttttcctgagagacaagtattcgtgtatcccccccttcttattcaactctggatttgcttattcaacagaagttgataaaaaggatctcccctgtgcaaagctcccagtctcattgttgcggcaacgtggcttgtcggtggttatggcaaagaaagttggcacaccttccttcttgtgtaagcgttatgatgaagtttgtagttcacacatctttctgtttgtgttaacattctttttccggagttaatgaggaaatatttttggcctgggctccaagaacgcacttacgtgggccggtaaatcttctgatgggccacaaaattttccaaaacattgggctcggtctctgggcctcggtagcctcgagctcgcaccacctcacgcttcacgcctcctccacagtccacacaccgcgccgccgccgtggactcgccgcaccgtccgccgcgccctgctccgtcctgctccgccgcgcgcagccgcctacacaaacctcgctccgccccaaatccagtaggagaagaagaagaaggggggaatccagtagcgttttgaccggaagaagaaattgaacaaaacgagctccaaccctaggaggtgcgaggcggcggcggcggaga

SEQ ID NO: 5347 - DNA, 1501 bp, Oryza sativa
ccatatttcatgtcgtctacagtagtaacataagtggcctgttcactctagctacatagtgtgcatatttttctatcagttgtgtgcccgtgcaacaccgatgcacccatccatcccatcatatgatcctatccggcggccacactgcaaatctgcaaaatgatagaatttaaaaacacaaaaaacaagttagggtcggtcaaaaatcgacaagaaaagcagcagcaggagagaaacaagaggccatcccctccagattatcctgcagtcatgtcatgcttctcccctccctgcaggcctcaaggcatggaaggaattgcaaagataatattattgctagtacatggatggaatatatacttgaaaatgaaatatatttatacaaacatcctaactttatattgttcaaactttggaattaagagagtgaaaggtaaatgggataaaacaaaaaagaaacatctttaactggtaggtgacatcaccaatagtgagacactttgtgacttcagcaatctcaagacatattagctgtaatttctggtaagtgtgtatggtgagtttgtatattacacctcccagaaagctagctataaatatgcacacacccaccatacacactttacagaaattatggctaacatgtctgaaattgccgaagtcacagagtatgtacagacgacgacgtgtgcatctgtattgtatttcgaatattaatttctctttaattaactttcctgtcattttctcaccccctgagtagctagcaccaagctgtctagccttcctataccctactaggctctactacacccatttctacctcacacacctagctagcaagtaggctctctcactccacacccacactactcctcccaggctgcctgcctaaaaggctagacctatccatctcttccccccactcctccagcatcgccatcatccactgttcatccactccatctctctctctctctctctctctctctctctccatcgatccctgcaggttcttgctgctgctgctgctgccttgcttgctgtcaagcatggcttgaccacctgagagcgaggagagcatagcgtagtacttggctagctgctgttcaattcctcatggatgattggaggatcgctagctaggtcgcccggatccacggacacctctcctcgtctcgtgctcgtgcatgccaagatcgatcgatcccagctgctgctgcgagtggagcagtggaggaggagatcggctgctacctgacctagatcgggaagcagattcatccggtacatgttatatatagatatagatcgttgcttaggttcttctcttcttgtttgatttcgtcggagcaagaaatgatgcttgcttcttgtgattcaggttgcattacggcggcgaggcgagggcgaggatggatcgtcaccatcaccaccaccaccaccaccaccatcacatgatgtcgggcggcgggcaagacccggcggcgggggacggcgg

SEQ ID NO: 5348 - DNA, 455 bp, Oryza sativa
  unsure (1)..(455): unsure at all n locations
tagttctgaatcttaactcttgaacggtgatcatgtaccagtcctggttgctgtatattctgtaccactctagtggcaatatattttgcatgttatttctttgattggtaaataagcaaatcctgttcttcccatgttcaggcatagctaacttcccgttcactatatccagcattacatgtctgttttctgcagcatgacctgcatcgaagatcaagagacatttgtttaacaaaataatgatcaggtctcaagatacttgtgataaggagctagcaatttactgcctaacctttttttcctattgaattcattataatcatattngtggctagcaacttcactctcacttatctgaaactgatttctgacaatgctagttaaggctgtgggcatatcttgctctgtgagtttcacgcatcatcaattgttctattgataacaaattcttcagg

SEQ ID NO: 5349 - DNA, 1501 bp, Oryza sativa
cacctaaatactcatatgataacatatttacacgcgcgagtttcaattctcaccgtacaaggcattcgaaggagtaggatattatgattttgatttgtttagagacacaaatgcactccttttatcaaaagtgcaaaatagatagagttcaagtataatactctataagtttcgtaaaaaaaagattcccatacttttaatgtttttaatgctacaatcaaaagatagtaattcaaatcacaaattgctatgtcacaaacatagaacaattatccttttgagtcgggtttgtgctaccgctactgcactctcaattccatccttagtattatgatatatacacaacaacatattttgtaggccatatagaaaatcctcggtagctcctagctccgtcataaacttatataaagcagtatcatttagtataacacgaaatcatcataagataattttgaaaggaaggtaattatcacaagatgctacgctattaactcgtgtttctgaacttatttttcccatatatcataatcaaaatgagaaggaacacaagcattagtttttgttaccacgaaaagccccgaacgtgtacatcacttccttgttttaagagcacaacaagcatggtacgttcaaccactactacaagtctacaactaaagatactccccttgtttgaagcaactatttttgaccctcccctttcttttaaagctaaacaatttgttggtgttttgttttgaggcattgtaaggaaaaggggaccaaacaaactgctgctactatatgcgtactacacccatcaccataacaaacaagaaacaataaagtgccagaaaaagagagaaaagaagaaggaaaagaaaagagcaacaaaccaagatggccgcacctgtcaattacttgtaaaaacgaaaaaaaaaaacaaacaacctgctcccagttaatcagtttctttaatcgggtggtgtctatttactaatcgtcccctctccttcactctttttctcttgctggtctccgtcttcgtcttctcctcctccaccctctctctctctctctctctctctctctctcctcccctttgttccgccgcttcccctctctctctacctctcgcggcgaattcgccgagagggcgcagggaattttattaggagaaatcccctttttgtatccgtttctccggatccgcacacctcctgttaatccgccgattcttctttgatttgttcatattcgttttttttatttttttccctttgtttgcctttttattcgttcgattgtggggggagggaagagtttggtcgaccggatttcttggtggtttgcctggatctggcgtcctagaggccctcgtgcccgaatcccgattcgattcgcctcggcgcggcgccgctcgcctcgacgggtttggatctcggggtgggattagaggggaaagggggggggggggcagttgattcgtttggttgagaccatcggagcagcaaggaga

SEQ ID NO: 5350 - DNA, 1501 bp, Oryza sativa
gtgaccagcattctttccctctttttagttatagccccccaatacaaaaatgcgtcccacatgtacacaatatcacagcactagctacactaactcataagttcaagtttctgattttcttttggtgccaggcaacgtgtgatatagtgacttcgttaatttcaagtctattagtctcaatcgttcgaagttgcttataagagcgcatatgcatacaattgataagggtgacgagcatatactggctccatcgtaaaatatagctatcagatgcgacatatcatgtattagttagataattcctccgttttagaatatagcaaattagaactagattaaacaccatataacacaatgtatctatgtgatgtccaatctagtttctggttactatattcctgagacggaggaagtatatttaagaaggatatagcaattgtttgcgtttgtattgcgtttagcgtagctcaactggttaggtttattgtggtggaactaacccacatgggcttaagtcataaacttgatacggatggtcgtattttactgttaattatttatttagtggtaggcgacgtaccccttgacagcgagacacccgtggtgtttcatacaagctttgaaattttggaattggttttgttgccggtggggaccggaattttagaaatttgtttgccgaaattatttgaaaatttgattgattttgaattaatttgaataaaacctgatcaaattaaaaaaaaattacaaaaaactgaaaatttcgggcaagatgtgagcttgccggggggggggggggggggtggggcgaagttaccaaaatttcagaaatttcgaaccgaaatttcaaaccctggtttcatcaattttaagatataccggcccagcctcgtggatatactcatagagacagggtatgcgtatgcgtatgcgtgtgttataagcaccaacgattgtactgtgtttctcaaaagaaaatcacacccgttacttacctaaccatttaaccaatgatgtttgcaccaagagaaaacatcatcaaccgcaacttacttagctcacaaaacaaactgtcctggcgaccatgaaatgatcacccgagcccatgacaccaccaaaccaaaccaaacccccccaagatcacccacacaaacacacagtggagggagggaaggaggcgccaatctagagcacacgcaggcaaagtctcgatacagcaggagggcgagacgcagacacagagagaggagaaaaaagaaaaatacagcgagacatcgcgcgaacaggaggaccacttcccccctccctcctctccagtctccctccgccgcgccgcgattcccctccctcccttctcccccccgcgccgtcgtcaccgccgccgcgggaggagggggcggatcccgaggccgacctcggcgagccagatctgggccacatgccgcccagctcggcctagatccgccctgacctagcgccgagcgacggggtgggggca

SEQ ID NO: 5351 - DNA, 1501 bp, Oryza sativa
aacttaattaatcatgtggtaaacgctgcttcattttatgtgccgggaccctcactcccgaacacagccttaatcatgtttgcacttgtgttcaatactccctctcccgtaatattcatttttagctattgttgttttacttgaaataaatttatttttagagtaattattgtatcggagtttgtaaaaataagaaataattatgggagtagataaagcgaaaaaatagttgtattgatatttgatataaagcatgtttattctattttttattggtatgtgtataaatgaatttactttggggcggagagagtagtgttcagaaatagcatacggttaagcaaaaatttaaaggatgtgagcttttcaataacggcctaaaggctaacagcatatgctaatagtgtaattcgaggctaaggccccctttgattcaaagaaaattcataggaatttaagaggattttattgctataggaatttttcctacaaagccttgaatcaaaggaatgaaccctatggaatcctatgaaattcctatggaatgcctttttccatacaagttttggaggaattttaacaagaggtagaacctcatggaagaagaaatcctttgagtctttatctctcctcaaattcctgtgtttttcctatggtccaatcaaacggtcattactatattttttctgtgttttgcaatcctctgtttttgtcacgccccgaactagtcccgaccggaactagcccgtgatgctccaaattaacccgttaatcgataccagtcccaggaaacagtgctggtatcacaggaagacagaatatcacagcaacagaggtctctttattatagagtaggagtacagtcatgttgggctgcggacagatctcgagctcacaactgcattacaaaagggaagcggaagccaagacttggaccaaacatcacaggcgcgacttgggaactaggccgaaaccctaaaactcatcatagccggcttgctcctggaagaactcctcgtcagcgggatccgcttcatcttcttcagcaactgggggggattatttatatagagcaagggtgagtacaggagtactcagcaagccatgggaaataagtgtttaatgtaggcttcaaagaaaggctgttgtttttgcgattgattttatttaaactcttttctgaaacaactaagggagtgcttctcaaacgacacggatgagacagtgcgtctcatccggtcggagtatgtgcaatgtttcagtcttttgaattgatcaagattggcacccggccaacagctttcaaacggccacctgggcctggctgatcccatcagccgcagattttccaaacatcaaacccattccacaacagcaaatttcacaaggcagtagtcaaacaaaactacgctaagaatcacctcacatccgcccatgaccgtgggcacggctgttcgaacagttttaataacctctgcagagggggtacactttacccaca

SEQ ID NO: 5352 - DNA, 1501 bp, Oryza sativa
ctttttttttcggacagagagagtatgtatgagcaataaataccgcctcattttgtgtgtttcggtgtgacgcaagaggccttaagaattgccgtccttcatccccgcaattaaaaccacccccccttccctccctccctttcccctcatttccttccgccatcgctttgcgtttgcacccccacctccctctctctctccggcgatgctctccgacggcaccccccgccgcaccatcgccgccgccttctcgtccgcctccgcgcgcgcgtaacccggcaccaccgcagcgacgggcaacctgacctatgccccccgaccagtccggcattggctgaccccctaatgcctcgccactgactaaccaaaccgaaccctgtacatatacccgccgccgccttcgtcgtcgtcgccggtgagggattttagcctcggcggacgcgagccaaggcgtggttcttctagagtttttttttatatatattttggtggtggtgatgggagtggtggagttctcggtgctgggggcggtgcagaagttcagatccctcatcgccggccccacgccccccgccgccgccgccgaaggcgaggaggtggcccggcagacgagcggcccgccgtcgcccgcgaccccgacgagatcgcgcagcggcgccgcggacacgacgccgccgctccccgcgaggcccgggggcggcaggcgcgccatcgccctgcgccgccagatctcctcgccgcagctgctccgctgccacgctgtcaggtactccctccatttccatcgccttctcatgccctccttacgctaccacgacttccttttttttcttcttcttcttccttggcttgctatggaggaaaaggggaaaagcgaggtagagattgcttggtattacgatattattattattattattattattattattattattattattattattattattattattattattattattattattattattattattattattattattattattattattattaagtaatcacttacatggcatctaaccttttcgatggtgttggtgaatggtgataccacctattattgactaatttaggtgtagtggattatgcaacatatgcaggtagcactcatggatgttcatgtatgcttgttggtgttaatccggcgctgctttgtaatcgattcgcaaatactattgtgctgaatttgttgtggtacttgttttcgtggatgcaggcgaggcgatggagaggacgacgatgagcccggggtacagtttttcaccccagggaatgactacttacatgacttttcagatacagactctcttagcgtcagtactcctaacggggtcgccaggtccttgacaccaagccctctggagagcccgacttggatggtggggcacaacgacgcctcgccaacgtccaagaggaacgagcgcctcagcctggattctcttggttgcgataccaggctgaacggtggcatcgcaga

SEQ ID NO: 5353 - DNA, 1501 bp, Oryza sativa
ttctccttttcggagtcaaataaaccccagccagccacttattatgagtcaacttttttttattacaagtcgctccactatagtactatatactaggtgtaatgctagaggggtagttcgaaagaaaaccgatgaaatgtttggagtggtggaatcgatatgatttgtctaaatccataggtcttcataataatatatgtacaattagccgagtgttgtatttgaattattcatattgggtggagatatgcatgatgattggctaaactcgattacctctaatttttcgttgtttataaggagcaatatatatacgagccccactaaataatctttttgaacccattttccttttcaagtcatatggtccaaaatttcctccatttttaaattattgatagtggaactattcattctcaaaactcgtgatctctccttttatttacagtaatattattataagtaatttaaaagctattatattatcgagtgtactgaattttaaatacatgcataataattttgttcatcatagtctaaccgtttaaaagtaattagtggttaaagagaaaggatatatagttaacactatcatatattttaaaacgaaaggggtaataattatttcaatgtgagaatgagtggtttaactatacaagtcagtagtgcttcgaaagagtggtttaactgtatttatatttgcacatttttcaaaagggaaaatggtactcgtgcatcgaatcaaaagtggttcccagggttaatttttaattcaactcacataaaacactttccctcctaacacatgctcacattctctaagcacaacctgctaatgtccttattgctcttggccgctgattcccgtgtttatatattttaatttcaattttaaatgggatctttgctcttcaacaaacaaaattaatcatgcagcgaaagcatgcaaaaagcctgcgatttcacatgctaattattctcggccttggcgtttgctcttgggtacctaattaaatcatcacctaaattttgaattgattagttgcattgagcatttgagtgcaattcctgcacagtgaggatgacttgaccaactgaccaatagcaaggctcgtttctatcatgaacttttaaaacaattagtaattaattaataattgcacaattaattaattgctagtgatgacatggcttgcacaagcgcgatcattccccttatccgattagtgacaagagaatttggtcaagatatattctccggtcagaatattcataatgttcttgtaatgaggacaaaatccaaagttgaatgatccatattagctgtccaccggataaaaaattggagaattttccatgcaaggcacgctgcatcgttcgagaactaaaatttgacttcgacaatagaactgcgcaagtacaatttaatttaatttaatttcataaaattgttaacaaatataatttgatttaatatgtgatctaaatgcgaacgaaacgt

SEQ ID NO: 5354 - DNA, 1501 bp, Oryza sativa
gggctgtatcattcgttttttggtcccttggattttgtttgagattcgtgctatctaaacttttgttttcttttgtatgtgggcttttgattattgtaagttcgggcttccatacgtgggctaaatgggcttctttttttttttacatttttgtgggacccactttgtgttgccgacagagagagatttttttgtgagagagtgttaatggtgggacccacatacactattcaaattttgaaatccgcaccggagagagagattgtctgaatcagactagagagagagagtgagagattcattttgctttttgcctttttcctcgtcgtctcgtccggcgatttcggcggagatttcgtcggcgactccgggaagcgacgacgcggcgtaagctacgccgcggtgtggattcatgcaggctacgtcgcggcggtgattccactggagtttgcggtgtgggcttctccatcttgtcctcgagctccttctcctctttttctccggtgagtatgttttgattcttctctagcttcatttgttagcttgctgctcgattcgttgttgttttgctccgctagttgtgcttttgccgatggagagagagagagagttatagaaggagaggttgacgatttcgtcgtctcgttctcatcgtctccggcgacgcggtggcgatttagcgaggcgacgaggctgctcttcggcgagtcgactcggcgtctgctgctgttgcggaggtgtcgcgccgtcgattgcgcaagattattccagtggctttcctttttgttttttttttcttttttgttcatttccatctcctatttagcatgctacatgttgtgtttcgttgattctgtagtactagtcattctagttttcgtagatctgagcaccttttgtttcggtgtttgtttcattgaatccccatgattcgtgttcgattttgcttttgtgattttttttaggtttctgtgatatatttgttcataaatttgtgctatgcgatgttctagaaagtttcgtttatgtgatgtgtgatgtgtgatctgtgatatgtgatatgtgatttacgaattgtgctatgtgatctgtgatgtgtaaagttagatctagtttttcccatgggaatttgagttgattctatagttgctcccttgttctccggatgttaggttgtgatttgttgaatctgcgagttgctattttagtagatgcgtgtgatttgttttgaatgatgtttgtgaagaagtttgctcatgtttggatttatagaagtttgtgttgcattattttgtatctctgactatttgtactttatttgtagtcttcaactatttgtttagcttgctagctgatgaattattgttagctgtagatctgatagtgaattattgctgtgatttatgtattgattatgtttctattttccctgtgtgctatgcaatgttctatttctcatttcattttttccattgcttctaatatgtgcatccttataata

SEQ ID NO: 5355 - DNA, 1501 bp, Oryza sativa
atcttttaaggacgtcaatgacatttagcagtggagatatcaacggcgaagcctagaagattgcccgacaagcctgggagctggctccgctgctacttcatggcaatatttctgaccttctcttgcatccaagagctatgatctccacttactctctgcctatccttactttgcaaatgcaatgaaaccataagcccaactaaaatacctttgccttaaacaatctcgtcaggtatgaagatatgctacctccttttcacttagtggaaatactgattgccacacaattgtacttaactattgcagttaattatctcaattctcaaccgtaccggttttgcaactttatgccaaagccacatcattcactctctctcccccactaacaccccaaaaactaatcttgttttcaccaacatggcctcacctttaggtcaaaatcaagtcaaacacctttctccagccttgtttatcctcacattttgtagagataaccacaacgagggtagagagagagagagagagagagagagcactggcatatactccgaaaattgttaattagagcatgtacgctgatacagaaataggttttgagtttaatttcttgctcctcaattacgtttgataacagtattgccaatagacaatagagacaagtttcaatactatctagcccgccaactagtggcggagtcattgcccggcgaccctaggcagctgcccaggctcgtcatcgatcactcaatagaatcttaatacttttgcaaggattaaaaatatatttctttagcaaatactatatttgtctcaaaataagtttatttttcatccatctcatactgatatataaaaacaaaaaaagattagaatatctctgctttatcacatcgcaatacaattatttctcactttatctactttaaatataattattcttgcttttacaaactccgatgtgacgattattctaaaagtgaacttattttgggtaaataggatgagctaaaaatgaatttattactgaatggaggaagtacaaacgtagtttgatttagctagcctctaaacttttttttttggctctggcattgccgccaacacaaccaaacaaccaatcaaagtaaaaaaataatactagaaattttttttaaaaaaaagtctggataaggttttttccgaacacgcaaaagaattgcacgtcaatatattaaaagaaaagagttatagtgatacgacgcaattagccagaccggcttatgccaggggaaggaagaaaaagctaaataagaaaaggctgaacaaggtaggcgccattgtgttagttgcatggtcactgggcaatgtcaaagactcccaagccctatatatatacacacatgtatggcagtgcctagtgcacacaagccgccattgcagctgcaagcaaggaacaaggccaagaacacctctcctctactctgtcctcctcctgttcgtccgaggtcgatggcaatggccg

SEQ ID NO: 5356 - DNA, 1501 bp, Oryza sativa; identical to SEQ ID NO: 4605

SEQ ID NO: 5357 - DNA, 1501 bp, Oryza sativa
tggagctgtggagcagaaaaacccagctccacccccgtagttcagtttttaggagtacctctactagctccactccaaaaaaacagaggatctggaccgtttggcacaactccggctccaggtaagttgagttgggagctagagctgtgccaaacggggcatatctccctcatatgattcttgtgttttttcctacggtccgagcaaacggtaatttctatgtttttcctgtgttttgcaatcctctattttatactttcattcatgttaggatcctgtgtttttcctattccttcatttttttcattcctacgattcaaaggggcccttaagcttaaatgataaggtggaggaaagaatagaggataggggatgtgatggaatacgcgtaggctacgatagcataaatcaaaattttctatcatgtaaaccaggaaccatgcaagtattagatcatagatcgttaccactcgacgcgctgcgcagcggaagaatgcgctaagaagtcgaagaaactcccgcgaagtagcgcacgtcgatgtagaggaagtagtcgatcgcaccggctcgaccttctcctcctcgtgcgttcccctcgccgtattcccacgccgatcagcaccgcaaagtagtggcgcctctaccggtatccacacgtacagggacggaacgccacgcgtagatgtgctagcacccgtgcgtgactagggttttgctcggggaggggagtgacggctagggttttgctcgtgatgcaatacctccgccaatcacacctctcacgaatatataggatctatgactcgagcctccaaggcccataggactcctattcggatccctatccgaattaagctcatattggatctccatccaatccccttattccggcccattaagcgtacgatcctggaggttcatgtacactcggctgtaacccgaaaactcattttcggtccacgtgtcaacaacggcccctagcagaacgtattgacccaccgagcatacataaagatcatatcggctgaacctctagtgtatacttgtatgaacccctttgcctcacgatatcgattaagctcaaggttagatatgtgccatcctctaatagctcaatcgttcactcgaacctgtatagattatataacttgtgattgactcctcaatcacctttggcatggccatgcacttccataatctacaacatcaaggggcccaccacatcccatcttgattattcatatcccactacatgtttcacaacatacccgaaaactacttttataactacccaattacggagtagcatttagcagtccctaggtaagctactacacatgttgggaatcatgataatcttaggtctaaggattcaacaccagcactaaatgagatcactgatgacacaacacatatagcttttgaagtgtctcatgttgggtctatccaataacatgttccccaacatgtgtccacattattaatttggtatctctatact

SEQ ID NO: 5358 - DNA, 1501 bp, Oryza sativa
cgaggacggcggcggccattgccatcgacctcggacgaacaggaggaggacagagtagaggagaggtgttcttggccttgttccttgcttgcagctgcaatggcggcttgtgtgcactaggcactgccatacatgtgtgtatatatatagggcttgggagtctttgacattgcccagtgaccatgcaactaacacaatggcgcctaccttgttcagccttttcttatttagctttttcttccttcccctggcataagccggtctggctaattgcgtcgtatcactataactcttttcttttaatatattgacgtgcaattcttttgcgtgttcggaaaaaaccttatccagacttttttttaaaaaaaatttctagtattatttttttactttgattggttgtttggttgtgttggcggcaatgccagagccaaaaaaaaaagtttagaggctagctaaatcaaactacgtttgtacttcctccattcagtaataaattcatttttagctcatcctatttacccaaaataagttcacttttagaataatcgtcacatcggagtttgtaaaagcaagaataattatatttaaagtagataaagtgagaaataattgtattgcgatgtgataaagcagagatattctaatctttttttgtttttatatatcagtatgagatggatgaaaaataaacttattttgagacaaatatagtatttgctaaagaaatatatttttaatccttgcaaaagtattaagattctattgagtgatcgatgacgagcctgggcagctgcctagggtcgccgggcaatgactccgccactagttggcgggctagatagtattgaaacttgtctctattgtctattggcaatactgttatcaaacgtaattgaggagcaagaaattaaactcaaaacctatttctgtatcagcgtacatgctctaattaacaattttcggagtatatgccagtgctctctctctctctctctctctctctaccctcgttgtggttatctctacaaaatgtgaggataaacaaggctggagaaaggtgtttgacttgattttgacctaaaggtgaggccatgttggtgaaaacaagattagtttttggggtgttagtgggggagagagagtgaatgatgtggctttggcataaagttgcaaaaccggtacggttgagaattgagataattaactgcaatagttaagtacaattgtgtggcaatcagtatttccactaagtgaaaaggaggtagcatatcttcatacctgacgagattgtttaaggcaaaggtattttagttgggcttatggtttcattgcatttgcaaagtaaggataggcagagagtaagtggagatcatagctcttggatgcaagagaaggtcagaaatattgccatgaagtagcagcggagccagctcccaggcttgtcgggcaatcttctaggcttcgccgttgatatctccactgctaaatgtcattgacg

SEQ ID NO: 5359 - DNA, 1501 bp, Oryza sativa
gtccgtcgtgtcgccgtcgtcttgagccccgcgccgccttgtcaccatcgccgcgcgccgagccccgtgccgcgccgcgccgtcccgtcgacactccgccgtcgtcgtcgcgtcgcccgtcgccctcaccgcgcgccgagccccgcgccgccccgagccccgcgccgccgtcgcgtcaccccctcccttctcttccctcttccccttattccctctctcccctataagagccaccgttctcccctctcctcactccatcttcctcctcctctccctcttccccctctccacgcgccgccgcgtcgccgccttcgagccgccgcgccgccgccctcgttctatcgtgccgccgcattcgtgaccgccgcgccgccgcctcagtgtgccgcgccgtgcgccgtcgtcgccgccgccgtcgtcgccaccgccgccgtcggtgagccgctgccccccccccccccttgtttgtcgccgtgccgccgggtagagagggagccaagaaagagagaggaagggagaagccgagggagagaaagaagagggaaggaggagagaaaccggaaagaagagagagagaaaggaaaagaaaagagagagggagaaaggagaagaaaagaaaagagagagaaaggaaaagaaaagaaaagagagagagagaaaggagaggagagattagagtgggccccacgtgtttagtgaatagtaatccccttcttaatctttattagttgagtctattacatgtgggtccgggtggttaaaaatctaattatagaagttttatggtctcgagtttatgacatgtgggccccacttgtcattagctcttcctatttccctttagaaaataattcggtaggaaaaaggaataaacccggggtcctacttgtcaatggatatgtcttggattaaaaataaatcgtttatgaacagtagcttttcgcaatttctcggattaattcaaatttgaatctttacactagcataacttattcattttaactcggatttgagtgaaacttgaacctaaattcatctaaattcataagctttccaatgatatataattcactattcaataaaatatatttataattataaattaattaatatcaaatgattagataatagttaacctaaatagtgtgccaataaataaaaaaatggatattgtatagtagcataattatctttaatatgtcttgtcactgtagcaaccaaataaattagttataatcaatccttcaaattaatgggtgtaaaggaaaatattagtgccatttactagcctatgtccaaatataactaattccatgacttataaattatttacataaagtttagcctcatattttgtaactaaaatataaacacacatagatgagtctttaacttgtttaggagagtaatcacagagctagttgtatttggaccacttaaaaaaattagttgatacaatgtcatgtgaagtagaatatatatatatatatatatatatata

SEQ ID NO: 5360 - DNA, 1196 bp, Oryza sativa
actggtaattgactttctactatgaacttggaaaccacgtccttagtaacaattgtgctggtttatcagtaccgctgaggaattgtattcccaggaatcctgttgtattagcacaagaatagtatagaattttcatctgataggctaggagcagtgatgccttgtggtactgatgccttggctcttccattcctcaatgtttctttgatccttaacaatctgcaaatcttggttttggagccacttcttccctcgtcctatcaaaagaagcaatgatcattagatataatttgatgggagaacagaggactctattgcattgatacaaggcagcagccaaaactacaccagtcttatctgattgaatgatgtagctgaggaccatgtaacatagtgaatgatgcagcctgtgacctgggtattgtatatgctcataatgcaaaggcaatttgcaaattcaatccatgctgtttgacagataaatatgtgcagatgtcaaatctttgtaaaaagggcaggtgcaaggcaacttaacaacttcaccctgaactatgttactgtactcagtcaattcttcaagttgaaaggactcaacacataatgtctgtagactgcagtttgtagaggcaaaatccaggcaagtgcagaatagaaccataatatgcagcaacactattccagtattattcatttttctaatttgcattttcttgtgatgctcttggtaaggccgaagaggacggaaaaggatggaggcatcaattccttcaacccattcatacccaacaattttcctggtgattgatagcatggtggtgttttagttttgctgagaacagggtttgatgttttccatgcttggcttggattcattacccaccttctcctccttgttggcatattatacggctgatggctgttacaaggaaaataaacaggtcatgttgcaactggagcaatcaaagtacttctagtactggtaagtattactctaggtgtccttgctctacatgttgacaatactagcacgttcataattaaagaaacttgccaggctgctaaaatgcaaatcgctgtaacattctgtgcacacgatgcacttttcatgtccaaagataagtctactaacttgcattttttatgcagaaaaagaagaaaagaaaaaaaaaaccaaacagtcatccggaggaattgtc

SEQ ID NO: 5361 - DNA, 1501 bp, Oryza sativa
ctatatgtttgattgacatgttaaatctaccctttatgttaagatcttgtcgcatctaagtatattaagcttatgtttagtatattctacttgctttaaaatcttagtatagagtagtatcggagtattagccgatacatgctagatctacctgatcggctatgttatgaatgtatataatcctactattaatatatatttcgatctaagtgatttatactgtctcggcaaggcgaccgatctatcccaatcattttatttaagtatatatcgatataaggattatatatcattagtatctacagccgatcgagtagatttagttctggtttgcttattgatatttgccgatcgatgtacacacgacatcggcttgaaataaatgatatgtcatcggcacctagccgatcggctatcatttataggattaattgtggtttctttgttctatttcttgttaattgcaagatcaaatcaactggcatgctcatacatccgaaggcgagctttggacctgcactggagttaagcagatctcccaggcctcgtgttttctgtcaacacctagccatgtctaactcttatcaccttgatcgccatctcggcctaaccatgccttcgccgccctagccgctagaccgtccacgcatcaaattaactcctccaccgccgctcgccgtcgccggagatccctagctccctcccctcctcggccgcaaccactttctccctctaacgccgccgcaatcctaaaccctagcaccgccgacccgatttggggaacggccgaaggtagaagaagagaagagaaagagagactgacaggtgggacccgcacacagtgccatttcacatttatttgattttcaaactttagaagcccatatcttttaaaatatagatccaatcccagtgaaacttggaccaatattcttctaaaatcattctctatcttttaagcccctttttgctatttttgcattttattttattttctctatttttcatatttttggattttatttgaattccttttgaatttgaattttatatgtctaaccctaggtcttaaggattcctctgacactttagataatatcaatcaatctcaggacatcgagcaaggcaagttaccatatacctgttgatcatttaagcctatattttataaattatttatttatagcattctattcaatattctattttctatgcataaattaatcatagaaacccagataatttagtattgcttattttgcttacaatctggttaaaacaccctatacttagattgggacaatacgtaagatttggatgatttccgggtggctagtattgtctcaatcgacataagttttaccaggtacttatgtcgaacgaacgagtacgaccgcagtttctagaatggggacagacctagttattaggttaattggcaatatggcgcctctgtatagtggttcttatttttaagtcctcgcgcaggaggcaactatag

SEQ ID NO: 5362 - DNA, 1501 bp, Oryza sativa
attaagatatcctgctttgaaaagggaagcataaacctttagcatcagcagctgcatcaatactttagtcccttcaaaatttataatgatacatctcatttcaaaatctagaactaagccttggtagagatagttgcctgtgatattttggaccaggaaccttcaactactataagatatataagcatattgcactctcatgtttggttgtttggaatttatgaaacatgcaaatgttacttcagaatacaataaataacttacatacagtacattatttttagcctgtgtacagtgtataaggttatcaaacattttaaaattgtggaaggcattatacacctttcaaataatggtgcaccaaaaggttgttgtcttctttaggtagttttatggtttcatggtagggatttagctttggtgtatctctcaatccctgcactacccaatttgtcaactggttttgtgatcgactttgtggttcatgtattttgtggaggcctttgtgatccaaaactattaaaacttggggcagtttccttaactcatatatgcttctgaaataactcaaatagcacatatgcatatcaagtagaatgcgatcttgagtgttttctagcttatactctccagtccagattttagatttatgttttggcattgccaaattttggtggagatggaggtgtcttgtaggtttcgatctgagtgtttggtatgctaccaaaatgagtcttacattttttttttgtagggtagaacagagaacctaaccagtcgtttattactctgattctgtcatatttctctatcgatagtctagatgtgtcttgtatattttactcagggtaacaaatgttgttttaatattttacttcattcaaatttaaggcgctcatgtttaacgtcaactgaagtgactcggttgttgttttgtttggttggttgatagtgggaaggagacatctgagtttcaaattgaaccggagataactctggagctgatgatggctgcaaactatctggacacctgatgagatgaggtggaagtgttttagcaggttttttttgttgttgataaggaagcaatcccttggtgtgcatccccatttgagtgatgtaaacattagaggattgtaactgttgtgttgtgttgtaatatgattatgtgggtgcttatggaggtatccctgagactttggatggcaaaggccttttgtgtgcacaaacgggtttgttacattacaggaatggacattcaagttgggggccggcttggtatgttttttttttctatggttgggcgagatggtggaggcggcagcgtgcagtggcagaggagattagagtaatacggagagagcgtggggactaatacagactgttgaatgtgaggggcagatttttatttatattcctagcaagcaaagctgataataaagcgattagttgatatgagaaagagatagtatagcgtagcagcaactataatatactatat

SEQ ID NO: 5363 - DNA, 1501 bp, Oryza sativa
acacacccattttacgagctggtttgtgatttgtgatgttgcgtttctcgtacaacgcatttggcatgtactttcatcatcctaaaatagttgttttctagtacgatttaaactttatcttaaataattatcactttgaagtagtacttgctcccatcaacaattaccattattcaaatttagtatgtaaataaattagaaaagatggaaccttatcgatctctaccaaaaaattttgatagatttaaaaccttccactcacctaacaccattaaaatttggtaaggtcttaattaaaacctatcgacgattacggagtatgtgttttgagtaaatctggggttgtgaatctataaacccctcctctaagaagatgatcacacctaaattaaaagctaagacaaatcacatagattagcaagtaatcctataaacctatacaaatcatcgccacttagtgaaattaaaagctaagacaaatcacatagattagcaagtaatcctataaatctatacaaatcatccccacttagtgtaatttaatggtattttcctgctttcctacacttccacatcaccacaattcttttgcaccgtccgatatcaatcatgaggaatgaaccatccgaaacaaagtaatgttcgtttagtgggccgaaacaaagtccatattgtggtggctcgacagggcccaactatgcttcggctgggccgagtaacgtgaaaccatcccattatttgagccgatatgcggaagtggattttttgtccgacatccggttgttttgtgcatagcattaaaaaagtaatcaaaaaattttaaaaaattatgaagatatatcaatttcacaaacatgcaagttaaaattcgacttatacaattcgaaacaaaaataacaaatatgaccatgaattacgtgttttattcgtagtcaaatttattatttttgtttctacttgtataagttgaatttaaatatgcatgtttatgaagtgacatgtcacatattaatctatcatactattttttaaaaaaaaattgataacttttaagtgacatgtaaaaatgagggaatatcttttggatgaatagagttttccctgatatacacacttagctctcctactgtgagaattctcttccgatgctaaaaccgattgtcggcttgtgaattcgtgaacatcgcttttcttgggaataacaatagaacgtaccgttttgtaaattgtaagcacagcacagcaatttgattggtcgatacaagttaccgtgccggctgcatgctcgatgtaaacaaagacacccgcatctgtcaacagcccctgccaacttttgcctaagcaagcctgtttcgttaccagcttcctcccaatcgcgtgctggcgtaaatctggtgacatcgtagaagtggggcagctcgttcgctgtttataaagaccgacgcagtcacgcacacaaggcaaggcttgggaagacttgggagaagaatggccgggaaaa

SEQ ID NO: 5364 - DNA, 1501 bp, Oryza sativa
ccctcctcttccattcgtctccgcgccatagccgccgccccgtgctctgtctcacctccgccgtccttcgccgagcgccgggagagccggtgcattcgaggacgcggaaggggacttcggccgcgccctctccttccccttccccggcccgaggccggagagattactcacgcgtcgtcggcctctcgtcacagcgcccctcctcttctcggtgatgtctctctccgttccccctcctcgctccgtctcctccccctagctttcggtagtagctcgagtagaccccccgtagctagccggcgccgccccaaccgttgccttcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacccctcgtggcctcgtcgccgtttccctcttcttccgccgccggttgccgcctccgcaatccgccgccgtcgagcgacctccggcgaatccgagccgttggctcgcctccccctgtcacgaacaactgcccggtgtgctcgcttttgcccgtatctccgtggttcgctccgccgctcgccgccgccgcccgccgtccattcgcggccgggtcgtcgtctacctcccgccgtcctgcgtggcagccacgtaggtgccacgtcggcgccagctcagcttagaccgggtcgagccgaccccggtcggtccctccccgtgcgcgcgttccaccgcaagccgtgaggctgcgcgtgggcccgtcgcatctgcgtccgccgcggaccgcgcgcatgcaccgcgttcctccccgcccgcgtctaaatttcctccctccttccttttctttctcttttccaaaaaggatttaattaaataatcttagaaattcaataatcttagaaattctatatcttcccaaccgtaaatccgtttgactccgttcaacttccaaaattcatcaaatctcgagatctatctagtggcacgctcagaggtcattaatagggctttattttcgctgtttgttgagttgccccgtttcgcgtgtagtttcggagcccgaagacccgcagtgcgaggatttcgaggatcaagctccagatctcgagcaaggcaagccacctttgaacaccttgagcctatatttgaaatttaattatgttgcttgcaaaatattatgcattgataggatcacacttaatctgttgtcccgtctgcgaagcagattggcggacttacctaatttgtcgcatttgatccttccattgttaattgctataccatgtccccttgtaaccacccagttgcgcctcgatactcgcgcactctgtgcgagtaccgacggtcgccttcaaacttaaaatctgagtaacaacttgggtaaaactggagttttacaaaagacttggaaaacccgacacttgggtcggtgcttgcgaac

SEQ ID NO: 5365 - DNA, 536 bp, Oryza sativa
gtcttgtgttcatttgattgtatattgtactagtgctactactacgtggagagcagagcactagcagagtgtgagaaagataaacaaggaaggcagatgtggacggagggagggagggagggagaggggcaagtgtgattgatgcacaaacaaacagctcaagttgaggccaggtggacgtgcagccacgcaagacaagacaagcaaagcaaagcacgagaggagcgagggcgaggaggacacgacgcaccgcacggatcattcattcattctctcctcctccgttcctgactccaccactcacattcattcccttctctctcctccctccctcccccgcccctctgctcccctcgccggcgagcccaatggcggcgtccgccctcgactccgcctgggaggtacgctaccccccaagtccccaacccaacccaaccctttcttctacttttcgatttgctcttctcatcatagattagattatatacgatatgatacatggatagatagatctctcatctcatcctgtcaacaat

SEQ ID NO: 5366 - DNA, 1501 bp, Oryza sativa
ttgagaaacacacacaaaaaagacgacaaatctaacgtataaacagtaccgacactgtgtgtagattgaatttgaactttggtggaaacagatgtcacactatactctacaattgtcaaattttatcaaaatttttcataaccatttatattagagaaaacgatacacacaaaacattctctcaagtgattaaaatcctctttttggcgacatgtacctctcattagctcatcgatgatgctgtataatcgggtgggagcacctcggatgcctttgcctattgaactgtcaacaacatctagctatcagtgtttattctctttcagtggactcttcttcgaactgaattattacctgaaaagattttagaagaaaaactattaccggcatttcaatgaaaacatgtacatatatgcatatgcaagagaatcaatttagaattccagattcgatggagacacactaccacctcgatagattaggatgactagctagctagctaggattgccttgaatgaattgcagagacacatcaatgaccagttagttaagatcgaccaacaaatatataatttaaaaacatgattttgccggacaacgcattctccaattatatatatgctcctggattttacattttgtccaataaaaaaacatcttaattacaccactggtgtgagagaaattaatttgcttccctctatacatatataatagcaaattaaataatgaattaagctacatattttttcctctgaaattaataaacccaagaaggaaacgaatgaataaattaaagaggagctagcaggccacatgtgcacagtgcagtaaccaatatatacctaaagaacaaaacctgatcgaggagaagacatgtcatccaatcatacactgtacgcgcacacacacatgagacatatatacaccgatctgatctgatccaatccttgcttaattcttctccggctggccggcctctcctatagcttagcttagcttgcgagacttcgttccactagtcttctcctaatttcttcctcctgcaaatatgcgtagtcttctgtcatcgtcgaccgtcaagtgtgtctctcgctgcacacggagatgcatgcacctcttgattgattgctcggtcgactgattgcttcttacacaccgcaactcgctctaattagttggtttagcctgtttagatttgtagtattagaatcgtcacattcaatatgtactagatttatttattttgagacgagctagagccgcttgattattgtcgatcggtactagctagtgctacttagtaagccggctagtggagtactcaatctctgctactactcggctagcagctggctgctgctgcagcagtagaacatcaagagaggaggttaattagctagtacgtagtaccttggctgctttaatgaactcgatcgatccacagctagctagcatagcagagcagcagtaatggaggagcaaagaggcgaggaggagt

SEQ ID NO: 5367 - DNA, 1501 bp, Oryza sativa
aaaccctgtaaacaacctgccagtgaaatagtcatacactaattgatgtcacatgttgaccttttctttatccccttcctctttgtttcttctttaattttcaggtgttagattatatattcgcaaggattccattgcatattgtttaccgatgcaactgtcgcaagcaagggtgttcaggagttctactgcacctgacaaggggaacttatttgtttacagtagtatcgactcatgccatgttgagaaggtgatcagatgttcagaatttctatgaggaggattgttatgataactggtaaatgactttctactatgaacttggaaaccacgtccttagtaacaattgtgctggtttatcagtaccgctgaggaattgtattcccaggaatcctgttgtattagcacaagaatagtatagaattttcatctgataggctaggagcagtgatgccttgtggtactgatgccttggctcttccattcctcaatgtttctttgatccttaacaatctgcaaatcttggttttggagccacttcttccctcgtcctatcaaaagaagcaatgatcattagatataatttgatgggagaacagaggactctattgcattgatacaaggcagcagccaaaactacaccagtcttatctgattgaatgatgtagctgaggaccatgtaacatagtgaatgatgcagcctgtgacctgggtattgtatatgctcataatgcaaaggcaatttgcaaattcaatccatgctgtttgacagataaatatgtgcagatgtcaaatctttgtaaaaagggcaggtgcaaggcaacttaacaacttcaccctgaactatgttactgtactcagtcaattcttcaagttgaaaggactcaacacataatgtctgtagactgcagtttgtagaggcaaaatccaggcaagtgcagaatagaaccataatatgcagcaacactattccagtattattcatttttctaatttgcattttcttgtggtgctcttggtaaggccgaagaagacggaaaaggatggaggcatcaattccttcaacccattcatacccaacaattttcctggtgattgatagcatggtggtgttttaattttgctgagtacagggtttgatgttttccatgcttggcttggatacatcacccaccttctcctcctttttggcatattatacagctgatggctcttacaaggaaaaataaacaggccatgttgcaactggagcaatcaaagtactagaagtacgcgtaagtattactctaggtgtccatgctctacatgttgacaatactaacacgtttataattaaagaaacttgcctggctgttaaaatgcaaatcactgtagcattctgtgcacacaagaagagtgatgcacttttcatgtccaaagataagtctactaacttgcattttttatgcagaaaaagaagaaaagaaagaaaccaaacagtcatccggaggaagtgtcttgt

SEQ ID NO: 5368 - DNA, 1501 bp, Oryza sativa
ttctaaaccctgtaaacaacctgccagtgaaatagtcatacactaattgatgtcacatgttgaccttttctttatccccttcctctttgtttcttctttaattttcaggtgttagattatatattcgcaaggattccattgcatattgtttaccgatgcaactgtcgcaagcaagggtgttcaggagttctactgcacctgacaaggggaacttatttgtttacagtagtatcgactcatgccatgttgagaaggtgatcagatgttcagaatttctatgaggaggattgttatgataactggtaaatgactttctactatgaacttggaaaccacgtccttagtaacaattgtgctggtttatcagtaccgctgaggaattgtattcccaggaatcctgttgtattagcacaagaatagtatagaattttcatctgataggctaggagcagtgatgccttgtggtactgatgccttggctcttccattcctcaatgtttctttgatccttaacaatctgcaaatcttggttttggagccacttcttccctcgtcctatcaaaagaagcaatgatcattagatataatttgatgggagaacagaggactctattgcattgatacaaggcagcagccaaaactacaccagtcttatctgattgaatgatgtagctgaggaccatgtaacatagtgaatgatgcagcctgtgacctgggtattgtatatgctcataatgcaaaggcaatttgcaaattcaatccatgctgtttgacagataaatatgtgcagatgtcaaatctttgtaaaaagggcaggtgcaaggcaacttaacaacttcaccctgaactatgttactgtactcagtcaattcttcaagttgaaaggactcaacacataatgtctgtagactgcagtttgtagaggcaaaatccaggcaagtgcagaatagaaccataatatgcagcaacactattccagtattattcatttttctaatttgcattttcttgtggtgctcttggtaaggccgaagaagacggaaaaggatggaggcatcaattccttcaacccattcatacccaacaattttcctggtgattgatagcatggtggtgttttaattttgctgagtacagggtttgatgttttccatgcttggcttggatacatcacccaccttctcctcctttttggcatattatacagctgatggctcttacaaggaaaaataaacaggccatgttgcaactggagcaatcaaagtactagaagtacgcgtaagtattactctaggtgtccatgctctacatgttgacaatactaacacgtttataattaaagaaacttgcctggctgttaaaatgcaaatcactgtagcattctgtgcacacaagaagagtgatgcacttttcatgtccaaagataagtctactaacttgcattttttatgcagaaaaagaagaaaagaaagaaaccaaacagtcatccggaggaagtgtc

SEQ ID NO: 5369 - DNA, 1501 bp, Oryza sativa
taggcttcaaagtttaccagctttccttacaaattcttgtagtactacatatttctcggtagtgttcctttgtttactggaatagcaggtctgaaatactgctagtttggttcatcattccatgtgctgatatggtttgataattacagactgatggagtttgatctgtcctttttcgttaggtgactaggagtatgtcttttgctatgtccttgaagcatctgcttgtatattttagccatgacttctggaggtttaggtagtaggaccgtaggagtaattcagtaataactagatagtagcagttaatatactagtcctaaataggagcaggatataatttgttgagttgcttatggagaagaagttgttttcaataagagggaacaagttgattaagtttcccgattgcttgggacggtcaatagcagcaaacgatttggcatactagtaccagtagtataatatatagaagtatattgggttggtgcaacttcgtccattttgtcattggcttcaataaaactagttgtagtacagtggttgcataaataagtatttcagtaaattagtcctaggtgcaccatgatagtggtgaatttaaaataaagcttcagattcatactggtattgtagttgcttttaatttggtcttgaaaagaaaaccaaaccaaacctgcgacacaggcaggcagctagagggtagctgctctgctcgatccattccattccatgccgccgccctccttcccatcatccttaatccttcaatttaattgcacttgattaatagctagtgatagtggaaggaactggtaggcaatggctaccacgccggaggcggcggagtccctccgattccgatggccggcagcggaggaggagttcgacaacgacatggtcctcccctacatctcccgcctcctcatggaggacgacgtccacgaccacttcttctaccagtaccccgaccaccccgccctcctccgcgcccagcagccattcgcccagatcctcgcctcctccccctcctccgccgccggcgcctcgtcgtcgtcctcctcctccgatgccccgcccagccgccccttcttcgatgacgaggcggccaccgccaagactttccccactgctgcggtccacagcgttgaccaccagtactccggcggcctcgacatggtcaacatggcgttcctcaagggcatggaggaagccaacaagttcctgcccaccaacaccctcctcctctcgaccgactcttctactaccttgcagttgcaggttcagggtgaggtagtcgtcgacggacatggaatgctcgggggggtcgggggagcagctgcagctcatgctcatggtgcaatcaacagcaagaaagtcaactgcagggacgacgacttggaagctggcactggcagggccaccaaactgatggcgcccgagccggagctggaggaggaaggtgcacgccagatgttcgacgaaatgatgctccaggagc

SEQ ID NO: 5370 - DNA, 1501 bp, Oryza sativa
catatgaaaaaaaagagagatcttaattctgttacgaccggtgtagaaatccttaacactccatctttaaaatcagtcgtggattagatccattttgcaagtaacaatctttaacatatccaaaagatgcaagaatttctatagttaatgaagctgactttgttgatcaagactctaaacccgtgctatgcatatataggctatacaagattctaaactaatttaattttatgtagcataataacgtgctacagatcattaattgtatattctcgcagtatattatcttgaagtttgttatgtagtcgaactttaaggagctgcaggtcacttcaggatcaatggcacccaagtacccaaccaagaagtactacgatacaaaacttaaagcttgcagatattagttaatactacattcgtcccaaaatatagcaatttttaggtgttcagatttatagctaaaaattgctatatctgtgtgtttagatttatagctaaaaattgctatattttaaaacggaggtagcagttatttgttttacaagcgagagatatattaattatgatagcatgattaccaaagtttctagctattattttttaagaatacaacgttattatgatgttcgatccaacacgagagggatctaataagatcactttggacaagcagcatgatcgatgattcgtacgttggagtataaagaaagtcatcatcagttaattatctggctatataaagagagagagagagaggtcgatcaatcgaagcaagcaatcaagcatatgcatccgtggatctaacactactgtatcaattaagtagattctctatagcacttaactgcattgtagtactacactgggtagcaagatgctcggctaattactactccatccgtctcaaaatatcataataactttttcacctacattatcttctcaattaatcacaaccttacaccattcaaattcttacctactttcttttcttaatcaatcacaaccatccttcatttaatctcacatatttttttaatacctatacataagtctaaaacttcttatattttaggacatagtttgtgctagtttaatactacctccgtttaggttataagattttctagcattacacacatttatatagatgttaatgaatctaggcacacatatatgtatagatttattaatatatatatgaatgtggataatactagagtcttatatataatatgaaacggtgcaagtactaatatgttgagcaaatgaatgcaacaaaattaagggacccggcaccatgctgacccctattttggagacacacacgtacgcgtggcaagcaaattaaactggttaattactcctatcgcgatcctcatcatggccatgcatggggtaacgaattaattaagctgctggcttgggtatctcactataaatacccaaactggccatggtttaagcaaaaagctagctactcgattcattcgccgctagc

SEQ ID NO: 5371 - DNA, 1501 bp, Oryza sativa
attcaataaagcctaatagtaatttatagaagtaacttataaaaaagaaagtaactttaatgcatgccttttttcattgtggacgtgactacacagctagtggtagctggtttgtacacagctagtggtagctggtttgtactccatctagtgtctccttttaacttaaaaaatgcaatagtatgtatctttttttaatctctttaataaattatatattttaaatcacgtattatttttaagatctatttacatcattgtactccacaccaaaatatgtgacaaaacgagattcatattgaatatatttgttgtagcaaggggtaaactttgccccccaagtttggccaaaaacacatttcgcccaaaaagtctacttaaagataaaatactcagagagtttcccctaaaatataaaaactcgaatgaagttctcctctttatagaaaagttcttttaggacatgttgttacccaaaggaaacagcgttatgaggaaaagtaaattcgagttaatgtcaagtagacagatgtattcgagccaacatcatccacctgacattatttttcttaatagttgtatccgagcaggttcctatggagtgacaaggcgccaagataatgggaaagtatattcgagttctcgggtgcgaccaagacagctgaaataacaagaaaagaaggaaaagtcttatcgagcaattgactcattcgagaaaaataactatggggaccacttcaactactctaaccagctggcaccagatgtcacctagggaccaccagcaaagtactattatacccctagggcatatggatcactaggggtaatatggtaacttcatgtaagcccatgatggcaaagatgtaaatatttgtggtcatggtcgaacactataaaaggccgaccagagtcctgtagcaaagacacaatgaaatagagaaaaaaatatcttatatacatcctgacatctacttttgggctcactctcagggtaaacgggaatttacactttcccgtttacccccaactctgtttgtgccctaaggtcacaacaatattcaaacattttattaatttaaaagtaatttattacatgttagaaaattaacttcaatgttatcaggaagtaactattacttcttatacatggttaattctcattagttattccatcaatgttatctgcaatccattaaaggttttatcttcttttctcattctacatgaaaaacaaaaatgaaaggaaaaaagcaatcggtgattaaacatatttataaagagttacttctgaaccatgcaaaagttacttccaattaacattgaagttactttcaaaatttgttaaacttacgtgtgttgattaaatttaatttctagataaagtcatattttttatccttacaacaaatttgttgacgtttgatatcgcgattctgttatttgcatagtatgggggatcgttggtgctaggatatatgcgagactgaggtaaaagaga

SEQ ID NO: 5372 - DNA, 1501 bp, Oryza sativa
cggctccgtagttcttgttcgtaaaatcgacgaccttccacccttttgctgttggaccgatgcaaaatctgtagtccgacacgtttggatccagcaggacccaggaaggccatggcgatgacggaggcggagaccgagacgccgccatcgccgaggattgcggtagaggaaggaggggggaggggaaggaaggggaaggaggcggagattagatgtgtgcacggtgagatttgatgggggaatacttgagagaaactccctctcttaataaaattggtcgatccggaaaaaaaaaagggactagctacagttatagtgccatattttttaccaaaatatagtcggcatgtgtttatattgtaagtctctaaattatatatataattttagtgtatttataatgtaagtcttaaaattacatatgtaggtcttaaaattacatatgtcaatcccaaaattatatatgtaagtggtgtgcaagtggggtgtaactaccgtgtaaatttatataaatatataatttacaacaacaaccaaagtttaaaaaacataacagtatgcatctatggcagagtgtcagaaccaatcaccgacatgaaaaaaaaagtaaagcctgtgtgctgatgccccgtgagcacgaatcttcataccaatactaaggctcaaaattcgactgcgtttatgggaaaaatctgtcgccataattatagccaatctgaaaaaaaaaacttgagagagatggtgcgattttgcacggtgatacgatcatacgagtagtagaaagaaaagagggctgagtcgttagatttgggttgtcacggatgtccgattagcggacggtggatgtgtgctgtaaataaagaaacacataaacaaaagcggaaaatctatttcgagagcgctctcggtttagctctatagcacgaagcatctcacagccgtctgatcgtgcacgtcgtcatggcgtccatccacgtggatgtctttttcctcttcaaataaagttctctcaaattatttatccgatctacaatccaattacaccattgtgttcgttacaattaaatcttcacaataagatcttacatgattatattacgatgaaaaaatatttatatttgtaaattacttttattatatataaaaaagttacttttagatttgactaaattatttcttagacatataaatgtaaattcaataaagtctaaaagtaatttgcatatattataaaagtaacttaaaacaaaacggaagtaactttgtcacgacattaaaagtaaattatgtcaggattatggataccacatacctaatagtagtcgactacatctcagcaggacccaccacataccatatcttatacggaaacaaccttcggatataggaggagttacgcataaggaaggatgactagagttctacatggaaacgacaaggactactcggattgtatccatattggtttccctagttctacttggataaggggacacctatg

SEQ ID NO: 5373 - DNA, 1501 bp, Oryza sativa
cattgctaatgagcctaattaaccatgttccagatgtaagttttttcatctccttggtccatacttggaggttatacttactctctggattcaccaatgaagccattcaatttcaggctccagcagtggtatacttggaggaggttgtactcttcagcagagccattctctttatcatgttgtagtctcttatctctgaacttctctgaaacttcaattccatccttgaactttctctgaaatagcaggagcaattcagcactcatgatcatttcttcacttccagctattgcatgagattatatttcactagcactcatttctgacaagacagaacgatttagaagcgagattaattagtaagggagtgattggctgattgcactacagtgagagcaaagaaaccctgacctcatcaggataaaccaaggtctgaagagaaggttagctgggactcttgttacgtgcgcagccagcagccgataaagcaggaaaccgtgataggatcccgtttggaagcgttcgtagctgacaaaatgtgagccccataagctgtcaatttttagcctggactcctttctctacttaagtagaaatgcgccgttgtgttcaaccgtttttcttgcgtgcccaaagggagataccctgatgtcgacacgaatcctctccatcggctgtcgtttcaactgttgctgatgaactctaagagaaccgcagaaatcgattgatgccatctcttttgttctttctttgcgtatgattcaaagaacataacacgaagcgatgtacgggaatttagctggtttttttcatgagattggttatcaaacattcgctcaattcattgcaacaagtacttgtttagctggcagagttgagacttgagagtccccatcgattcaacctgaggccaagagattccaaggtcactgttggaatccacattatctttcggcttgatcctaaccttggttgggaatcactcacagttccatccaggagaacggatggctcacgacaccaatgcaaagtcgataataattcgatttatttcataaggagcacaaatgtgtgcatggcctccatgttcttgcaggtctcactcagctaaaaaaagacggcaacatcatgctcgttatctaatcaatgcatatatagcagagatcgatcgatcgatgtcatccggccgttagcttcagcaaattaaattatgcgtgtgtaggatcttacttcacggctcttttgatcttggaccttcttgctggtcattaattgtgattgctacatgtattttctttaaggctaatgtgatcgtttgctcactgttaatcctgcctaactcgtcttggtttttacatttcatttagtttcctgatgctgcatctgcttctatataaaccccttgctgccttgcagcttttggccaagcaagagctaaaagctagccgttgtgtgagggactgagagctagtggtgcactagctggctgtgaatctagcca

SEQ ID NO: 5374 - DNA, 1501 bp, Oryza sativa
gcatgcaagtatataagttagcaggtactccctccgctccgtttaacaatgtaagaatgttagaatgacttacattgtaaaacagagaaagtatatacgttaaccatccacaagctctattccgggggtccgagattactggagcacgtgcggtgttgggtttagtcgcacatcggtaattgatgatggaggagcacgacttaaaaggtgggggcggtcctcacccatcagactagtcttttggttgtgtaggcccagaacctaaagttgtggctccggttgagcctgtggtggagcagccccaatgtgacctgggtagccacggttagtgggccgggctgcgcactttaacaagcggctgaagaggatgatgatgtgtcgaggcgcacgctggaccgccacatacgacgacgggttgccatggctgtgtgcctttgtccgctggcgacgtggacagatgggatatataattaacgtgtgtgcagatggggtatataattaatgtgtgcgcctttgtccgctggcgacgtgggcagatggggtatataattaacgtgagaactcgtagaaagtgggatatataattaacgtgtgtgcagatggggtatataattaatgtgtgcgcctttgtccgctggcgacgtgggcagatggggtatataattaacgtgaaaactcgtagaaagtgggatatataattaacgtgtgtgcagatggggtatataattaatgtgtgcgcctttgtccgctggcgacgtgggcagatggggtatataattaacgtgagaactcgtagaaagtgggatatataattaacgtgtgtgcagatggggtatataattaatgtgtgcgcctttgtccgttggcgacgtgggcagatggggtatataattaacgtgaaaactcgtagaaagtgggatatataattaacgtgtgtgcagatggggtatataattaatgtatgcgcctttgtccgctggcgacgtgggcagatggggtatataattaacgtgagaactcgtagaaagtgctcaactagtacaggtatacgcactgtgaatggccttaccgttgcgccatgcacgcgaggctgacgtggccacgagcgtccgacgtggcaactttccacgctgtacaacggccaagggcccacctgtcagggtgagctgcgacatcgagctgggagcctgggagggagttgagctgttgatcggtggttgagtggagtccagctagcgcaccgagaaatctcatttggggaaagtttccgaaatccccgattcttctccttgtaggaaaaggcattgacttgccccttcctccttcgatccgcggtctagccagctggttgctgattcgctgcttgttcggattgattcgattcgtcgtccatggatcgtcgtgacgattcttgctgccccggcggcggcggcggcgtctcatctctgatcggagaatttggtaggcatctcgatccgatgatgggtaggtatgcttccag

SEQ ID NO: 5375 - DNA, 1501 bp, Oryza sativa
ctaacagtgaactatactaataaactttcttcttatcgtgtagattattgtagaaatattattttaatagtggattgaaatatttgggtttgtagttcttgtatgtaatgtagtcatatgcatgcatgcaggacacgacatattaagctaagcagatatccgtcgacagcaagttcgtgagttgttcacctggggctcgatagctctgtcgacctcccacacgtacctctgcaagcaggactcgaactgcaagaacgcatgcaagtatataagttagcaggtactccctccgctccgtttaacaatgtaagaatgttagaatgacttacattgtaaaacagagaaagtatatacgttaaccatccacaagctctattccgggggtccgagattactggagcacgtgcggtgttgggtttagtcgcacatcggtaattgatgatggaggagcacgacttaaaaggtgggggcggtcctcacccatcagactagtcttttggttgtgtaggcccagaacctaaagttgtggctccggttgagcctgtggtggagcagccccaatgtgacctgggtagcccacggttagtgggccgggctgcgcactctaacaagcggctggagaggatgatgatgtgtcgaggcgcacgctggaccgccacatacgacgacgggttgccatggctgtgtgcctttgtccgctggcgacgtggacagatgggatatataattaacgtgtgtgcagatggggtatataattaatgtgtgcgcctttgtccgctggcgacgtgggcagatggggtatataattaacgtgagaactcgtagaaagtgggatatataattaacgtgtgtgcagatggggtatataattaatgtgtgcgcctttgtccgctggcgacgtgggcagatggggtatataattaacgtgaaaactcgtagaaagtgggatatataattaacgtgtgtgcagatggggtatataattaatgtgtgcgcctttgtccgctggcgacgtgggcagatggggtatataattaacgtgagaactcgtagaaagtgctcaactagtacaggtatacgcactgtgaatggccttaccgttgcgccatgcacgcgaggctgacgtggccacgagcgtccgacgtggcaactttccacgctgtacaacggccaagggcccacctgtcagggtgagctgcgacatcgagctgggagcctgggagggagttgagctgttgatcggtggttgagtggagtccagctagcgcaccgagaaatctcatttggggaaagtttccgaaatccccgattcttctccttgtaggaaaaggcattgacttgccccttcctccttcgatccgcggtctagccagctggttgctgattcgctgcttgttcggattgattcgattcgtcgtccatggatcgtcgtgacgattcttgctgccccggcggcggcggcggcgtctcatctctgatcggagaatttggtaggcatctc

SEQ ID NO: 5376 - DNA, 1501 bp, Oryza sativa
atactgcaattatcccatcgactgagctagtggtaattaagcatggctaagcatatagttctagctaggtcacataagtaacatgagctagtcgatttatcacccaaggttgacaaaggatagatatcaagtaaacatggcacaagcgagcagataggtaaaccctgatcccatgtaattagcaaaacatgcatatttatttgcaaacggtaaaacatttataaattaggatcaacatgctcaagggggaatgtgcgacttgccttgcttcttcactttgatcttccgaactcttttccttgcgaccgcggacctccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattattcacgaattattgcgcaattattatttattttctcaaaggaaatgacaagtgctgacgtcaacaaaggggaggggcggcgccggcaagcgggccccaccggtcagcggcacaagggcgccggtccaccgtggaccgggaccaccgaggcggtccaccgccggtccacgggaaccgacggcccggatcggcccaaagccgattggacggccacgaggcagcgtggctggggcacgggcacggcatgaagccggctcggccgagacatgacgcggcggcggcaagggggaggcggcaagggggaggcggcaaccggctgcagcagccggcgacgtggaacggcggcgggcggccggaggacagcggcgcgcacggggacggcgacgcaccccaagaggcggcggtcggcaagaaaggggacgggaaaaaaggaagggaggagagatcctcaccggaagcggcggccgacgtggaggaagaggacggcgacgacgattgcccaatggcggcttgcgaggacggagggcggacggggtcgcccttgaccttcaggaggagaagagggagttagggaggggaggaccgatgcggggtgactggaaacgaagaccgatggcgatgacaagaggtagagctcaccggcgaccgaggaaggaggagctccggcggatttccggcgaagaggggcggcggccgaggtcctcctcgtccttgcggagctgagggaggcaacggcgcgagtcgacgtcgaccgaagcggcggcgcgacgcggctggaggcggtgaaaggggcggcggcctcgggtgtgcggtgggagtggtgctcgaggggtggagagggggaaataagaggcggccggacttccccttgcggtggcgaagctggcggtggcggtggctcggcgcggcgacggctgtggcggcgggaaacggcgaccggagctcgccggagtgtggcagcgcgtgggtgcggcgtggggaga

SEQ ID NO: 5377 - DNA, 1501 bp, Oryza sativa
aggaatatgacgtcagccctaggaagagagaaaaagggctagtgtcagatgggacccactcgtcatagatacaagcggtagactgggtctaccatgaaccaagtccacaaagatagttcacgggtccacgggatggatggctaggattgctttgacaggcctttgaccacgatctgacaggtgagatcaaatccaatatagcgtttaggatagcggccacgtggtgacacgtgtcgctggcgcagatgccatgtggatagaacgacaacgtggcaatgcggtggcggctaacagggcgatgacgtgacagccacgctggatcgacgccggtggctctggacagcggtggcggtggcgacggcgaacagcggcacgacgacggaagcctatagaatggggaggaagaggaggacacggcgatgcttaccaacacttacagcggcggtgaggttcgggatgatgacgacaccagcgttccagcgaactccggcggaggagaaggggtggacgggcttcccggggtccttgtgatgccaaaggacgagacgacaaggtctggcgaccatggagtccacggtgggtggtggctagagatcgaaacacggcggcgacccactggttcatggcgacgaaagcttccggcggggtttcggcgcaaaggaaccggcggccagggtggagctcggccttgcggagccgagggaggcgaaggcgcaagcccgcgttgaccagaggggcggcgcggcgtggctggagttggcggcgatggtggagagagagggcgagctgagggagaggcgactagggcacggcagcatgggaaaagaggggaaaaacgaagaggagacctgggtcatcctttatataggcggaggaggaagagatcgatgcgcattcgagaggaaacggcggcggaaatttagagtttatcccgagttcgtcgggataagaaccgagacgaaattcgagggcacgggacgggaggccggctgaaggaggaagacggcactgtgccgggtgggccccttgcgtcagagggaatggaggaagaagctaaagcagtcttcggccgagagagaggggctgcgggccaaggatgggagagaggagaggcgtgggccgaattcggcccaagactagggagaggatttcaattaacttttattttaaataattgctgaaatgatgtttcatttgttaaaaatacttccaatgctcaaataattccgggaaaaatccggaaaatacttggacactcaaattatttaataaaattttatctagctcaatttaatgttaaaatttttcatagattttattcaaacacttactttatttattaaataatttctaaaaatttcctttttcacaacaatttataatttagcgatttttagggtgtgacagttgaaaagcaggttgtgccttactttcttctgttaacctgtatagcttctccccataaagagattctcaacttttagcaatacgagaaggaatc

SEQ ID NO: 5378 - DNA, 1501 bp, Oryza sativa
ctttctcttcgcttgtatcgagaagccttgcagataggacaagcatctaagtccgcatattgcttgtggtacaatatgcagtcgtttggacaagcgttaattctacggacctctaaccccagtggacatagaatctgctttacttcgtatgtcgtcttgggcaatgtgttctcaacaagaagcatagtcttcaaaattcctaaaagatctatgaaactcttgtctgtccatccactacttgccttcaacttcattaggttcaaggtcgctgacaactttgtgtgttttgctttgcatccggcgtacagaagcgtctcggaatcactgaccaacctgctaaacttcatgaaatctctctcattctgggctgggtcttcaacgtcacgtaacatgtcttgtagcagatcgtgatccacatttcaccgcccaatggagaaggtataaacatgtcatgctcatcttcatcttcctgattatgcgcaccacttctgtctgttgctgcaccacttcctgattcttgctctccatgcttcacccaacatgtatagtccttcatgaatcctcgttgtatcagatgatcgtgtacaacctcttcgctatcaaacatattctcattcttgcaatctgcacatggacaacgcatgtaatcattgtttcttcttttcctatcctcctctgcggcgttcataaattttattacgccatttctgtactccggaaaatgacgtttcacagttgtcgcatacatccaacttcgatccattgctacaaaataaaaaaataaattagaggcacatattataatatcagtattgctaaagtaagttatgatgaaattgctgaattcatcattagtattactcacttgagtgctccattttgatcacttttggtaatgttctgttttccttggaaaaaagacaaaaaatcgccctctatagcctcccaccaaaatagtgaacagtagtatacaattacactaggtggtggggggtatttatactgtgcaacaaatatttgtaagggccctaaaacaattaaccgtgacgggcatagaagtaatctctatctggccttaataaaagcccgtcaaataagagagtcatctgtgacgggcattaaacttatctcaatcggccctctagttgaagcccgtcacagatgacggtcatctgtgatgggcttcctttagggcccgattaagatattgaaccatcatctcaatcgggcctcaactatggcccgtcacacataagtgtcattcgtgacgggctctagttttatgccgatctagctgtctgtgtgcccgattgagattacttctttgtgacggcccacaaatttcaggcatgttaggggccgtcacagatgaaagaatctgtactagtataaaaatgttaatgaacaataatcattttatttcctggctgtgtcttccaaacgaactcaccaattaacaaaggcaggttatatgtctactagttgaataataatctataca

SEQ ID NO: 5379 - DNA, 1501 bp, Oryza sativa
tacttattaaattttaatcaaaataaaagtatttcttcatataccttttatatcaaccaataacaaacatccccaatttaatttcatcatctactttattttcttagccaattacaactttctcccaatcatctttaataacttttttattacccatgcttaacttacaaaatgtgtacattttactgctagccttctccgacattgcacatacaacatcacccactagattggacaggaagactcttcagatgcttttaatgggcaatttgcacattgaaacaacatgttagttcttttttttttttgcacattagcacttgtttaagcttcttccaatgtactactccctccattttctaatagataacgccgttgactttttctcacatgtttgaccattcgtcttatttaaaaaaattatgtaattataatttattttgttatgagttgttttatcactaatagtactttaagtgtgatttatactttatacatttgcataaaatttttgaataagacgaatggtcaaatatgtgagaaaaagtcaacagcgtcatctattaaaaaacggaggtagtagtattttaagcttcttccaatgtttacttttcctactacctctgtctaaaatgacttcatctctaactatgtatattggataattctcccaatagactttatttctagttatgcgtatcacatagctagtccaggtgaaatgatgaagctactactagctttttcgcagtgcgacagctagcttttttttcttcagtcttggagagcgtaacgttatttttagtacaaactacacccttcgtctcgaaatataaacataacatttttagcatagtggtaagtcaaccatttttaactttaactattaataataaagaaattaaaaatatcaatcatatagaattgatgttactagatttattattaaacaaattatcataatatgcaacactttttatttaaaacatgctatttttataaatattgttggtcaaagtagtatctcgaagactgtgtcgaagtctaaaaatacttatattttaggacgaagggagtagtaagaaacaataatgtacgagttagcagtaccatggtactagtaacgcgcatacatacatacattggtagcgctacacggcgcgacacacgggcgcagcgcgccagggaccaaaatggagcgacacacagcgggaatgtccccccactggtgcaaccaaccgaactcagagttaaaaattaacttacatacagttggtgatggattacgatgccattcgtgatgagttaaagtttaacttagatttagctagtattagtaaacgtttaagttttatacacatgggtggtcggttgtgaaggcattgttgtggagttaatgtttaacttgatacagttgggatgtggactatggtgtcgaggatattgagttaaaaaataacttggagtttttgtaccttgcaaaaatcgatagatcttttaa

SEQ ID NO: 5380 - DNA, 750 bp, Oryza sativa
gcagaggcggcgacttgactccccccctccccgccctctcgctatagggtttcctcccttccccgtcatcagccgccaccccaccccctcccccgccgggcttcgccatgtacggtcaccgcgggtaagccaagcccctcctcttctctcttattcctgattaatctccgcaattccatcccgccgattcatccattgctttctttttttcctacaatacttgcttgcttacgcgatctcatcaatttctcgattcttttagggataatttctaagtaggtcactttgctttgctaccatgatatgatatgatatcatctgcctaggatttaggatacatgtacagcttcccccttacaagaccaaacctctctccccccaataaataaataaataaatcggaggcagtaatacatccaaattgatgtttcatcaactgcaccagcatcccaactgtggtttgtaagattcttttctactgatatgtgtcatccagtagtttgagtatttcttctattcatatgctgtcaacatttaattagtttttgtttatgtccactaatgcgttcgcatttcgactccattcacctttttaagccttaagtcatgtttagattactagtatttcttatctgtgcagttatctttatgtttgggttattttatatgaaatggggattgagagatggggggatcgtctcctttttttttcttttctctttttgggactctggattatctgaagggcaa

SEQ ID NO: 5381 - DNA, 1501 bp, Oryza sativa
ttccatctctcgtctaaatttgctaacatccatatatatttgggtatatatatgaaacatatacatgaatctattcagaacctaaatattttgtagttataattataacgtgaagagaaagtagtaatcgacaatgaaaatgttcagacgtatgtacagcaccaggattttatgatctttgagcaatggattcttgaggcttggttgcttgtatatgtccacgcagtcaataatatcaccgcactcgctctgtcaattagaaaccaaagtgagacttaattagcacatgaaacttttttggggggtaaggtcaatgatcactggaaaaattactacctggaccaaaatgacctcagttgttcagctatatataaattcatgaattcaaccagatcgaatatatatcaagatgaggaatattagatttgagaattcatcttgtgtgattaaaattaaacagatttatactatgatatatagttaatagatatctgcgaagtggtaacctaaccaatcctaaataaagaagattaacataatgtagaaattcttacctctatggtcttgataatgtcattgggatcgatttgtacaccatgaacagtagttgtcgttgaagccaacaatatgctttgctgcaaagaatgcaagaagagacatcattctctaggagtcgatcttcaggacagtcgaggatcataccgttggcaaacaagataatatggaggctttatatagaggtgtttgtggtgcatcgataagataattatgtattaatccattgctatcatttttacattactacacggaaataaggaaaggaggaataatgcttccttgtattctgtaaaattcatgattgattaattaaataccataagtaggtctgctggtaaaattcaaatttcgaatgcaagtgtactaaccatattttggtggagaaagtccatttttctccctcaactatagggcggttttgggtcgtgtccatcaatcctaaaatcaggtataaagaccccctcaatcgttaaaaccagatcaatttaactccctaggcgatgctaatggtgaggtttcctcctctgtggtgttgagtttacgagtcactttggcctagtttttatatgacgtggcacttacctaccattccaataataaaataaaataaaatgttaaaaataggcaggacccaatgtaagtctcctggaaaaaaaatgggatcctcccctcttatctccctcctactcctctctctcaccctgcgagtatagagagagattgccaccgccactccactacaagtgtactcctccgttgcaaaaaaaaaactaaacataggaggggatgtgacattttctaatacatcgaatctggacaaagggctatccagattcattgtattagaagatgtcacatgcttgcctaggttgtgttttttgggacggagggagtacacaagcgtataggggagggccgccatggatcatctccgagtggtaca

SEQ ID NO: 5382 - DNA, 152 bp, Oryza sativa
gtatattaaaaaacaaaggtagttcttttcttatcgccagcacatctataaataacaggtctcccctccttgaaagtactcatcgggtcatcaccttctcctgattcctaaaccctacacacttgagtaacttgctttgaagtaaaaaaaaa

SEQ ID NO: 5383 - DNA, 242 bp, Oryza sativa
tgcctaggcatccaaatatcaaaattagtttacctatctatattttatatttgaataatcctgagcattagatttggattcttcaattcggaatgccatctcagtatgcacgtttagtatccaccaacagagagtacctttggaaaaatcttgattggatgatctaacttggtatagattgaaccttaagtttgacaaaacctaaaattagtttcttttatcctttgtactctttctgcaga

SEQ ID NO: 5384 - DNA, 1501 bp, Oryza sativa
gtggaactaaatgagggatgattttgattgtttgatatatgaaagtggtggaaaaaattaacaagagacaatcattgatgggtcaagatgagatagtggatagagaagttgttatatactaaaaatttacaacggaggaagaactagtttgttgcatgtgttgcaatgtagagtatcttgtatgacagctaatgttagaattggtattagtcagatactcacagtgtagttgatgtaacctttggtagtacttcttagcagatttggacatttttctaagttatcttgcagagaagaacttctagttagacttagctataaaaaatgacatttaccttgaatatatggtcaaaataagaaacacatatttaccttgaatatatgatcaaaacaagaaacaacagatcccctataagtcagtgcacaaccgtaacaacagctaacatgtagcagtaattgtaggcaattcctgttgcaaaacaagcatccacaaaaaggggaaacacttttaaactctcgagatgatatcttctcgttgcttaaataatacacaaatagtatactctacattatcaaaacttttcagttttttcttacaaccatttgcattgattttttttaaaaagtatacatgaaaagacatcccctctaaaaattataatccattccccatgagaagcacgttgaatgaattatctagcaaagccagcgtagacatagatgggctaagcaggacgtagacggtgggagtaacatgtctttttttttttacattggagtacatgtcctttgcggtggtaggtgtcattttgctctgtaacctctataaatctctgttttcaccctcctacttattaaatttcggccggcttttgctctgtaacctctataaattactccatatgtattattataagttgtttaactttttttcttagtcaaatttctttaagtttgattaagtttatagaaaaatatactaatattttcaatacaaaacaaacatattattaaaatatattcaattaaatttaatgaagctaatttagtgttgtagatattgctaattttttctataaaacatgataaaacctaaaaaactttaactaagaaaaaaaattaaataacttataatatgtaataattataatatgaaacgtagggagcatctagcaaagaaaacattcggctttgctcgaaacgattggccaatcggtatgtccttatccatgaataaaacatcgtcatgactcatgacgattcttcagcatgactttatctcttcactcggcttgctggaatgctctcaaacaaatacaaagatgcagtcgctgttgataaagagttaacgatgcaacatcactctcagataactgtaataacatactgtattacactacttaatttgtttaatttaattaactcaacacctcaacagtgagcagaagcaaatcatcgcttctgatcaacccattcaccgccacggccatgggcaaaagtt

SEQ ID NO: 5385 - DNA, 1501 bp, Oryza sativa
ggaatacaattcaaaattaacttaaattaggaattaaatataagcaatattgaaataaaaatacatataagaacccaatagtagattaaataatattcggaataaaaataggaatataattttgaaacaactgaattgaaaataaaaaataaaaaatcaaaagaacataataataaataaaataaattctgaaattaggaaaaaaagatttcaactaggaatacaatttataaataactgaaattggtgataaaaaaataagactattaaaagaaaagaccatctaaaacacatgatgagattaattaagtaacatacctatagaggaggagagtggtggcggttgatgagacatctaaaaactactaataaaacaccaaatagaatcctattgacgattaaaaggaaatacgacaggcatgtcgtgaagtaatcagtcaaggcggttggcgggacttctaaaaagtaaaaaaaataaacttcaatgataattatatttgatttttaaaatctcaattacaataaaaatgagaggcaacggacgggtcgtataggagtgcaatggtagagccgctgatggttggtcggtcttatagaaagtaaaaaatgaatttcaacgatagttatgtttaatttttacaatcccaatgacaataaagattatgcggcggacgggtcgtagaggagtatatggtagtgtttgatgggatttctaaaaattataaaaaaacataaaacccaacgagacaacaaaactttaaaaactataaggttcaatttttaaaggtacgggcttctaaaaggtaaaaaaaaaataatccccaatgataattatgtttgattttaaaatctcaatgacaataaagaaggacgacagcggacgagccgtagaggagtacagtgacaaagcgttgacgttttggcgaaacttctagaaagtaaaaaaaatgaacctaaacgatacttatgtttaatttttaaaatagcaatgataataaagagaagatgcagtggacggttgtagaggagtataatagcagcgtttgacgggacttctagaaattattaaaaataagcccaacaggaaaatgaactctaatagtttttagatccaatttttaaaagttccaaggagaataaatagaaacagcgatagatagagcaagctaataaaaaataatatgacataagtaagaggtatcaactgatgtgtcttttaaaaactacaaaattagaaacacgacgatgataagatttggtttttcaaaatcttaagacaacgagataactatttaataaattttaagtaaaatcatacttaaaaaatatataattttatatagatgctagccgcgtaattgcgcgggccacccagctagttttcgtaaatggggtgacagtagtagtagtgcggcagctcattcgctgttaatgaagaccgacgcagtgacgcacacacggcaagccttgggaagacttgggagaagaatggcggggaaaa

SEQ ID NO: 5386 - DNA, 759 bp, Oryza sativa
cggcatgttattgctagcccatgcattgaaggagtatggcgtcagattctgataaagaacatttctattggaagcagtctggccataagacatgaatggcggcccattgcacattggcctcaaatcctgaaaattgctaggaagatgcggagctgcaacattattggagggaactcggtcttggaagttttctgaagaaaaatcaaacaaaactgatgaaataacatataaggacacaagacgataaggaattaaagaataagcaggaatagtaacactgaccagagcaagagatgcaagatggtatatatatgctgtacataattgctatctatatatgtcgtcactgaccataagaaatgcaagatgatgtataacatacatgaattacattgaagatcctagttaccatgttgttgcagacttgcagtggatctcaaactgtagaatgatttttatgctcacaagaacatgcgtgattctaatgagacagaaaccctacctgacatgcaaggaacagtggcaagggaagagagacaccggatcttatatgtaggtagcaggaaccatgaaaaaacataggccccacatgcacaataaaccctagactgacctagacgaagccctatggggaaaatatcttcgtgctgaattcaacaagtgcagatgatcgtggtgcaacaagatgtatatggcggttaggagaagactaaccttgagatatctgcaattggcggtggtggtgctgcagcgggagca

SEQ ID NO: 5387 - DNA, 1501 bp, Oryza sativa
ccgtaaatccaaacacccatcaatgaaggcaaaggtagcaaaagcactctagtagtaactcaccatctcttatgatgagatcatcaactttactgtctctaggattgccaccagaccacacgcaccgtcagaatctgggttgatatcaaccatgttaaactctgcctgattatgcaacagaagccctaccataatatgcaattccatcattcaagcagtcaaaaacagatctgctattgctatatgagccagtcaatcagaactcagaactatgaattttctcaatatatatatagagaaggaaactccattgggcattaaccagcaggcaacattaaaagagtaatgggggcgcagatagcaagcactggaaactcccctacctataccattcaccaccaaacaagacaaaatactaatagggctcatgaagctcaacatggagaagaaaccaaattcagagcgtttctgaatcggaatcgcgataagaggactccgcccgagatcctccgccgccgctccttccccccgacctcctccgagcagcaagctcccgccgccggcagtcacagtctcagagtcccaagctccacactaggatcgacgcatcgcgtgcagtaatagagatgagagagccatcagagacgagcgcgcttacctgattccaaccgaggatactccaggccaaagagagcgaccccgccgccgctctcgcgcacccaaccgcggccgccggcgacctacccgattgcgcccgcgacgacgagcaggggagaagggggaagacgacggggagcgattgcctctcttctcgtcgcctctgcagcttctgttcatctcgatgccttccatggaattttttttatttataatttttcttattaaaagttttacaaaaataattttccattttgaaaattgacggaaatagtcgcctaccgccctcgggcggcgaaaatgacgtggcagacggccgctcgctctcgggcgacggccgtcaacgaaatttgcaggcggcccccttgccgccctccgcgagggcgatttttgcctcccccctataaagcccagcccctcccctatgaaatttcattatattcactaaaaatccaaaaaaaacgaaagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagttttgtttgatctggagaatgtaacctacttttagaaatttagagaacaatattgtagagaatgtaacttagggcgtagtacagaaatgcgaggttaacgcagttattgttttcatcaggcacaa

SEQ ID NO: 5388 - DNA, 1501 bp, Oryza sativa
aacgtagggaaagctatccagtttccggaacagtacactgtacagttcccttcctcaacggcggagcaggattatgcatgataggagaggggggccagtcaagaaacaataaaaacaaaacacacgtataatattaatcacaagcgatggcttgtatagaaaattgagatacggtgtcattatatattgaccatacttattacttaaaccattgcgttatcctctatgtacaagcaatcagatttcgtcaaaattgtcaggatcacctgaccccgacatgttcattgcttgtgctagctgttgaatgctgatgcttgcaagatggtctaaactctgaatttgttgatggtttttaactatcaatttgatatattatgtcacgttttgcaaaatatccacaagtactgactgggtttcggactttcggttaggtacttgacgagcaggcataggtatatttgttccattttagacccggtaagcttgttaagacgtattcctattccaccgagacaatccagttcgttgccatctctactttagaccacttagtaaaaccagatcatttagtatatagaggatatctatatgttagaaggatatccgtgtaggatcaccgttcattccgcatccaatggcagcactggttcctagcttctcttcagtcgttcggcctagctcagagccaaccagggggaaacgtacgccgctacaagaaaccccgtcgttttgccgcaggattctgggccaaattacgacggaggagagggtaggaaactatgaattgatgctgtcgttgaatgctgggtaaacaacgatccggcacagatatcccctttgatgtagaaatcctcttcatcagaagacctggttccgattgagtaaaaatgggctctcacggttaacctttgcatagaccatagaaacatagcccttgttaaagtgcccgttaaacctttgcacagaccatagaacgcaggcacgcagcccatgattcaaacaaaaaaagtagattaagtagagtaattaagtatatccttttgttctagtacatcggagacggtgttcagtttggtgactacaaattaattaaagtagagtaacgaaatatccactgaatgtgcgcctgtgcgagtgcgacgaatgtacctaacagtcaatgctgttcctctatagttcgtctgaaaccagcgaattaatccgactaggcaacattgaactagtgctatcaaagatcagcgcagctgccgtgcgtggttctctcattggctggatcgatgttgaaatcagaaccaacggttttgaccggtttcttaaacagttaaacccgtacataaaatcggcgccaattcagcttgttttgtggaactgtgtgtttagttatcggcaaatagcacacgccaaattgccaactagctagctatctcgacaaattagagcctcatccaaaacgataggttggcgatgcgtgtcgtccaaaactaccttagtacgttaccgt

SEQ ID NO: 5389 - DNA, 1501 bp, Oryza sativa
gacgtcgacgatgaagaggctgttgctgccgcaggagcaacccaggtcggccgccgtgaagagcttgtcgctggacgaacgttccatcatcgcgtccagtgtctcctccagaaagtgaagcatgcgccgggcgtgcagagcctatttatagccagtttacagttaaaaactgacgctatcaattcttaacctgtattatagtaactaccatgcatttacttgtacagtaaagtaggactaaatattggatggctagctacatctgatatcttgtgcaggacaaaaacactcgtcgttttgcacacatcttcagaaaatttttgagtttttgtacttgtaaaaaaaattgttgcagtaactgaaagccatattcaatatattaaacacaagtgttagacgattgaaacatccacatgatcatttcatagagcacaagggttcagttcagatcctaactttttctttgctaaatgtatagttaagaggagtggattctaatacctcgaggggatatcctctcgtatacatttttcttccaaattcgatgctaatagttgtgaaaaattctaaaaaaaaaattgataatgtaaagtataatgatacctactagtccaccaaaattcatgttcaaattcgatctacacatcgagaaacaaaaaagacaaatttagatataaacagtacgctactattcatacgctgaatttgtcttttttatatctcgacgtgtgtgagttgagtttggacttttgtgaagttgtatatatgtgttgtatgaatgttgtcaaatttttttagaatttttcataaccgtttagatggtttttgagcaaacgagggaacatcccctcgagcgattagaatagtttccctagttaagatcccagtgattcatttcacaggatttgcccctgctttctgtaaagctcgtgtttggaaacgtcgtacgtacctgagcttgggagttgttgagatagctgccatcgccgttccctcccttcatgcaaagcatgctcgccagcttcttcatccgaggagctgctgctgcagatacagtgacgttctctcccttcattgacgccatggccattgtcatggtgattatggcgacttgtgtgcaaaaacagaattagtcaaacggattagttcttaactcaatgcagaggctctattcagaatagatggatatgggcagtgtgccagtgtggagtggagtgtgaagcatggtggtctccatgcatatttatacaggaagtttaacagttagtttgcttagtctgatcaagtatgggatgatgataagcatattgcatataaaaatggtgctatcagtaatgcgaccttttaacgatattcgaatgcgacaagtgactaacacgcattactttatgcccttgcacaattttcgattaattattaatcagagtccatgtgaccccaaaagtaacggccgattgtcattttgtccagtgaaaaggcaggagatactgattttgttagg

SEQ ID NO: 5390 - DNA, 1501 bp, Oryza sativa
agatcatgcaggtttttttttttttaagaaaaggccagctgcccagcttttacagaaagccagataatgcagtagttaatcaacgacatggatcccatgtgatttatgggtattcacttgaattaattgcccaagaattttggtagaagaaatcatatatatactacctccatcccaggtgaaaaatggttgtgattggttgacataaaaaaatatacgatgaaaccaaatgagagatagttgaaatgaaaaaaagcaagtaattaattaaaaagtagttatattacgagaaaaatttaaatgttagaagtagctataatatgagacgggtagttctatgtctagtgtgcatgcatgtaataatataggtttacttaaaagccgagtgatcgcttgaagattaggagcgccacatcagcgatttttgcaaaaaaataccctgtgtttttgttaattacataccggttccctccaacatcgtccgttcgatctcacggtagagtccatctaaccgtccacgtgtctaacttggcggccctttttcagccgtgggatcgtcgaatcgcgaatgaacggcatagatttcgttcagccggaccaaatcctagttaggatgaaagatcaacgtatgcaacccaaagagataaaagaagccctttgtaaagtcacataagatcaaagctaatatagtaacgataaccagtggctccacgtcagcatgtttgccgcttattggctgcatgtgtacgtatttctgcgtgctatctactgacatcgtttaattttctattctcgattttttgattctatgattgattggtcgataggaagacatataacagcgttcacaactgggagaagctatctcctaatatcttctctttttttttcccattcccagttttggaccatctacgattggttggtaggagttcacacctaggagaaccggagaaggaaggctcagtgctgtctgccttgagagttgagagtatacaaatatctgatgtaataattactatagctcactgacgtaggtttattgtacctattctaattaaggcagctttcacctcattaagaccggtatctgttgagacttgagagtctagagtgagggtaatgctccacaattaataaattcccgtattatttaattcattcaaagtacacgtacgagaaaaccctagtccttgtactacaaaatgcgtgaacttttcttgtgatttacatagcggcaaaatcctgcagccgccatcaacagcacattagttggatcgatttttctctcttagaagacgaaaattctaacgctgcgattacagtatggagttatggacgttgacagtacaattgtacaaattgtggttgtggggatcagatctttcgtgtacccacatgcctagctatctcgtatgcacatccgtcccggccctctctcctctatataaagcattcgctacgactagctcattgtgccacaccacccaacacacatctg

SEQ ID NO: 5391 - DNA, 1501 bp, Oryza sativa
aaagattagcaaccctatccctcatagattgtggctcccactttcccaaatttgagagaggagaaaagaaaaaacactctaccaaacaaccaattcaacataaccaccctcctagttagcaagctagcagtactctaatagtctaattagacaagctaggcaacaactagctaatggagcatcatctagctgtcaatccctagctaatacgagtagcggatgcatgggaacgatgatatagaggtagtacacacatatgcatcatgcatgtgcagctagctagcaaccaattaatacttaattctactagaacaaaacgaatctgcacacatgcagattatcatgcatgatatatatgcaacatccattcatctatgacctcattgttaagttctttgattaagtaattacctgtttcttccccaatcagatagaagacgtacctacagaagatgaaaaaatatatatataccaacatcgcagatacagctacaaaggtaggttagtaggatgcatgaatttttcacaattcacaaacacacatatacgcagatatatagatcgatttactgacaattgacaacaattaacactgcactaattcactatcatatagtatatgtaacttcatccttctctttatatgttacaattaattacccctctctctctctctctctataaagccttcttcttggtatatatgattcaattcattgtgctcccagccggtcggcctatacttctatacatggatgtatgtatccaacaatcttttcatcacctaccaataatcttaattaccaacaaaaacaaaaaacatgtatactaacactccacccaatctcctagatcctccccttaattaccccaataataatcccctatcttaaccaaccatcatatgcatcgatcgatcgatccacatgaacaagagatagatcgatatgatgtaggtagagaagtagaacagaagcagcaacagcagcatgtgatgcgtgcaagacgaacgaataaataattaaccatatgatgcatatgttaattactcgatggatggatcattggtaggagaagaggtcgacgaggccttgcatcagctgcacctgcgcgcgaagcgagcggaggtagtcggcggtctcctccaggaggctggagtactccatgccggcgccgccggggaccaggcgccggagcgcttcggccctcggcggctcgccctgctgccgcggaggcggcggaacagcccgagccgccgccgacgtctctccggcagcaataatcctgacgcctctggcggaggcgggagaaggcgcaggagcggctacgacgcgcctccgcaccagcacggcggcgcgcctcatcagcgtcctggacctccgcgcgcggacctggccgagcagcgcccggctccacgcgcggcgcgggctcgccgcccgcgccatggaggagtaggccgcccggcggatggtccgcgtgcgccgcgtcacgggtgtcgccc

SEQ ID NO: 5392 - DNA, 1501 bp, Oryza sativa
cacctatatatatattcatgtcaatgtatagctagcctatttgaaaattaatgaaatgcataaagtccaaagaaataaaatctattagtgttactttgtaaggcaagaattttacaggatttcacataattaaatcggttcaattcctgcaaaacttctcaaagaaaatcatccattccaaacacatgggaatatgagaaaaaatgccacacctttttgaacggagttctctttatttaattaatttacaattaatggaatgtctttaatttctccaactaattagtagtatataaaaaaaaatgacacacgagttacctgtatgtggtcgatttgtcaattcgttataattaaaaacaattgctacatataaacccgacagctctaagaacatgatccatgcattggtggcccatggttaggaaatgccggagatcaggcgcagcatggatatatcattagaggttgggcagagtatttatctcgttgtttaagcatcattattgggctcgaaccaatctgatgaaaatttggtagctttctagtgacagcattatgagcataaccactacaaaattaattaagaacgccaaggacatgtacttataaaatttttacattagctgcaggcactaacaatattaataagccaacaattgatgattggtgtgaatatgctcatatgtttagcctggtaattaaatggggaagtatatatctcgactcttcaaatattgcatgtcaattcacatgatgtgattaattataggaacattacaagtccgttcttaattggcaacatatagacatagataccatgcacatgcgtgcatgatatggtatgatcgatgcatatgtatggaatatggatccatgactagcttagcctcttgcatatggtcgatcggtcggccggctttgctccaataattagagtttaatcgtcgccttgcacgcctaattaatcatcccgttgatggcaacaagtcagcggtcacggaggcaacacacgatcgatgatcgattatcaggttaatttcccctgtatatatatagcttaattattaatttgattctctctccttaattagctttctagctacctccctgttgatttgtgctcatatgtgattagcaagtcttaaccatcggcgacaactgataagtcgttgggtttagacgtgcgaccaaaccacgaccagattaattagcagctaattaattaggcccccttcgatctccctctaatttgattaagcctgaaaaatgcatacaataatgcactccgtatacatacacttttatacgctaatcaatacattaaaatcaatcgaactagtattataattaaaaatcgttttcagttgacccggcaggccgggggatcgatcgagagcgaattaaggatcagattttatgagcacgatcgatcacgattgagcaggtagctcgatctgctacataacgtactcagaaattaattaatttatatttttaagaa

SEQ ID NO: 5393 - DNA, 1501 bp, Oryza sativa
atataagaacccaatatgagattaattaaaatttagaataaaaaaataaaataatatccaaaattagaaaaaataaaagagagttcaagtaggaatacaattttgaaacaactgaaattgaaaataaaaaaataaaaatattaaaagaacacgatacatattatttatttttttaaaaaataaattctaaaattagaaaaagaagaaaaacaagatttcaattaggaatacaatttataaataactaaaaatgtgataaaaataaagactattgaaagaaaagaccatctaaaacacatgacgagataaattaagtaacaagcctataaaggagtagagtggtggcggttgatatgacatataaaaactgttaataaaacaccaaatagaatcctaatgacgattaaaaggaagaacgacaggcaggctgtgaagcaaacgagcaaggcgattgtcgggacttctagaaagcaaaaaagataaaccccattgataatcatattcgatttttaaaatatcaatgacaataaaaaggagaagcagcgggcggggtgtataggagtataattgcagagccgctgacggttgacaggacttctagaaaataaaaaatggattccaacgatagttatgttcgacttttagaattacaatgacaataaagagtaggcggcggatgggccgtagaggagcatagtggcatcgtttaacgagacttctagaaattataaaaaataaaacccaacaagacaataactctaaaaactacaaggttcagtttttaaaggttcggaacttccaaaaagtaaaaaaaatgataatcatgttcgattttaaaatatcaatgataataaagaagggagtcagcgggcgagccgtagagaagtacaaggcaaagccgctgacggtttggcgggacttatagaaagtaaaaatgaacccaaacggtaattatgttcgatttttaaaatctcaatgacaataaagagaagagacagtggacgggccatagagaagtataatagcaacgtttgacgggacgtctagaaattataaaaatgaacccaacgtgataataaactctaaaaactacaagatccaatttctaaaggttccaatgagaatgaatagaaatagtgataaatcgagcaagcaaataaagaaggagatgacataggggtagcaactggtgtgacttttaaaaaactatataattagaaacacgtagatgataaggtttggtatttcaaactcttaagacaatgagatagctatttaataaaatttaagtaaaatcatataaaaaatatatgattttatttaagtgctagccgcgcaattgcgtgggccacccagctagtttcttgcaaacaaaaatttcaaccgtttgattgaatcaactgaaagattcaacacacatcagtgtttatagaaagtttgtaaaagtaatttgagtaaatttcataaaactacatatactttacacaatctatcataaaac

SEQ ID NO: 5394 - DNA, 1501 bp, Oryza sativa
ggagatgagacgaacatgggtagatgcatggcaacctacggagtggcggcagttagggttgggagatgccgccgtgatgtggtggtggcggtgcgtgtggcagcgccggttggtagtggccacggaggagatcggcgtggtgtcactggtgttgtcctcgatggtcggtggcggcacggagatgtcgagggtaggcttcagcggcgccggtgtggtcccccgaggtggatgttgccggatgttgtatcaataatccctaatcctatacagcaaaataagaaaatcaggaggaagattacggtggtgcaatgtttcatgaagcttattgcactttgcttaaaaatgaaccatcttggtacagaattagtcaaaagcttactgaagtcataagttcaccttgaccaaatctgtcaagaatccagaaacagttggattgtcctaacatatgcatggagatggtgatttcattaatcaaggaatgaatctctactatactgataattgatatagatggtgcatcatcttaaatattctgtcactgccagtgaaaatcgaattttaaggtttgatttctgaaatgtgtaaaatcttaaataaccagatactatatattgttctttggagatgtttagacatgtgcagacagttatgcgttgttcatagacatggatactttagttatcattatctaaaaacatgaattctttagataccaaagcgatgctttcggtttttttcttttgattgattctggattatattaagaaccgtatgatcaaatcagcggcgactgatggggagagaggaaatatatataatactgcattgtggattaaaaaaaaggggaggaaggatgattactgtaccttaatttcggcgaatcagatcgaggatgtggtgacactgttctgaaagcagagatcggtggttgcacggagacggtcgacgagccggagattgggggcggcacggaggagaccggcgaggcggagttcctggtggagatcgggggcggtgcggaggagaccggcgagaagggcgatgaatggcggagtggcgagtggaggagacaactggcggggtgggagggcgggtacggtgtgcggcgcgcgacggcggagtgggcgatgcggtctggacggcgggtgggggcgcgagcgccgggagatgacgggggcggcgacgtgcataggcgcgatgggcgagagaactggcggaggagatggatttcgcgatcagaaggaaagtgcgactatttccgaggcgcaggggtgtgggaaggcggatgctattctagacgtcagatctcttagggataatctgaaccgttaagtgataaataaaagaataagtgaaagtatttcttgaactataccctaataacttactaatagcacaatctcacaatgattccttttaaaaaaatgcgataagaaaaggacacccctccgcacctcgtcgttctccatccccaaccccgagtgcagacgaaaccagcctg

SEQ ID NO: 5395 - DNA, 1501 bp, Oryza sativa
gatgggaagaaaccctccaaggaaccaagcacaaagcgtgcagggtcagtagcacatcttagtgcagcagaaagttcatcacgaaggctagaaagttttttccaattttctgaaagaaatttcagaaggcctgctgtatccatctgctcacatagttgcttcaatacaggacgtggcttaacatcaacaggtgaagcttcagatggttcacccagcccactagcagttgtattctcctctgaagcacacaacgcattcatgtcattggttgaggttcttacctttttatctttgcttccattggcatcaagtataccagcaagctccaccttatatttttgtcgcacctctgaaagggcagagacagctgtatcccttagctcctgaaactggttcaggaaagcacgctcttttgcagaaacattagcttccttctctgcaataagcctacaggattcagctttcttttcttctaatgccttctgcttctctgcaagttcatcgcacttacttttgtacgacttctcaaggttcaggaaatgtgctttgatatcttcccaattgatgccgttttgcaattgcaaggatgtttctgtgtgagatttcagcttgccaaatacttcagcaagctgttctagcaatggaattgttgactcagaactaccagaaatgtgagaagtatcttctgtggccatttttcaacaaatgatgacctggagaaatgtaggattagaaccaaagttaaaaggagctaagtattatgttttatatatagaggtacagatcacgttataactagcatgtctatggaatttattgatgtaccattgtttccaaaatagaaagcatggacaaataaagaaataaactaataccataatacggcaatagcacattacaaaagtacagcccaaagccaaaaggtcaagtgaagatcggaaaagttgagaatatataagtcctaggagtatttagcttctctgagataatatgaatcaattggtaaaaaaaatggtctgcaagttctaagtaattgcagtaactcgtaaaaatatgaaggcaaaacaatgttttaaaaagcagccacacagaccgcttatgcggccgtataagcgtaacaggtcatcagaccttgccgattattgctgtacggtgcatttacaaggttaagcgggccacatattcggatatgtggcctgcttaccgtgtaggcaatttggccttatggcttaggtacccttttgtgttctgccatagtgccattagtatttgctatttgctctatcctctatgaactatgatggtgtgatcagaagtttggaacctataatatatataatgtgtgaatcacaacatctttattgctaatttactgcatttatgtttttgcttcattacattgagtcagtgacttaaattttggtcatccttgggtcctctttggtagttggttcttcatgagtctttcctctttactgatcctttaagcctacgttcatta

SEQ ID NO: 5396 - DNA, 1501 bp, Oryza sativa
aataagttgaatgtagatgaataaaaaagttaaatatggtctagagtacttaaaaaaaataaaaaaatctgattcaaagtactattaagaaaagatggtttaaagcgaaataacctaaagtaaaatttacttaaaagtattggtaaacccagaaaagtttggaaagacggcgcagcgcaagcaggcccgcgtgcgtgcccaagagtacaggcccggtccacggaggccggaacagaaggaaagcacagccgtcgtcttctcgcctccgctgtcagttacacacaccccccccccccctccttccagccaggctgccgcccgtccgtccgcccccgcgcaccacgcggcgtctcgtcctcctctcatcggaccaccaaatttgcagctcgcctccacctccacctccacctccacctcctccgcctccgcctccgcctccaaaccctagcgcctcgccgcccaccgacccccgcgcttctcctccatccatgcgcccccgtctcgtcgccgccgccgccgccgccgatcatggctgcctctagggtttcccgggcccagccatggtgatctcatccccgccaacgaaccactcttctgcatcggtaagtccccgttggccccccacccccgcccacctctcgctcgcttctatgacctcgaggggattcgatctcctcgcccctcgctcgcggatgcgcggagcccaatcgcgttgctaaatccgaacctctaatgtgagtgtctctccagctttgtacgattcgcccgagcctggatcccgccttcattgacgcgcccgctgtccgggaacaccatgatgtcgaggtcagctccgcagctcaaaatctactgagcttattggtgcttaatttggtgcaatgtagaagtgtaaatggttttcctgttgcttccaggtttatgcaaatagggaagagcagaaaactagttcatgatgtattggttaactcgaaacccaatagtttcactgcacataacattggatccaactttgcgttcggtttggcacatacaggcagggcctgtttgcacgggaaggttccgcatggaccgggcacgtcatccatgcttggaagagcaaaggagagtttataccggaatccagctgcaagaaacttttcagttctctcaacatgtagccagaatgcatttcatggtcaacttgcttggaagcaactcatgacaatcggttctcatgtaccaaaggcatctccgattttaagtagggttgcttgtgccattagcttggctgccactagatctaatttagttccttacctctttgctttcgttgctggggagataatgctagctcagaagaccagtgcagacggagagtacttaccaattcgtgatagtctttacacgcgtgctcaagatggtcgtatctatgtcacctccttgatattttcagcagtagagctggtcatcataatcttcagatcaatatatttggcattgttgttcactccaagtatactca

SEQ ID NO: 5397 - DNA, 1501 bp, Oryza sativa
gagcaggtggctaaatagtcgacgacacactccctcccaggcgtaagaggcagcacatgattaattgagtgttcgagaaggacgggattgaggagactgagaagatgcgtaaaatgaggtgagctattagtacatgattaattaagtattaattattttaaactttaaaaatggattaatatgattttttaaagcaacttttttatagaaattttttacaaaaaacacaccgtttagtagttcggaaagcgtgcgtgtggaaaacaaaactatctttctctctttctcctgcgctcgaacgcagcctcgtcaacatgattgtggggtccacgtgaggtcagactagttgctttcttatgaaaacgagtggacatgaagaaagaggcagaaaattagaagaagaagataaaaaaaagcatttaaatctgtgggtagatgatgtaggccgtgtttagatttaaactttttttcttcaaactttcaactttttcgtcacatcaaatatttagacatatgcatggagcattaaatgtggacgaaaaaaatccaattgcacagtttgcatgtaaattgcaagacaaatcttttgagcctaattacgtcatgatttaacaatgtggtgctacagtaaacatttaataatgatgaaataattaggcttaatagatttatctcgcagtttataggtggaatctgtaatttgttttgttattagtctacgtttaatactttaaatgtatgtccgtatatttaaaaaaaatttagcacacgaactaaacacagccaaaatagctaactattgtacacaataaaccctcgttaacctaaatctagcttatcctgactcccccaaatgtgcttgttcacatggcgttgtcctaagtgatcatctttggcgtaatgacatccaaatgagcaactttctgcttgtccatggcggcagccggaggagccacggcttgtgtgtcggtggcttgaggagccactctgctcggcatgtcggtgtccacagcagccattttcttctcgctcacagccggaatggtggcggccggagcgatcacgaccaacttcttctcgacgggcatggacgcatggtgatgtccaaagccaaaggcacctccttttcatcgtccttcatcggcaagtcggcgcccggagcgaagcagagctactcgatctcaacatgagagacctaaactaaacttattccgtacaacaccggtgcgcaccccatcacatgggcccacttgttctttacagttttgtgggcccaaacttattaacaggccaaggcccagataaggagcccgggcccaattcatcgtgtcgtcttctctacccctaaaccgactacacgtctgacccctgttcctcttcgctccgtctctccccaccccacctccgccccgagacgacgagacccagcgagcgatcccgagggaagaaagagatcgagagggaagggaagggagaggatcggagagctttccgccggcca

SEQ ID NO: 5398 - DNA, 1501 bp, Oryza sativa
aacacaggctagagatacaaatactcttagtcacgatacaataattaaaaaaacacagtagtatattcggactcttttcttgaaccaatccttgaagacttgaaagacaggataacaaatcagcacaaactttatactaacccacagaaattgaggcaggactataccatgacattatgccatagttctcccaagatcagttataaatcgttcagtctacatatattaccctaaattgtagttctatgcatcgtattgaccctctacaatattcaatgtcatttatgccccttttttcttttctatgcattatacatagctattgaaaagtccatactcagaagtcaaaagggcaaagtaacgtcttcctgttctctcattcacaatgaaaataagtccatactaaaaagaggccattcttaatgcatctgactttaaactggcattgtagtttccagtcgaaaataatgcgtgagtgtgactgtgtgatctaatgacccatgttttcccggctccggtaattttgtccattagaacctcgtaatatgcactgaaacaatatcatcctacggcagcatgtgtcagaatctttttgaagaaaaatctaattggcatattattagagtaattgaaccactcgaattagctctgaaaagccaaacctggttacagcctaccaatttcatcttaagagaggaacatagggtaaagattgaacaaatttgggggttttcgcacgaagtcacttcttttactgaacatgggctaagatcagccgctacccccatcgatccaaccgtttcaaccgttatccgatcgaaaagacgacgcaatctcaacgagaaatctaccaatagaggaaatccttagccctacacaatacgcccaaatctagatcaaaaccaccatccggcgggtcaaatccgcccgaatcgcgcccgccccgatccgaaagctccaggcggcatacaggcgatcccaatcacaccacaccagatcagcagctatctgaagagaatcagcgggggggaagagcgtacaggttggtcgacggcccgcggttgcagcagagcagcgagaagagggaggcgacgaagccggcgaggaggaagatgagcgtggtcacccagaaccccatggccggcggaaagctctccgatcctctcccttcccttccctctcgatctctttcttccctcgggatcgctcgctgggtctcgtcgtctcggggcggaggtggggtggggagagacggagcgaagaggaacaggggtcagacgtgtagtcggtttaggggtagagaagacgacacgatgaattgggcccgggctccttatctgggccttggcctgttaataagtttgggcccacaaaactgtaaagaacaagtgggcccatgtgatggggtgcgcaccggtgttgtacggaataagtttagtttaggtctctcatgttgagatcgagtagctctgcttcgctccgggcgccgacttgccgatga

SEQ ID NO: 5399 - DNA, 1501 bp, Oryza sativa
agagacatctatcatgcacttctttggtaaagatggatggaacatgagaaagcggttaaaggagtaatgtggtcgttagtttgtttggaaggtcttttcactttgaaaggcgttggaagtctttgtgctcttttagttttatgtaaggtgcttgagcctttgtgatccttttgtttgtgaacatgtgtgtatgaactgagcttgtttggtcagattttctgtggctgtatacacccccgttggtgtagaagccgggttttataaattcccattatctaaaaaaaattagcgaccccagcggattcgggcaagcgctagtagatcaagcctctagtctaagggtgcatttctcgttttttattttcagtttttctttttgttttttcctggtttttccccttatttctttcgatttttaacatatacatatatataaattttgtattcatgcgtatacaaagtttgtatacatacgaataaaaaaattgtatacgtggtgtttttttcttggttttcggttttttaaatatgtatgtatttatatatataaactttgtatacgtgtatacaacaaactttatatacacgtggtgttttttttttgttttcggttttttaaatatgcatactttacatacgtaccacctattactactaggactgcctactacctctactactacttttatactactagtagtagtactactacaactatactgttactagtagtaatactacactgttgtacataaaatttaatttatgtacatgtatgtaaaatttgtgtaaaatagggtagtagtactactagtaattatagtagtagtaggtggtactagtactgtactataggaggagaccgcgggggcggctgggcgcgcccattagcagtggctgcgcggctctctgcactcactgttcttcctgcagtcctgcttcgggggatcactgatttcacatgacatggttcacatcttcttcttattttttgaaacttaagcaattttattaaataaagacagataaggaggatatggttcacatctcacattaacaaaatgcgccgcttgctgtcacattccagtagttcccaggaccaagcagcttttcggctttcgctagatgatgatcgtgaattcgtgactcctgaacgcgcggccggcgaaaccgtcgtgcgcaaggcgtgtttcttcggagttcggatcacacgttcacacgcgaagaagagagaagacaaaagcattgacgtttgttgctccgttcacagatacgtcttccctgatgtatcatcccatttgaatatagaccggctcgttagggacgtgatatttgggggtttaaaattgatcccgctggactttacagtgcatacgcactcacaagtcacaagtacgtttatacatatccattccgaacacgttccagaagacgaatggtaatatgggattcgtgttaataattaccaagactcgttctatgtatctgagtgaacgtacgt

SEQ ID NO: 5400 - DNA, 1501 bp, Oryza sativa
tggctccaattttaactcttacttgcaggttattttcagggggacgtattgggctcgacaatggtccttgctgcttaaagaagattagcgcgatgtgatgaaagaaggatgcaaactgttagagacatctatcatgcacttctttggtaaagatggatggaacatgagaaagcggttaaaggagtaatgtggtcgttagtttgtttggaaggtcttttcactttgaaaggcgttggaagtctttgtgctcttttagttttatgtaaggtgcttgagcctttgtgatccttttgtttgtgaacatgtgtgtatgaactgagcttgtttggtcagattttctgtggctgtatacacccccgttggtgtagaagccgggttttataaattcccattatctaaaaaaaattagcgaccccagcggattcgggcaagcgctagtagatcaagcctctagtctaagggtgcatttctcgttttttattttcagtttttctttttgttttttcctggtttttccccttatttctttcgatttttaacatatacatatatataaattttgtattcatgcgtatacaaagtttgtatacatacgaataaaaaaattgtatacgtggtgtttttttcttggttttcggttttttaaatatgtatgtatttatatatataaactttgtatacgtgtatacaacaaactttatatacacgtggtgttttttttttgttttcggttttttaaatatgcatactttacatacgtaccacctattactactaggactgcctactacctctactactacttttatactactagtagtagtactactacaactatactgttactagtagtaatactacactgttgtacataaaatttaatttatgtacatgtatgtaaaatttgtgtaaaatagggtagtagtactactagtaattatagtagtagtaggtggtactagtactgtactataggaggagaccgcgggggcggctgggcgcgcccattagcagtggctgcgcggctctctgcactcactgttcttcctgcagtcctgcttcgggggatcactgatttcacatgacatggttcacatcttcttcttattttttgaaacttaagcaattttattaaataaagacagataaggaggatatggttcacatctcacattaacaaaatgcgccgcttgctgtcacattccagtagttcccaggaccaagcagcttttcggctttcgctagatgatgatcgtgaattcgtgactcctgaacgcgcggccggcgaaaccgtcgtgcgcaaggcgtgtttcttcggagttcggatcacacgttcacacgcgaagaagagagaagacaaaagcattgacgtttgttgctccgttcacagatacgtcttccctgatgtatcatcccatttgaatatagaccggctcgttagggacgtgatatttgggggtttaaaattgatcccgctggactttacagtgcatacgcactc

SEQ ID NO: 5401 - DNA, 1501 bp, Oryza sativa
agtggacaaacctgcgcttgcttgactcctctgtctcaaacatcatcgcaaatctcattccaactgatggttgcatatatgttgccttgttgtaccttgctacaggaattacaaatggcgaaggacttgtcctatggagattccatgaatgaccaaatgctcaccaggaaaaaaaaaagcatatgtaaaagggtaagtaaatttctgtacctaggattgtagtagatagtaaatgaactaccacttgatgcggcatgagctgcagcagcaagaacgccaatgtgcatgctatcagtagatagaacagaagatgacaacattgtttgttgtcgcgtggctcgcctaacacccaaaagaagttgtgacttctcatccctgcaatcaggaacttctgtcaaaaatggcatttcatcctcacatatttgtgaagaaaatattatactattacatacaagctgttgtcagtccgagcgagtaaaaagtgcggtgtcctataacagtcatattcacattagaactgacaagaaatagaaaagttattgttgttgagattttaatattctagaaagttgaatatgtatatattggttaaggttaagtagatagccgctgtaggaaaatctaatactggtaatggacattctttcgaaagagcaaataacataagcagttcttgtggtatttcaatgcatgaattgttgcatagggtttagtatcaaaaggcttaacaatctcagattcaattttctgatagcacacacaggttaagtaacaaacagactttgcatgtatttatagaacttatttcaccttataaataagacagagtcccctgcttttagacgctttgccccaacaaagagactccatccagttgttagaagatgtcgttttggctgtcctgcaagggacaagaaaagaagaaacttttaggagacagtggcccaagaagcatatatttatgtatcaatgaacaagacaaataaaatccgaatattgtttgaccctaccacgataaatgtgacggaatgtccacatgttatcatgcaaatctcgaacaataagctcctggttaggaggttgcattgagtaatcctgtcggtacaaaacttaaacccatgagctgaagcatttttttacagaaaaactatgcggcaaacaaaatgtagataaaggctataccagttgtgggaacaacttctctgcagcccttcgtggcaccgagaaaccaccatgtgtactcgtatcacttgcggttaaattcttgcagaaatattcagtggggtgcttgcttttggtataagcaccaagagttggaatagggaatacatccgtttcctacaatagacggcacaaataaatattaatttagaatccatcttttattccttgcacactgaatttttgtttctgtaatcacattttatgcatttcaataacaattggtgtttacattttaatagaaccaaataaagtagtacagaactcagtacacaatgta

SEQ ID NO: 5402 - DNA, 1501 bp, Oryza sativa
attccggtactctgccttggaaacggcggcagcggcccaaacagagcggtttcggaggacccggggagcgagcatacggcggaggatgagacggcgcgtgagatcgtggacgcggaggtgcgtcgccaagtcgccaggtacaaacacaagctcagggaattcaagctgacagtcatcggcaccgctgtcttcctcgtattttgggtggttttgttgctcatcgggaccctcgaccaccacatgtccgtgtcgtggcgccggttcttcgtcacctgtggtgtgtttgagtgcctattctggctatacctcgtcgtcggccatctcagagagtatggcttgtccatccccaagatctccgacttcagcaacgaagagcatcaactgccgcccgtggggcacgaccgttgctgagtgacggctatatatcgatctcaaaaatcgatcatccctcaaatctgggtctttgttcgtataatctcaaaaaaaaaaggtatagaggggattaagaaaaaataattccacgtagatgtgaaattaatccttctaaatctctcttatttttttgggagggattaaacgaacaaatcctcgtgaaacattatccatgagaaaggatcattaggatcatgcatgcatgcgcacacgacttgacgacgaggagataaaagtgatctatataccgagataacgacttacactcatggagatatgctgatttaattcctgtttgcctctctaatcctatagaaatttagaaagttcatcttcagtactactacgtacttctttctttcattacgtcacatcaacttaattgtttctagttatggaatggttttatgcccaaattatctcattttttctttcttttcttataaaatcatatcaccttagttttatctttgatgattaatttatattattttctcttttccttctgttattgggtcatatcatcttagttttccttttaaacgatcaatacatatatgatttaaatagttatagaccacatcatcaaatggtttatatatatagctttttttttcaatagtcgatcaacgataaaaaaattactataatatgtagctattttacatgttattttcactaatattatacaaaactttcatacaacgcacgagatttcatctagttgtaaacaaacatgcacgccattttcattcatcaatatgaagacaataaaattcaattgcatcgaaaatagtgtagtggaagagggcggagtgatggattatatgatgcacatgcgtaatagtgtaagtataaaatatgaaaaactatgaaaaacgccatttgttcggatttatctattctaatctaacctacttaaagtagatttggattttctcaatcgttacgtacacgctttcgtccgtagtcgtgttcgccacgtgcgatgtccgcattttgtgttttctttcttcatctccgatatacgccccggcccaccagtcacgtagctttaatttttgtgttt

SEQ ID NO: 5403 - DNA, 1501 bp, Oryza sativa
ccatgaagaagaacaacatttgtttgcacccctaggcctaggcttgttaatggtcggtccaaggacggtacgagtgatgtggtacaagacaacgatcgaatgagagatgctaactccccacatatattgcggtatattccaatagatcgagctatgcagcgacgagacactgtcccacggaattagagggactaattttgtcacaattaaattagattgtcatgtggtgtgtcacacgtgctagcgttatttttaagaaacaagtcgaatttatctcgctatcttttaaatctatgaattaccttctcaccgattcccttctcctctcttgccaaccctcaaatcaaggtgcagatcaattagagcaaggctaataatatagccgaattgttgcatataaggttctttacagccttctcttagtctacacatacaatagttagctatttataattaatatatatggcccacttgcctctctcacaaaattttttggttcttgtgtccaagccagatgtaagtttacagcctgcttctcatatctctcctccacttgagcatttagccgacttagaacctcccattatacttgcccttagggaggaaatgatcccaacccccatacacatccttctcgatgggaaaaaaagaaaatgtaaaacctgagtggcctatttagtacgagtacttttcttcccaacttatcttctttattttccacgcgcacgctttacaaactattaaacggtacgcgttttataaaaaaaattctataggaaagttacttaaaaaaatcatattaatctatttttaagtttttttatagctaatacttatttaatcatgagttaatatatcactccgttttatgtgcacggggaagatgtttctgaccccttcgaaagctagaacacggccttaaagatccaatatggttgggctatagaacatctaagcactcatatgataacccatttactgacttaatatactagaggcttataaatcctatacccacgtatatcatgtgtctagtactcttgcgtatgtacaatcacgaaaactatgtgtctcgccgtcttgcgcgtataccgtcttccgtgtgtatcttctcccggatgaaatgcaaaggtaaaagaaacaaatataaaatcactcgcaaaacttttttaaaacctcaattacgtattaattaattaaccttaattaataaaaggaaaagaaataaacaaagcatataaagctgcattggagaaggggaaaaaaaaagggaggagaaaggaacagcggcaaggtagagatagcggagggcccgaatcctccggaatataaaaactgcaagcaaacaagcagagccgcagctaaacgcaaagcaaaaccaacgcaaagccagagaagaaacaagtcagaggaacgcagctccctatcctgttccgctccagacgcacgcacgcacgcgctgcactgactgaggccgacgcggcggcggcggcggcagcgg

SEQ ID NO: 5404 - DNA, 1501 bp, Oryza sativa
aacagcacacacacacacacaaaaacggatccacgaactccggaggccggaggagggagtctgggccgtacctcgggtgccgtcgcggaaggccttggcgacgcgcttgggcgtcctccgcagcccctcccggcgcgcgtcctcgccgagccccagcagcagcgcgcgcaccgccggctccatggcgtcggcggccgccgcctcgccgtccccctcgacgaggtcatcctcctcctcctcctcgtagcactcgcactcgcacgcggagatggcggcggcgaggtgggcctcctcgagcgctcccatggcggtggtggtgcctggtcactcgagctattattaggcggcggcgagagatagcacaaggtgcgcgagcttgcggccgcgcaaaaatagataaataataaaaaaacgcggtggagtggaggagaattgatgcccaccgcgcgcctcgagatgtgtcatgtgtggatctcgccgccgccgccgcctcgcctccactcctctcctttcctttcctttcctttcacaggcctcagcgcgtcccggaatttttggaccgggccgaattccaaaaggcttatataaagtggggcggtgggccccgctctccagtggcacgcgttacgatgggggtttgaggatttgtggggcccacaagccggaaagaaaaaaagtgcggctccagtctcacgactcgcggtgaggcgggggtggtcgaccggtcgccgtctcgtgcaccggatgcggtgtttggtgaggtggggggcggttgctttacgagcggtaggtgggtggtgctggtaagccacgaccacgaaggtgtgggtggccaggtcggctgcagggagctgcgcgtcacggtgaccgttggatcgagaacctacggatcggatcaacctatgggagagtcatcacgaaccaagaaaattggggcgtgtgtttcgttgcggtcgggttactcaaacgtgcggtaacagggtcagtgggagggtcgggctttcgttgaaatttgacattttttgtggttgcccgtggctgcaagctatatccatccccgcatttcaacgagagaataaaaatgattctcctagtagaaaagataataaaaatgataggtgggtatattcttccgtttatctctgcttttataccggataatttttttggaattgaatctctttaagagatacttcctccgtccttaaaaaaagataaaccctgagtttccgtgtccaacgtttgaccgtccgtcttatttaaaaaaaattattaaaaaattaaaaagacaagtcacgcataaagtattaatcatgttttatcatctaacaacaatgaaaatactaattataaaaaaaatttatataagacggacaatcgaacgctggacacgaaaacctagggtttgtctttttttttggacggatggagtacgtataaatgcggattctaacaacatgagctcacctctataaatacatacacacactcgatcctcatg

SEQ ID NO: 5405 - DNA, 1501 bp, Oryza sativa
tgagcgagtgattggcacaaagaatatctgactgactgccatcccatcccatcccacccatccaggcaggcaggcagggatggccagtcccgtcgacctatcatctcctctccccccctgaccatgttacaacttgcgacggcttcacgtggccgccagcccgtaacctgaggtgaactctagtctaatccctctcccagcacacggccggcggtcgctctctcactagctagctaaccttccccaaccacaaagattcattgaatgcggctgcctcgctcgctcgctcgctctcgccgcccgccggccaggttagccgcgcacgcgcgccatcagcggctggcgcgcggccgttccgtgattccgtcgcgatcggttgggtgcgcgcgcccgtcgcgtcccaagggaaagtttggtatcgcctttcccgaatcagccgagctcgtggcccgcttacgtacgtgcgcctgtgacctgtctgcccgcgccgtgtgcgctgcatctatccatcggtcggctcgatccgtcctccgtttcgcgtggtagtatgcccgtggcgcacggaattccgtgtcgagctaaaagcggctcgacaaaggcttgcgcgcgagaaagtcggggataaggcctggctttcactcgctcgctcggccagtattagctggctgcctaagctcctccctctccccttgcaaacgaaacggacaggccatgttcgagaagaggcaggcaaagaggcgacagggattttgccttcgattcagcagttcgcagaggcgcgggctctgctaaattcgggcagcgtttctgccgtgctcgcctctgcctctctctctctcatcagagaatctatcgccgatagcaacgcgaaacagatcaagcccgatactagtaatttgttaatcgcgtccgttagtctacgcttccggccgaccttacaccaacccgacgaccaagttgcacgagacatacaccgtccacgcatctgtcaatgaactactactagtaactactaccgcgtggtgaagtgaaagggtgaaactgctcgggtcggcttggcttggcttcggccagctagccgccacgtctccgccggttttaagtgtgagatccgacgtggaggccccggccgcccccaccgtgccggccgttgtccacctcccgacgggacaccgggccccgccgttgccgcgccgtggaccgacagccactgacgtcaccccatgtccttcttctcggctagctcttctcctcctcgcccgtgaccagcagctcgcctcgccctctataaatacccggccattcgaaggcgttccgactcaggccacacaccaccaacacaaaacatttccttgtccctcgccttcctcgcctcgcctcggctctcacacgacgcctcttcctctcgctactactagctcaagctaagctagcaagagcattccttgggctttttttcttgttcggggttgagaggcaatggcggtgatgactgatgtgt

SEQ ID NO: 5406 - DNA, 1501 bp, Oryza sativa
tctcccgttctgaggttcacctcattctttatgtggcttaaaagagtggtcggttttcgactcttcttgttttagcatgacaaacatggctgtcctcgtcggcgttcttcttgatgtctcctttctgtcctttggatggtgggttcaccttcaaacccttcagttgtaagttgaaaggacttgattgctttttctatatctttttatgtctttcttcgcatatgctatgctcgaagtgtaatttgcccaaccattgcttttatgtaaaacaagctgttctctcagctttgcctccctggtacacaactcatgtgttttgtcctgaatcaataaaacacatgagtgcaaaaaaatactcacctgtcaacatacagcatctatatgcaaactctgacaaacattatcttagcaaagaatttcaaaatgtttaagaatacgacatgtaatcgttgcatgttaaacagaaccatacaattttcgttcactaaaatataatatagtttttagttatttgctatattattttagttaatgttgacaagtactacattggaagtgagggagtataataaatacgaaatgaatgacatcagagagtactgtactgtacagggagtttaaattagggcctgtatttgtagcctgattatagacaataaagttggcgacgttccacgtccataggcccatttaggcccatattactcctgctgggaccatcacggtccatgggctccggctccctctcctcgccgccgctctagctccagagcaggagccgctccccctggctggctgcctgccacgtactccagctccggacaaaatcgaatccggagccgcgagctcgcttctgccattctgcttccccttctccaaccaccctgctctctcctctcccccttcacagttcacacctgcgaccacgaggcggtggcggaggagacgaggcgcgccggggagatccgaggcactcgttgaccctgcgctccggcggccgattcgctgccggggacgccgtcttctccgtcaactccggcgaacggctgccgcgctccgatctgcacgtcgccgacgtcggtgagtccacttcctcgtcggctaatcctcctccaaaccccctctaccgaccccgtgttccgaccggtcccgcccctctccggccaccgcacgccccgtcgtcgtcgccggtgaccatgcgcggcgcctctgggtcacgtgaggcccgcgtgagggagcggagcgatcccgtgcggggcgtgatggtacagcatctggtaggaatattccgaaaaaaaaaaggaaaaaaatcctcatcctcatcctgtggcttggtagccatattatcgcttaaactagactagacacgggtccgactccgagggcaatatcccccaccacccatctcatccagagacgagctcctcgaatttgagggagtccggggagaaacctacggggtgatcttctggtccgcatcgggtcccctcccattgcatga

SEQ ID NO: 5407 - DNA, 1501 bp, Oryza sativa
gtacacagggaattttctctaaatgtttctagtgatagcgttttcaaagtaaatttggccatatattgctttaggaaacaagtgtgacaaggaagcataaatatgtgctaataggttccttgtggtggaatatgttcactcgagtttaacctaacatggatgctcccatatgatgttatttcagtggtaggcgatatatatgtcaataacggaacgttgtggtgacttcattaattttatgatacaccggtccaatttttttagatacacatgaggatcgagtgtgtgtatgtatttatagaggtgagctcatgttgttagaatccgcatttatacgtactccatccgtccaaaaaaaaagacaaaccctaggttttcgtgtccagcgttcgattgtccgtcttatataaattttttttataattagtattttcattgttgttagatgataaaacatgattaatactttatgcgtgacttgtctttttaattttttaataattttttttaaataagacggacggtcaaacgttggacacggaaactcagggtttatctttttttaaggacggaggaagtatctcttaaagagattcaattccaaaaaaattatccggtataaaagcagagataaacggaagaatatacccacctatcatttttattatcttttctactaggagaatcatttttattctctcgttgaaatgcggggatggatatagcttgcagccacgggcaaccacaaaaaatgtcaaatttcaacgaaagcccgaccctcccactgaccctgttaccgcacgtttgagtaacccgaccgcaacgaaacacacgccccaattttcttggttcgtgatgactctcccataggttgatccgatccgtaggttctcgatccaacggtcaccgtgacgcgcagctccctgcagccgacctggccacccacaccttcgtggtcgtggcttaccagcaccacccacctaccgctcgtaaagcaaccgccccccacctcaccaaacaccgcatccggtgcacgagacggcgaccggtcgaccacccccgcctcaccgcgagtcgtgagactggagccgcactttttttctttccggcttgtgggccccacaaatcctcaaacccccatcgtaacgcgtgccactggagagcggggcccaccgccccactttatataagccttttggaattcggcccggtccaaaaattccgggacgcgctgaggcctgtgaaaggaaaggaaaggaaaggagaggagtggaggcgaggcggcggcggcggcgagatccacacatgacacatctcgaggcgcgcggtgggcatcaattctcctccactccaccgcgtttttttattatttatctatttttgcgcggccgcaagctcgcgcaccttgtgctatctctcgccgccgcctaataatagctcgagtgaccaggcaccaccaccgccatgggagcgctcgaggaggcccacctcgccgccgcca

SEQ ID NO: 5408 - DNA, 1501 bp, Oryza sativa
aaatagaagggtgctaagcttatatgtgggccagatctaaggaagaaggatgtaaggaacctcatcggggttgcgatcatgaagcacaagtctagttcgaaaaggaggtagaagcaaatgcttgggatctttatcttggaggaagatgaagaggacctcaggctagtcgttgtctcgccaaagacgacgagaacctctaatgtgttgtggcctacaaggcgtaaacctggttgacgacagtgaagaaggggatgcaacgggaaggatgaagggggaataatgggagaggctagatttggtttcactctcttgtgttcacggagaggaacaaatagaaagagaagaggaatatgaatatcaaagactctagccttaatagatcacaagttggaagttaatagatcaccaagttggaacgtgttcgctcgttaaagtgacttgggtaagttcggcaattagctatcccaaagaatggtgcatctgtgggaggctaaaaaagaatttgattgttagatgtgacttaagtgttatagagaaaaaatttattgaccgacattgcgagtcagtctctaggaaatacaaacttccaatttaacaagcagcaaatccatacacatcaacattccattccgtcacttgaataatttggtatgtacaaacgaatatcaaaggagggtccaacaaaaaaatgaatatcaaaggagggagtgaactaaggttcattgtgacacatgttacacataattattatgtgagtggtaaattatatgcacattgatggtgatatacatgtgatagcttcgtctcaagatacattgtcctagttcctcaaagatagttataaggacatggtataaaagtgtatgttcataagactaacatatatataagtgtctgtgtttatactatgtatcgaaaaaaaggaaatgataaaaatgaacaagaaagcttacatttttttcacctatggaggaatggagcataccgtagaactcaattgaaattattttccttacaaatgggcttccctaccatagatagacaacatatgcatgcatgggcaaactactaatccaaatgaattttccaatgtttgtttcctatacataccaaacgatgattcaaaaatcccaagataaaaaaagattaaatacagttttcactttatagtaatatatcatgtgttacatcactattaaattaatttattttagggacgaaaggagtataaaataggagaataaagtcacatctcgccgtagtattaaaaaactttgcgagccaactggacgacccaaaaacattttcccagttcgtctgtcccgtcctataaaacgtcccgccccgcccactcgaaaagccagctcctccatttcaccaactcacacccccacacacgccattaactcacccaacagcagctagccgagccgagccaaccaacggacgaacacctctctggctctctcccccaccgcgtcgtcgtcgtcgtcgtcgccga

SEQ ID NO: 5409 - DNA, 1501 bp, Oryza sativa
ctgctccacttggtattatcagtttttgttctttcaaaaattcataaattgtatttataatgaatcaagtgaatataacattaaaagttgctgtggtgtagtggttatcacgtcagtcttacacactgaaggtctccagttcgatcctgggcagcaacagtttttttattctgcattttatttaatccttttccatttttttctgcattttatatctaacccttttccttcaatttcaatgccttttaaattccttttccatctacaatttcaatgctggatcatctgccgcgcaggtaaaaaaacatcgacgaagcgaagtgatctgtcccttcagcaacagctagtcagctacgattcacaaagcggaatcacttccagtgagtctcgaatccgccactccaacgaagcgcacacgagagagaagggagggaggaaagaatcgcgatgagaggcgcgctcggcggcaggagccgggcgcggcagaacgcgatgcggtcgggcctggtggtgctgggcgccgccgccttcggctacctctccttccgcgtcggcttcaagccctacctcgaccgcgcccaggaggccatggacgacaccacccaccacggctccgcctccggtgccgccgcccagcctgaccacgccggggaagaagacgacgtcgcgacgtccaaggacccggccgtcgtgctccgcgactgaggccgctcgtcgaagcttccgtagaggttggtgccttttgcttttggttggttgtgccattccgtcgaacaccttgtgtgcagctcgtagcggagctgcaatcttgcgcggagagtgctgttgctgaataaacacttcacattaccaacagacttgagcatgcatgtcgttctcttcatagaacacagttactgtcttgctgatgaacataagtgctgaagtgcaaatgggcgctactgaatttgtcgagctcttcgattctaataaagattctgcttagatttagcatgttgtgttttttctttatctacgccctccgcgattaatgaaagcttccaaacggctaatcaattcccatgccattttttgagatggaacttccaatttcatattgttatagcctagataaatgtgattactgatgagattgttccaagtagttcaactcagctcaacatagtcagtcagcactcagcacccaccaaactgagcagcaaaaagtccactttacgtccctagaattataggttgagttttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggca

SEQ ID NO: 5410 - DNA, 1501 bp, Oryza sativa
acacacctgcccttcttcatacagtgccttccttgcaatggttgcgatgaagcctggcatgaatcgagccgggactgacgtgctaatcccaggagttaccacgccggctccagctagggatgagtgccaagaggctctcatcattccgacgggacggggcgaggcgtatgacaggctgcctgctgccatctaacccgcgatctgaccggtctgtgaccggtcacacactgcgaccggtcacggaccggatatgcgtgcgccatgccgcattaaatgcggcgtggcgcgcttgttcatcccgcaataaatgcggttaggtgagcgccgctgtgcccacctaacccacacacgtggcgccaataccacagggggtcggggcgccccagccctcggggccgaaacaggagcggcccgacccctcggggagacagaggagggggtggccaagtctccctcgggcccgacccccccgagggggtcaggccacgtgggtgaccgcggctgcccaagcctctagtcacgatacccccgatcccatgtcaccgacagttagtaagtatggtttgttaacatttgtcattgttaaatgttagtagagatattaaagtagtcgtatggtttaatgagttgttagttagtacatgtaattaatttcttatgtgttaaaataggtagaaggttgcagctgatggaagccgccgccgttgccgccaccgtcgtcgccggctcgtggaagcgtggcttgaggggtcaagcgcgaccatcgccgccacctctagctcgttcctgcctacacctacccggccctgccttcctttagcgtgagcgctaatggagactgccctcgccgccaacacatgcttcagcgaggatagggtgaggattgaggaactagaaagccatatgacatgtgggccctacaaatttttgtatttggtattactgactggattaccatgtgtgcgtcacatcggactaaaaccgcttcggagtgagttaggggggtaattcgtccggtataagtagtttagggttttaaatgtccagttttgtggtttagggggtaattcgtactaacacgattgttcggagggtaattcgtactttttcctttgtgttttgtctatcttaaatttggaaattactgatacgatcagtatacttacggcattttaatttgtagagttgagtagttaagacaacaaaagctccaactactaattcaaaatataatattttttattactcttttctttttcttcacctttatacaaccaagtttttgagagagagggagtacatagctcggttgacagaatgctgccaagacctagccactgtgtagaggtgtaagttccaaccacatcctaaaaatatattcctagcatttttcatgtttcttcgttttaacaccacgtttgcactctgctccacttggtattatcagtttttgttctttcaaaaattcataaattgtatttataatgaatcaagtgaatat

SEQ ID NO: 5411 - DNA, 1501 bp, Oryza sativa
cacgcgctggatcgatcgaaggcctggccgcgccttccgcctccccccccccccacggccgccgataccgacgacggaggcgccggcggcccgattctaccccccacccctgcactggtcggcgatcgttgcttcccccctcccgcggtgatcgcgcgcgacacccatggtgagttgtctgtgctggggctactggctgtctggctgctagatgatgagatgaggggtgatgctaatgtttcattgttttttcgttcggtccgatgtcgctacgcgccgtgcggccgcggtgtgttgcgcgggcattggggttgccatgctggtttgttagtttctctgttagcattgggtttggagagaaatgtgaggtttctgtgttcgcgtagttggggggaattttttgtgaatgaccactttggctctagaggaaccgatggacgacgggtgactcgattagtgtgagttgttcattgctcccgatgaacggacatgttttccatttttaatctcgtgtgtgtaggatagctgaagcgtttgatttgtggcgaccaggaagcaaagctgtacgccggaaaggatttttttaaaaattttaaaaaagccagttccgtctactcattttagatatgaatatgagaataagccttttttttttttaagttcaagtgttctctgaatttgctcaatataagtattgcttcactagcccactttgtcaggacacactctttcttctatgtgccaccatattggaatagagattagagaagtgtatgctgcaattagttttcactcatatctagtttggtgatgagtccataacttcctacatttgtcttgaaatcagattctgtataatcgtgaccaaatatgtgatgaactaggtgctcttatttcaattcatggtagtacagcactggtgctaagaatttagtttatctaatatctttgctctagaatttacgccttaaagcatatgtctcatgaatttgttttctgattctatgctttttgggtcggtatgatcatgtatcctttcatggtttgacacggcattcttagatttattaaactatgcatgtccatttcaacagtgatccatgcctcattctgctttgtactccatgttatatatctattgtatcattaaaagtttaaaacagtagttataaattatggaattaatttgatgaaaaaaagaaaaggatcctacaccagcataatattcattttagtgggtcctaaatataacaacgtagataagaaatacaatgcatttcatcaacaagcacatgagttctatggcaaatacaaacataccattgtatgtaagtgtgcaaggtgaggctagttatttatagtatacttctagtagtgtttttacaattccttttggcatcttttggaacacaaactttagatataaatctatgcatccatttacctattaaccttgattttttccctggcatgttggatttttgtgacttgtggcttgtgc

SEQ ID NO: 5412 - DNA, 1501 bp, Oryza sativa
cctgctgcccagcccctagccctcattcttctctcctcaattccagtgaaaaaaaaagaagagaggggaggagaagagaagaaggggcgaagccttgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatttgctagtttggaatcaatacattaccgttgcattggcttacacaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctaaagtaaacgagacttctgtggaggaggtcaacgcacgagaggacggggacgtagtagctccagtgggcattcaactaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacagtgttagtcgttaccaagcatacatgttttctacctggtaatgttatgttatattattgaactctacatatatgttaaattgcacgtcatcgttatgtaccattagtaatgtttgctatatttaaatagcaacttgttgtacataattaatctcatgattttattactatttcataattttgcaagttatcttttgttttacattactatttttgaattgttctaacacgaaacactatatttttcaaagatggcacgtcagg

SEQ ID NO: 5413 - DNA, 1501 bp, Oryza sativa
  unsure (1)..(1501): unsure at all n locations
aattaggcatctacaattctacatggcaaagccagcatacatggcaatttgattctaaggtattgatcagatcagatttgatgcaacctgtttggaagtcaggcccctttgactttgaggtgcaaattaatcttttgcttgtctcctagcttagaatcgcctatggactgttgctgtttataacttaaggctggccaaacaattagttttgtcctctatgcatcaaaccttgagacatctcatcatttgttcatgaagagtagattagtttcaagccatccggacaggaataagcctgtgcttaactgaagtttcnnnnnnnnnnnnnnnnnnnnnnnnnnngtattggaatggtggtgtcacaagacttcatcagaaaagatgcaaagaaaagggctcaggaccctcttcttgctggtctgctggggaatttggacggaacgaaacaatagaaacttcgagaaagagggatggtcaattcagcgaattgtcgacaaattcttttttatgagatcaagcagtggaccagctacagagaaaaaaggctggtatagttctctcgaagagagagctgtttttttgttagtttgtaactttgtatagcctctggcttcagttctattttgttccctcctatcaaaattcgtacaaaacagacagatcatacccataattacaagtaccgattatgttggttatatcttttttacaattacacaggatatatattttataaatgttggttgaataaattatttttggtagatatagtttccaaactttcaatgtatccctatgatatattttatgaaaaacgtgtattgcacgtgcacgattactagtgcccagataaattagtactgatcttgtcccgctcaaggcctcaaacctcggtaaaaataatttcacggcggtaaaaataaaacatggcaccatctttttactcaagaaagaaggcaaaaatcctgtcgctattcaccaatcacgcaaaacccttctctccaagaacacggcgccctcacctcacatctcacatcaattttgataccattttcaaccttaccaaattttaataaagttataaaaaaatggctgcatttagtttgttaccatattttaatacttatagaaatcctactaaaattttagcaagttatcaaaatttgacaactatattgctaaaatttggtaaggttttttttacatcaaagtgaacagtcccaaaagttcaccctgcgcaacaattaaattaagcaaattaaatcatttttggcatcttcttcctccccaagaaaaagggccaggataagcccatccgacggcgcaggcgagccgagagccccgcgagcgcagatctgggccgtccgcccgccgataaataccagctctctcctccactccgcttcacccccaaatcaaatccccttctcccatttttcctctcctcgcttctcgccgcagccgccgccgcctcctcctcctctcgccatggccgccgctg

SEQ ID NO: 5414 - DNA, 1501 bp, Oryza sativa
ttatcgctaagtgatcagttcatcaaattccaactaatgtagaaaggagagacatagagaacctgcctcactctgtgccacgcgacgcgccggaacagccggcgcgcggacagcagcggccgcccgccaagtgttcgaccgaggacctcggtgaacaccaccgtgccgacgcccaaagccggcgaacctctccctctcccctttccgttcctcccgcccgtcgcctctccttgcccctccccgccgctgaccacgactcccaccttcccttccgcggcgaactgggctgcatccttcgacgccacgtcgcatgccaggtactcaaactcctccccggtcataggcaccgcctccttggccagcatcagcgccggctcgccaccggcgccgacgtcgatgtcgagcgtcctcccgtcgccgccgaccacgacgccgaccgcgaggtccccgggcttggggtcgtaatacacgaccccacgcccacccgcaccagctccggcactcccctccccttgtcctcctcgtcttcctccacatagcctccgccgccgccgccgccgcctcccgccgccgcgtcgtcctcgtcgggctcggtgctcttcccctggaagaacttgaggaacggcgcgagcgcctcctccgtggacagtgccggagcggcctcggtcgactcagactcatcctcatcggcgggggatggggaagggaacggcttctcgaggaggtgcagttcatcacctcctccgccttcgccgccaccggaggaggaggaggaggaggcgtggagcggcgacgcagctcgtgctccgcggacggggaggcggctcgcggtggggggtctccgccgcgccgctcggcggcttcgcggggagacggaggcggcggggaggagggagaggagggacgggggcggcatggcgtgcgagcgggtgggggagtggagtggagtggagtgggtgggtaggaaagccgttatctcctcgcggcgcggccaccgtgaacaggagggatatttcctattttgggtcttctcgcggaagcaggcctggatttttatgcgggaaatcgggccagagtaaagctgcagcgacggttcggcccgatactttcagcccgttttaatactttcatccgtccttataagtccagatataacatatcatattacaatgaatctagataggctctctacgcagattcattatactaagatgtgtaacatccaaccaaaaatttagagacaaatggagtactattttatttaatgttactatactggtcttagggatgatgtatatggaaaagagttgaggcataccaagagaaatattcaaggctaatatatgaatatgaatcttattaacaataaaaaccgtgttttttaaagaaaatagatagatatgaactttgatgtggagttttcaacttggtagaagtttgatttttttttctttaaaaaaatccatttgtgtatcacatcaggctagtaaattgcagtttg

SEQ ID NO: 5415 - DNA, 1501 bp, Oryza sativa
agtagttcgggaagcgtgcgcgtggataacgagacaaatctcctctcaagctcccactgacgtaattgagttcagtagttcggaaagcgtgcgcgcagagaactagacaaatctcctctcaatctcccactgccgaatgcaataattgaaaagtaaatgttgcattgcacccacagtgcatcagtttggtaggtgagtgcaatttggtgtaataacttgagaaataagcattctagtgcaacaacttgacaggtatgtgcaatttagtataagaactttataagtgatcgtacaaatacaacaacttgcaaggtaggtacgattttgatacaataaattaagaagtaatgcgacaacttaattataaggagcatttttatataaatccaatttttaagtacttattttgacaatatactagcatggatttgtgtaagcatatttatattttatcctattaactaataactgaaagtctatttaattggatgtagaaattattatttttctgttgatatttgagaaggagaaaaaaacaaaaaaaaattcttaaaggtatttggatgtaaattgtatgttcaatataattcttaaagattaaattcaatattataaggtaatatccgtaggattactatgtaatgacatattggcatcgtgaaaagaactcacctagcatatgcttagccaagttgatgcaccaaaatactaaattattaagtttctgtactagaacgcacccacttgtcaagttgttgcactcaaacgttcaattctcaagttcttacactatatcgcacccacctgacaagttgttttaccatggctgcaattactccaaaataaactactatgtcctttgcgatctcacgggctctcggcttgtcatgccaagacggcccattagtaggcttaaaactataagcgcattttggcccagccagatccttggatcggatccatttctcgttgggaaaaagtccacattgactcccttaaaattacgtcgaatctaattcataccccttaaccagaaaactgggtaggatgactcctccaactattaaaaccggtacaatttgactccctcagaggttttagagatggtttcactgacatggcgctttgactcggtccaactggctgactcagcacgtgggacctacatgtcatgtcacattttctttctcactttcttttctctttttttcccctctttttctccaaggccgaaaatttcccctctgcctccgaacgccaccacaaaccgccgccgttcaggggggggggctaatgggcgatcggtcccgccccccctggctcccttctcccccttcctcctccccttctttccctattacagtacaccacaaaaaaatttaaaaaaacaaaaagttagaaaaatttatgtataaaaaatttgaattcaaattcaaatttgaatcgggtatataaacttttgacttataaactttggatctataaactttagatgtataga

SEQ ID NO: 5416 - DNA, 1501 bp, Oryza sativa
agtttatgtatatagaaaattaaagttctgatgtgatggaaaacttggaggtttaaagaaaaagttgggaactaaaccagacctggatcatctggctcgagcaggggcggagctagtatatattaggggggtgcccagaaacctggtcaagaaaattttttagctatacctcatctattttcatcatgtatgtaccctctaaatacaaacttaggcatccgcatcagcttaaacttgatctaaagtagagtaaattaaacaagtgacaccaccatctatttccttctagcttcgccctgggctcgagtatgcttttcttttggagaacttgcttcatccaagtttctactggttcaatggagtactgctcgcagttagtgcgattaaaatgaaaattacggaacttaagactagctagtcagatgaaccaatgctagctgattgcttgaaaaatgatcatttgtctcgcgacgaaaacttgcgttgaccacccacgggaaccattcgtcagatccacctccacaaactggaccaatctggacgctgtccaattcgacgcccaacccaaccactgcctgaaattgtacacaaacagtttggaatttggagcaagcagtttccgatgttagaaaataatagtcaaacaaacgataaaaaacaataaatgacagaagacacaagatttaacgtgaaaaactcttcaaagcagaagagaaaaaaccacggccaccaaccaataaaatatctccacaaggttccaacaccgaacaacagcttacatgaggtatatatgaaggtgaaattctaaaagaataacgattagctccgatccaaaccttcgacgactcgttccggcagaagctgattttgtttgtgtgtaaatgaatttgatcacacctcaagcagcgcagacgacgacgcgccataggtggcgtgccaccatctcatcggatagaatgtggggtacacgtgccgcatcagttcagacgaaagctgacaatggtgtactgacgtgtagcagctaggctccgttttggacttcaaatacaggtgtttcacgagcatttttttgtcgacaagaaaacgttccgatatatgccaagatccatcagtagtgatccaaccgtgccaagatctactacaacctgcatttcatcacctagctcggtcgcaagcaccacagaaactgaagttttctcaaggtgaacactgaagagcactgtgggtgaaggatgttgagagcaacgcaactcgttgtcaggtctctcatttctgatcattttctactctcctgttttttatcaaatatcattttctaccttgttcagcttccatggagattgtttcttgtacggagcacgttcttctgatgcctgcgtgcgatgaatctgattgtttcttggaaagaacaagaagctgatcagtttcccttgctgcttgttcgatgtatggtcatgtggatggatcaatgcaggagggagaagagcggagctatgggagc

SEQ ID NO: 5417 - DNA, 1501 bp, Oryza sativa
accaaatatggtatggttgaaaatgtcatcaatctgaacaagcccttaattgtagattagtgatgaaggaatagtctaacatagaaggctgagtgctttccacgcacacttctttctttacttaaaatacatacaggaaaaactacaaaaagcaccccaaacatcacccggaatttgatattacccatataagacctttttttttcaattacatccctcctaatttattttgttttgatactttcccaactgccgttactcaatcattctcgtgaacgcaaaccccacaatatgacactactgcgaaaatatggtcgtcactcatatcggacaggcacgataaaaatgattatggaatcctcactcacagtatcatgttgttggactttggtagtcacgagtctcgttcttagatattggggtggctagaaaatgagttgttacgtttatcttacagagtttaattaacagtggctttattttggttgattcaagatgagaaaaataatatcggcatgacactatatagttgagaaaaaaatatgtatattcacgctaaatcttgtaacggaaagaaaaaatacataaaaataaacttattttgagatgaaggacataaggagcaagtaacatgcttatgactgagttcgggggtgagggttataaatcttcattcctagtacgaaaaacggaataatagttagttcatgattaattaagtaataattaaaataaaattttaaaatggattaatataattttttttaaagcaactttgttatagaaatttttgaaaaaaaaccacactatttagaagttagggaagcgtgtgcacgaaaaataagtggatagaagttagaaaaggagagtttaaggagtatttgagagaaggagaaataagaagattaagaagataggccgtgtttagttatttggctaatttttttttaagtatacggacacacatttgaagtattaaatgtagactaataataaaacaaactatatattccgcctgtaaactgcgaggtaaatttattaagcctaataaatccgtcgctagcaaatgtttacttagcatcacattgtcaaatcataacgcaattaggctcaaagaattcgtctcgcaatttacatgtaaactgtgtaaatcgggttttcttatccatatttaatgctttatgcatgtgtccaaatatttgatacaacattttttatctaaacactatatataacgagagaaatcttcactcttttctctttatcatccatgaaactcagcagcttacatctgggtccacctgtcagccagccagattgcgtacagacagagcttctccctcctctcctccctcgtttctcctgacacgctctcatcctacaaggctccaaccccaaggcaagcatgccaaacgcgcttcttccataaacccccgcaatcccaacaccctctccaaaccctctccgaccgatcgatcccccaccacctcctccgcctccc

SEQ ID NO: 5418 - DNA, 1501 bp, Oryza sativa
caagggaattattgttttatactccctccgtcccaaaatataacaacttttaggcaatgtttggtttatgggagtaatccattagttcctccattttagttcctaataatccaaacagggataactaaaaggaactaaaagtgtatatgaggactaaggacctgtttgattcagcttatgattattataatctggattattaggagtaagctgaaacaaacaagtagattattatgctaaattattataatctataagccaaattactataatccaataatctcctctagaggagctttttccagattattgagtgtctaaagacccactactcttagatgcctctaataatccagagaaacaaacaacttgtagcttattttatgccagcttattataatccagcttacattaatctgatttaataatctagattacaataatcttaagctgaaacaaacagggcctaaaatacattaggccctcttgaaggtacttatagggactaaagtgacaacctctctcttctctctccctcggtccatgtgcttttagtcccttctagtctttggatctaaacagtaggggaccaaagtttttagtccagagactatttttagtctagggctaaatgatccttaggcacttaagatttgtcccaaaataataacaaattctccaccaatattctcttcccaatcaatcataacccttcaccgttcactttttccacctacctccacttctcaaccaatcataacccattcctatttaattttatctacttttcttaataaccgtgtctaactttaaaattctaattcggactgacagagtactataatattcattcaactttgaaggaggcaaagcacataaaaccttcttttttgggctggtttgcaatccagtcaagtcccccatatagaaggactgggattgcgggcctcctaagtaaggcccaagcatataaagaggtgcctagactttatgtaaaaaagtttgaaaattcgaaatagataagaattcaaattcaaacccccaacaatttcttcaaaagaagggcattcctaggaatcgtatcttcaacaaaaggagtatcgtacaaaagagagagagagagagagcctctttagcctttagcaaaatcacctgcctctttttgcaaaatcacctttctttacgaaaagggaacattgccattaggcccccacgcgcagtatgtgggccatacctgtcagcctcacaaaaaggatgtctttacctcgtggatttggacaatctaatggttttaaatatttttttaatcgtatccaacttctctcctccagtcctctccctcccgtagaccgtggatatcgtagaacaaacggaagaacacgagaagcctctcgaagcttccagaatcccgattccaccagattcctcccccccccccccggagccctaattctctcgcgcggttcgtcccgcgacctcccggttcctgccaatggccgac

SEQ ID NO: 5419 - DNA, 452 bp, Oryza sativa
taattcaccaactcattcttacacctacatactcattcatcaaatactacggacgagaatcatccaatccaacgccacagaatcgttccacgtaccccctcaacctccgcgcgcatttccccaactcccctcaaccgaaaatcacgccgctcagatcgctcctcctgccatcttcaacgcgctctccttccccaacataaatcgctccgcctccctctcccaacctacagcgccgtcgcatcccctgccaccacaagcgccgccgcactccccccggcaaaccctaatcgcctcctcctctctcccctgctgccacccttccgtttcgccaccagcgcgacggctcccctccccaccgaccgcgtcgcgaactcgcgatatgcctccgacgctcgtgcccccctccagcgacggcggcgccgcccctcgccgctgaccgcgcagccggcgcc

SEQ ID NO: 5420 - DNA, 1501 bp, Oryza sativa
gcctccaacaccatcctcgtcgtcgtagtcgcttgcaaccatcatgtcgttgtaggtggaggggctgcgggatgtgcacgggagagggactggtgctggctccgcccctcccatcgttatcgtcattatcaccggagatgccatggtagatccggagatcccccacgctggatccgcggccaccaagtcctccgtttccggatccgccgccgccgccgcatatcatacttcatgtgcatctaatcagacaaatattagatgtaacacttacctagtcaaacacacgtctatatattaacctattagagtgggatgcaacgtataacggaaacataaaatatatacagaaacacggacgtaaaccttcatattcacattacccctttacccaaacgaaatggagatgcgactaaacgagaaattcacatataatcatttgcatgattggaggcagtgagctctagccatccatctaaccccaagacccccaaaaaagcacatattcatctcacgcttccttctcacttcttgtcccccgttcgccatcgtccaccttcggatagtctaaaaacgctcattgtctccaccgccaagggtgcgtgaagctctgatttgactatcatacaagtagaattcgtccgcctctctgagtgatttaggtaagactcgataggaccgtcgtctcccagggacgacaatgatatcagacaacgagatggaggcgaacgtcgaccccatgatgaggtggggtcatgtatcatgtgtatctagtcggacacacatctccgtaccaacgtacctagtcaaacacgcgtctatatatcaacctacctaatcagacacacgtctatagatgaggcaagtagtacaagtgttctaactctcgatctatatataaaccggaacgcgtatatatcatataatggagacatacgcttaaaaaatatacgcggaaaaataaaagtggaagccttcaattcatatttaccctagcaaaaaaaaaaagtgaaaggaagactcaactgaagcaggaaggcaggaacttaccgttttttcatgattgaaggcagttactcacagtgagttccaatccaggccatccatccatctaccccccacaaaataaaaagcccaaaattcattcgtttcccttctcccttcctcgctccccgtcccccgactcgccgccggccgcgccaccggagaatccaaaccctcgccgccgccgacgccgccgcccggccgcgcagagctctgattccgcggaatccctgcgcgccttcgcgagattccctcgggtttgggcgggaccgtcgtcccctggcctgagggggggttgccgagttggcggcggcggtggcaggcggcgagatgggggcgaacgccgaccccacgggggtgcttctgggcgggccccaccaccgcaacccttcccccgcgccggcgctggcccagccgccgggcgcgagcaccgcggcggcgctgcgccacgacccggggc

SEQ ID NO: 5421 - DNA, 1501 bp, Oryza sativa
atacttgcgaggtattggatgatacctaccaggtatcaggtgattcctactagatatagctgggcatcccgttggggaaggagcatctcgacacgcgcagtcggtcccctgcagccgtcccttgcagacgaggacggagacggcggcggcggcggcggcgggggacaggcgcggcgacggcgggggacagcaacggcggcggtgggggatgggcgcggtggcggtggcggtgtcgacgggggatgggcgcggtggtggcagggtacagcaacggcggcggtgtgggatgggcgtggcggcgatggcgacgcggaacggcaacggcagcgagtgagcaggaattgcgttggaagaggagctatcccgttgggggatggtatcccgtcccctggcattcccgtttatgataggtacccaaatgataccttgcatgtatcgtgatgatatctaggagatatcagtgagtgatgatacttgtacttatccgggatgatacttatagggtagtagtgtatcgacgatttattttcatgtacacaaatgatacctgataggtatcgtgatgatacttacaaggtatcaatgatggataatacttgtaggtataagtgatgaaaaatatttcagagtaaattttcaaagttacactaaatgaagcaatcaagcaaatttaactaaaaaagattaaaaggaaaaaagaaaaaaaagattgccaagcatggcttagtcaacatgtcattgcctagtttaccatgccatgcaacataacaatcgtactagtactacacacaaaccacaagatgatgccatcgggattcgaaagggtgcaacgtgtaggcgtggcatgggcggggccagcattgagtaagcaacgtcgtcttgtgatcgtgataaagcgaatactagtcaagcatgcgcgtgtgtgtcgtacggatagtgcaatggggatgatcccgttccgatcactaccaacggtataccggtctctagcatttccgggtaaaaaaacatagtcccggttaacatgagtgggaaaaaaaacacagtttcaacaaggtaaagtcaaatttgagccttaatttattttttcgttaaaaaaaaaagaaactgacgccctcaccaaaccggcgatgaatgagtgggggtgttgtcgttccttaagggctaagctgttggaaacaaacaatgcaagaaaactgccatttggtaatattatgtatatagtccaaaatgcaattaaactaacaaaaaaatatttaattggatttagtagggatgattgatggatgacccaaggaaagaagggaggaaggaaggagcgaagagcgaaggttgaggtgagcaagcattgacaagtggaagcaggcccacgctgcagtcggtcaaacatggcagctcctccaccagccaaatcgcgtccagtcaccacctcttgttcggttcttccccatcaggccatcacccacccacgcgcctcgctgacctgccctcctgacttgcc

SEQ ID NO: 5422 - DNA, 1501 bp, Oryza sativa
ggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatcgcgctgacccttgatgatgtggctagcttatgatacctcggatggaggttagcaccaaaaatagtggcgctgagatgttggatctcaacgccacttccgatggcactgagttcgtggttcattttttaaataagtttttgacacggtttattcttgtaataagtttttgtaaagggtcaaattgttaaaaattgtgccttggattactcattgtacttatgtgattggatgtttatattaaaaaggtgtctctcaacctggtacttcaaaattaaacaaacacctcatttatcgaaaatgttactacctagtttatatgattggacactccttgctctttgtttaaatttattgtactagaaaatattcaatcaaatcgtgtattaggtagcaaaatagtttaggatcactatagaatacttcaattctatccaactttgctatagagaaatgctaggaagtaacttcactagaaaacaatatatgtgtcaaattcatataaggacctgtttagttcaggggtgaaaagtttttacgtgtcacatcggatatatgggcacacatttaaagtattaaacgtagactaataacaaaacaaattacaaattccacctgtaaattacgagatgaatttattaagcctaattaatccgttattagcaaatgattactctagtaccacattatcaaatcatggcgtaattagacttaaaatattcgtctcgtaatttacacgtaatttatgtaattattttttatctatatttaatactctatatatgtgtcaaacattcgatgtgacagagtgaattttttttttaaaaaaaaactataaacagggcctaagatggattgcaacctggaagagagtcagcgagtgatcgcacccgttcctccctgcctcctgcaaggcgaccgcaccgcagccgtacgtctttgtgggagggatccgaccgagcgagacacgatccgattcgattcgattcgagacaaacagcgaccgcgcgcgccggctttcacctctcctcactttacggggctccgcaccaccgatgcgatcacgatcagccacaccacaccatcggccagcctctctccctccctacccgacccgacgcatttcccaccaaaattacctatcaccaccacggctagggtttcgccgccgccatggacctccccgccgtcaccggccgccgcaccacctcctactccctcctctcccagttccccgacgacgccgccgtgctccagcgccagtccagcggcagcagctacggcgccggcagctccctctccgcctccagcgacttccccttccacctcccttccgccgccgcccc

SEQ ID NO: 5423 - DNA, 1501 bp, Oryza sativa
tgcttataattcatcacagaatcgatttataagcttctgctgctagtggtggtgaggtattttatttattgttgaaacaaatcaagtcatcttgttaaacatttctcttattattaattaagattgctcttggtcgataacatcgatccatactcttgttgctgcctgtatgatctgtgttatttcttctgtcgtaagtacacgtatatacgtttgtcacagcataatcctggatttccttgattggttattgagtgaaaaatgcttcagttgagcatccgaagaacaattttgtcacttatcagaataacgcaaacctcgtttacccaatttggttacttacttggaattgggctggtgcataatttggcccacgcaaacatgggccgaaatgtaaaatttgagcccatatgataatgaggcccaagctgtgagtgcttctcccgctaaagaaaacgaaatgaaaagaaacgcctttctgacttgtctctctgactctgttgccgactgtttatcagtttcgccgcccacagtttcactccttcctcctaagtcccaacaaatctctactgaatttttgttttctactactactactgctgcaactactatctcaaaatctaaaatatttgcggttgatttgaagagtcgtcagtttgagacctgagaattctgaatgctactccaggttcaaacgaagttggatgagtggataatgtgtctcttccagttggatgagtaagaaacaaacaaaccaattgcttgctgctggctcttcttcttccagcactctatgaatcgcacgtaaacgctgtgaccactctgctaggctgcctgtacgcttgatttcataaagctgacaagcaagtttcagaattttgaactcaaattgtttcaagtggcaacaaaggtgcaggactgaccgacactaaccagacttgcacattggctgcagagttgcagttgcaggcacaacacaacaacaacgtagtactactccagtaggagcaattcagtaaaattaaaacgaattaaaccggcacgaatctcaaagcaggcaaacgaagagacaaaagggggatgaaatctgggccgctgctctcgaatctttcttttcctttccccttttcgtttctgtttttttgagatttttatttaaatttcgtttcagtttcgtttgagttcgagttcgagttcgattcgattcgattcgatttcgttttctctcaggaaggaacacgagcggttgggttcatccccctcctcgccgtgttcttcgctccgccgccgggcgccgccggatcggtcgccccaccccccccccgccccctccctcccgaagcttctcgaaccttcctcccccctaccaggagccgtcccgaggcggcctagggttcccgcgggcggccgcgcgatttctagggttttgggtcctttgctcggggcatgggccctgcggttcggcggcagtgacgagcggcaagccacctagaggaggaga

SEQ ID NO: 5424 - DNA, 1501 bp, Oryza sativa
ggctgcaatgaaccgacaccatcctgataagccccctatccatcagatccttcatagccctcctagccagggacccattaatctgcaggtaaatatataaaatcttgttacccatactgagcaagatgattaaaattacctagctgtacaacatctaggtataaattacacagaaggctaaaacaacaatgatgacgttaagagttacattgccaaaagagaatatgctatatgttgcacatgcaaggggaaaagagcaagatcaaacttgccatactaataacagtagtttcaggtactaataaaaattcacaaatcaactatatagtttggcgcatggaaaccaaacaaacatgcacagaggcctaacaaatcattactcctttgctcattggcatcactcaaccacacaaaaatgccaaccatgacaccgaataccccaaacagtggtgattctgcatttaactcatggatggaatatcaatatcataacccacaaatttagcacaggagcctaaaattaaccacaaggtccttatcttcctgaattctatcaagtgggctaggctacatgactgtgaaaatatagtgaaaatctgaattggcgcgcataaacaaagaagaaattgagaatgtgagctaggcaaccagcatggcacagtattgttggtggtaatctaaatttatcaatgaattaccctgaggcgctcggagaggacggagggggtgatctgcttgtacttgggcacctcggagagcagcttgtcgtaggtggcctggtcgaacagcaccgagttgttcaccttctccttttgctttcccttgctccacttctgcaaaccaaacggaggcaaatccatgaccatgagaaaaccgaacaagccagatccgaataaaaccgaacaggaggaggaatggagatgaccttcttcttctgcttgccaccgccggacttggcgggcttggacgacggcggcggggccttgtccttcttcggggcctgagacagcaagcaagcgagagggtcagcacgcagccggcgatcgagcaaaaatggtgggagagacaaacgaggcgtaccatttcgacgacgcgatgcggcggcggaagaaggcgcaggcgaaggcaaggatggcggcgacgaggaggagcaggctgaggctgcaggtatatgacttgggaggtggggaggctagggtttcagcgctccgatgcgtttctggccgtcggatttgatctgatccggagtattattcatccaagtcccacacaaacctctaatactcgttaaccatccctgaggggaggactacgtagaatgttttcaaataagcatatttgaaagggccaaattacaaagtagcacagggagtcatagcagcggtggaatagaatcgagtcatcatcatcatcagtgggggagttgggagagagagacagtttcacggagccaacgaagcgaagatcctctcgtctcgtgttctagggtttctcgcggcga

SEQ ID NO: 5425 - DNA, 1501 bp, Oryza sativa
acatgaggcattacactacaaaaaaacttaaactctgatcttcctgttgatttcaatgatccgcggaaatgatatctcaaactctagttcttgatcttcttcttgggcctcagctgaaagggtaggaatttgaaagcacgttagatgctacagtagataagacgcatttcggcgaggatatagaatacttgtcaacaagctatactaaacttggttgacatttcaagtgcaatttctcacaacagtattaaaaaaaatcacaaatctaaggctgatgtaaacctaatatgctcaacacactacactacttcaaacataattagagcagcagacttgcaccgctctaaattgcaagggtcaatacaaattctaaaatctaatggtgcccttagctgttgctcctattactaaagaacattggtgccaagtaaacagcaaatctaaatcacttgcttgtatagaacaatgataatcacctggttgctgtggccgcacttcttcttgcggcagttgacagccctggggtgcagccgagcatagcacctgcaagaaaacagtcgaaatgtattcacatgctgaactcagtctaccctaaaagggagcaatatcaggaaaacagatgcagcactactgtgcctataatacatgatggtactactggcataacattagcaaatgacactaactttctggcaaggcatgccagtccaagcatcagagccaaacacagtgaaaaaatgttttgaatgttactagattggcaggtcagaaagtaattatgcctcaaaagttttagatcataaggtgagttcacacatctaattgattcatcatcccagccaatctgctaatttccacatacatactacatggcactgctggacacagcaacaaaatacttgatgatagaacttcacaaactaagagtcagtgagtcactcatacctagcaataagataacacagggtatattaattgaataaaataatacatcctagaagatggttaaaatgaaaaatgtgcctcgataggttagctcacttgaaatttcaagtcgaaaagtagtgtttttatcttcccaaaacatatggtaaagctcacaaacaaatgacaaaaaaaagcaacttgctttgaaacatagatgagctgattggcaggtcagacagaatgtatgcctcaaaagttaagctcacaaggagacttcgcacatctaattgattcatcattcctgccaatcttctacgcagttccatgtggtatgacaacgaatgatttaacatgtcccaccagtgaaaatcaactaccgaaataggctaggcagcagacaaagtataggtgggttgtcaatctctggacccatggggaacccaatgccacgcgtcatagagttacaaaccacagatccaaccctcacaaggcaagcatcatatcataagcataataaactataggaacatataaaggagtatgcataatcaaaagtcgagcattcaaggagaag

SEQ ID NO: 5426 - DNA, 1501 bp, Oryza sativa
cggatgtcatacccgattcatttcttgctggtagatggtagcaggcataaaagaaccgagaactacatatctgagctaaacaatccacttgatcttgttagcttgtggttcttggtgttgttgcaccctgcacattcaggtgcaggagaggcaccttcttcgtcctggaagtaaattgcagactgttgcatacgggacctcaagtccaatgcatagaagctgagaaatgaaggggagagcagtcatggctggcatgatcggtgctgttctgctgctgttccttgcagttcagttttgagattcaggaggggcacattgcccccttgaagtcaagcactcagcgcgggtgatgagaagagaatcggcacaacatctaatatgtggatatttattcaggacgtggttagttcaattcttgctgctatttgttttgcttattagcatctttctcgctgaaagtttttctcgactatttgcagctgcttggtccttgtcgcttgctgaagcttcgccttcgccttccacctgaagtggcgtcagattgactggaccgaagatgcagcgctgtagtccccacagtgaacctaagcccctcgctgaggcttaatcagtgtctgttatagatcattgtagttgtagttgagtaaccccaactttgtaactccactctagtaagttaaaacaatgtactaagctcgattgccaattgtactagtagcactatatgtattgtcgtatggactgggatgtcgcagttactgcttgtacagtggagctgcgtaactttaacccattactacagctttatgccgccgattttattaggtccctttgtgttctgtattgaaatgatgccatccttcctgcctgctactcacaccctctccatgtttgttctggtcatagggaggcagccagcagagacgaacaagcagaagagtcaaagccaaagcaacaaaaggaagggaaagggaaggagatggaagggatgcgatgccgtcatgatagctagcgaatctcgtggtggccgggcctaaccttttgccatcattttccttccacggcctacagaatccagcatatctgctgctctcatgatgctcttgcactgcctctgccttgcattaataggctcgctccgagggctggatcaagtgaaatgatgaccattcgagctgctcacgttacctatgtcaattctgcactgctgctccttccttttgcttctataaataccttaccttgtgctgttgctgcttcaatcttcagttcttcactagcaggagctggagctagagctgcatccattccgctcacatcgcagcctcgcaaggaggaaggaggtggtttcttgacttgatgtaagatgccctctgctttcctttgttttctctatctcaatatatatatatgctctttgttacataattctccctatcttatgaactgcttgtatatatgttgcgatggatttagtaagatcgagtgaggagggaggaga

SEQ ID NO: 5427 - DNA, 1501 bp, Oryza sativa
ttatttttttaccactcacctattttatgatttttatcatagaaaattaaacataagggggcttgccgcagctagcgctgagacacgtcagttgcatccctggcatagctaataggaaaccccaagattaacattctataggtgtaaacatgtgccgtgtcattgacgaactttcacttgtctttttaatacttattcctactatatatacctgagtaagttttagtgatttttgctaccgttttcttccacaaccatggagcccggggttggctccaagggtgagctcgacaaccatgaattgacctagaaggccttgaggatgccaagatgcaccaatctcgacggtgacttgggcaggcgagcatgagatggctatagttgagctcggggaaaaggtgatagagaaaaggagattagagggcatcaaggtcatttcctacctgtcttgctgacagcgaagagcctaagaatggcaaaaccgaaaacaacctagtgggtctggatggcaaataatcaaatatgatgaagagaatgacatttgggaatgcacacttaaagaggatggcaaatagtttaaaaaaaaccccaactttcagaggggggggggttgtgaataatttttggttggtttgatcttttagattatataggggctgttcgacaggctgactgcgagagctgcagctgcgcacagtgagtgcggcactgttcgtgccggctacggcgtagccgcagccctggcatccaaacaggccctaggtttttttatttagagtttatatagttttcacaaggtcttcaacaagatttaggataagcttgtctactgggttgctgatgatccaattagccgtgccaattctatggtttggggcactagtttgtttggtgataccggtttgttgatatttagggtgatgaagatggtggccgatactcgttcctagtattttttttggcgtgcgtcggagttgtttagtgttatacataacaagaagaagattataatttattttttatttaatataatctgccttgcctagaaaaagaaaataatcactacactagttagagcatgtatggtgtagagaatctactacttagttgaggggagggcaaaaccaaatcctgagcaggaagttaagtaaggctgaatcattccttccttcgcatgcaggcccaaaatatcccgtccgtttgctccatcagcacggccacagcccaaggccattactgggctgggcttgaccttcacaatccgagatgcagtactaagactgaattgcccctggacggagcgcggagacattgaaaacgtgtgagggtaataaagtaagttcgcgtgcggagaaggggagcacgcgacgcgaccactccccttctccgcctcgtcttcagattccttcccttttccgacccaaattactttttcctcccttccgattccgacctcaatatccaccttccctatctaccccgaccaccgcaaccgcaaatc

SEQ ID NO: 5428 - DNA, 1501 bp, Oryza sativa
aaccagggattgattctcttctgcatcatttggctgtctatacttgtgaatctggcggcggcgggaactgcggttggcccatcgcgaccccggccagcggcggctgcttggccggcgcctcgtcggcctgcctgcggagcatgacgtaggacgtgatcccggaagccgtggcagcgagtgccagcacggccgcgccagcaaagattccgtccttgacgacgtagcagtcgttgttcaccaccgcgcccatcccgaacagaaaccacgcgatccccgccgctatcctgcatatccgctcccacgcacgctcgatcagtttcggcatgaatcacggttcgtcgagtataaccacaccgtaccggcggtgatatcggcggtgactaaccatgacatgacagcgcagatgacgccgattatccgcttggtctccgacgggatggaccgggacttgcagcagccgcagcagccgccgacggccgacacggtgatctgcgctaacagcaggaagacggccgcgcagacccccagcgcggtcgcggggttctccgggtacaggcacttgccgccgaccagtatatcggtcacctgcaacaacatcgttggccgtcgtcatacacactgataccactactcgcgcatgcaccgcagcaagctcatttttgcacatgttgtacaaggaaagacatcggtagtgtgcttacagtgatctttgtgccctcggcggagaaccccaggatggcgctcagcaaccccagggacccgacaaccgcggagacgatgatcgtcgtcttgtccattttcccggccattcttctcccaagtcttcccaagccttgccttgtgtgcgtgactgcgtcggtctttataaacagcgaacgagctgccccacttctacgatgtcaccagatttacgccagcacgcgattgggaggaagctggtaacgaaacaggcttgcttaggcaaaagttggcaggggctgttgacagatgcgggtgtctttgtttacatcgagcatgcagccggcacggtaacttgtatcgaccaatcaaattgctgtgctgtgcttacaatttacaaaacggtacgttctattgttattcccaagaaaagcgatgttcacgaattcacaagccgacaatcggttttagcatcggaagagaattctcacagtaggagagctaagtgtgtatatcagggaaaactctattcatccaaaagatattccctcatttttacatgtcacttaaaagttatcaatttttttttaaaaaatagtatgatagattaatatgtgacatgtcacttcataaacatgcatatttaaattcaacttatacaagtagaaacaaaaataataaatttgactacgaataaaacacgtaattcatggtcatatttgttatttttgtttcgaattgtataagtcgaattttaacttgcatgtttgtgaaattgatatatcttcataattttttaaaattttttgattacttttttaat

SEQ ID NO: 5429 - DNA, 1501 bp, Oryza sativa
cctactcctgtatttgggattatggatgagttttacaaaggtttcttcactctagaaagcgcgctcgcttcctctcttctggagttcaggttttctgggcgtcgtccccttgtctcagtgggcagggtcctccttttatagctcaaggggataccacatgcgccgcctctacctaccctctctcggagggggatcctactccacttttcctgggctttaaaccgtgccttctcccggaagctaagcaacaaccggttctcgagtggaacccgacgccgccccccgcctgacacgggggacagccctgtcattccctcataaatgaacgatgacttgcgacagcccttcctcgagtgacgctcggacgtgacgggtcatacccacccccactccaccgggaacaagggggacgtgaggacatggttgccctatccatcggatgtgacggtgacaggccggtcacagaccggtcacatccgttggacagaggttagctaggcgcgccgcacgtctgcccttaccgcattaaatgcggtgagagacagttggggcgtcgcacatttatggctgttcagcctgtgctcccctctcgctctctccctccgccgcgtggcagccgggtgagggcctcggggcgaagccgcgggatagccgagggggtgacgccatgccccgaggccctccctccccccctccccccgccgcttccatgactcacgtgaagcgtgaatggggctaacttgcagagtcacgtggccggagggaaagtaattcccctctacttcacatacccccgagtccatatctccgacagtagcccccggcgctatatcggatatcgatttcctgagatcgttctgacatggcgcctcacaacttctcaagctggggttgtgggcccggcagggaatccaaaaggatatggccgcgtggccaggttggcgtgccaaccataacaacggtttgaccgccactgaccgccctcatgatgaagatgcttgaggcgcgataaccggggggggtcagtcagaccacgcctcgattctctcgctcgctactcctgcggcggtagtggtgacggtttgctcaacctgcgctcatggccattgcgcactccacctcgagtgtgccactaacagacgcactaaaggcgggagcggatacaacaggcgatgtgatgagtgggcgcaggatgcgaagagacaaatgcgggcgtgagaatcgtgggggcaagtatgggagcgcgaaacgaggaggcgagcgcggatgaggcgaggataaaagggggcggaggcggagactctgcccccttcccttcgccaaccgcccactcgtcctttcgcttctcgaaccctaacattctcgccaccccattccgtctcgcgccccatgctctccgccacctctccgccggttgccatggcccaagacaccggtgacgcagtgctcccttcctcccgcatcacaacagacaggcaccttagccttccccgcaagatca

SEQ ID NO: 5430 - DNA, 1501 bp, Oryza sativa
gcccaagtcaccgtcgagattggtgcatcttggcatcctcaaggccttctaggtcaattcatggttgtcgagctcacccttggagccaaccccgggctccatggttgtggaagaaaacggtagcaaaaatcactaaaacttactcaggtatatatagtaggaataagtattaaaaagacaagtgaaagttcgtcaatgacacggcacatgtttacacctatagaatgttaatcttggggtttcctattagctatgccagggatgcaactgacgtgtctcagcgctagctgcggcaagcccccttatgtttaattttctatgataaaaatcataaaataggtgagtggtaaaaaaataaataaaactattaattttgagctgatttttaaaattttgaattgaaagttaaaatttaagttgaaagtttttaaatctgagttaaatgtttcaaaatgtgagttgaatgttttcataccttgagttggaagtttttaattctaagttggaagtttcaaatctaaacttaaaaagttttcaaatcttccaaatcctcagttaaaagttttaaatgggaaaagagaaagaagattagctgaactggttagttctttgtggtggaactagtccacccgagttcgaatttgggtgctcacatttatggctaattattttttcagtggtaggcaacgtatccatcgacagtgaggcgtttatgatgactttgtcaatctcaagatatgccggtacaaatttttggaggtgctcatatgtgtggggtgcgtgtgcgtgcgcgtggtgtggacacctgggtatgtattattttctcaaaagaaaaaaaaagaaagaaggttggataaggtgtgcattacttccgattgtagctggtatgggctaatataggattgctattaatcttaccttaatccccgtgtgatgtgtggcatggcagattaataagattaataagacggagcgtgcagtatattctgtgatgagatccatccatgtgaatgtgcaccatccagacccgagacgtaacgtacgtatacgcacctacgttaggtagggaaagacgacagcttagctatctatcccgtcttccttgctgttccagttacagatcggacggcacagtcagcgccaccctttcctccctgcgcgccgcccccctactctactagtattataccatctgtcaaatcatcgtcatcgtcgtcgtctcccccagttgttgtgatcgccaattcatccccgccctgctgcctccatccaactcatcaggaaccaacccatcgatcgaccatggatctgcaggaggcggcgatggaagccaggaacggccatcggatcccgccgacggaggagaaggtcatcatcgacacggatccagggatcggtacactaattctgatttctccacttctcctacctgcatctgtgactgtgatccatccatccatcttgacaattactaattcatatcaattcccagatgacagcg

SEQ ID NO: 5431 - DNA, 1501 bp, Oryza sativa
cgccaaggcctacccctcctgcgacgccatcccctgcgaccagttcgaggtggccttccaggccgtcgagctctggatcgccgaccgcgccgtcctccccgtcgagaactccctcggcggcagcatccaccgcaactacgacctcctcctccgccaccgcctccacatcgtcggcgaggtccagctccccgtccaccactgcctcctcgcgctcccgggcgtccgcagggacctcctcacccgcgtcatctcccacccgcaggcgctcgcccagtgcgagctcaccctcaacgccatgggcctcaacgtcgcccgcgaggccttcgacgacaccgcggccgccgccgagcacgtcgccgccgcggggctccgcgacaccgccgccatcgcgtcctcccgcgccgccgagctgtacgggctccaggtgctcgcggacggcatccaggacgacgccgggaacgtgacgcggttcgtgatgctggcgcgggagcccatcatcccgcgaacggaccggccattcaagacgagcatcgtgttcgcgcacgacagggagggcacgtcggtgctcttcaaggtgctgtcggccttcgcgttccgggacatcagcctcaccaagatcgagagccgcccacaccgccaccgccccatccggctcgtcgacgacgccaacgtgggcacggccaagcacttcgagtacatgttctacatcgacttccaggcgtccatggcggaggtcagggcgcagaacgcgctgtcggagatacaggagttcacctccttcctccgggtgctcggcagctaccccatggacatgacgccctgggagtattcctcctccggccaaaccgccggcgacaccagcagcagctgattgatcaacaagactgatgctgctgctgttattggtagttgaatacagttatctcaagaaatgctcaaatttttgttggttaatttgcttctttcttcttcttgttttcctttgaaatttttgtgaccaaaattggagagaggggaggaagacctcctaatgtttgattgcggtcgcgggtgcggatttacatcatgatgatgttctcagtaagtcgaattttacatcttggaatggaagagctgcctaaaacaatcaaaacaaccaccacatttctgctgtcctgtgatcttgtctgctcacaaatgtttggctctcttgttgctgagaaaaaaaaaatgaatgaattcactgatcgatatggcatgccattactttgagtacacacatagtactgtagatggtacagatagaacatagaagacagtttggtgagtactgggagaaacaaacatgcatccatggcagcacgtactccgtaaggttgatgttgataggatgggaatatggctgtggttggtttggtggttggggctgaccgacagaggtagcaaggggaaccatctgcaaccacaaactccataagcggtaggtggcgttcgactgttgaaatgagccattttcttttca

SEQ ID NO: 5432 - DNA, 729 bp, Oryza sativa
ccccccccccctccccctcccccccgccctgcgccgtcgccttctgccggcttgcccagtcgcccagggaaggtaagagaagagtgagaaagagaggagaaagggaaagggaaaggagggcagagggtgatgatgtatagttaagggatccacatatctggttttgtggtttgagagcgttttttatcccgatgacaagttgagggaccttcggtgtactttttccatcttcctccccttcatagaccggcccacttattctccttcttcccggcggcccaatccccctcacaggccggtcaccatgtccattttaccttcctataccccaccagcccaataacagcctcggcctagctcgccgcatgccgtccctgagcttgacttggcctttgcaagcgcgatccttagacattgctcgcactgtctccaagctctctctcttaaagcatgcgccgagccgcttcaccagtgtggttcagctgccgcgagcgcatgctagggtcaaaatcaataccaatatctcttgcgtgtctatttaaagcttaacgccattcttttttgcgctgagcatagggatttgtttctagaattagttttctaaaaagtttaattcgtaaaataagttctgcagaaagggccatgtgtaaaaagtccagcatctagacagctgctcctagttaacataacgactcaatgcctcgcatttctttctttctttctgtgttc

SEQ ID NO: 5433 - DNA, 1501 bp, Oryza sativa
tactatatataaccaaaaaaaaaaaaagaagatacatgcatgtgagcgagcgaggtccaaagttgtgctgatgaagcaaagctgttttcccgttgtaactgaccggagtacatactcctatgtacatgtacaatcaacacgttcggtcaggtcaaagattgattgaacagcgtgctgcgcaggagtagatcgatcaatatgatccgttctgcccgttgggcaaattaaagaaccgtcccttacaaatggagaggcgatcgatcctcaacacactgagcaaaagcttttgttcttcagtaatttgcaggcttgcagctagctagtttacggcatgtatcctagcttgcttgttgtttggaaagaaagtcaaaacaacttttcaaacatgcatacatgttctaagacaattaagttccagggagccaaaactatgtggcaaactatgtttggctagaaaggatctatcatagttttctttttaagactcagagaattttatttacatattattaattaaacaatagagtatagtacatttgagtgatctttcaaagttattttcggtgtgacaacatttggtatggttgtgttggtaatgatttgtttaatttattgctttgcattaaaattttgaaatgttgaaaagagcgataagtgaagtaccccctctgtcccataatataaggtattttgacattttgcttgcactatttgaccactcattttattcaaaaaatttgtgcatatataaaaaaacgaaaagttgtgcttaaaatactttggataataaagtaagtcaaaaaaataaataataatttctaaatttttttgaataagacgaatggtcaagcagtgcaaataaaatgtcaaaatctcttatattaggggatagaggatagagggagtgtatattttggaacctactgaaatttgcatgaaacatgcatgtcagagttttttttttctactttgatctcttcggttcaaaatacttacttttaacctattttacagtcctcaaaatatttgttgacctacaatttcgatagacagcttaatttggtcttttttttggtctgacgtaccgtaccccttccttaattaactcataactaagttgtttatccatgtatacatgcgcatttttggaatgattaactgaacaaaacagccattttatctaccttattagttcttgtgtccaactctaaaacaaacaaatattatggaccaaagaaaaaaaatttgtacaaaaagcacacatagttgggcgctccatattttatattttctctcaaagtatgtatacatctcgtaatttagtttgacactaattggaaatattaaatgtatactaatgataaaacatatccataaccctagactaattcacgagacaaatctattaagcctaattaatccattattagcctatgtgatgatacagtaaacatgtgctaaaattaggcttaaaaatttatctcgcgaattagctctcatt

SEQ ID NO: 5434 - DNA, 1501 bp, Oryza sativa
aggggatcaatcataaacatggatttctgaaatctggatccatcttgtgtgcaacggtggagatgaggtacacaatttgagaacattatcagcatgagaacagttcaacatgcagtgcagcacaaatctggggatcagatagtggaagagtaggaatgaaactgaagcctgcctggtacagtttgcaaccataagtcgatacttatgatattttctagcatcatagaacacttgcatagggtgatagaaccctaccattgatatccttttgccatgacgagtaagtctgatattcatacagtgaatgatatcgtgggcataaaatcgtcacacggtaacttgaaatggattccgcaacggtaaagcgtatataaccatgtgccttaacgtcatacaagagtagtgcatgagcacgcacacatagaaagggatttgatcgtagacaaagagaaattcagtccatagcgaaacactcattaccctgatatttgcatacatcaacataggcgaaatgcgggtggtttaaaccttttgttagaaattaggtcagtgcgcagttcattagtaaagaaggtgatgtttgggcaacaagcacagcacagggatctcatctcgattagctatgttattatgtatgtagagtagaatacaaaaaagatggctgctcatgggagcacgtttgctgtatctagcacaagacgtacatgataaagtagtaagtaggacaggaggcgcctcaatagttttacatggagagaaagggaatggaatagcggaagaggagaagggtcacctcgaggatgttggcgcagatgagagaggcgatgggcttggcggcgtggaggttctcgccggcgatgatggtgaggttggtgatgatgggcttggagttgaaggtgagctccccgagggcggtccggtactgcgcgacgagctcgtccacctgcgcctggtcgacggcgggggcgttgccattggcggcagcggggtaagatctgggatccctgggggcggggtgctgggcgaggcgaggcttcttggggtcgggggcggcggatctgcgggcggaggcggaggtctccatgggggcggcggaggcgcgcatggtctagggtttggggggcatgagcgtgtgggtgtgggtggagctagggtttgcgacgcccgctctcctgcgggtcgggtcgagtcgagtggagtcgaacggggtaagaaattggatgggcggaggcggagggagggagggagagagtcggaagctgtgtttgtttggttgatttggagccgaagaagaggaggaggaggtttccttccttctttgcttgtcaagactcaagactccacatgaagaggagaggaacacatgacatgaggaggaaggaggcaggcatatgcctcaattcctcaacttccatctattcactgacttaagaataagattgttaaatttttatcatttttataccaccttaaaacttttttccttcacctgatccgataa

SEQ ID NO: 5435 - DNA, 206 bp, Oryza sativa
atggccattaactaggtctgtctaaattaaattagggtgggagtagatgattaaaagtgggagtgcgtctggcttgcttaacaagtcattgattagccgcgtgtatttatagccgtccacccggagcaaatgaaatcatcttttccttaattccccacttctccctcctcttcccctcgatcatctctcccttctaatcccacagg

SEQ ID NO: 5436 - DNA, 1501 bp, Oryza sativa
cctgtcatgtgggtcctacaagtcagtctcgctcactgctggaatactgactactcgcgcaactactcctgtcaactcctccgacgccccgccgcgctccccaacttgtcgcccccgcccccgcagaggaccggcggatgagcagggatcccgtaccacccgactaggccgctgggtgacgagcgacgagggatgacgggtggttgaggaatgggcgttgctaccaccgccgcccccgccggtgcgctgtccctggccgccgccgccgccgccgtccgtgcgtggccgccggtggactgggtggggtgggaaatgaaatgaggataacatgggctttttagactcgcgatatactagtagttattattagtctaatatacatcctccggggatccacgggtcaaccgcccccgatcctactcatgaccgggaaatcaacacgcacccggcaccccccggcctctttcctactgattaaatttaactgttagtagtacagtatttgataatcacgctgattagcgttaatccttagggttcttcctactacaaaacatgacagacagacagacagacaaccgtcgtcaatctagcaatctcatataccaattagagcaaggataataataatatagcacacttcctacttcctactattagcctatcttaaagctaacatatataataaattagctataagattgtctacaatttttttctcctctctctaggtatttatcttggagattgtgttaagttagctcttgcatgagagccaacctttacatctctcatccacactagctaattaaatcgtgcattcgcgcgaccatgacatgtccttttatgtattaaaattagaactaaatattgggatgtggatttttatttctcgagggaatatcctccactcattgcttgaaacatatcacttccaacaaattcgatttatacatatggccataaaatatgttgtatttacgaagggctaatttgagttgtttcagctttaatatacgtgcgtagatgccacatcaaactggttaattagctggtgaaaacagcggttttctttatcgttagttggaagaaaaaaaatcagcagtaatgcaggaggctgctacttttttccttggagatggccagcaggattgttgccacgtgtctgtgtttattgctctgtgttgggaaccagagaaacgatcacactcttctagatcattctcttgcctcttagcttttgatcaatccaagccatccctccttaatccaatgactaatataatattgtatacgtggctcaatggcagagggaataaacattctacgttcatatgatgatgatgatgataagcttataataggcttatagttcactgttatactttctcttaacgtgatcactccagtttcattcaacaagcgaggtctatgcgtattgtctgcatcaaaattacatgacaatgtgcaggtaggcgcatgcggccagcattttatgttg

SEQ ID NO: 5437 - DNA, 1501 bp, Oryza sativa
atctgtcgtttttaatgtgttgtggagcgctacatgtttcgttttgttcaagctatctaggattctctctccaatgcacgagtagaataagcaattagcatgcaaagttgctcgtcctacacgaatctgcagctgcattttcagtgggtgtatcaccaattattagagcacagacaaacgcgctgtgtctatcagagtaaaagaaagaatatgcaactgccatatggttttatcagtaggtgctcgggtacgtcctccgaactgaatgatgcagctccttgaacaagcaaggaaaaaaccggaatgaatgctaacgactccgttgcaaagaaacttttagatttttgactttgcatttctggatcgatctgccacctaatctcatcatcgaccacttatgttccgagaacgatgcctcgccttctctccagcatccaatcaggtttagctttttcgtactactactgcaactactttttcattacgtggtgcatgatacagtgactgatgatgtggccaaaaatcatgccttgatgatcctgaatatgacaggcagatttttagtttggagaaggacaaagggtgaaaaattcgctaaaatgtcatggaaaaacgtcggtgaggagtttaattttagtttgacgagaactctgtacaagctacatactgtacacaaaatattcagagggaagaagcaggtacgttgtccttaatttgtgtatgcttaccacgtacggatatagcactagttgtcagcaaccactcaaccggagaaatcattcccctccaaacgaccaacgaccacctctctgatcgatcgatggaagaagaaggctccaaatattgccagctactactactttcattggccctgcaattattcgttcagaaagtgatggggagagcgagggaccgtgcagtcaaggcatcacagcttagctgctgcattgctgcacctgcaacaaactgaaactaaacgggagtcagcgttgtactgcctgaatctggtggcactagcacacacgatcgggcgagagaattaggtgcacccaacgaacgcacagggaagggaaggccatatgcaaaggggaaactattctaaagcacagtgtttctgttcgcacaccagcatgcatgcatgcgttgcactctgaaaacgacgccgcgatagccgaagagctatctacgttgttaacacgttcgattcttccgcgaatgattggttatatatccttcgggttcaagcaaaggtgccgctagttagtttgtcatacttaaacaattaagcctgtgcatggcgagatatgtcatacacatgtcagattaattgatcgcgtgtgcgtgtctatatatagccagcttcctttcttcttcgtcacaccgacttaacacttggtcatttctcatttgtgcgtcacggagtgagcagtgtacatacgttactagctcaaggctgcagcggagagagagagagagagagagagagagatgggcgctgtgg

SEQ ID NO: 5438 - DNA, 1205 bp, Oryza sativa
agccagcgcgcgtgcccgagccgtgtcgctcaaaccgccgcgccgcccgttgcttcccgcgcgcgcgtgccgtggtggccgaccgcctggtcgccgccgccgtcagcctctgccgcgcctgcccgcgcctgccgcccgtgtcgtcgcgccgctccaaaccgtcccgccgccatcgccgtcgtcatttcctcggccccgccactccgcgggcaagccgccaagggacggaggcagagccctcctccctatgctgcgacgcccccgctcccctcctccttttcccaaagaagcaaggggcgagccccctttctctccccctttttcctcctttttccctttcgccggcgtcacctcctggcgccgttttggccgccagccggagcgccagctcgcgccttgaccgccctaagtcggttcccaaaccgacattgccatcctttaaacccaagcctccccctttcccttcctctcccattcgcctccgcgccattgccgccgcccccgtgctctgttcgccgtcgccgttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacaagtagcctcccgtagctagccggcgccgccctggccgttgccgtcgctcaccgtgtgctcgcccgccgttgccgcccgagctcggaagcgccgctcgtcgccggcctcgctcggcatagctccgcccaatccgacgctagcaacggattcccgtagccgcgtagatgctctcgccgcgggaattggcccctcgtgacctcgtcgccgtttcccccttccctcgccgccggttgccgccgccgcaatccgccgccgacgcactccctccggcgaatccgagccgttggctcgtctccccttgtcctgtgcaaccacccggtgtgctcgctctcgcctgtatcgccgtggtttgctccgtcgctcgccgctgtcgtccgccgtccgttccggccggcgtcgtcgtctacctcccgccggcccgcgtggcagccacgtgggcccgccgcatccgcatccaccgcgaaccgtg

SEQ ID NO: 5439 - DNA, 1501 bp, Oryza sativa
gagattgctgggacatgacgcaaaggcccaaggaggcggagccacgagcccacggtgaactccgacctgcgatctcacccggtcacgccgctctgtgcttctctattcacatcgtcctacctgtccatctccgtcccggttggcctcacaccactcgtgccggctcgccgccgtgcctcgtcatctctcttatcccgtggtgccccatccgcatcgcccgatggcaaaccgacggccttgatcgcccaaccggatcaaccaccgcccccgtcttaccgttacgttgatccagtcagtcgcgtggggagatctgatgggccaccggccaggccgcccaagtttttgcacctgcgaacccaccgggcgggctcctggtgggcttcgccttcggcgaaacgcccgcggccggtgcccttcttcttccgccgaggcaggaggcagcggcggcttccggcttccttcttgtggctggtcgaaccgtctccgatgataccttccacgcaagcagctagtcgatcgcgccaacgggggaaaagccattcctatcatcctgtggacgcaataatgcgccgtcagttatcaggtactgctgcctccacttgtgctgctgctctccataaatgtccaacttgacaaaacggcgactttgttgtaccctggcccattcgatctgcagtggtacacatatgatacgtacccgcagcgactgttgctcgttttcgtttttgcggccgtgtggccgtgtccaaactgggcgcagagccaaccctctccacgtcggcttgggaatatttttggtggccttgctacttgataaatatcttttgtttaaaatgtgttcataaatacttactccgacttataaaaattaaaattctaactccgaggctttatcccataaaaaagtatttctaatcacgtgaaactcaacaagtaatttaagaatgctaattatgtggattaattatcttaatttttttaatcaattatatatatataatgtatgtatgtatggggttcattatcgtggtcatttgtctatccttctaatatgtcctaaattagctagaattttagtttttaggatagaggaagtaaatagtaatatttaggttatagcttctccatcctgaccattccttatttattttttattaaatcctttatgaatacttatattcgtgaacgaggaaagtattttaggatcatgattctgaagtctgaagaaagtattttaggatcatgattctgaagtctgaagaccattttggtcaggagcctgatgaaatttcgtagcaaatttttaccactcaatacaggccaaaataaatcaaaaccaactttattaatattttaaatttaaattatagctttttaagtgtcgtttttttaccttgcttgagaattgagatatggtggggggattttcaggatcctgtggttctatatgaggagagtcccctagtcaatatcatgcgcatatgagatttgacacacaaga

SEQ ID NO: 5440 - DNA, 1501 bp, Oryza sativa
gcgtgacaccagttaacaaagatgcgtgatgagtttgaattgaactgttcaaacacacatctgagctactatgtatagtatggagggtgcattagtggggacgcggtgagaatgttttcaaattagaacgcctttgcatatacaatacgttatgtttcgaaatggacaaaatagaagatagtacgaattaaattaccatgctatcgtagtaaatctgctcacttcaaccctccttttctgcatgcgattagtttagttgacatttctggtcactggtcagccgggaaaagtccgatccgggtgagaggtgagagataccgttcagtcctggacgtactaccgatctaagcttgtactaaagttgaaaccatatcagtcactactggcgtacctgcacgtatcttacgccggacaggcgcggcgtcacgcttcggtggttggtgatgatgacttggtgacgtactcgccggctgccaagcggcggcgcgcggcggcaacgtttctactgtagattattatatagatgactgacttcacgcacgtcggatgattaagttccatatatatgcatggcagaaaattctagatgaggactgaagaacagctggtctatatacgtatagctatatatgctgtctttgtggagtactgaattaaccaaccattaattaattcaactggaagatacagaagcccaatataccgaagcctcacgactacttaacaaaaataaaattaaagaatcagagcctttgatttcacgtgacaaatgtagtactcctccaataaaataagatatttctggtttttatcataagtcaaatttcttaaattgaataaagtttataaaatagtaatatgtacaatatatatcaaattaggaagggactaggtgtcgggcgcctgatccgggtgtaaaaaaatcaggcgcccacgtcagctgacgtcagcatgcatgcatgcaaaaccactttaaacttttttttcttttaaattatttatccaaatcatgattcgattgtaccattaaatttgttgcaattaaatcgttaaaattagaccacacatggatatattctgatgaaaaaaaattagcttattattgaactatttttaaatgttgcacgctgttgtaccaagtgtattggaattttttcactaagtagatcgaaaatgtttcaatcgtttaagatcgggtgtcaccttatataaaaacaatgtttcagcaaatagcgaaataatgtttcaattcactgcaacatttaatccatacatagtgaaacatcacgaatacactaggtgaaacatttttggtagaaaaaaaataaaacgaatttccttaatagagggtttccataatatgtgggtgattttgttgcaaaagaatgtttcaattcactgcaacattgaatctatacatagtgaaacattgtgagtacattatgtcagtgttacggataaggtataccctctatccttggatatacgttgtatactgata

SEQ ID NO: 5441 - DNA, 1501 bp, Oryza sativa
cctatttttaaaattggtttttgacaccttactaaaattttgataagttttctcaaagggtcaaattattaaaattaaggaacaaaccgaacattctattgttattgacaccttactaaaatttggtatttccataaacgttctctcatactagcattactaaattttgataaggctacaaactaaacgcttctaacgctatcaacatttggtactataaaaatgcgccaacttttgacaataccaaattttggtaaggttaattttgacatcaaattaaacaattgctctgagttaaaaacttctaaatgtaattatggtgtatttgtatctattatattattaaaacagctttgaaaggaggcaccacgttcgatgtgggggctagaaattcccacattaatcagagaaaaagaaaaaaagaaaagaagagtccaagtagaaatacaatctaaaaatagctgaaattcagaattaaaaataagcaatattgaaggaagtttccatataagaacccaatacgagattaattaatattcgaaataaaaataaaataaaatccaaaattagaaaaaaaaagagagtccaagtagaaatacaatttaaaaatagctgaaattcggaattaaaaataaggaatattgaaaaaagttttcatataagaacccgatacgagattaattaaaattcggaataaaaataaaataatatccaaaattagataaagtaaaagagatttcaagtaggaatacaattttgaaacaactgaaattgaaaataaaaaataaaaatattaaaagaacacaattcgatattaattaattttttttaaaaaaatctgaaattagaaaaaagaaaaataaggttccaattaggaatacaatttataaataactaaaatttgtgataaaaataaagactattgatagaaaagaccatctaaaacacatgacgagataaattaagtaacaggcatataaaggagtagtggtggtggttgatacgacataaaaaaaattgttaatgaaacaccaaatagaatcctaatgacgattaaaaggaggggcgatagggaggccgtaaagcaaacgatcaaggcgattgccgggacttctagaaagtaaaaaaaataaaccccattgataatcatattcgatttttaaaatctcaatgacaataaaaaggagaagcagcgagcggggtgtataggagtatagttgcagagctgccgatggttgacgggacttctagaaaataaaaaatgaattccaacgatagttatgttcgatttttagaatcccaatgacaataaagagtaggcggcggacgggccgtagaggagcatagtagcatcgtttgacaagacttctaaaaattataaaaaaacgaaacccaacaagacaataaactctaaaaactacaaggttcaatttttgaaggttcggaacttctaaaaagtaaaaaaaaacaatgatagtcatattcgattttaaaatctcaa

SEQ ID NO: 5442 - DNA, 1501 bp, Oryza sativa
ttgagccatctgatctataacagatcacaagaaatgttgaacgaagatattgttcatgatataataacatattcaaataatctagaacatcaacacattcaaaataattcaaaacatcaagatatattcaaataatgtggaacatatccaaacatgtttgctttattacaaataataaaaagttcaacatgaaaagaaaatcacactacgcttgagatgttcaagtgttatgagaattcaagaagctcttctttgcaccctacgctctctcattcttcggtggtcagcccacatattctttgcaatcttgtcccttagcttatttcccaagtgtctttgactattcattggtgctacatcatctccatataagtccactcatgtactggaacaagtttcttctgaactaaccacttatcatcacctttttggctcctgattatgttatggaggactattgcaactgcaaggattatcacttgggttgcgattggataaaatgttgcaacttctaggattggaaatcacatcttcaggattccaataacacgctctatgtggttgcgtaacttgaggccggagttgaaggctgagtggattgagctcgatatttacccccaaaaaatgtgacatctctagcccacattaccttttcgtcggaatgggccgaaaacgcctggaaatataataggttacggcccatccaagcagcgttttgagtttatccttggaaaaaaattatgggcctgtaacttataccggttttgggccaaatacaggccttccaagcaggcccttggagtaagacatttttttaggactagtaatgcacgtgcaaggcacgtttttacaatgtatattttaaaaagtaaaagtatggggaaaaacagtgccatattcatacacttaactccagaaacatgacacactgaattcagatacattccatgtagttcataaaaaaaagatacattccatgttcaaccttaaatggtaataggagtatattccatgttcagacactaaacccacacaaatcttacatcgactggtgaatttctaaacttccagtacttgagctataagaaattcataacattaattagctcacagcaaattaaaacattgaacaatatttagatgtttgtcgaagttcagattcttaattcagatactcctacatcataaggacaagtcgaaaactaatatgccaaatgctcagaaaataatataagaaatgttcaaacactaacctggcaaatgttcgacatctatagtgcacacgtttgaggtatatataaagaatttgtcatcagcacgacagaaaattagaactttttttttggaggacacaacatgagatgtgattgacaattttttgctcccaggaaatttgtactgaaattgttaaaaataaaagtgttccacatttctaaaggctgtcaggaattattaactcagtacataaccaatagttcacagggaaactatgcatgtttat

SEQ ID NO: 5443 - DNA, 1501 bp, Oryza sativa
tctgtgtcacccaatatcggactctaagaataagtctgttttgcgtctctcaactattgccataggtcgaatcgtatccctcaaccgtaaaatcgggtatataggctccttcaactataaaaaccaaaccaattacctcctcgaacggtttgaacggcagtttcgtcctgagtgtcgcattgatagggtatttatcccacttaacgtctacatggcatcatagtcaaggaaaaaaagcgagacccacatgtaagtcatcatatactatcttcatctctcttctcttttctcctcccctttggtcctatcctctatcttggtccgttcagtgtactgttttgggtcctttttgatctcaaatgggctgtcggcctggtctgcctggaaggccacaacccacaacatcatcagtcattgcgtcacctgcggcccagtggacacaagcacaggaaaataatcgtacttctatttttattgtgccacctacttttttttttcaattgggaacgttatgaaaattgttttttattggtaaatttcactttgctcattttttttatcatcgaagttttacttttagattatccatacacacaccctatttatatgagcacattaaaaagattatgccgatatatcttgagactaataaagacaccaatgaacacatcgttgtcaacaacaaattgaattccacagaggtgatgctttgcgcgaatgaaaatgagagaggcaagcttttctagacaatttcgaagccccaccggatgtgtaaaaccctactcgtgggatcattggtggatggtgatgatgatgatggtcacaactatgaggggtgatgaaaatttctaagtttgagaggatgaacccttcttccatatgatgtggctaattttgaagatgtagatcactcatgcggcggcacactttaaagtataggtctagtaggtcactttggggccataggggtcgatgtgccccaagcatagccattaggggctgcacccggagagtggatatgcccctgagcacaactcaaaggggaccgggttcctgttttttcaacgcatgcacactttaatctataccaacggaaaattttccatatattctttctttaattttatcatatttacattcctacaaaaataaatggtacatatacagatcattaaatcctttggaatatactcctactacatacaacttctttcttttccatcgtatagtccggagtaagaaggattacctcgttacgaagtcacacaagcccggcaaccgacacccaaaaaaattcatcaaactcgcagagaaacaccattttacgccaattcttttccctcgccgatctcccccaatttccagctcgatccccatcccctctcctccctccttcttcctccgcctcccaccctcccaccgcgaccgcgtcgacccgccacccacccaaccgcgccgagatccagatccagatccgccgccatgaacccggggcgcccgg

SEQ ID NO: 5444 - DNA, 1501 bp, Oryza sativa
cctcttctccgctctgtcagcgcgccgcgcgcgtgtgcgcgtgagccgcgccgagccgagccctccctctccgctccctcgctgccgcttcccgcgcgccgttgttcgcgtgcgcgcgcccgcgtggtcgccgcccgtgccgcgcctgcgccgtctgcgccgcccggccccactgcctgcggcgcagccgctcggccccgtgagccagcacgcgtgcccaagccgcgccgctcaaatcgccgcgccgcccgttgcttcccgcgcgcacgtgccgtggtggccgaccgcctggtcgccgccgccgtcagcctctgccgcgcctgcccgcgcctgtcgcccgtgtcgccgctttgctccacaccgtccccgccgtcatcgccgtcgtcatcgcccggcccccgccactccacgcgctagcctccaagggacggaggcagagctcctcctccctctgccgcgtcgcccccgctcccctcctccttttcccaaagaggcaaggggcaagccccctttctctccctccttttcccctttttctcccgccggcgtcatcctccctccgccctgtcgccgatttggccgctagccggagcgccagctcgctggcttgaccgtccaaagtcggttcccctctcccaaaccgacattgccatcctataaagcccaggcgccctccctctcttctcctctcgttgtcccatcgcctccactccattgtcgccgcctcccgtgctctgtacgccgtcgccgtttgtcgtcgcgcgtgtcggaggagccggcacgagcgaggacgcggaaggggactccgggcgcgccctcttcttcctcttcctcggcccgaggccgaaacgatcacgtttcgcgccgtcggctctcgtcactgcgcccgcccgcacggtagcgcatctccccgttctccctcttcgctccatctcctccccttagactcgggtagtagcatgagtagcctccccgtagctagccggcgccgccccgacggttgccgtcgctcgccgtgtgctcgccaccgtcgtcgcccgagctcggaagcgccgctcgtcgccggcctcgctcggcgccgctccgcccaatccaacgctagcatcggattcccgtagccgcgtagatgctctcgccgccgggaatcggcccctcgtgacctcgtcaccgtttcccccttcttccgccgccggttgccaccgccgcaatccgccgccgtcgagcatcccccggcaaatccgagccgttggctcgactcccctcgtcccgtgcaacttcccggtgtgctcgctttcgcctagatcaccgtgtttcgctccgccgctcgccaccgccgtccgccgtccgttccggccggcgtcttcttcaacctcccgccggcccgcgtggctgccacgtaggcgccacgtcggcgccagctcggccaagaccgggtcgagccgaccccggtcagccgctccctccggccccgctcgcgggcgcggtccaccgcgaaccacgc

SEQ ID NO: 5445 - DNA, 1501 bp, Oryza sativa
gttctagtgttttcaattactagtatgttgggaagaactattcattatgtggtagtatttgagaagtgggggacatccttaatgattagaggactttctctaagatgaccagcttcttaatttacaaaagagttgcacctgaattatgtatttctaaatagaagaaaaacaccactagttaatgtattggtgaaacatgcatattcatatcatgatgctctgtcaaggtcttgaactttttattagtatactgatttatcatttgagttgaaagctagccagcatcgatctgatttgttttagaaaacagagcatgaacagtattcttagtgcttccagcttgttaacggaatctaatggctctcatcaaaactgattggtcccgttcatccacgaacggcatgagattccgtagcactgacaatcaattcttggtagcctgatcaatggcactggcagagagatggcccctgcgccatgaggaagcatggaacagaaatgatcaaaaggaagggtctggatccagatttccagataggccagcatcattgttaatttggtgccatggaaagatgattagggtgatgtttacagataacttttttatatgtatgctgcataattcgtggctgttgctgcggtcccatgtaattatggtgtgatgcacctttaatttatggacagaggcctggaggttgcgaaatagtatctgttgcacgccctgcccctcatttagtcgatgttcactcaattgttatgcgtatggatcgtatgcgtccttgtggtagtactcctacctcttaagaaaaaaaaatgtaatcatacggccatctgttgtctatgcataatttagctgggcagtgattactaaatcgctaaataaaacgacaaaaaaaaatagacgatggctcatagataaaatccaaagagtaaattgcatccacggtgcatcaacttgacaggtgggtgtaatttggtgcaataacatgagaaatgaacattccaatgtaacaacttggtaagtaggtgtaatttaatataaaaaatttataagtgatcgtataaatgcaacaacttacaagttaggtatgattttgatataacaaattaaaaggttatgtgacaacttaattatttgcaacattatatatatataaattcatttttaagaacttattttgacaatatactagcgcggatttgtataagtatatttatatttttatcctaataactaatagctgaaaatcaattaaactggatgtagaaattattatatttcgattgataattgagaaggtgaagaaaaaaaaatcttaaaggtaattggatgtaaattgtactactatgtgcagtataattcataaatattaaattcaatataaggtaatatccgtatgattactatgtaatggcatgttgacatcgtaaaaaaactcacctaagatatacttagccaagttaatacaacaaaatactaaattgttaagttattgtacta

SEQ ID NO: 5446 - DNA, 1501 bp, Oryza sativa
ttcaggcatgttttcagtagtctcatgaccattgtcgtcgtcggctgcatatatagtcaattgtgaatatttgatgacccagcatgttacagattgatctttcatcagtaagtaataatttgagttgaactaaacatgcacacagtctgcactgattaattagtgattagctggttataattgaactatgcgatatactccctcctttattggagtagcaaattggactgttggtgtgtaatctcttcatgttctgaataatgtattggtagaccaaacaacctccgaatgatcagtggcgctggcggctgctattacaggctaagggtcaagatacgaatcattttaattttttgttcatatttaacacgtgagagccagacacattgaggaaatggttggtgagatagtaagatggcaaatgcagctagttgcatatatatgcagccatccacctgttctctccctgaaatgatggcgcatctgaacgaacgaaacgaaccgcaatctaatcattgatagattgtgttttgcaaaaatatgatagtctaaatatctagtcatcaatcaatttgtagttcttaaatacagccaggtttaggtgtattacgtttagcttacgcttacagatatttgtgtataaaattgtcacctctccttttcttttcatcataaagtacgtgcagctgtgttagtgcttgctatctggtcagctgattaaacaaatggtctgcgtgatccttcattatatttcgcactttcagaatactttttcgttgttaattaacactgcaaaacctgcaacttcgagagaaatgtgatttagtcgaactatcgaccattgtgaatacagatattgcggataagtagtagcagttgccaagaaagatctatctatcaatctcccactgcaaaaaggtaattagctagctagctaatcttagccattcactttattacatccacacacccactagctattctcaagctagctaatcactttaccatttaacacatgcatggatgcatatgcaaagaggagatgctaatggagtcagcacaaacttaggagttaggacattgtttgacatttcgtctcatgcagtggagagaacattaatcattcaggctcaaataattcagtgtatgcgtattggtgcatgcatatatcctgtgaaaattgtcatggcactgaggctgcttattgttattcattcatgcatgtgttcattgctctgaatccacaattagtagagactgtagctgatggctcctgacgatcgtgagatcactttatgcctttgcctaccaatgacttatatatgtcatgcatgcatgcacatattgttgtgtttatatttggatggattgctgcctaacccaactaactacttgttgtgcacaatgaaaagcagccgctatttatataaaaggctaaacaagattgcccctaacacaggggcttgcaatgtctaagactgaacttaaatgattgtgtgaa

SEQ ID NO: 5447 - DNA, 1501 bp, Oryza sativa
ggatcgttttgctgtccggggagtactaggcttaggagattgcaactatggtgtccatgtggaagtgccagcaacgacgaggcagagctcgatgatggcgttgacggtagcgaactcaccgtgcagcccggcagtccaccaccaccgttggttgctgctagcgctgtgtgtgtttgtatgtattcctctacgtcgcaatgaagcctatggcgatgggcgttgtggcatacaacgtgtacacaaggtgtacggtgctatgaagctatgaaggtggcgatcttgggcaggaggcacaaaggcaggagacgccaccagtaaacatgtgtggacttattagctagcgtacttcctcggaataagtccgcttaacattcgtcatctttacgtggaatttagttgaaatccctaaaccgcaaaaccaaatatcttcaccttccatcgtagcaaaaccgtcttagtcgggtcccatcatagtatggatggttgttttaacttatgtgcatcctagccaatagaaagaaaataaaaaacatttgagatccatatatgttaggagatctctatttcctttgatcgccctctctcatctattcccatctctcccacttcttccttctttccccatccctctttagggcgacgaccagtgttgacatggggagtggcggtggcgggagagaggagacaagacaatggtgggggctagacacatggaggtcacaccaatgacctcatcgtggaggtcacaccctagcatgacacatacaaaaaggaaatggaaagctagaagattgcttcgtcaccgtacaagggcggaagggataatcaaaattggtccgtgctgcctgttgtcagttgtcacaccatttatgcctctgcggatcataacaaccatctgctacaactgttgtccgtcatcatctaaatccccttatgctgtcgcccgtattttgaacgctcctagtgcaccgcgaagccactttgcagcgctaccattcaaactcaatccccttatgctgtcgccgtattttgaacgctcccagtgcaccgcgaagccgctttgcagcgctaccattgtcttgcgcagatcgtcaaactcgtcgtcgctcctagagtgttgctgcaactgcctttattgccatgagatcgttggagatgctccactgtcatccacacctcttagcaatcagatttggtgtcgacgctcgcttggcaagtgatgcctctaggacactgccaccagcctcatctgcattaggcgagctgacaacaatcacaccgtcagccgaccctgtcaccaatgaccaccgtcccctgttctcgcctggcgccgatgaaggggcggagccagccagtgtaccttgctccaatcctccaaatcttaaccaagccagtgggagacaggtaaaataccacctgttttcagctttcctacagtttcatcaatgaacgtaggatggtctggtactggcactctggtgatgaattaaccaagcacatg

SEQ ID NO: 5448 - DNA, 1501 bp, Oryza sativa
atgtgccagccaccaggatgggtcagatcctaggaacatagtattgattgtggctttgtggtctgtggggcataggtgggataacacttaaaaccagttcgttggatgtagaagaaccagactgcaaacaataagcacaattcacacttaatatagttcatagtttagtatgagatcaaaactagcgcctctgctcaccatgtgaattgccggaaacaacgaattaagtagctgcaggatcagaattactggggaacatgtcgtaatcgcaccgtggaattgtaacagatgagcttctcgagggtgtggcggaggtcgagcaggcccctggcggcggaggaggtggagaggtcgcacccacgcagctcgagcacgcgcaggcgcgcgaacggcacgagtgatagcggcgccgggtcccgccccggcccgggggccacgaccttgagcgacgtgagcaggcgcaggatccggcggagctgctcgagcgcgcggtggtcgccgaggtcggcgacgtaggcgcggaggtagtcgacgggcgcgccggcgccgaccgcctccagctcccgcagcgcctcgaggcgggaggcgacgtagtggagccccacggggtggagtcgcagggtgacggagccgtcgagcagcgccccggcgttgcggcccacgaagcggaccagcaagtcgaggtagcggtcgccggtgaccggcggcgcgccccccgcacggccagccgccatcgccgccgtcgggatcgggctagggtttggggacccgccgcatcggcgaatgggggcggagcggacgccggggagggaagaggtggtggtggtggtggtggcgacggaggaggaaacggacacggccgcgctagtatgattggggacacgcgggctcgtgggggagggaacggaaggcgacggggtgcggccgtgcagccaggccgcgcggttgccagtgggtaactggcaagtttcggctggcacctcgcggatcgctgtgctgtgatctccttcggagaagctcccggtttgtggaggccaaaacggacggaatcgcgagagtttcccgtgtaaactttgggtcggttcgagccggacggactgccggagcgacgggttgtggcactggtctgtgctcccgtgcgctgtgtgcggcagtttccggcgctaaagctttgcgttgtgagatgtgccgccctcgctggcttggcgtgtccactccaggagaaggcctcttttggtgttacctacagaagcgtttgtcctggtcttagctgccgcgtgaggcgggggatcgctttccccggaccgcgccccgtcttctcgtgatcgcgtcaggtgatgcttcatcagttcagcgttgtttcaggctcctacgcgcgcatgttggttcaccagatcagagttgttctcgtccgagaattatattactttttttcttgtactttagatcagatatgatcagaattagatccgatgagctattgtttcttcggcggctggat

SEQ ID NO: 5449 - DNA, 1501 bp, Oryza sativa
gcgtgcgctgagaaaacttagcccgtccccgaccgtccgatctcgtcgcccgggctgatcaaacggccgggatgagctccacgtgtcgttgaaatttccctcgctgacctcacgacgacctgttcatcctctaccgctgacctggggggattcctacttaagtaaagagcccccaaatgcgcgagataaattggggagaagaaagcgtaagaaaaataaaaggagaaaaaggaatagagaaattggggaagagagctacctcgaatcgaagctgcgatctccacctggtatggttgatttttctccggattcctctcgctccgttggattggggattgattgattgattggttgattgcttgcttcggtgagttccaattcagtggagcgtaggctaccgaatccaccgatttcgcttgcgttcttggttgaactgttcgatccccacgagctgctgccatgttcttgctgatttttttttttttgaaacctatgttcttgctgatttgggttcttggccaatgggataggatcatagaaatgcttgtgggatggggttctgtttgattttctttctctccccaatgctgtctgtccacattgttttcttgtttgttcaggtgaaataggagaattgatgaattgctgagatttggtgattagagggacctttgctgctgaggcattgaggtatggtgttcattccttctccatgctgagtgcttcatttgtgtattagctgacatcaccgtaaggttcttgagttgcaaataatggatggctgctattgtgttgcatttgcattggtctactaatccaattttaactaggttgctttctaatcgggggcaatcgagtccttaccactggaattgttttaatggacttgttgaattactcctgaaagattgatctgcagtcaagttctaagattgcaggagtatgttgatgaaataattgattctgtaatataagtaacttgtaatgtaaaatgcaaaccgagaatagatgattggtctaacctaagggaaaggctataatcattttagaatacatgcaatcaaatctcgaaatcttttaaatcactaatatattaagaaaacattaatattttatatgtaaaaatgacattgttagatttatcatgaaaataatttcatttagttatataattattatagatatattattagagaaggcaatgatcaaacatgtcatactatttcaatgccctacataacaagtagtaaataagaattaagagggagtattttttaaattctggctatgatcttcccttctagtctaatcctgtccaacaatatatgatgtcttaccttgcacacatgctttctttgtttaggcaggcagttaattgacaccttgtttactttcctttccttaaggtacactaaaagcaagggtgtgaaaaaggcaacttcaattgaaaacatctacatatctaggaatgtcctgaaactaatgtgtggagtaaacttct

SEQ ID NO: 5450 - DNA, 1501 bp, Oryza sativa
gcgtgacaccagttaacaaagatgcgtgatgagtttgaattgaactgttcaaacacacatctgagctactatgtatagtatggaaggtgcattagtggggacgcggtgagaatgttttcaaattagaacgcctttgcatatacaatacgttatgtttcgaaatggacaaaatagaagatagtacgaattaaattaccatgctatcgtagtaaatctgctcacttcaaccctccttttctgcatgcgattagtttagttgacatttctggtcactggtcagccgggaaaagtccgatccgggtgagaggtgagagataccgttcagtcctggacgtactaccgatctaagcttgtactaaagttgaaaccatatcagtcactactggcgtacctgcacgtatcttacgccggacaggcgcggcgtcacgcttcggtggttggtgatgatgacttggtgacgtactcgccggctgccagagcggcggcgcgcggcggcaacgtttctactgtagattattatatagatgactgacttcacgcacgtcggatgattaagttccatatatatgcatggcagaaaattctagatgaggactgaagaacagctggtctatatacgtatagctatatatgctgtctttgtggagtactgaattaaccaaccattaattaattcaactggaagatacagaagcccaatataccgaagcctcacgactacttaacaaaaataaaattaaagaatcagagcctttgatttcacgtgacaaatgtagtactcctccaataaaataagatatttctggtttttatcataagtcaaatttcttaaattgaataaagtttataaaatagtaatatgtacaatatatatcaaataggaagggactaggtgtcgggcgcctgatccgggtgtaaaaaaatcaggcgcccacgtcagctgacgtcagcatgcatgcatgcaaaaccactttaaactgttttttcttttaaattatttatccaaatcatgattcgattgtaccattaaatttgttgcaattaaatcgttaaaattagaccacacatggatatattctgatgaaaaaaaattagcttattattgaactatttttaaatgttgcacgctgttgtaccaagtgtattggaattttttcactaagtagatcgaaaatgtttcaatcgtttaagatcgggtgtcaccttatataaaaacaatgtttcagcaaatagcgaaataatgtttcaattcactgcaacatttaatccatacatagtgaaacatcacgaatacactaggtgaaacatttttggtagaaaaaaaataaaacgaatttccttaatagagggtttccataatatgtgggtgattttgttgcaaaagaatgtttcaattcactgcaacattgaatctatacatagtgaaacattgtgagtacattatgtcagtgttacggataaggtataccctctatccttggatatacgttgtatactgata

SEQ ID NO: 5451 - DNA, 1389 bp, Oryza sativa
cccctccgctccgcccgcgcgccgcgcgcgcgtgcgcgcgagagccgcgccgagtgcccctccctcgctctgcccgcgcgccgttgttcgcgcgcgcccgcgtggtcgtcgcccgcgtcgctcctgcgccgtctgcgccgcccggccccgctgccctgccgcgcctgcagccgctcggccccgcagccagcgcgcgtgcccgagccgcgtcgctcaaaccgccgcgccgcccgttgcttcccgcgcgcgcgtgccgtggtggccgaccgcctggtcgccgccgccgtcagcctctgccgcgcctgcccgcgcctgccgcccgtgtcgtcgcgccgctccaaaccgtcccgccgccatcgccgtcgtcatttcctcggccccgccactccgcgggcaagccgccaagggacggaggcagagccctcctccctatgctgcgacgcccccgctcccctcctccttttcccaaagaagcaaggggcgagccccctttctctccccctttttcctcctttttccctttcgccggcgtcacctcctggcgccgttttggccgccagccggagcgccagctcgcgccttgaccgccctaagtcggttcccaaaccgacattgccatcctttaaacccaagcctccccctttcccttcctctcccattcgcctccgcgccattgccgccgcccccgtgctctgttcgccgtcgccgttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacaagtagcctcccgtagctagccggcgccgccctggccgttgccgtcgctcaccgtgtgctcgccgccgttgccgcccgagctcggaagcgccgctcgtcgccggcctcgctcggcatagctccgcccaatccgacgctagcaacggattcccgtagccgcgtagatgctctcgccgccgggaattggcccctcgtgacctcgtcgccgtttcccccttccctcgccgccggttgccgccgccgcaatccgccgccgacgcactccctccggcgaatccgagccgttggctcgtctccccttgtcctgtgcaaccacccggtgtgctcgctctcgcctgtatcgccgtggtttgctccgtcgctcgccgctgtcgtccgccgtccgttccggccggcgtcgtcgtctacctcccgccggcccgcgtggcagccacgtgggcccgccgcatccgcatccaccgcgaaccgtg

SEQ ID NO: 5452 - DNA, 1501 bp, Oryza sativa
gaaaggcagcctcgacgacatcgtcgacccctacctagacccgcacagggacgcctggactctcacgtccatccacaaggtggccgagctggcgtttcggtgcctggcgttccacagcgagatgagaccttccatggctgaggtcgccgacgagctggaacagattcaggtcagcgggtgggcgccgtccacggatgacgccacattcatgtcaacgacgtcctcgctttgctcgtcggctccatcacgttgcacggacaagtcttgggggaccgctaagagcaagaggcaggccgcggcaaacgcagtggtaaagcaagagacgacgaagtgtgcagtcgccgactcccccgtgtccgtgcaggagagatggttcagcgataggagctccccttcctcaaatagcctgctgaggaatagctccctgaactaactcaatcaatgtccttgtcatggcattttaggtgtaagtagcattagaacgatctgtaattgatgcaatgatcccttgtgcatcgattgtcgatgtttatatctgcaatattgaatatggggttatacgtcgtggttaaagctacacacagtgacatatatagatggccatatggcctaaggcccgatggcccgacccaagacatggtgatttggcctggccaatgcacggcacgccctgacttgggtcatgcctatgccggaccagcccaacagtcgtgccgtgcctggggtgctacttcggtacgctgcgctggcacgacctggcacgaagttcagagatgcgaaacagacttattgtcaatcacatgtaaggcacgtataaatatagatagccataaggcccgcccggcaaggcccggcccaggcacggcccgatcgacacttcgtgccgggctgagccggcccatgggctgcacctccggcccagacacgacccaccagcagtcgggccgtgccatgctggcccaaaggaacgcgtggcccatcgtgcctttttaaaataagtctattttcctccctcttctttgggctgtgatatatatatatatatatatatatatatatatatatatatatatatatatatatatatatatagctaaaataaatctattttacctccctcctctttggtctgacatatatatatagctaaaataagtctaattttcatccttattctttggacagtggcatataatgtctttttgtactccctattctttatgtgccggcccggcacgaacgtactagtggggaggcccaggcatggcccagcggtcgggccgggctggcacgagcccgactcccgtcgggccgtgctgtgcttgggccgggtcgtcgggcctcgggccttttggccatctatatgcacaaagaataggaaggaaaaatagacgtattatatggcacggcccaaagactaaggacatgaaatagacttattagctatatatatgccagatcccaagaagggaggggaaatatacttattttaaagaaggct

SEQ ID NO: 5453 - DNA, 1501 bp, Oryza sativa
acaccatgactctacaccgtatcatttttttgtccctgtaatatggtaatatattcttaaaactagtgtaagttagtgctaattagtgggacacaagacccaccagcactaatcctggtaggttattaagcgtacacatgtacatttagccatctggtcacatatatattagcttatcaatggatctctttctctccaaattcgacccaacctatttgcaattggcaggttgacagtaataaccttataccatatatcataaacattagttcgcattggaacggtgttttaataagttaacaattaaggtgaagagcgagaggtcgacgaaggtcagaagtagatattgtaatacgacggtgtagtatctatcttctaattatctccatctcaagatatgtggtaatttttaacaatgaatccagataactattatctccatatcctaaatatagtaacttttgattattaatctggactggacatataattatctagattcatagctaaaattacttatattttgggatggacggagtattaaatatgatactcttgtataatatctactacttcctttccaaaatataacttttaattatatatgaatgtggatgggtatttgttcatattatagctaagagctgttatgaatctggatgagtagtggttcagattcatagctaagcgtttctatattttaaaatggagataatattgttggtgacaatggtgtgcacatcaatttcaaaaatttatagatgaacttgtgttaacgaaatatcacatcatttcctctcgtgtatatataacttataatgttacaaattgaaaatataccgtcaagattgtatatgtttttcacatcccttaagcaacggtgttgtgacgtggagttgtgcgtgtacaactttactaatcagagattaaaattccctgagggcacacatattacatataccctgcactatacttcctttgtcccaaagaaaaataacttctgaaaatgaatcgattcatccttaaaagttgaattttttttaaggatagaggtgtaggattttagcaaggtccaatatataggttacggatttgtcattggtcgttgtattcttttatgtatgccagagaatgcattcgcggatatatgggttttatattgcacgtttagcaatgacataatcgggaaacatattgaatactccctccgtcccaaaacataagcatttctacaaatgaatctagataactccatgttcatattcgtgttgtttttttaattaatttagctcacaacatatgggcagatctgagctggaccagggagtcaggtcaggcgagaggcgaggccaccacacaaaactgtagcgagtgtggccacccatgcatgcaatgcagcctcatcgcttacgtcaccgccgtcctccccccccctacataaaccatcagcatcatcatcatcagccgcaagccactccacctcgagctctcgcaatgccgg

SEQ ID NO: 5454 - DNA, 1501 bp, Oryza sativa
tgacggatgaaaatgaaaacctatgacctattcatacaaaacataggagcagaagatagattcttggacgaacaccttgctaaattctgaatatgaaatacatacagataccggatacttctcaagaactacgatgaattctgcatacaggacataaatggaagaatttttttccccaatgataagaatcataactagaaattatttaacaaaagcaaatcaaactcgcaaacaactcaagaacttattaggatgcagtgttaaggttccttttagaaatcccctttgattttctaaactaaggatgaagtactgctgaataatttgatagttctttcatactcctgcataagatggaacggggaagaagaggatgataaaatcataatgtaatcataatcatgatccccacttgcacagagtataagattttggggaatcagagaacaagaaatttgatttccagtttctgacttaacactgaacacctgaagcatctcccaaacaaggaatcctgcgtagtgtttccatgaacagtatcgaagagcacagagctaagcaaggacataattccttaccagattgagctcctaggctcgaagatgcctggctcccccttcccctcttcacttatgcacacagtatgctaaggaagagacgaacagtggactagtagtcctgaaaagaggctttcctctcaattatacgaatttatttctccaaggaattgagccccgtaaatccctcaactgacacctcacacattgcacacgaaagtccaaaaaacacctcttcatgcatgactgcataattccgtttggtacttttggcagcccagaagaaaaaaaaatataaagttgccattcgaaaaagtaaaaggaaataataaaatatatagttgtccatgaaggaaaatggaaattgcttttgatggcaattttttatttaatttctcaatgtgtaactgtgaacagatgcccatatgtaactgattggggccttttaacgtgcgttcaattgcccaatctaaatagtggcaaaacatcgaatccaacatctcagctattatttagcttcacatacgtatttcgtttacagccacctatgcacacacaaaggacatgaaaccacttgtgtattttgttgtttctctgtttttttgtggtttgtgtttctgacatgtcgatatcatttttgcaaagtggctgaaaatgtatccagtagcattcatgttacaaactacaaagacatgaatttaggtggctggtaacaaacgaagtatagcctagtgtttaagatcttgaacttggtaatggtagtcttactagtctccatcaactgtttcctgccacatataacaattttgttgatagtgatatgtaagatctccgccatatctcgggaaacaaaaaatctattactgcttctgattctccaataagcaaaatgagactgtaaacatgcatcggtctgctccttagtttatcatccataactaaaa

SEQ ID NO: 5455 - DNA, 1501 bp, Oryza sativa
atacggctagctccagccctgcaccggccaccgcctgtcggggtccggccgccacgacgacgacgacgaccgcctccgctccttggtcgtcgtcacccccgcctcctcgtctccggggcacctgcacctcccaggcctctggacggcgcgggtgagcgccccccagagcagcctggccgcgcggggagggcacgccggcggcgacgacgacgacgaccacgcgccgccgccgtcgtcgtcgtggaacgccgtgccatacacgctcggaagtcgctcgtatccggacagcatggatatcttctccaccccgccggcctcggcggcgaccaggtacgacgacgacgacgccgacgccgccgtgggcgccgccctccatgcgatgggcgccatgatccggcggagcaacgccgcggcgggcgctctctcctccgccgccgcctcctcctcgtcctcgacgcgcgttgccatccacgatgacggtgctgtacaacttgaacgatccgtgatggttttatatacgttggagcgcggcaactgatgcggctgtcatgcgtgaacacagagattgagggaggccactaatacgagctctccgtcactgcatgtgggcccgcttgaccgctgaggaaaagtctaaatttgccactacaaatttattatagttttcaatgctagcaaaactgttttcaatttgccgacagctcgacggcatgggctgcgtaactgggcagtttcggcccacaaagagtcgtatgggctagtttcagtgtgcagtctcctcaattatgtggcatactacgtggcgcttatgtggcagtttcctcgaaggcggccgcgccgccatcggagtacggaggtgccgctctcctccgactctgccggtgagcttgaggccgtcgagctaccatcctccctcaaggtgctccaggagcggttgcttcccccgcggcgccgacgtcttcccccacttttgctcgcctgcagctcagtactggagagcctcacgctcgcgctcaacaggcggagagagaggaagagaacaggggagagagatgacgtggcattccgacatgtgggataaaaccggggttaaaactactgaaagacttattgtcaccggttttgattagttaagggacgtcggatatctggttttgcggttgggggatgattttgtaactcgacaacaagttgagggaccttcggtgtacttttccttcgtattagtgtccgaatacgagcccaataacatggcgcgcctccccccttgccgtccgcaaacaacgatgggccgtgtcttgtcccatccgtgttgggtcgctaccattgctagcgacggcatcgcccgatccataccaaattaccaattcggatgagttttccggtggagccccttgagtttcccgctattcctgttgggtccctccccagcgatgtgactatcagaccgccatggccgccggccggcgatgcccgccacaatcttcaagaatagccgcat

SEQ ID NO: 5456 - DNA, 1501 bp, Oryza sativa
ggcgggctagcgagcagagcggcagcggccgcgagcgcgcagcggacgagctctgcagcgagcgggcgggcggcggcggcaggcgtgcgagcggccgtcctacagggagctgctccggtcgctgcaccgcctggcacgcgacctgtccgccgtcgacacacccgcgccattcctgcgcgcctcgttcgcgtccatctcgaggcggtctaagctactggcggccgcgttggatgacctgcggggcgccgcggtttatcttttctttctggtctgtgttttcatgttgccttctacatgttcaatttgattttttttttcatggatcgatggtatatggtttttttcctgtgtgttttgaatcgtcctctcttgctcctgttaaggttggggaaccaatatctctgtggtgtcaccatctttgcaagaaggggatagatcgacgcgtcaagaaatcatttctgttgccatggctccagtaggcaatacgattgttgcttgcgtacaattttttcttgatgcagactagtttcttttcttgtaccctgttttagaaaaatctcactcttctctgtttatatctgttctgttcatgcacagtgctaaccccgggcttgtcggactggaatcctttgaagaatgaatccccaatgactgtgctagatccaccatgccattcagtgttgcaggtcatgatgcttcgagctcgtgattggtctgtgtcagcgtaatggatacattcagttatcatatttcctctaaaatattcgtgttttcgttcattagatttactttgttagatttggcggtttggcaatgatgaaacaaactttcagcttaccatgccagttctgcttctgagaattcatgacagataaagctgatatagatctgaactgaatgttttcatttgcattatgagtgtgtggcgccgccggggagctgatatagatatcgaggctgtgcggcgccgccggggagttgccgcggttggcgtcgctgtgcctgcgggaggtgctcctggttcaaggcgatcgtcgccgattgctcggtgcgaagccggatgcggctgctgctggagtcagacgagatggaggcggagctacgggagctcaaccacgacctggccacgctgctcgacctcttgccggtcgtcgagctgggcgcctgggcctcgccgacgacgtgctcgacgtcctcgccctcgcgtcgcgccagtgccggcggtgctcgccggcaccggaggcggagcaggcgctgaaggcgagcgtgctgtcgctgatacaagaaatcgagccccggcaccgccgtcggacttccggtgcccaatctctctcgatctaatgcgcgaccccgttgtcgtggcaaacggccagacgtacgatcgcgagtcgagcggccggtagagtggagcggagcggcggcggcatccagcgacgcccaggggaaaaatgagaggaagggagagaagaggggaaagagagagtgtgggccgatatggcat

SEQ ID NO: 5457 - DNA, 1501 bp, Oryza sativa
ttatggtgtatttgtatctattatattattaaaacagctttgaaaggaggcaccacgttcgatgtgggggctagaaattcccacattaatcagagaaaaagaaaaaaagaaaagaagagtccaagtagaaatacaatctaaaaatagctgaaattcagaattaaaaataagcaatattgaaggaagtttccatataagaacccaatacgagattaattaatattcgaaataaaaataaaataaaatccaaaattagaaaaaaaaagagagtccaagtagaaatacaatttaaaaatagctgaaattcggaattaaaaataaggaatattgaaaaaagttttcatataagaacccaatacgagattaatcaaaattcgaaataaaaataaaataaaatccaaaattagaaaaaaaaaaggatagtccaagtaggaatacaattttaaaatagttgaaattcagaattaaaaataaggaatattaaaagaagagtccgtataagaacctaatacgagattaactaaaattgggaataaaaataaaaataaaatccgaaattagcaaaaaaaataataaaagaagagctcaagtaggaatacaatttaaaattagctgaaattcagaattaaaaataagcaatattgaaagaagaatccatataagaacccgatacgagattaattaaaattcagaataaaaataaaataatatccaaaattagataaagtaaaagagatttcaagtaggaatacaattttgaaacaactgaaattgaaaataaaaaataaaaatattaaaagaacacaattcgatattaattaattttttttaaaaaaatctgaaattagaaaaaagaaaaataaggttccaattaggaatacaatttataaataactaaaatttgtgataaaaataaagactattgatagaaaagaccatctaaaacacatgacgagataaattaagtaacaggcatataaaggagtagtggtggtggttgatacgacataaaaaaaattgttaatgaaacaccaaatagaatcctaatgacgattaaaaggaggggcgatagggaggccgtaaagcaaacgatcaaggcgattgccgggacttctagaaagtaaaaaaaataaaccccattgataatcatattcgatttttaaaatctcaatgacaataaaaaggagaagcagcgagcggggtgtataggagtatagttgcagagctgccgatggttgacgggacttctagaaaataaaaaatgaattccaacgatagttatgttcgatttttagaatcccaatgacaataaagagtaggcggcggacgggccgtagaggagcatagtagcatcgtttgacaagacttctaaaaattataaaaaaacgaaacccaacaagacaataaactctaaaaactacaaggttcaatttttgaaggttcggaacttctaaaaagtaaaaaaaaacaatgatagtcatattcgattttaaaatctcaa

SEQ ID NO: 5458 - DNA, 1501 bp, Oryza sativa
gagagacacatgctgaggaacacacaaaaaaccatcaagtacaatttcagcatcataaagaaagcaaactaaacaaacagggtatacagtagcacttaccattgttttcatcctgtgcagcattgcttgaaccaccagaaattcccaactcagccagaacagcatcaagttcggctagctccttctttttcaactcctttttggacagctgcctctccgtatctttaggcggtgcaacaggaactgcagctttcttaccagcaggttcagcagaggtatcatccacttcatgctcaggttcatccacagcaccatcatcaacctcatcatcgaggtcctcatcttcactctctacttcctgcagtgcatagaggcaaacacaaataagaattccaccaatcaagcataaagaggcaacagtgaaaatgcagcacccacagtttctgttgagctttatattgtattcaacatcagtcaattatttgttcacatgttttttttggcaccaattatgtgcccctaaaatctaatcataaagaattacatacttatgggaggaaaagaaatttaaaaacatactgttttttataattattcatgaaaaattatacatcgtattcttgttcgataggtaaccagtatattagcagccaaaatagtgtgttcttatttgctgtgtcaattcagtgatatagtgcaaaaagtaactccttgtcaatttatcagctcagcatatgctgtcagacaaacaaaatcacgtcgttggacaaaacaatccacagtataaataaaataaaatcacatcattgaaagaaacagtcctaataaatataaataagcatagcagacatgatatcatatcaagtaatcaataatgactccacctgtgatgttaggttattcatcaaatattgcactgtgtgacaaaaggaaattgttttgccaacggacaaaattaataacgtagtaacaaatacgatacaaacattccaatttaccagttcggtatctaaagcctgttttgaaaactaaccatgcagaaataaatacacctgagatattcccttgtctcctcttaccgtttcatacggatgcattcgtagtttgtaaaaactaataatgcatgcacaagtataactaacgcattctaacctcatgctacggtttcaatatacctacatataaatccaaattatcaccgagcatgtgtttcgcaattccaaaaactaatcttgcagacatcaccactaccattacagcctacataatatcctcctacctcaatccagcaattcctcgcgctacacgagtgcgaaatctattattccaactataatcaaaacgttgcgcagcagaacagcacatgtaatcaagcgaaacaaaaaaaaatccatgcacatcacagacaaataggcatggtacatggaggagagataaataaacctcctgaagggcggcgtggacggcatcgtcgtcgtcctcctcatcctcctccttggcc

SEQ ID NO: 5459 - DNA, 1501 bp, Oryza sativa
ttaacatcaatttgttagataagagatatgatctcaagaagaaacagaataaacagatagctttcttagagaaattttttttagcagacctatcaataatttgtagataatttaggtagcacatgtcaactgaaggagcgttcaaccataaagatcttttatacggttagacgggttggatacatgtagatgtgtgtagagatgggccaatgtgttcatgtgggctacatttagcactgaagaggcgaaaagactcacccgatgactgatgggttgggctctatcctgtattgcatcaaacgtcttagaagcaatctaatacattcatccaacggttcagaatttgatgatgacgtggaagcacaagatttgagcttttggccttaattttatataaaaaaaaaggattacgatcatttgtgctgtgtcctctctattctctccctctctcactcttggactattggtcctcccagcgtcggcgaagcgaggcggcgagcgaaacaatactcccaccaaagccccacaattgttttgccctttttttattcttttcagagcgaagaaaaagaaaagaaaattataaatgagagaaacacacagcccgcttggacttggagacgagacgacggaaggcatccgtgtggtggtgtgtgccttgtgcttgtggggtcaaaaaagtcaaagcgctgatgctaaccgctcgcctatctaggcaaacaccagtcaaaaagctgacccacccacgccaccaccacgctgctccgctccgactcctcccacctccacccccaccacccgtcatcaaacgagtaggagtatcaattatcaaacattcaaacccatcaccgcatccccaactcgccaccaaccaccaccaccgccgcacgaacccccgagcgcccgaatcccacaccgcaccacgcgccgcgccgctgcggccccgtccccgcgtcccctgttccgccccccggctccggatccgcttcaccttcacgtggcgcaggcgtccccggtttaccccaccgccgtcgcccgggtcccgccgcacgcaggcgcccgcgtgtgtgcgtgtcctgcggcccctctccctctcgtcgtcgtcggtgaaaaaggaaaagaaaaacagagaggaggaggcgtttttaaccgcggtgctcagcggggtggtgaaaaaatctccgacccgggtccaaatccaggtgacggccgttgaccgcgaccgtgggggcagtgaagtggtggccgggagcgagcgggaggaggaaggagacatcgaggggaggagtgacccggaagcaagcggagggcgagcagccaagccagcagcggatgggggagtgggggcggtggtagccatctcgcgcacgcctttccccgtacaagctgctcctctctttccttatctctccccccctgattactacccagcagctgcagcccccgccctcctcggcggatcggaggggcagttgatttccgggcggcggcggcggcgcca

SEQ ID NO: 5460 - DNA, 1501 bp, Oryza sativa
atcataattgataaattacgatcaaagttacacctacatgtcgataaattttgctgctacaaaatcagtccaccggctcaagctggctcggtttcaaaaaaattaaaaataagtcaaagtatatgtaggacatactcacagacctgaaagcatttattatgatcagtattagctattggaccagaggaattatatcagtaatttggtggagttggtggactttacgcgtgtggtatatataaatctcgttaagaagaataattaaagacatgtgaaattggtacaaataaagaatctggagtaattcaaatgttaaaaaaatatattctcgaagatacgcccaatccagacaggaggttaatcagaactaataataattaagctacgcaaatttaattccgctgtcggtcagtcaagctagatcaaagctgcgagcttactataagcatgcactgcagcatatctgcaccaaactagaccactgctattcctttttggttttaaatttgttgtaagccaagttgtctctctcgatcctgattaggagtaactaattcaccacctgctgctaattgacaagttgtctaatcagtcgatctgactgtttatcggtttagcactcgctaatcagtttgatttgatttgattttggatgacctggtccatggacctggtagctttcgtgctctcaatgtgaaggaacatgacgtacttcatcacctttggaacgcgtctctgttcgatctgagtctgaatcatgagcttatgcctgattgagaggtttcatcggattgaaaaagtgaaatatgatgatgaaataaatctatatttacccctgttttaccactgggcgatcagatttttttttttcacatatcaacggttgcaaacagagagtattttagagtacatttttgttgcagatttattagactgtgaaatgtgaaatcatttgtcatgctcactgatttaatttgaaatcgttgctccatttcacaaaaaaaggcctttatccagacaattatgagcataaaacaaacataaattcaactttatagtacaattgcttgtgataataattaatttgacctattaaaaaaaacactgctaatttggagatagagtccagagtctatggagcaggaaggaagggttcagacttgcttggaaagcacatcttcccctacctttgaccacgacgctggaactcacacgagcaggaaatctctgacaatggcaggtgggccccaccccgactccttcctacccacggccgactcccctcctcgtcaccacgttgtccatttgatccaccatttcccaaatccaaaacacctataaataccactcaccctccttgcactccaaacaagtcaaatcaaaccaaccatttcaaaccaaagcaaagcaacgagctagcaagggcaacaacaaccacccctctcctcgtcttcgtagttggttattcctctcagctacaccattttgttaacaatggcgg

SEQ ID NO: 5461 - DNA, 1022 bp, Oryza sativa
ctttagccattggcaccagcctttgtggggcctccttgtctgcctcttttctcctcaaactatgttcactccatactccatgtatgcatcagcaactggttggtgccaatggcttaggtcatgaacttttaaccgttgcagtgggggttcggtgttaatcataaggctaacccttcggttgttactcggtatttatagttcagcatgcctgggtgattgtcatgtgcccttgtcagcactcagcaccctgtgccgagtgtgcgagagagtccggtcagtctctcctttgactggttggtgacggttgttttcccgggaccacctggcagtgtcactgctagtattaatggagtcacgtctcctagcttgtgcggcccagctggttgtcgcattggaggttttgccttgcctgcgcagaggcagcagcagagggcggtgcagcgtgcaggactggactgaactgtgcttcgctcgctgtggccatccgcatgaaaagcccgggattttgcgctgcgtcgtggtggtggtggctcctgtttccaacgtatttcccccgtaccaagttgccttgtgctttacagctagcttggtgtactcccaacatcccccatgcccatttttctgtagggaaatcgatgtgctgctgtatttgtccaactgttctttttcttgttgctactagtagttgtacgagttagggggtgtttgggagagagagggtaaactttagcccctctctcaacaacttacttcctgcgttccaaaaattcctccgttcttaaaaaaaaaccctgtgtccagattcaaattcaggagtggtttttttcggaggaataagtctctcggggagggactgtttttgagagaggtaacccctctctcccaaacacccccttagtgatcagttactaatcctccatttacatttgcatgtgatccttgtttgtcctcaatgatttgtcggagttttgaactgtgccgtatttctctttattcgtcatgttcggtacggagtaaatgaa

SEQ ID NO: 5462 - DNA, 1501 bp, Oryza sativa
ttcaacatgtgttttcattatgtttcataaaaaagtttaaatgtttcaataattgaatttgtgtttgaccatgtataactcaatgtttcactaatgaccaaaaaattatgagacgcttttgccccttctctctcctgccattccattctattggctccctcccacaccatggatgcttgcatatattagtgatcttaaaaatatttttcttctaaactatttatccgatgaacgattcgatcacactgttgaattcgttataattaaatgtttacaacaagatatcacatgattatattctgatgaaagaaaaacatatgtttcaaacaataaaaacttattgtttcatacgtgatagcaatatgtttcaccatgtattctcattgtgtttcacaaaatttctatatgtttcagagactgatttttttgtttcaccatgtataacttaatgttgcaccaatagtcaactgaaacatttgaccgtccgatttttttacatcatcggacatccgatttgtagctctcccctaataatctccttgtttgttatgttatgtatagtcatttgtgattgttcttcatgcataatagatatgacggttgccgaagaacactaatccaagggaagcttctctggcccttcacaattcatatttatagtgaagcgaagtcgagagtaggcttttggtgtctggtctgcagtttcttttaatgctcttctattaagtacatggcaaaccatctcagaaatgagtgtactagaattcatacaaccactactcccatgctgacccgcatgctgcgagagcttatattgcaagccgccaaataacaagatagagcttcttcctgaaaaaatggagcttcttcctcaaaaagaaaactacatgtaaatgtaatatttatacgccattgcacacaaactgaccctttccatttgtgatttagggcccgcaaggctcggttgcagatttgatttgagtagtgtaccgtgacttggaagccgggatgaacaaaagcacgataggaagggcaaaagcatctatcaccctgtctacgcagggtgtcacagatgtcttccacagattatgcctaagcgacaacagttcagcatattatacactctacatgtcttccttcagttgctgctggaagcgtctcccaattcacccttgctctcgctgttgtcccagccgacgtccttgccctgttagtgatatgttgttacgagacacaggtaagtgtaattgtattttcgtgttattttaacaatcacactatttttgtaattgaatttgtgattaaattgtatcttatgctgttacgagacactggtgagtgtaattatatttttgtattacgagacactggtgagtgtaattatatttttgtagacacttgtgagtgtaattgtatttttgtgttatttcgaaaatcgcactatttctgtaactgcatttgtgattaaattgtatcttgtgctgttacgagacactggtga

SEQ ID NO: 5463 - DNA, 1501 bp, Oryza sativa
aaaatatataattttgtactaccacccagctcagctactatagattaaccgaaaaacggccagccgctgcgcggtgcgtcgcgtggcgtcatccatcgccgccagtccgcaaccgaacatcgtccgtcatctcacgcaccgaaactcgtcccagaccgcacgcgcggcgtgtaggcatatgcacgttggcgcgtgcgctatctcatccgggcacgtccggccagccagttcgcgacgccgcgcacgcgctcgaatcatgtacggcgcggccagggaggcgctttgcttttccagccgccgcctgcctcgttgtcgtttggcttattggctgagaccgagagcgagccatgtgatgtgaggccgccaccggtggactaaccgcacgcatttgcagtggtgaggtcgacgccatgcgtgtccgcgtacggctcgatccgggtgaaacctgcccacccacgggtggagtgatgccacccgtgcccaacggcgcctcaacgtgacaacacgtcccaaccgtgtgagctgttggtgttggtgtgcgttcggcagctgtatccttttcttgtgcatataaaagttgcatttgtttgttgcctatcgaaaataactgaattaaaacaagcggaacatgcatgggcactgagactcagacacgtgccaattaatactcatttgtacactttttgcagatgaaaacatggagagggtacgcgtcggacgttcgatgctttaggaaaaaatcggacactgacgtcagcgttcgatttacatacaaaactacttttaaactaatttttttaaattacttatccaaattatgattcgattacaccattaaattcgttgcaattaaatcttcaaaacaagaccacacatggatatattccgatgaaaaaaaattagcttattattgaaatatttttaaatgttgcacgatgttccaccagatatatcggaattgtttctcgaaaatgtttcactcgtttaaatctggtgttgtttcaccttatataaaaacaatgtttcagcaaatagcggaagaatgttcagttcacttcaatattacatctatacatagtgaaacattataagtacactagatgtaacatttttcggtgaaacaaaaaatgaaacgaatttccttaatagaaggtttccaaaatatgtgggttttttgttgcaatgatatatttcagttcactgcaacattagatctatacatagtagaacattgtgagtgcattaggtgaaacattttttgtggaacaaaaaataaacaaaattcccttaatagagggtttccaaaatatgtgggtgatttattgcaacggcacgttccactgcaacatttgatccgtacacagtgaaacatcatgagtacactagctgaaacattgtaaaactactagttgaaacataagtgaccacatgcaacattaaaaaaatcaataaaaattttgtcgaaatataatcatgtgtggtcttattgtaaagatttaat

SEQ ID NO: 5464 - DNA, 1501 bp, Oryza sativa
gacgggtctggcggcggcgaggagcagcagtggaggcggatctggcggcgaggagctcgccggctgctcccctcccctccggcgcgggctcgccggctgctcccctcccctctcgagcgcgagctcgccggctgctcccctcctctctccggcacgagctcggcggcggggagtagcggtggcgccggatctggcggcggggagctcgccgactgctcccctcccctctccggggcgagctcggtggcagggagcaccggtggcgccggatctggcgacgacgacgaccacgacgacgaccatggcggctgcgttgatctggcagcgacgacgaccatggcggtggcagcagatttggtggcgacgacgaccatgacgagatggggatttggggcagttgcacgggggtccggacgaggcgacgaccggggctccgactcctccaacgcgaggcttcggctcgtggcttcacggctcccgagcgcaggcgcggtgcttctttcggtttttctacaagctcgctgcgcgcctgcgagaccacgagcgggcgtgccagctcagctcggctccgacgtagagccgtgagaccacaagctaaggtcatgcgttgtacatggcattagggaatggttgttctaacccaactaataatatatatgcatgtattgcacctacatagattacttgccaaaaattttaggtagataccccatgtcctatgtcctatggtagatccgcccaaatcaacatatactatccattagtatttatattgccaaccgtttattgattttcgatggtatcatgattcgtgtgtttgttgcgttgaggatataataatatgaattatacagtagagaagttaattaaggtgttaatattatataatactttctccgtttcatattataagactttctagcattgcctatattcatatagatattaataaatttagacacatatttgttacacaaaatactccgtagcataatagttcctactataaatgaaacttttaattggcccttcccatttcttgtttaagctagctccactactggtccattgctacaagtggcagggtctttttgaatttcacgttcttttttgaatcgtaggaactttcctcctttttgtgtatgagaattgttccatttcttgttaaattttcataaaatacatacaaaactactatatatacgtatgcagtatgcactcagcttgatgaaatcatagaaaacatgagcgtggaagccgtggattggagttctggcttttttttttgggtgggtggggcgccccgggggggagggggggggataatccacttgcacagacatgtacacgtagacatagagtcagccgatccaatccacaataatgactgcatggcgtgcatgcctatcgatctgtgatctgtcccgtagctgatcaccaacccacagtcatgggttgcatgcaaatatggcaacatggatgactagctgaagagacaatt

SEQ ID NO: 5465 - DNA, 1501 bp, Oryza sativa
ggccggccccggccggaccaccacccaccacttcttcaaccccttcacccactccgccgcctgctgatccgatccatccatcctcatgaatctgcagttcgatcgatcgatcgatctgcaacaccaaacagacatagcactgctgctgactgctagctaaagcttagtactacctcacgtcacaggtaacatatacacgtgacatacatggcgattggcgacatgatcatcatgcatcatcatcctctccttgagctactgtttcttgccctgggggattccagcttccattagctagacagtccatctcagtcaaatcaatcataggcttaatgataggattagtcaaattaattatagccgggccacagctagtacccgatcaatgtatatttttgtgcatgcatgtaagtatgtaactgtgtgcccccctctcatcactagttagctttacttttcttttttgtttcacaggctagttaattttcagaggggatcatcatggggcagtgcagtagctagatagattaagcttgtatactagcactactgatggattaaaattcttagatagtgtcacacacgcacagtgttggatcggatgacgacatgagctagcttagctagcatgcctgcctccctcctgttcgctcggccctgtcgggtgcgtgtacatgtgtttacttttgtatggatatacgtctcaatgattgtgtgtgtcggggctccccaacttcaaaaatttattgagttgccatcgctttcgcctctctgctgattattggttaatcaggaagagagagcgggacttcgccctctcgtctcatctttttgtttgcttaattaggacttgagagcggtagctagccatctggatctctgctctgctgcacgccatattaattaacccaaggcaattttaacacgtacggccacaccaccactcgcgatcgactcttgctgcgggtacgtagcacatacatgatcggccggttgcacgtactgttggacactgacggtttccgtgcgatcatactatagtagtagctagttcgttgagtaattactgcacttaggtatagtcagcgtcgaagctagttgcccttgctagctcctgccttcctggactaactaatttacacaggaaaattatgcggatggtgtgtgtgatgagggatggcacgaccaaatcatgacacgtaaaaaggagcttcgcgtcgcggcgtggtagttaatatgggaggcatgccaagaaatatgagccgggcggggcttggctggcatggccggcgcgggagcacgcacgcacgcatgcgcgcgttcgatcgatctctctcctggaaatttaacctggcagccgaattccttttctgacggcttgctctctctctctctctctctctctctctctctctctcgctgcgcgctgcgcggcggcatctggcacgtactctggccgttgtgttggctctataaccctttataaattgtgtgttgcacg

SEQ ID NO: 5466 - DNA, 1501 bp, Oryza sativa
taggtaccatttgctaatgaattgattatttgacatatagttattattgtatgtacaggttttttaggatttaggaggaaaaaaatgtttgttttcaagcctcaagtataaaagtttgggattgaaaaaaaaagggaaataagaaaacatagaatttggatagaaatatatgtgcaaaacatataaacatatagaaatgatcgtttgaatagaccatagaaaaaacataggaatagaattagagagataagtcttaaagaaaattcttcaagagttggaaatttttgctaacttcttccacaatcttcatagaattacccattctatagaaattttaaagaaaatgataatattttgtttcaaaggttttcttaggattttctttttaagattgaaattctttaatttttctatgttcccctataaatcaaatcaaaggagcctttaatctggcttcaacttagataaggatactggaaagttgttatctatactactagtaatggtggtgtccattctatcattcacccctaccactaatatttggatcccacaatttatattattactagaaaaaatgcccgtgcgttgcaacgggtaaatgctattttaattctattattgttataactaggataaaatttattgtgggaattcacttggatattttttcagaaaatcatgagctgcaattagaagtctgtatttcttctcaagttagcatgtgagttttttttttcaaaaaatttcttatatgactcattttatacttctaaaaggaaacaagcttaaaatccaactcaaatacaaatatgtatttcgaaaaacgaaagaaaattaaaaccgactcaaatacggataacgtaccaaaataccataaaacattttcaattaaaggaatcaagcttaaaatccaactcaaacatagatatatatatttccaaaaatgaaagaacttgaaaaccgactcaaatacgaatgacgtatcaaaataccggcaaaaatatttttaacttttataataggagagatatactatcctccaatgagtcatcctgtttcactgctagctctccctaaattttgaaatcacatacttattcaataagaaaaatcataaaggtactgcttgtactaaatacgtgcataactgacttgataaactacaagctcaatttgtttttcgttgcaacacacaggctcttggctagtaaaaacaaataatggtggtgtccgttttaaactgcttttcgatttagctgctttcttatctttttcgttagcacatattttaaacttttaatcgatgtgtttcatacggaaactttattatagcaaatactttaaaataaaaaataaatataattcttaagttttaaaattttgatacttaattaatcgtagcctaattatctctctcgtttttgcctacgaataatcagccgtttcaccacgcttactctctgagactgtgaccgagagtaactgtaaagaacctgaa

SEQ ID NO: 5467 - DNA, 1501 bp, Oryza sativa
gatttgcactacatattatttttttggtgcaatataacttaactgcacatgtatgtatttgctcgtactaaagcagccttaacctcagattgacaatgacttgaacccaactaattaagtagtagtgtagtacacactcaagctaactaagcaagaataaattgaaaactatacacactctagtttctactataggactaaaaagattatgcttcgccattactatatttgacccacctgatgttatcacgatggagacgtcagcgtgtagataaatgctacccataccactgacgaaacgaacgaacaaattttaagacacgtgtgttgcaacttgcaagtgttgcaaacctgcaactgactcagctccaggcgggcctagcttgaccctgtttagatccatgattaaattcctatcatatcatatgtttgaaccctaattaaaaatattaaacacaaaacccatttcataaccctatactaattcgcgagacgaatctattaagcctaattaatccataataatttgtctctcaaattagctctcatttatataattagttttattattagtctacgtttaatactctaattactgtccaaacatccgatgtgacgtagaatttagggtgcgatcgtttcagcttttcatgattagattctcctcgttttccgttagcttttcaaactgctaaatgatatattttatgcgaaaactttcaataaaaaagttgttaaaaaatccaacaaatttatttaaaaatatatatatattaatacttaattaattatatactaagtgtattttccgttttgttttgtgtgcggctaaacagtccaccgtcactgctggaacgatcgaaccctttagtgtctgatcaaaacaccaccagcctccaaccagacgcaatgaatacgtacgtacgcgaatgcgacagtcctgattggtcctcttttcttttgttttttccattgttttctcgctacttgccagagttaatccctatattttctcccaaattaaattgagtgccatgcatatccccaaatccctaaatcaaagtaacatcccaaatcttcacatcacaaatcctaagttacttatacacacaaatcaaatacatcacagattatacatctcatatttatgcaatgaatcacaaattctaaaataaagaaattatacatcttagcgaatcacaaattatatataaaaaaaaagaaaggatgccggtagaggagagggcgccccgcctccatgcatgcgcgccccccgccccctctcccgacggccggcgcctgccgcctgcggccccaccggccgccggatgggaggggaggaggagaggggatgatccgatcttatctaaatatctcggtgatgaggaaagtcttgtctaggacttaaccgatcgaagatgggagagaaatatttactcccggtttagtaactccaaccgggactaaagatggatttttagtgccggttggtgttactaac

SEQ ID NO: 5468 - DNA, 1501 bp, Oryza sativa
ttagtagtggactatactattatgtggaggaaatagaagaggagagagagaggaaaatggtgtagtaacatatgtgagagagaaatgtggggaaaacattaatggtgtagtatgtatccatagttaactattatattagtaggctattaagttagctatagatgatgtgttaatttttggagttagtagttggctatattattgctctaagtgtgcttgttgttcttggtccttgtatcgggtcaaaatatgacgattaaacctaaatggaggatagttaaataagctctttttcatagggaggcaaatcaggcaccttattaaaaaacacttcatattcgtcttatttaaaaggtttatataatagtattttttgttgttgttagataataaaatataatactttatacgtggctaattttaaaaaaaattataaattttttaaataagacatgcggttaagtgttggacagagaaacctaaaaatgaagtctctgtgcgtgttaaaaaaaaaagtctccgtgggatggaggggtatctcgtgcaacaactgcagcatggtcttcagccatattgaccatgcttttagttttcaaaaagaaaaaaagaccatgcttttccttttttttttcctttttgttagggggcgtgggatgggggttgggtttgtagaggcggcatgatggggccagagcgttgcatggctttggctgaaacagatcaagcacgataccctacaatattggagtgtgttgtagtcttgtagaggcagcatgatggggttggagtgtaccttatctgggacgacagagcaagcatggcgtgttacagttactcgactttacaaactaattatttttagtgctggataacgtacatgttaatatgaagacttttatatcgatttagtctctcgaagatgttcacatggtaagatgtgcgtattttgcatgtgtatataagtatatgcatttgtattgttttttaaaaaacaaaagtactttgatagtaaacaaaactaaaggcatgcttttcatttaatgatatgagacaacttccttagttaatttagatagtacccatttcctcgtgtaaaaaccaacataaaatataatatggtattggatatatttaaatttattttattagaacacgtaatatccattctagcatgtcctatgggatggagggaatacattttcgtctacttgcggaaaagagttgcatctatccctttaggtaatgtttggtttagggataaagtgggatgggttagacctatcctagttttgcgggatgggatgattccagttatctgtttggtttatggtatgggatggttatagttttctgtttggtagaagggattgaggtgggatgagatggacgaatttgtactcaccgttagtaccgtctgggggcggagtagctcggcggtgctcggatctgagaggagcagcggcggcggcgttcgcggaggtggcggcggttgcagacaagc

SEQ ID NO: 5469 - DNA, 1501 bp, Oryza sativa
gaaaagatcataatacctttcattcctttagagcaaggttaatagtagcccactactagctccaattcatctatagccaattcatacaatagttacttactatactattaatatatggtctcatctgtcaaacacactgcgtcttggagttcgtactgcagctggctacagatctatagcccgttgtttttctatctcatattttatcttattaaaatatgtttacagctagctaatagtttgctattgtatctgatcttaggtggcttagaaagagtggctttgaaaatggtaggatagccatagtagtactaaataatctaccgtataaaaaagctatactacttttttgggacgggacagagtatatctctttcacggttatactactgccttcgctttcaccagttgaaggtgttctgaactttctgatcgagttgcgtgtaatttgtttcacagggaggatcgacgagttttccagctcccagcctcccaccaaccagctaccgatatgcttttgagctggccgctggcgcatacagtctcgatcctaccttgcttatcctcttcgttttcttcttgatcgttggcaaattgtctcttcagctagtcatccatgttgccatatttgcatgcaacccatgactgtgggttggtgatcagctacgggacagatcacagatcgataggcatgcacgccatgcagtcattattgtggattggatcggctgactctatgtctacgtgtacatgtctgtgcaagtggattatccccccccctcccccccggggcgccccacccacccaaaaaaaaaagccagaactccaatccacggcttccacgctcatgttttctatgatttcatcaagctgagtgcatactgcatacgtatatatagtagttttgtatgtattttatgaaaatttaacaagaaatggaacaattctcatacacaaaaaggaggaaagttcctacgattcaaaaaagaacgtgaaattcaaaaagaccctgccacttgtagcaatggaccagtagtggagctagcttaaacaagaaatgggaagggccaattaaaagtttcatttatagtaggaactattatgctacggagtattttgtgtaacaaatatgtgtctaaatttattaatatctatatgaatataggcaatgctagaaagtcttataatatgaaacggagaaagtattatataatattaacaccttaattaacttctctactgtataattcatattattatatcctcaacgcaacaaacacacgaatcatgataccatcgaaaatcaataaacggttggcaatataaatactaatggatagtatatgttgatttgggcggatctaccataggacataggacatggggtatctacctaaaatttttggcaagtaatctatgtaggtgcaatacatgcatatatattattagttgggttagaacaaccattccctaatgccatgtacaacgcatgaccttagct

SEQ ID NO: 5470 - DNA, 1501 bp, Oryza sativa
cccccctcccgtcgccctcgcctccgccgcagccgcagccacaggcccaacccctgccccgtaaccctaaccctgatgtcccctcgatcgcgggagctgctgacccgaccaaatctcctgtggagtctggtagctcctcgtcgatgccgcaagctttgtgcacgaatcctggcttacctgtcgcatccgatccgcatcatcctccaccggatgtggtgatggcggaggccttcgccgtgatcaagagcaagtcgagtctcgtcgtcggggatacgaagagagagatggagaatgtcggtggtgcggatggaaccgtcatctgtcgccttgtcgtggcgctgcatgcggccttgctcgatgccggcttcctctatgcaaacccggtggggtcttgccttcagctgccacagaattgggcgtcaggttcttttgtccccgtatcgatgaagtacaccctgccagagcttgtagaagcgttacctgtggttgaggaggggatggtggcagtgctgaactactccttgatggggaattttatgatggtgtatgggcatgtgcctggggcaacatcgggggtgcgaaggttgtgcttggagctgccggagcttgcgcctttgttgtacttggatagtgatgaggtgagcacagcagaggagagggaaattcatgagctgtggagggtcctgaaggatgagatgtgcttgcctctgatgatatcgttgtgtcaactgaacaatttgagcttgccaccgtgcttgatggcgctgccaggtgatgtcaaggcaaaggtcctggagtttgttcctggggtggatcttgcaagggttcaatgcacgtgcaaggaattgagggatcttgctgcagatgataatctttggaagaagaagtgtgagatggagttcaatactcaaggtgagagttctcaggtgggcaggaactggaaggaaaggtttggagcagcctggaaggtttctaacaataagggccagaagaggcccagtcctttttttaactatggctggggtaatccttatagtccacatggctttccggtgattggtggggattcagacatgctcccgtttatcgggcatcccaatctccttgggcgcagctttggaaatcagcgcaggaacatctcacccagctgcagttttggtggacaccatcgcaactttcttggttaagtcatttcgtgggttttgctagtatgttaagaatatttcatctgaaaagctacatataacatattgtacatattttatagttggcactttatgcatgttcagttgttaactgtattactgtactcgtaatcttttctttctttgttgatatatcctatattttcttgtagtaccagtgttatgcatgccttaatcatggtaaagtatcgtctgtttaattctctgtgctacaatatgcatttcaaacacttgtaacttgtaagtctcatttgttggatgcctttagtcaatctgattatttcatccatcaacgg

SEQ ID NO: 5471 - DNA, 1501 bp, Oryza sativa
aatctttggaagaagaagtgtgagatggagttcaatactcaaggtgagagttctcaggtgggcaggaactggaaggaaaggtttggagcagcctggaaggtttctaacaataagggccagaagaggcccagtcctttttttaactatggctggggtaatccttatagtccacatggctttccggtgattggtggggattcagacatgctcccgtttatcgggcatcccaatctccttgggcgcagctttggaaatcagcgcaggaacatctcacccagctgcagttttggtggacaccatcgcaactttcttggttaagtcatttcgtgggttttgctagtatgttaagaatatttcatctgaaaagctacatataacatattgtacatattttatagttggcactttatgcatgttcagttgttaactgtattactgtactcgtaatcttttctttctttgttgatatatcctatattttcttgtagtaccagtgttatgcatgccttaatcatggtaaagtatcgtctgtttaattctctgtgctacaatatgcatttcaaacacttgtaacttgtaagtctcatttgttggatgcctttagtcaatctgattatttcatccatcaacggagaaacaagatactggtcatgttatataccatcatgatctgctgatgagattgaaactgtcacttgtttctaaagtttgcgtgaaataactggaagcaggtggtgtctttctttggtaaaagaaaagtattgtccttatcatctctttgttcttttcgttttatatgctatgaaaagatatattcatcccatattccgataatttggaatacttgcttgccttttgtgctatggcaacttatgcatattattttgttatttttatgttcgtggggggttgtagcctcacaggttgtagcctccatactgaatcgtgcaaaactgctatcctacaaagaaggacaaacaaactggataggctgtactcattaatcaatgtctaagctagtgcgattaacttgggcagcatatggtccgaaaacaaagaaggaaaaggtgaacatatatcaggaacagatcaatagacttatcacgagactataaccactggtgccaaacgaattagcaaacagataataccttagaatttttgtatttggcaataaaatctagtaagaatttgttgagctgcactacaaacatgtatagataagaaatagcatccaaggcgaggatgatatgttgttaagacatactatcgagcaaatcctgtggcaggtttctcttacaccaggttttacctatggtttgtaagtttctacctgattttcattgtatatattattttgtgattacacgaatcaattgtttccttctatatattgctgaaaccgagctgccctgtttaaatgcattagttaatgttatacgttatctgtgtttgataaaaagcttctatgaaactatgaccactgtttgcttttgttttg

SEQ ID NO: 5472 - DNA, 1501 bp, Oryza sativa
gaagaagaagtgtgagatggagttcaatactcaaggtgagagttctcaggtgggcaggaactggaaggaaaggtttggagcagcctggaaggtttctaacaataagggccagaagaggcccagtcctttttttaactatggctggggtaatccttatagtccacatggctttccggtgattggtggggattcagacatgctcccgtttatcgggcatcccaatctccttgggcgcagctttggaaatcagcgcaggaacatctcacccagctgcagttttggtggacaccatcgcaactttcttggttaagtcatttcgtgggttttgctagtatgttaagaatatttcatctgaaaagctacatataacatattgtacatattttatagttggcactttatgcatgttcagttgttaactgtattactgtactcgtaatcttttctttctttgttgatatatcctatattttcttgtagtaccagtgttatgcatgccttaatcatggtaaagtatcgtctgtttaattctctgtgctacaatatgcatttcaaacacttgtaacttgtaagtctcatttgttggatgcctttagtcaatctgattatttcatccatcaacggagaaacaagatactggtcatgttatataccatcatgatctgctgatgagattgaaactgtcacttgtttctaaagtttgcgtgaaataactggaagcaggtggtgtctttctttggtaaaagaaaagtattgtccttatcatctctttgttcttttcgttttatatgctatgaaaagatatattcatcccatattccgataatttggaatacttgcttgccttttgtgctatggcaacttatgcatattattttgttatttttatgttcgtggggggttgtagcctcacaggttgtagcctccatactgaatcgtgcaaaactgctatcctacaaagaaggacaaacaaactggataggctgtactcattaatcaatgtctaagctagtgcgattaacttgggcagcatatggtccgaaaacaaagaaggaaaaggtgaacatatatcaggaacagatcaatagacttatcacgagactataaccactggtgccaaacgaattagcaaacagataataccttagaatttttgtatttggcaataaaatctagtaagaatttgttgagctgcactacaaacatgtatagataagaaatagcatccaaggcgaggatgatatgttgttaagacatactatcgagcaaatcctgtggcaggtttctcttacaccaggttttacctatggtttgtaagtttctacctgattttcattgtatatattattttgtgattacacgaatcaattgtttccttctatatattgctgaaaccgagctgccctgtttaaatgcattagttaatgttatacgttatctgtgtttgataaaaagcttctatgaaactatgaccactgtttgcttttgttttgatcaagct

SEQ ID NO: 5473 - DNA, 1501 bp, Oryza sativa
accccagcgcggcctcctcggcggtggcctcatcgatccgaaccatccgcatgaagtcgaacaggaacaccctcccaccgcaggcggcctcgcaaacggccttcccctccatgaacgcccgccgcagcagccccaccacctcgcccgcgacgtccgcccacgcgccgccctcgaagcagaggagcctcgccggcgcgccgctcctccggaacgcctgccacccacgcaggagcgggatcgccccaccgttccctcccccgcgtgccgccgcgacagagggccggtggatcgccggcttgacgtcgccggagaagtccatcacccctcccgacccggatctctctcgccgcctctgctctcccgcgcgcgcgcgcagatgtgcaggtggagaaatggcgatcgggatcaagtgggagcggaagacggaggaggtggggatgaatatataggttgaggccgcggcggggggtcggtctcttgaagagcacgtcggcgaggaggtcggttttttttttttctcacttgtgttctggggcggcgcccgcccgagtcttctttgcgtttgttggtaatggtaatggcggttttgcccctgatgaaggacagaaggagatgccttggtagagaagtctagaaatgtctagtttgcccccgaacctgttttacttgcgccagttgtttttttatttcttttttggtctggactactacttacttgaacggaaagaatagtgctccttcccttaaaaaaagaaaaaaatatttctcctctataataaattaattaatataagaaaattggtctaaaaaacggttacatttcaatttcatgcatacacatttgattgtatgagtttggttaattatataaaccaaaaaattgtttcctaacaatagcaaaattcagcatagcacttctactagtactagtccttgctcgtactgtcgtacataaagacttggctctttacttcaccttgggtcagagttgtcgcatgtgaagcacgctgactataccgattagtaccgactttgccctttacttcacctggacaggcccaggcgcccagccggtctccttgttgtataccagcttagtacgaaacgtccgttaatgcgaaaaaaagaaagggagaaaaaaagaaaacgaaaatgatactccggcacgaaaccggcgcgtggctttctctccggccacaaaaccgcgcctactcttctctcttgtgcgtatttttcttggcgcttaagattgctttcgctcgttcccacccacgatgttcttgtgaagcaagttgtttatttctcggtctagtaataattagacttccaggtgggccccaccggcccaccgccggacgaaggcgtggtaaaccaaacgctgacctttgccatcgccgttgaccatctgatcatcctacggttacgggagtttttgagttttcgtctggatagtataatggcgagttaaacgttttcaattttaactattaataaaaaatta

SEQ ID NO: 5474 - DNA, 1501 bp, Oryza sativa
agtacatctcaaaacaaataacatgccccacaaaaccaaccgaccaactacttaatccattcacacgtaggatattaacggattaactaaactaatcttgaactcgggtctactgcttccgtggctttcgatgctgccaattagctaggctgcagatacttagcgcctaagctaacaaaccaactcgcagtagtccagcagccggccgcgctggtcgatattttgcgtcggatcatacaaaaaagtagaaccaaaaaaaaaaaaagataacgcgatccaagcgaactttttgatggcgacgttgcgagctcgctagcgatcatcgagctaaatatatagcacgggggcagcggctttacgattcattgcgaaccgctacctttttttcgccagaatcatatgcaaatgtaccttaattatctatattatattacatatcatacaaatatgacatattatttacaattttattatatttttaagaacttaacattcaaataatgtaagtcattatctccatatcattttcatattaattaaacatatacatctatcatttatataatatatagcatgcgttcattgatccatatatttcacagcaaagcgcgggatattaactacgactttctccgtcttataatataaaagatttagattgaatatatgtgacatattataatgctatgaatttagataatttttttatctagctttataatattaggatgtatcgcatatatatacgatctgcgagctcgatcgaaaggttgcgatttaattagattaattagtctcgtttaattaattgttcctacgtgagtacgtgcgccgccacaggggagcatatgcatgcactggttcggtttgggttcgtgagatcacttgcttaaaatttagtttcgcctttgctttggggcaaaggaacgaacagatgcgaaagagacgagccttgcggccactttgcatagaggaccctcacgttcaggcaaatccttgtggggcccttatactgccatatctcaaaacgtttttattttggtcttttttatatcatccgactgccatgtcgaccttgatatggcgtgtgttgtcatggtattcgctttagggaaccttcatggcatgcatagtctttcagtatcaggcctgctatttttcagtgtagtggtgtttctctttttattaaaatacatagtttatctcgacttttattagcatatttttcaagctgcttatgaaaactttctatatatacattactttaaaatattaaaacttaatttgttgtacgttaattactttttttatgtatcctagctaggggaaaaaacaccaccgtagagtcactcttggaaatggagtatggctgtgtttgcaaccccttgttcctagcccctatctctcgttttctgtgtacacgtttttcaaactgttaaacggtatattttttttgtaaaaagtttctatacgaaagttgcttaaaaaatcaaattaatct

SEQ ID NO: 5475 - DNA, 1501 bp, Oryza sativa
agatttctggtatttgagattagggacctcggactgactcaacgtgaagttgagggacaataatgaacttatcctatcttactataaagttataacccactaattctaaagctcaacatgcaaagatgtcacatcataatacattaacaatatatcacatcatcatccattaacaattattacatttaaacatcatacaagcatgttatcttatctataattttataatttattaaattttagagtttaaaaatgtaaacatgttaaatcatcactccaaataattcacataatatttcaatatatatcttcatcatttatgataatatcatatatacctatatggtacatcctcacttagttagtgttatttctctcttctcccattaaatcatatcacatcaattatttttagccttaaatgattaatctatggtccaaactatctcactccctttattctcttataatacttcaatatcttacttttacatttgaatcgtctatatactatttaaatttaaattatcataaaccatatcaacttatgtaagtatatgttgttagccatcttacatattatttttacttattgttatcatactgaaatcccgcagcaacgcgccgggtttcacctagttccgtagatgattggtcactaaaaaaaattaggaaatgccttttttttttcttcaagaagtaaacgttcttgtactagttagatgcttagtttgagttgattttttcagttatacagactcataagaaagtacgtgaagatcccttctaatcatcagactaattctatgtcacgaaaattacttatagcagtaagaatccaagaccagttcatcaactggtaaatactggagcagttggaggcctgaagaaggtgcaaggcaaaacacctgacaagccaaatgttgcacgcttttgaaattatctaatgcgtgtgtgcagagtataatactaaaaggtttactgtttgtactaataataatacaataaactaacaattcagcgatttctggccgacgagttgctctctcgagtaatcacctctatctggtcacgatcaagaaattagaccccttctgtcacatcagcagatcagctcaagtgctcaaccactacacaagtacacgatcaagtaggcaagtagtacgcgttggcgttggagggagtccacacatcattgcacgaaaaagcggcgtctgcaactaccgtagccggaacatgtcaaacctcgttcgagccctggtatataaatacacccggcgacgccatgtccgctccacgaacaacgcaacaccaagcttagctaatctcacagtcaccgagctgaggtagctggcgagatagatatagctagcacagagagcaaaaatttcctagcgagatcactttaattcgccggcgtgcatggcggcggcggcttcggtggtggtgttgtgcgcgctggtcgtcctcgcggcggcggggggcgcgagcgcttggccgg

SEQ ID NO: 5476 - DNA, 1501 bp, Oryza sativa
taccggccggagcgcctcctccagcagctggaggcggcgagggacgagttcgtccgcgccaacgtcggcgtccgcggggggcggcgcgggcgcgggcgccgggtgctcctcctcctcccgaagctcctcgagccgtactcgagggacgccggcctcggtgcgcacgacctcctccgcgcggtggagtcctgcctcccggagccgctccggccggcggcgcagcaggcggcgcggtcgcgcggcggcggcggcggcgtcgagtggaggccccacaacccggccttccgctacctgctcgcgcgggagctcgtgggcccacccgcgccaacggcccacctatcctccacgtaaagtttcacggcccaatgtacagagccttgtaaagttgatattttgggcccggcccaacaaacttggaaagttagttatctgggcctgaaaagaggccgtggcttttggcccatgtttgtggaacgttctacctgcttggtctctcggatggcacgaacggacgacgatttccgtcttggtggacaagaaagaaagtggaacgtttttgacttggattcttaaacccgccaatggttttccacgcgcccacgttattgaggggtgtttagatctcacatcaaatattatataggttatcgcagggtgttcagacactaatataaaaaactaactacagtatctgtcagtaaaccgcaagacggatttattaagcctaattaatctatcattagcgtatatttactgtagcaatacattgtcaaatcatggagcaatcaggtttaaaagatttatagttgcaatctatacaattagttatttttagcgtatgtttaatattttatgtaggtgttgaaatgttctatgtgatagggcgtaaaatttttgggtatctaaacagccccgagacgctgcctcgcacaactacccgctttcgcagctgcattcagcacacggttttttggctcgaatcatcttcaattctttgccccctgtacatcttgccgtagacttgggagtggaacggcaactgccaccacggcacgatggccaacgcttccatgcttcttggctcgtcgcgagcgcgaaaggccgctaaaccctgggtcagatcgacctatataaatcggcctcacctgcgcagtttgaattcagatcgaaaccagcagttgttttcagagcccagctagctctcgatcatttgttacagagaaattgatcaaagcaggaaattaaccagctgtcaggaagcaatggctctcgtggaggataacaatgccgtagcggtgagcttcagcgaggagcaggaggcgctggtgctcaagtcatgggcgatcttgaagaaggattccgccaatattgccctccgcttcttcttgaagtatgtacatgcgtgttactaccatttctctttttgcggaatcagagattgggtttgtgaagcattaaattgagcaatgcatttcgctgatacatgtgtgtctgattgtgt

SEQ ID NO: 5477 - DNA, 1501 bp, Oryza sativa
acaacctccccttccaaagtccctgaaaatttagtcacagtttgacctgcttgagtgattggtaaaatttgccatcttgaattgcatatgatttgtgcagtggctgagactactcctgtacccgaaatggaagtccaaggagaaggaagacctgcaggggttcgccgtcgacaggccggagccgctggtgcacttcgcgctgtcgtcggggagccactccgacccggtggtgcggttgtaccggccggagcgcctcctccagcagctggaggcggcgagggacgagttcgtccgcgccaacgtcggcgtccgcggggggcggcgcgggcgcgggcgccgggtgctcctcctcctcccgaagctcctcgagccgtactcgagggacgccggcctcggtgcgcacgacctcctccgcgcggtggagtcctgcctcccggagccgctccggccggcggcgcagcaggcggcgcggtcgcgcggcggcggcggcggcgtcgagtggaggccccacaacccggccttccgctacctgctcgcgcgggagctcgtgggcccacccgcgccaacggcccacctatcctccacgtaaagtttcacggcccaatgtacagagccttgtaaagttgatattttgggcccggcccaacaaacttggaaagttagttatctgggcctgaaaagaggccgtggcttttggcccatgtttgtggaacgttctacctgcttggtctctcggatggcacgaacggacgacgatttccgtcttggtggacaagaaagaaagtggaacgtttttgacttggattcttaaacccgccaatggttttccacgcgcccacgttattgaggggtgtttagatctcacatcaaatattatataggttatcgcagggtgttcagacactaatataaaaaactaactacagtatctgtcagtaaaccgcaagacggatttattaagcctaattaatctatcattagcgtatatttactgtagcaatacattgtcaaatcatggagcaatcaggtttaaaagatttatagttgcaatctatacaattagttatttttagcgtatgtttaatattttatgtaggtgttgaaatgttctatgtgatagggcgtaaaatttttgggtatctaaacagccccgagacgctgcctcgcacaactacccgctttcgcagctgcattcagcacacggttttttggctcgaatcatcttcaattctttgccccctgtacatcttgccgtagacttgggagtggaacggcaactgccaccacggcacgatggccaacgcttccatgcttcttggctcgtcgcgagcgcgaaaggccgctaaaccctgggtcagatcgacctatataaatcggcctcacctgcgcagtttgaattcagatcgaaaccagcagttgttttcagagcccagctagctctcgatcatttgttacagagaaattgatcaaagcaggaaattaaccagctgtcaggaagcaa

SEQ ID NO: 5478 - DNA, 1501 bp, Oryza sativa
ggcggagaggagcacctgcgggagcggccactcgcagcggtagtggcgcaggatgtactcgttgtcccgcatgtagcccggcagcgcccggtactccacaagcccgtacctccgccgccgccgcagcccctccttcctctcgtcctccgcctccgcccaccgcgccgcctccacctcctcccccgccgccgccgccatcgccaggaagagagagagagagagaaagagcgcgcgtcccgggcgacaatggtgttatgccgttgccgctcgaatattcgccgaccacgcgacgacgcgaccgagagggaagggaagggaaggggagggggtttttttgtacgcgttgccccccgcccgctcgatcgctggctcgcctcggttgcgtcggcccgtcggtctcggcgagggggccgcgccgcgagtcggagatgacggagacctctccccgatttagcccctcctcccctctccccccgctctggccttctgacggcgccgcgtgcgtgcgtgcgtgcgctcgtcgatcaccttggcctttcctgggcttctctctcttggctgccggggcggtgcgacgcgagcgcgaccggtgttggggttggggtttggtgccgtactgtcgtgccgtgtcgtttgctcgctcgcctacgcctctgcgcgcgcgggggcctgcggcgtggagcggcgagtcggggagggttgggttgggtagggtgcgagcgattcatcacggattcgacgtgccgtgcgtttcgggaagatttctaggaagcgtgacggtttcattgcttcagaaatctcgtcaaacgcgaggggcgtgtttggtggcattttcttcgtgcttatacggacgaaagcgaaagatatggtttactggccttttcctttgctttgcagcatagtcatcgtcgtagactcgtatagtacggggatgttaggatctgttgaaaactgagcccatgagattgttaaccgataagctactacggcctacgggccagtgtcagttatgggccaactctgactcccggggtacggagtctgtgatggaataagttcgtttgaggtcccttaacttgtcaacaaatccgattttcgtccttcaaccgaaaaacagatacaatgggtccctcaacttttaaaaccggtgcaatataggtcccatggtggtttggatagcggttttcactgacgtaacgcctacgtggctattttgactcggtcttcacatgacgtggcgcttatgtggcaatgtaattggaaaatattaaaaattgtgggcccacatatcagtttacaccaaaaaattaatttaaaaatggtgggccccacattttacacgacgttgacaagttaagagacctcagatgaacttattccgtctatgattgatagaagaagataatatcggcccagcaaaacaagcaagataggaaaaaaaattccttcttcgttttggattttttttctacggtaaaactaagtacaacacattctcagc

SEQ ID NO: 5479 - DNA, 1501 bp, Oryza sativa
cttgtgttgttatctgacgggaaaacctccaatcagatggctgatggcggcagaccggttccgttgttccggctgcaaaacggccgctcatgaaagctccgttcacaagatacaagcaggccgacgccctcacaataattttctgatcaaatgatgcgtactattgtgaactaatctaatcaggcgtgatgcagacacagaaggaatggcatctgagccgcgaggagggactttcacgaccgaatcaaaagcagcagagccgcgacaacagacgcaccggcgtttgacccgaacaaaaaccccacgctgcacgttaactccactgaaaaaccgagctctctcactcctcacaactagtacgttcacaagcaccgtgacagccagctccaaatggaacacaagggtttgtgcatcctcgccgtcgtcatcgccttccagctcgccggcggggaggccgtcaccgatgccactgcccgggcacgtcgcttcgcctgtaacgtgtcggcgccgtgcgacacgttcgtcgtgtaccggacgcagtcgccggggttcctcgacctcggcaacatctcggacctgttcggcgtgagccgggcgctgatcgccagcgccaacaagctgaccaccgaggacggggtgctcctgccggggcagccgctgctcgtgccggtcaagtgcggctgcacgggcgcgcgctccttcgccaacgtcacgtaccccatccggcctcgcgacaccttcttcgggctcgccgtcaccgcgttcgagaacctcaccgacttcgtcctcgtcgaggagctcaacccggcggcggaggcgaccaggctggagccgtggcaggaggtcgtcgtgccgctcttctgccggtgcccgacgcgggaggagctcagcgccgggtcacggctcctcgtcacctacgtgtggcagcccggggacgacgtgtccgtggtgagcgcgctgatgaacgcctccgctgccaacatcgccgcgtcgaacggcgtcgcgggcaactccaccttcgcgacggggcagcccgtgctgatcccggtgtcgcagccgccgcgttttcctccgctgacctacggtgccatcgccgccgatcccggagcgggcaagcaccgccacggcatcatcgtggcgacgagcatcgcggggtctttcgtcgcgtgcgccgtgctgtgcacggcgatcttggcgtaccggaggtaccgcaagaaggcgccggtgccaaagcacgtcagcccgaagctttcttggaccaagagcctgaacagattcgacagcaatagctccattgctcgcatgatcaatggaggggacaagctgctcaccagcgtgtcgcagttcatcgacaaaccgatcatctttagagaggaggaaatcatggaagcgacgatgaacttggacgaacagtgcaagctcggcagctcgtattaccgcgcgaaccttgaaagggaggtgttcgcggtgaagccggcgaaaggcaacgttgccggggagc

SEQ ID NO: 5480 - DNA, 1501 bp, Oryza sativa
cggcgctcagcttggccggcatggcgagggcgtgcaccgaggaggacgcggcgcggcggcccaagatggccgagatcgcgttcagcctctcggtgctcggacagccgctgtccgtctccgacgcgttcgagaggctatggcagcccagctcggaggacagcatcgggattgggaacgaggtggcagctagatagatcaaaacacagcaatgggtatgtataacactgttgggtagtgtttggttgcaaggtttgggatggaatgcgatgggacgaacccacttttaaataggtttggtttaggggtgagcgggatgggttggtccctaaatagaataactcttaaatccgggaccaaccgatccggcaaaatcgagcggacgaactcgtcccacctgagatgggcgcacggcatgagtcccgttgctactttgctcctcgcatcagtcacctggggatgctcgacgagagcacgtcgggctcgagcgacagcaggcggctcagtgacggcggcagtgaagtttggcggtagggagggcggcggcggtggatccgaaggccggggactcggcagcggcggcagatccggaggcaaagcacgactagccatagcacgcagaaataaaggagacccaataaggggctcaatcgcggaccagtaagacccatgaaccagctagaccaaaagacaatgcccttacatatatccctgtcacgaggacaattatgtaaaatcattagcacaccaaaatttaaaggttgtaaacctataaatagatctcaaataatgtgtaataggagatccaattttagagagaaactaatatactatttattattttcctttccacttaaaatgaagcttgactttggtacaagcgtttgtccttcgataacagtgtgtcatggcccatatatatatatctgggccttaaaaataaacttgcgtttgtacgaactcaaatgtgattcaatcctttgtccaagcatgcactttacattgctatcgacttttcatctgctacggaattgttgccaccaatccacctccacagctccactacctccactccaccgatcaatctgagccactacgcctatatttaggcgtgaatggcagaagttgggcacgcgacgtccggcgctgctcgtgccttcctccgaattctcaacaaactccgccatgttctctccagttcccacctaatatctgaggatatcaccaacgtccatataaacaagataatcaccgggcaaattactgttgctgctagttcaccatttgcgcatttcctcttctattacccgcattgttcaactgccatttctctcctcaattccaaaaaaaaaacacatattcattttttttctcattcgagctaaaccatttcaatccatggaattcggacgaactccagcccttcaaatcatcgttggtaagtctgagaaactttcaggttaactttaggctgttagcatacatcttctttattcttcaacaa

SEQ ID NO: 5481 - DNA, 1501 bp, Oryza sativa
gtacaaagagaagtacaagatgcgcaagtatctgacgctactggggatcctggcagcgagcgtcacgtaccaggccggcctagtgccgccagggagcgtgtggccgacgaacgacggcaaagggcacgcagcggggaaccccatcctgggggacaccgacggccgccggtaccacgccttcttctacagcaactccacatccttctcggcatccatcgtggccatcgttctcctcctgcaagggaccttgatcctcccagagctcaatgaccctgaccggttcgggccaatgcacatggtggtcgtgctcgacctgctcggcctcctggtggcgtacgcggcaggcagcagcagggactggggcacctccgggtacgtcgtcgccatggccgtcatggtgctggcttatgtagccatctatgtgttcctgtctctccgtgacaggaagggatcggagggcagggcaacgacggaggtacgtagctcctcctcgacctcgcagtcgtctagatcgacgctggaagtagctcgaccggcctcatggtcatcaggatcagctgacaacgtttgacaatgtgtgcaccttgtgtgtagtgtatccatatcagacagttgcttattgctgttgtacactttttttaatgttgcttctgcttgatggagagtctagtgttacaaaatatgtgtttatcatttttaatgtctactggaccaactgtacacattgtaaaacatataaagtgactcgtataaagacaaaagcaaccatgtcaactacttcttccattttatattataagtcgatttgactttgttcctatttacacttctttaaatttgttcaactttatagaaacatttagtaatattttcgacataaaacaaacatattatcaacatatattaaatgttagtttgaatgaaactaatttcgtgttgtagatgttactaaattttcctataaacttgatcatacttcaagaaatttgactagaaaaaaaatcaaagctatttataatatgaaataaaggagtagggcattaaatcgcatgcacctggccagtacacaatctcacactcacgcgtattctgtgtctcacgtcgaacagaaactcatattgctgatgaaaattgtatgaagatgtaacattttttccctgatcataggacgattgttaattcctagcttgtaaggtgtgaaacatggcactagtgcgaagtcctttttttccttgttgatggttgacgaacattgatatgattcgagtccaggcttccagctgcctgcaagtctgtaaggggatcgaattgaacaactatataattcagaccagcaagtcatgcattatcagggtcctgtaaactatgcaagtgtgcaactcatgtcagctagctacctgctgaccaatgataaaacgtattctgcgtcagatcaagaaacttgtgttcaattaggatgatcacgatgaagcaaaatttgtgtgcaagctgtgaagatagc

SEQ ID NO: 5482 - DNA, 1501 bp, Oryza sativa
tgacgaggttggggaagacattgacgccagggcagaggtgttcggtgtcggggaacaacctctagaggacaaggtagaggtggcggacggaggcgacgcggaggagctgctatcgatgccatcgtcctgctgcctgccggccgttgccacctgccaccgtcctgctgccgacctcatcgattgaagctgcgcagggacagaatcgtactccacatcagtttcgctcctcttgaaataataaaatataaccatgagtgtttatcagctaattaccagtttttttttttgcccaatagcaaatttgtgttcttgcgatgtccaccagctaattacatgttttttggatgctccgtagcaaattttgccattaatgtagcatatcataacacacaatatcccacaaactggccataactactgctagtacttaaatggatttccaattcatcgtagcattgattcccatattcgtgcactattataccttcacttttaaatcagcttgacttggcaccatgtcaggtcatccatggcgtgcactctgcattcacatgtgactgtcagactatcaacacggaggttgggaaatggaagggctggttgagcaccgagaagcagcttaaacaacgacgcgacctgaccaccacattttattttcttagccgcgacttgacttgcaaacgcagatatatatatatatatatatatatatatatatatatatatatatatatatatatatatatatatatatatatacacagcatcatcatcatctgcaataacagcatttgcacaccactaatcaggatcacacaatacaggcgacttcagctcccgtagctgagacagtttgcaccgtgcaaatggagcccgacgccgacgacaacaagcagcagccgggtggtggtgggaaggcgacggtggcgagccaccccaaatcgcgggagtggcagctgcgcaagtacctcctgctgctcgccatcctggtggcgacggtgacctacatcgcggggctcgacccgccggggggcgtctggctggagaccacggacgaacacctcaccggcgaccccatcctgccggacacccgccgcctccggtacgacctgttctactacttcaacgcgacggcgttcgtggcgtcgctcgtgctcaccatcctcctcctcccgttccgcgtggaggggccccggctcatggcggtgcgaggggtcatggtggtcgatctgctctgcctcatggtggcctacatcgccgggagctgccggggcaggctcaccaccatcttcgcctcggtgctttcggcaaccatcttcgtttacatcgtggttcatgcgctggtcgccccttctaccgacacgcctgagaagaagacagtgcacgactcacctgacaaggagaaggccatggacatggaggatggccatctccatggttgctcaagtaacccgcttgacatgaaggaggccgtggaggatggcaagctccgccccaaaga

SEQ ID NO: 5483 - DNA, 1501 bp, Oryza sativa
ttaattaggtaggatttagtagtttccttttatttttaggaaagtttctttcttgtccaataagtatctacccatgggtataaatatgtacacatggagtcattgtaaactatcttacatatcaatacaactactttcgccgcatcgccaccctcttttccgaggattttacttatcatccagtggaagatggcacctgacgcggggctgcattagcttttgatctccggcgaaggggtaagtcctatgttccatcggcccagacaattgtatcggctacattggtgtgcttcaaggctgcatcgcttcgatctcttggatcgcttcggttcggttgatatatttccctacatatttatcatatatcttagctaatctagtttagaatcttaatttgatcatatcagctgagattcattttagggtctatgttagtattggctaaattatctagctagattaaattaactaagatattcaccaccctaaaaattagtcaaatgcttgattgtttagactttatgcttctttgcatactccgcgatgcatcattcctagctgtgcttagaatcataaaggctaacctgtttttaattatagtaacggtttcatcggggtttcagccgataagttatatggacgttgcatcggcttacaaggattacatataagtcggtttgagccaatcgcaacaaaggttttaatgtttatctaatcttgtggattttatgacatcagacctccagccgatgtatgctttaacctttggatcaggtcgcttattctatcatatcactattagctgattggtttctaccggattatattgttattttgttacattaccatcagccgattgtctttatatcgtatctacattggacatataaatgattgctcaaaaccctattggcatcggctagtatcagcattgactggaactactccgtcggcttgtcagccaatcagctatttgatctgttgtttacatatcttgtcagttgtaggatcaaactggctggcacacccgtatcttatcaatttttggacctacactggagcaaagcagatctcctaggccgttgctgttgtcgacttagttcgtgctaacacagttccggcaccatcgaccgagcacggatttttcgtcaatacttgctcgtcaaatttgggtcgagtaaccacaacaatgaacatcaagtatttgctcttaacctctctttccgttcttggttcgacattattggtgaatagtatttctagttctgtcttgtcctgtagaactatttttttttatctgtgtacacattgccgtgcattggattgaatttaagttaatttctaaaatcaatcctatattgttaaaggcaatgttcaatacatgttcagatttgagaacaagatgtgtaatactccatgttacagaactaatcaaatcacaacagtttcgtccttaacaatatatgattgatttctgaacttaatttaaattcaagctagt

SEQ ID NO: 5484 - DNA, 1501 bp, Oryza sativa
taaggcctttcgcttgaaactctaaaatcattcgacggatttaattgccgtacgttgattcatacattatcgattatacttctatccttgaaaccctaccgcatccaacggatttgtatgccaagcgtcacttctagaaccctcggcattgttgtcttttcattcgctcgagtgatcacaaaaaacccctaagttgagcacttaggcgactaagcggccgaattgaatctgaccattccacccaaacgatccgagtgcgggctaaaccaaaagtccatatttgcagttccaaaccccagttccaaatttcgacccagagccaaatcaaaagtccaaatatacatcatttacagttgtgcaatcccctttacaaattccctttacaatttccatctatagttatatacaaaacacatctattacagttaccccagccgtgtgccgcgctggtcgcaggcacaccgccgtgcaccgaagccatgccctggcatcccctgtataaggacgttcgtctctcttcacctcgaactccttgaattcctgtgtgcactaaatgcattctatagtggtggcttgctgagtacggttggtactcaccttacttaactaaatcttttagaaaggagttggagttaactatatgagaactatgctaatgaagagatgtctaagacggtggagtcgggacctaggttcacccgtcgattcctgtggagtacgttggaccaccgctgcttcacttccgctatctaatctacttcttttggtattttgcaatgtacatgaccatgctcggtctatttgagtcccatttgggctacccttgtattgttaatgtatagttcaacctacataacgatgtcaacacattgggtttctggtgtatgtaagggttaatgtataggtatgtttgcacatgtgcacttctaaacatatagcaatttgtcatttagtctatatgtatgtaagggttataatatatctctgtccacagtatgtcaagaaaataaaatacacatttatattaaaagtactaaactaacttattttttcttttattttttcccaggattatttatgggctagaaaaaaaaacattatggaatgtggaccaatacttacacttctgggcctttctctagagttcataatcgggcccgctacctatcatctcgaaattggggaaaaaatatgaacatgacgaatagatctggagtatctatatatatctatttagaaccgagaatactattagcgacaaaaaaatgaacatgacgaatggatcccgagaatatagatttagataccatatcatctcgaaattggtgaaaaaaaaatgtacagaacaaacagatcccgagaatatgtaatctatctagatggtattgtattaaatatactcactatatatagaattgatagtatatatatagtgaagactgatatctcatcctaatctccaaactaagcatctaatttttttaatgctttcttttctagt

SEQ ID NO: 5485 - DNA, 1501 bp, Oryza sativa
aacttctaataattttattgatctctataatataatattgtaaatgatgcgtaattgctagtgagtgaagatgtgacatgcttgcgtgggattttaaatgggctagaatagtaattgctaccatttgaggtcctcaatccgcaataccagaaatctctacccctcaactatcacaaaccatgcaaaaaaagacactgaggcaatattgacccaattttcctggttttgttgacgtagcatatggtgggccccacatgtcagcgttctcccttctcttatcttctttttcgcttttcttcttctcttttctctcctctttcctttcgtctcctctcttctcttcttcagcgagactaggagccggcgggcaggacgatggtgggcgagcgcgagagcgggtgggaggcgaagtagacaggggcggggcgcatcaactgtggcccgcttcagcgcgactgctccctatctatggaggccatcctcgccgtgcaatccctcaagtgactcacctactctaaccgctccccggccgtcgccgccgcctcaacctctcacggcctcctcctcaagagagacctcctcaccgccatggccgagctccaatgtcagggctactggtccttcgccctctccacgctccacgttgcccgcgccgagccttggtaacgccccaacctgaccctctatgccacgtttgtgtcctcctcgccggtcaccgaggacggcaccaccgctgccgtggatgcgcttgtggaggcgttcctagaggagaaggagcaaggcaacggggtcgtggaggggggaggaggacatgtacaactggtgcgcacgctggtggtgagggcgaagacgcgcgcggggcggagtgtgtacgaggtggcggtgaggatgggaggctgcaaggtggacaagtacatgtacatggtgatggtgatgggaatggagcggttgggcttcgaggcggacttccgggagtggaaggccaagatcttgccgttggccagagagatgctcgatgaaatgcgcgagagagaagagcaacacaacaacggcttaactatgaatttgattatcatttagaaacttgaggattattaaagttactgatgtttcttttgcactcgtagtcattgcctgcgccgacccctgcctgcttcgtctgctagcctctcagtctcgctgaagaagagaatagaggagacgaaaggaaagatgatagaaaagagaagaagaaaaaagaaaaagaaaagaaagagaagagaagagatgacacagacatgtggtgcccactgtatgccatgtcagcgaaacctggaaaaattgggtcaatactgccttgggactttttttttttttgcacagtttgtaataattgaggggtagaaatttctggtattgcgattagggactttagacagactcgacatgaagtcgagggacgtcaagtgaacttattccctactactaggcccaacgataagcgagttcttctggactctga

SEQ ID NO: 5486 - DNA, 1501 bp, Oryza sativa
ggcaccacatgtctgtgtcatctcttctcttctctttcttttctttttcttttttcttcttctcttttctatcatctttcctttcgtctcctctattctcttcttcagcgagactgagaggctagcagacgaagcaggcaggggtcggcgcaggcaatgactacgagtgcaaaagaaacatcagtaactttaataatcctcaagtttctaaatgataatcaaattcatagttaagccgttgttgtgttgctcttctctctcgcgcatttcatcgagcatctctctggccaacggcaagatcttggccttccactcccggaagtccgcctcgaagcccaaccgctccattcccatcaccatcaccatgtacatgtacttgtccaccttgcagcctcccatcctcaccgccacctcgtacacactccgccccgcgcgcgtcttcgccctcaccaccagcgtgcgcaccagttgtacatgtcctcctcccccctccacgaccccgttgccttgctccttctcctctaggaacgcctccacaagcgcatccacggcagcggtggtgccgtcctcggtgaccggcgaggaggacacaaacgtggcatagagggtcaggttggggcgttaccaaggctcggcgcgggcaacgtggagcgtggagagggcgaaggaccagtagccctgacattggagctcggccatggcggtgaggaggtctctcttgaggaggaggccgtgagaggttgaggcggcggcgacggccggggagcggttagagtaggtgagtcacttgagggattgcacggcgaggatggcctccatagatagggagcagtcgcgctgaagcgggccacagttgatgcgccccgcccctgtctacttcgcctcccacccgctctcgcgctcgcccaccatcgtcctgcccgccggctcctagtctcgctgaagaagagaagagaggagacgaaaggaaagaggagagaaaagagaagaagaaaagcgaaaaagaagataagagaagggagaacgctgacatgtggggcccaccatatgctacgtcaacaaaaccaggaaaattgggtcaatattgcctcagtgtctttttttgcatggtttgtgatagttgaggggtagagatttctggtattgcggattgaggacctcaaatggtagcaattactattctagcccatttaaaatcccacgcaagcatgtcacatcttcactcactagcaattacgcatcatttacaatattatattatagagatcaataaaattattagaagttaaagctcacatgcaagtataccacatcatcacccactagcaattattattctcgtccatttaaaatcccatgcaagcatgtcacatcttcactcactagcaattacaaatcatttacaatattattgtcaacgtttaatgtcgcggcgattccggtatttgcatagtatggggatcgttggtaccagatatatgcgagacttaggtaaaagaga

SEQ ID NO: 5487 - DNA, 1501 bp, Oryza sativa
aattaatggaggcaaacctaaaaaggaatcggactactaaatactttgaaaatcatgtgatacaaataatatatattatctcaaaagttataaaaaaacataaaaagtgcctacactattccatttataaaagtgcaaatttcttcgcattgcacccgtaaaaactgacaaaaatagaagcaaatgaaagacgagaacaagcattacaccttttatatgaatcaaaatcaaagatttaaggtcgaaaacctcccctcttaatgtttgtaagtctaggagagagaaaacgtcggaataaatagggcatggttgggctggggtgtatatagaccaacatcatcacgtgcggttggattaaacagcccgcacgggaagatgcattatcctgtgcgggcatcttaacccaaccgcgctggataatcgcattatctcgtgcggttcggttaagacgcccacacgggataatgcatcttaccgtgcgggtgctggccctgcgtcggtcctccggtttccaggaaaatgttttgtgtagtagtgttcttttcttttattggacagtgatgggacaagaggccaacccaaaatataaggaaacacctctgatgttggcatggcattgttaggaaatcgcatggtctagaaactcatgcaaatggacacttcatcctcgcaaaattctcgtagacatggtgaaccgaaagtatctgttgctagtgttaccaatgttacactggtttaaaattaccgataaatatgctaatatctcgctctttcagaagtaccagacattctcctaccaatataataattaacatacacttcagagagtgcacagataataggatggactcaattcaggaggttgtatttctgcaaacagatattaagctccttttcaatatattgaaaaacacaagcttcagatgcatcaactgtaacatgagtatgtgtagctagcctctccagtgcccaagaaccagttcaatgattgtaagctgccgctgcaaaatgtgacagaccaaatgcatcgtacgtatcatcgttcatcatccctagacactgcttctctagagaaatcgatttcctagattcgtcccaagcctaatttggctgctgttttctttgagtcatagtggccaatcgccagtaagaatatataggcagcattgcatgcatgaggagcttatcacttgaattatatatttcgtatatacgtgaaccgagaatggaacctacaagctcccttctgtatcttctgacgctagctagggtcttcagtttataaatagaacaattttaccatcttacactcgggcctgtttagttggtgaaatgaaaatttttgggtgtcacttcgaacgtttgaccggatgtcgaaagtggttttcggacacaaatgaaaaaactaatttcataactcgcctggaaaccgcgacacgaatcttttgagcctaattacactgctggagaatcgctttttagtcctggttgggaacccccc

SEQ ID NO: 5488 - DNA, 1347 bp, Oryza sativa
agatggctgattaatctctaagatgtgttcctgttaatcttccaagctttggaataatcactaacggtttatgacttcaagctaaatctcagactctgaaatggttctgatagaaccttcagatgttataggggtcaagcattggctgttctgtagtagaagtgtgcaataattctgctatatattatcagatgtaaggaatgtatggaataaacagtatgaaatttgtttcaacaattcatgcatattacaaatggacaacagtttccgtggactaataatgaattctctagtaaaaaagttaatgttcaagttttacactatcaatcaaaatgcacacagtactcccattttgccagcctcgtcttcgaattcattgaaaatcaaagagctaggagttaagaaaaaagaaacgtcagggtttttcagtacttatcatgaaacaaacaaatgatacccgtgctttaatgtggaacatattgataaatatatgttaaatattataaaatgatagatagatttgttaaaatattgctaaaatatatgctaaatattacaaatacttgcatgccaatttgtggaaattaaatagattacaaatgatgttgcatgtttgcatggggttaaatatgtagttattgctagtgggtaatgatgtgacatggttgcgtgttgagatttagagttaatgggctgtaactttatagaaagtataggtcaaccccttcaggatatagattatatataagaagaaagtcacaacaaacgacacaccacgtaattattggaataaatgggctaggcccaatttaattcaattaaaatatcaagagcccacaagtaatgttagagacaataatactgtcttgaaaatttaggtggaagaacctcgacttaaatagggtgatatggagattcactgttgaccagtataggtgatggttggactgccacgcgcgcacgtgccaagtgggcctcggccgtgggcgtggcgaggcgaggtggccgaccgagctgagcctgcctgctgctcttccgttttgtaacagatgagaataaagtcaccattaacaaatgaaattcattgtgttataacctccccaacaaatgagagattcattgtgttataacatccacaacaaatgagagatttattgtgtggtaaccttcacaacaaatgagatttattttgtggtaaccatcacaacaaatgagatttatttgtgtgttaatggagatgtctctctctatatataacgcaaggcagaggctctcaaagattgtgtcttcctcctgctgttgtttcttggcgatactctccttctgttcctgcgttgtctctctgtt

SEQ ID NO: 5489 - DNA, 1501 bp, Oryza sativa
cgttctagaccgtcgtcccgtatcggatctagtcgacggagacaacaagtctaggtgagaagtcaccgcctcttccgaccaatcctcgctggcctctcccactcaggcatgccaccaccatagtccatacatctgaccaccgatgccacccaaccaccgatgtcaccacatttgcttgtcgagctcgcctctttcgatacctccactgcgcacgaatctaatcagggatgtgggatctaggccggatctatccagggagatgttgtatccggtcgaggtggctccagatctggctatccctatcacaatcaccatcgtcatcataggggtcgtggcctcacggagctcgaggatggggaggaatggaaaacgatagattagaggcccgccgtcaccgtccttgtagctgcacatacggctgctgccatgctctggcggttacgaggaaggggatggcgggaggagggctggcggtagagtgagtttggtcattgcccatgtcgccctacatagtgacattggggtccaagttgtgttatgtcggactgtggtttcttgtttttcctctgttttcaaagaaaacgatcttgggctcaaaccgtttggttaggaagaaggtattctctataaatatattgatgattccaacgttgcaactatacgtagcgtgtgtgagaccaatatgttataatttgaatttaatggtgttttaacttatttatttattttatatgccagttctcaaaaagtttcatttttatatccagatgttgcactttttttctcatattccacaaatgtttcatgccccaaatggccaaattgtttttttcatacgcaaatgattgcgtataagactatgaaacagaaagaaaaatagacaagtagagagaaatagatctgattgtttcttttgactattccattttaaactttttttctctttttctccatactatttatctctactattataaaaattaaagatgtttttgccggtactttgatacgtcatccgtataggagtcggttttaaaagttcattcgcttttgaaatacagaatgaatcttataacaaatctctttaaaaaaactcataagctaatttagagacgatcatactcttaattgcagctcataattttctataaaaaaaatatatccaagcgaatttaacacagcaaatttcaccttaattaaatcatataacaataataagattaaaatagccttccctcattgcaattcacgggtatattttctggtatcaatatagaaaaagaacttcatctcctgcgagtagtttccaaaaattttcaaacttctcggtggcatactgtaagagggagaaacaggtgccaaattgtaaaattcccctgtccatccatcgccatttctcctatagaactcgttcctccactccacggcccatctgcaacaaagtccaaaacccataaaccccctctcccccacttctcccccacaaactagggtttcactc

SEQ ID NO: 5490 - DNA, 737 bp, Oryza sativa
ctatttgacccagatgatattcaaatccaagtttagagaccggggtgacacaactgaacaagttggagaacctaaacgagtgatctgcaagtttagggaccgggatgacacagtagaacaagtttgaggacctgaacggtcgatttgcgagtttagggaccgggatgacacagcagtacaagtttagggaccggtgatggactttactcaatttaaaaatagccaaaatcgatacggtcggaaacagtaccccttaaacgaaaacgacatccggtcgatcggtaatttccgtgaccgctttcacccctagctggcgtgacaatattgtcctgctatgtcaccgtgacatgacaaaactatcacaaccattgcgggctttgtgagtgtgacggtattattttgccacgcgtaagcaggctaacattgtaaaaaggtttagatttttaaaacaaattttagaacggttaacttttaaaattaaaggtaaaaaaaaagcagatgaacatcaaccgagtaaccgacagaggacagacagacgaccgaatatgccgctgcagtgcttcttcctcctcctccaccctccccatatccacctcgaccccccctctccttcccacgaatcttctccattcccacctccctctatatatatctccctcccacccccgccgccactcacatccaacaacccaccaccctcattccctcaagtcccaagatcgaacacctcgtgtcca

SEQ ID NO: 5491 - DNA, 1501 bp, Oryza sativa
gctcagtgcttacaatatagtcacggacagtcatctgatttggtcttgctctaattatacacgaacgtttgttcgtccatccatatcgccagtggtagttagctaggtgcaaagcgtagctaggcctaggaggcgatgggaaattcggattcagcttattcaggatactgggtaatgaattatcagattgttgcacacatcaatacatgaagcactcaatccagtggaatggtttattgttgagggatatccatcaggttaaaagtgacattattattttatcatgttatcaacatcttttccggctaacaaacctttttttgaaaacctttccagctaacaaacctaaagcctaactgaggttcgccatgtataacttcttatatgtacatatggataatgtttgggcatgtctccatgtattgcatacatgccttttaatctttggtatgcacaatatactccctccatattttaatgtatgacaccgttgactttttgtctaacgtttgaccattcgtcttattaaaaaaattatgtaattattatttattttattatgacttgattcgtcatcaaatattttttaagcatgacataaatattttcatatttgcaaaaaaaaagttgaataaaacaaatggtcaaacgttggtcgaaaagtcaacggcgtcatatattaaaatacggagggagtatatattaggcttaggaggcaaggagtgtaatgctgagtctaccctctccgtcaccattgagattatcctatatatagttgaaacttgaaacataaacttgatatgcatttacatcaattcagtgttcaagcatagcaagtgaaagaaactggagcatttacatacgtttacatcaatttcgcatgtactataaaccaaccaggcaaccacatatgttttacgtgtagttagggaaacaccttagctttacttcaatttcgcattcaactacagtccagttctacgtgtagtcagggaaacaccttagctttatcatggtggtgtagttgtggtcgtatgttttttgcacactagaactcaaattttgtattttgcagttgcacacatggaggtccttttttcagtatgaattttcgcttctgtgctctgttccggcctacataaattcagcatgaaactttgcacatctgcttcgattccactgctccatctcattgatctctgcctgacatctctgtttcataggttcctagttattactcctagctcagtaggcttatgacacattgagaactattgatccgtatgcccatctaatagaacacttctcgttttcaccttaagaacaggggagagatggacaactgcttactaactgcagaggagtcttttttatagttcgggggggggggggggaggtgcttctagtaactcccttcctattaaacatctacagtttattttaatgggtagcgtggagattatgggtacccctatagttggccataaggcccgaggcccga

SEQ ID NO: 5492 - DNA, 1501 bp, Oryza sativa
cctttttcccttctaggattatacacttatcaatgttatttccataacagtgagatcaaggagcgcatcaagaagacaaaggacgagaagaaagcgaagaaggcagaggtggcaaaatcgcagaaggcttctggtaaaggcaatgctcccaagcctgggaaaggcccaaagctcggtggtggtggtgggaagcggtagatgctcccatttccagagctgatattatcttctagatcaaaaatctaatgttatttatccagacccttttttggaagaaaattttgcaccatcagttgtcctgagtaccatacaaatggagaacttagtttgaagcatttttggagccatttttatcattgttctatctgaagttggtacttttgacatgattcaaacctgtactatgtgcatgatttcaaacttgtttagattgtggagacctttgaaaagtgttccgctctatattgcaaacccccaaaagaaatagtagaccatatcatggtcttctgccccgtcacaaacaagatcgaaaaaaaaaaatgaacgctgatgcgatgaaccgtggagctgggtttgtgttgaagattgaaatcaggagaaaaaatgaacgcattttcatactctaatacgcaatgtcatactctaataaaattgtaaagtactcttgctgcgctcgtaaagaaagtcgtttaggacagcgacatgctcttcaaaatataactttgacttcttgtttctatttttatagacacacacacacttttataaaagtatttttcaagataaatctatttatataatttttacattttcaaagttattcatgatttatattcccaatgtttgacttaaacattgtcctaaacgactttctttacgagtacggaggaggaaactattataatccctctaggggatgttctctcatttgcttaaaaaccatctaaacggttataaaaaattctgaaaaaatttgacaacattcatacaacacatatatacatatccacaaaatctttggacttcaattttggtggactagtaggtatcattatactctacattgttaatttttttcagaatttttcataactatttacatcgaatttagaagaaaaaggtatacgagaggatatcccttcgagggattagaatctactcccgtacggagggagtataatgtacaaatccccgtgtgcaaaactctgtttttttggtttgtgcataagcataaactacaaatccccgtgtgcaaaactctgtttttgcctactttttaaaacatatcgttggagcacaaaattcactaatgcagccagagaattggcaaaggaactggatccttgagagaaatctgagcactgattttttgtacactatacaaatggaagtataaaatgattgttatgactaggaacatagccttcaaaaaatcagctctggcatatgttcctcaacagatccacacaatcagctctggcatattctctctagtccattg

SEQ ID NO: 5493 - DNA, 1501 bp, Oryza sativa
ctcggcggcaccgcttctcccctctcccttccggccctcacgcgccgccccgcctgtcgtgtaacccaccacctccgttcctccctcacctgctctcctctcctctcctctctccacttggcaaggctgatggcaaggctaccgccgctgccgctccagctccagccgcccgtgctcccccgcggccagccaaaggggagagaagagaaagagaaagaaagagagaagggaggaagaagaaagggagagagaggatgacatatgggccccacatgtcagtggcccccacaattttttattttgtgtgtgaatgactaatgggtcccatgcatattttttttaatgccacctaagcgccacgtcaacgccacgcggaaagaagaccgagtcaatactgccacgtcagcaaaactgccatccaaaaccaccaagggagttaaattgcaccggtttcaatagtttgggggtgaagatatccggttttgcggtttagggtcatgaattagattcgagtcacttttgagggttatgaagtgaacttattccgagtacagaagaaaagccgacggcccactttgaccaaggcccgacaaaccagcccggcccattatcatcacaccaactcatccaccccgtccattccgtccccccaccgcatcggacggctccgatccatcccgccgcgcgcttgccctactataaaagggagcaccacctcccacgcgcgccgcagcggaggcggacgcggaggcgctagggttttgctgctcccacaggtgagtcgagctcctcttccccccatggatttgcttcgctgctcgctgccatggcgttgctgcgccgtctcgtgtatgtagcgtattcgctgtttcgagtcccgcgcttgtttcttggtaggttttgcgggctgttgtgtgatggcggcgcggcggctaggtttgttcgcgttctcgacgcgtatgattggatcgaggcgtttgattagatgtggggcttgttgttttggtggttgaggtgatgctgtgatggggaatgggggtttcagctggattggagttgtggtggtggcgttgtccgtgcatccgaatgctgcaaatgtgttttagatttcctttgattagtttttgggcactgatttggaatggcaacttagtggaatcgcatttgctttatgcgtcatttcttgtactcgtttgatggatagagaaatgctagaattttgttaatttagattgctatatattggggtctggtagtgttgggctgaagaggagagatctttgtggtctgtacattgcaatgcatttatattctgctctagcgatgattcctgacgttgtaatttgcaggtaaggaggcattgaaggtttggtgaggcagcgaagatggttctcaagtatgtattttgcaccctgcacaattcaatttcattatattctgtgctgcattttcgaggctggaatgttgcaaatagaaagtttcttacataatttgggaattc

SEQ ID NO: 5494 - DNA, 1501 bp, Oryza sativa
attactttttgtttgcaagcatgccgtttggtttcttccacgaaagcgaaacgatggggccacatgtcgttctatatattgaagaagtctccaacatgcaactttgattgctaatttattttctaaaacatttgaaaaacatgatttaatgtaatattataaaagtgcttttgagttaaatctacccataagaaattatccaatttaaatatttcaaaaaaaatattcattttgatgtttttgaactttaacttgatacatgtctaagacaacatgttgtcgtgatagaaagtgttagagtttaatttgtgacaaatatgtgcacgtagtcggttacagtttaggacttggagttgtatactataaatagagtaagagtcagattatgtcctcggatctcttttaaatagagaggcacacctgttgtaaccgcatgtcgacttagcatagcgagagggagcggctgccagcagcaacatgtagagggtcgttgtcactttgatcgaaacctagatcggggaggaacgcctgttatcagtgtcccggatgaacttcgttataaaatatcgtgtctcggtgttatcattagtttgaatttcctataatttttttcgcgtttggtttttgatggtgattttaagcctattttataacagaaaggagtatcaataagcgattacttccgaaatttcgcaagggtttctgtcgaatggtacctaggggggagaggggaggttgatatcagctagaaggctagaaaagatgtggccatttattgtttggcattaatattcatatatctccttgtccttcttggtgatagttacgaaaaccatttgtgtcctagctgttttgagtaatttccaggaagtttcatcgacagcttgcagccataaccttttattaagtctgaagtcatctccaatatctacacagatagaaaaaaaataaagataggcaataatagcatatccatcttcctctgaatttctccgaaatgatgcaaagactcaccttatggatatcttgaaggatctatgtcagctatatatacaggctatttgcatgtaagttgagatgttcctttgagtaagcacttcaataaggtacactggatttcattgctgttcaatttgctgcatttcacacaaagatatatagtgggtgatgatgatggatcacaacatcctaattccactggtgtcatccctcatgatgttggtactgggaccattgatcatagatgtgatttcggtaagtaataagattggaaggttatttagcgcaattgcaaggttcttagcgcatgacgatagtgttatcaactctatggtcgtggacaacgaccctcctccttcttcgcagttgcttggaggaggggtgtcatgctttgatgcaatgactgtcacaacgaggttaggcctcaggtggcaaaggagtggggaggccgccatggagtgccaagggtgtgacatccctatggatgctaccgtggatgagc

SEQ ID NO: 5495 - DNA, 1501 bp, Oryza sativa
agccctgcaagcacccacggtctatcaggccttgacactcttgtccatcggactagagatgttgaactagcttgactctgatacaaattgtaggatgttaaagggttttttccacacctaaagatagccaatgaggtgagggccacccaccacttatatattaggtcacactggtggagaaaccctttgtactcccggttcataacccccctttagtcccggttatccaaccgggactacgaatccgggactaaaaatcgctatctttagtcctgggtgaaataaccgggactaaagatcgatctttagtcccggttggtaacaccaaccgggactaaagagagggtagcggcagtcccattaggtctccttttctttttttttcattattttttagccagagtttaatccctatattttctcccaaatcgagtgggatgcatattcccaaatcaaaccccaaatcaaagtaacatcccaaaacattcacatcacaaatcttaagttacttgtacacacaaatcaaatacatcacaaattttaaaaaaattacacacaaatcaaatacatcacatattatacatctcagatccatacaacaaattacaaaattatacatctcagtgaatcacaaattgtaaaaaaaaagaaaaaaaagaatggatgctggtagtgcctcctgccgccgctcgctactcggcccgtgcgcggcctgcgtgcggccccgccgggcgtggccccgcctgacgcgtgcgggaaggcaggagggggaggaggcggccctcgctgggcatcggatgggaagggaggagggggaggagagggccgggatgggaggagggggaggaggagagggagatggatctgaggagaggagaggccggttgttgaggagattgaggccggttgtggcggagaggatagggaataaggattatatactatgcgtgattttagtcacggttggtaataccaaccgggagtaaatatctaggatctttacttaccaaccgggataaaatggtgatctttagtcccggtttgtgacaccaaccgggactaaagatccccgcccctctgacaagggactgacaggggatgaactggttggtgttaccaactgggactaaagatcgtagaatggctatggggttttaaaccgggactaaagatcccgattctttttataactgggactattgtggttttgggacgacctagcaaagatcagttttccagtagtgtcacttgccctttgacaaccaatgtggaactattcaacattccccttgcaagccgacaccgatgtgcctaccctctctctaaatgttgccaccatggcattatcaaatgtaaaactttgggatatttaaaattggaaatatcaaatacgttttcgcaagtaattattgcatatagtggcattcgtggtcatcttctatatatggaagaactgtaccaatccatggtttctgtttccaactcatattgcatccctctt

SEQ ID NO: 5496 - DNA, 1306 bp, Oryza sativa
tgtgtgtgaatgacaaatgggtcccacatatatgtttttaattgaaatgccacctcagcgccacgtcagcacacagactaggtcaacaccgcccacgtcagcgccacgtcagcgaaaccgccatccaaaaccaccaagggagtcaaattgcaccggtttcaatagtttgggggtgaagatatccggttttgcggtttagggtcatggattagattcgggtctcttttgagggtcatgaagtgaacttattcctctgtactctgtgtctttgtgcgtttctttttctgttcttttaggctattttctgtgctttatgcgtttgtttgtgtgtgtgtgtgttaaaagaaaattttgtgtgctttgtgttgaaaatttaaaacagtttcagaagaaaagagaagaaatcgctaggacgttgacatttgtcttaagatgaccgaaaaattgttgttgcactccatcccaaataagtgtagttttatagtggccctctgtatatctttatattttacttcaacttttccatccagattgtagctattgaaccaatagtaatctctacttacctccccccccccccaaaacacaatcccaccctcttattttcttcatattagtgaaggacgtaatcctatatatttatatagtccatccacactcagtgtagttaatgctatttctctcttctttcatgaaaccatatcatttcaattattttttattctttggatgatagatctatagtacaaatagtcatttctttcctctctcgtaaaaccacacaatctcaattattttttattcaaaattcataagtatcaattacataaaatatgttcaccttgcattatatttgcaatcatgtgttgattatataaaacatatgaagtcattttattttggtttacaaaatataatatagcttatttgtacatacgatacaacttaatttcccgcaacaacgcggcagggtattcatctagttatcttcgttattacctccgtctcatataaattgtaattctaggttatttaatatatattaaggtttgagaataaagactataattttcttattaaatggtgcataggtaagagcgaaagggtagttgaaggtaaaatatgaagaaatttgaatgaggagtgattaataggaccattagtactttattgcgacaattattttgggacaaatttaaaccctataaatacaattattatgggacagaagtagtatcttttaagctcttgcttaatactatgtctttaactctagctatttgaaatgtggttgcgttgatttagg

SEQ ID NO: 5497 - DNA, 1501 bp, Oryza sativa
tttgtgtgctttgtgttgaaaatttaaaacagtttcagaagaaaagagaagaaatcgctaggacgttgacatttgtcttaagatgaccgaaaaattgttgttgcactccatcccaaataagtgtagttttatagtggccctctgtatatctttatattttacttcaacttttccatccagattgtagctattgaaccaatagtaatctctacttacctccccccccccccaaaacacaatcccaccctcttattttcttcatattagtgaaggacgtaatcctatatatttatatagtccatccacactcagtgtagttaatgctatttctctcttctttcatgaaaccatatcatttcaattattttttattctttggatgatagatctatagtacaaatagtcatttctttcctctctcgtaaaaccacacaatctcaattattttttattcaaaattcataagtatcaattacataaaatatgttcaccttgcattatatttgcaatcatgtgttgattatataaaacatatgaagtcattttattttggtttacaaaatataatatagcttatttgtacatacgatacaacttaatttcccgcaacaacgcggcagggtattcatctagttatcttcgttattacctccgtctcatataaattgtaattctaggttatttaatatatattaaggtttgagaataaagactataattttcttattaaatggtgcataggtaagagcgaaagggtagttgaaggtaaaatatgaagaaatttgaatgaggagtgattaataggaccattagtactttattgcgacaattattttgggacaaatttaaaccctataaatacaattattatgggacagaagtagtatcttttaagctcttgcttaatactatgtctttaactctagctatttgaaatgtggttgcgttgatttagggtgtgtttagttcgcgaaaagaaaatttttgggtgtcacatcgaacatctgaccggatgtcggaaggagttttcagacacgaatgaaaaaactaatttcataaatcgcctggaaaccgcaagacgaatttattaagcctaattaatccatcattagcacatgtgggttattgtagcacttatggctaattatggactaattatgctcaaaagattcgtctcgcgatttccatgcaaactgtgcaattatttttttatatctatatttaatgctccatacatgtgtccaaagattcgatgttatgtttttgggtaaagttttttttggaagctttagtgtactgaccggccgttgtgtgtgttcttgacaaggaaaagtatcaattagcacttgtgttagtgacagagtgacaatgacaagttaacgtcagcatccatggcattgatatagaacagagatttttatttttgttaattttactcttttagtttctgacatgaagcaaattgtccactcgtgccacgtttccacgccatcgttctagt

SEQ ID NO: 5498 - DNA, 1501 bp, Oryza sativa
cgcgatgcacatgagaagaatcgtgtacctggctaacatgatcaccgattccgaacgagtcggcccaaatcctcatgctagtgccgccgtcgtcctgaagttgacgacgacgaaaccgagtcaatgacgccagcatgcgccgtcgtgcccttgccgccgccaacacgcgttgccggtcacccccttcaccgatggccgcagaatcgtgccatcggctttccatcgtcggttcgcccttgaaaagccagccgacgggtcttcaatcgaccgcctgcactcgccgttgacggccgccgcccgcagagacgctgaggagaccgcgtccgcatcccccgccgccggcacgcacggcacacctcccgcgctaccgcacgcgactgggatgggggtcgaagccgccgtggcctcccgctgccgatagctctccgcctcgccagcccgcatgccgaaccaaactccccggcgcacagcaaggagctgcgctagccgaacgccggatatgcccgtagccaaccacgccggcgtcggtgctgcttgtagcctcaccgccgctccgcctctatcgtcgaccccgccgcgctgacgagctccgtcgaccccgccgtgacgacgagccaccgccgcctcgctcgcatgagtcaccgggaaatccgccgccgccgccgaattggggattttggggctagggattcaaccctagccatccgaatcggataaggtgtggctcccctttgttgggctgcaccgtgggccaaggccattagcaggccaacggccctgacgggccggctactaattccttgaatggccggttcatggaggtgggccgaaaaagattttggcctataaaaggagtcgggctcgaatcgaaatttgccccgaaaaacggcaaacttccgaatattttctgatttcatgcggatttggaattttagcggaataatccctcgggattatagaaattacggggaacactataattttggttattctgcattattttatgccgaaacagagaagatgtttaatgctttttctttgtcttagccctcgattttctatgtattaagtgttcattagttaatttttgaatcaaccatagaatcctagagacatggtttttaggaaatgagctctcataatttgaaatttagtacacaccagagagcatcatatttatggtttattttccaagctgttttattttttcaggatactatttaatgggttagtaattcagtaattactttggtacctaaataaataatagtacagcaattctgagaaatgttgggagaattatgggaatatattgacacagtactaaatttagataaccagacaatttactatttgcacacttgtcatgctcttacttgcagtacttattgaattttgcatgactaatgtaggaaaatgactgatattgctaagagagattttgctgaactagcagtcagcggcaagaattacctgacatgggcactagatgccaaaatca

SEQ ID NO: 5499 - DNA, 1501 bp, Oryza sativa; identical to SEQ ID NO: 4

SEQ ID NO: 5500 - DNA, 1501 bp, Oryza sativa
ttaaggaccaagccatgaagttaagcatgaaacgacccccgtacaaccgtacttctcgaatgggtgtagacctagcggattagatagctgagcggatgcagtatccctgcatagatggttcacccctgagtgaggcaggtgcgctacggtgggacagccattgaggtagggccgagaggcgtgccctacatcggtgtcaccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccatgctcgcggttattgagcaccgggacatgtattacacttggctagactctaaaattcttaaacttgtgtgggatgggatctgcatgatgatttttatactgatggagccacttcctgagaggcgggaatgtggacgtcctcagaaaaccataacgactcaatggcgggaagctatccttgggatcacaatggatggtggacagaaccgtcattgtttaatatgaatactggtattaaaacttgatcagtctatgctaggtcttaggcttgtgaaaagaattacaaaacttgctttgcgcaaaagaaccatagccatcctctgaattcctctgtcatgtgcatcattgctgtgatggcttgctgagtacggttggtactcacccttgcaaatataaaattaatcagaagcaggagatgaagcctcggaggatccctatgcctactaccaggagggagatgaagacgatggcgttcagtaggtcttagtacggtcgttgcctgtggcaatggcatgccgctgcctgaattccgctgccttatctatttctgcttttggatgtattccagaccgctcggtccgatgatttaagactatgcctgcgggcctatgatgtaataattcgtattagacactcgtgtatgtgcacttggtattccagctatgaattcgtgtgtaccaaactacttgatccagggaaatggtactgtttacacgattgattcctgttataaaaacgggggtctacagagctggtatcagagccatacgactgtaggaaaagaccaaaaggcgccccaccccttttctaagttggccaagggagaaattcccatttagtaatactatcaaaaataaatacgctatgtttacaaaactctgtacaatattcatcttactcttaactatcttctttacaaaaacaatttttaaccttaactgactttgggttttcttaaaattagatggcagattcggattcacccgctacctgggagt

SEQ ID NO: 5501 - DNA, 1501 bp, Oryza sativa
gaagcttccttcccacgtttggggctcgagtggtgcattgacactttcaaattcagagtcatcaggctttgcaccagcaactgtagtccgtggacttctggtactgcatttagatttccaattcaacatacttccctgtgttgcaaagttgatagggcagcaattgttatgacaatattctaggcgaaacacacgcacaaatcaatgatgcaacaactagattaaactaatgcagagggcatgaataaatcagactaaattcggtaagaatcaaagatgcatgttgtggctgtggactagtgaatttttgaaatatcttgtctggaaaacaattttgacggtgcagtggataggatactgatagaagaaagacgacaactgacaaataaaaaaaaaagagaaactaaagtataagttttacttcacataaacatacactctaaagctataaaaactaagactactattgagcagtaacaaggaaacactaaaacttaatagaaacagacattagaaatttatctcctttcacacatctcagtttaagtaaagagctcgaatccagtttgaaacagcctacttgagaagtaaaacctctcatttaggcagtacaggtacgtcgtaaccaaagctcctaacttccaaaaacaagagtgggaagaattgcagcgcaggaggtcgtttgctacacctcatctcaaatcaatcactccggtatgcaaagcaccgcccctaaatataaaataccacgtcatcatcatcataatcatcatccgccatgaacaccaacgatcaatgaaggcaggaaccacgagactccacgcatcccccctagtggatttacacatcacgggcaagagaggaaccgagaacgtagagaggcgggaggtgggggggggggacctgcagcttccagcgggatgaggaggagacgccgcctcggcgtacggcgaccgggcgggcgactgcggcggaggcggcggcggcgcgggggcggagggccgccatgccgtggttgaggggggatcgaaggggataagagttggatagcgtttggggtgcgtgcggtgcggtgcggtgcggtgcagtcagcggcttctctctcgctcgcacgagtcggcgacgagtggtggagagactctcgtgcgaggggtggacacgcgtggtggctgtacactcgctctactcggtggtgtgggtgtggcctgcctaccccctgcccccacacactggcacggcacattttgacacgagagcccttgtgggagaaatccaaacacacggcacaaactttttgaaggatggaaaaagctataaaaaccatcagttttacattccaccatgtaatttatgccttgtttagttacaaactttttcttcaaacttccaacttttatatcacatcaaaacttttctacacatataaacttctaactttttcatcacatcgttccaatttcaaccaaacttctaattttggcgtgaactaaacacaccctta

SEQ ID NO: 5502 - DNA, 1501 bp, Oryza sativa
atgtggaaggaaaagacgctaaaatcttgcacattatggactgtacgtaggacggctagctttgagatttcgtgccacatacccaaacctttttttactctaattttctctcgatggctatttagcaatgccggtaaaaataatcagaagacttgggttggaatttttttgaattttggattttgtcatggttcgttgtatttttccacggaaaattaagtatccctctgtatcaggagtataaacttgtgtacgactttatctcttttttgttcctgttgaccaatatcaatccttcattatttaaaaaaaataatccgccgttctattagagattcaaacagttgaccaattaatacggtgctctaaaatacaatcctactaattaattttaagtcaaacgataatgctgcttaatttactgggttgaacctctgatcatacagttccatctgtcttcttttatgtaaacgactattcagcactaattaatttgtgtgatcggctcccattttctatgagctgaccaatgctgccatttgttttcattattaaggtaaacctactcattttccttgaagaatatttgatcgatcttgccttgtgacaaccgacaaatcaaagaccattcgtttcttcagtagcttcttgaggtaaggtagtcgactcaaagatacataaattaaatgaaaaagtacgaattatctccttgaactattgcggtcgaccgaattaccccctgaaccacaaaaccggatattcttcacccccaactatgcaaaccggacgaattaccccactctacccaatccgctgaggttttggtctatgtggcgtacgcgtggcagtccaatcagcattctatctttatatactaaaagtccattaaacttcctacaaacactcctaatccgccatgtggcttctacaaacgctcctataccgccatgtggcgctctaacaaattatagaaattctaaggaaaaaataaaaatccgaccatcgattttcccttaatacggtggacccaccgtttcacaccattagatatctatcttgtaacaaggaaaaaaaatcacaaaacccatccgtatcccctccatcacgtacataccgtacgtacgttccccaccttctctctctttatttccatttatttataggtagcaaatttttctattaaaatattaatattaaataattagaatttcttataatatatttgattttaattatgccatgtgttggagtgtgtgtgtgtgtatatatataagaaatatatcatttgcatataaactcatatcctttatataataactaaatattaatacatattatgcaatcgtaaatgatctactctctctccttactcactttattatccttatttctggctagcagcttagtatataaataattaatatataattcttattatataataaagatttgttaagcagatccccataaaatatcatgcagatctatttattatacatcc

SEQ ID NO: 5503 - DNA, 1501 bp, Oryza sativa
tttatattgtttttatattgtcacaccaaaatataaaaatgcacaattactaacttggagggatgaataggttacatcataatgatttcgttcctactaaaaaaattttaaaacgcttcgcaaattgggacctatcagagacggaccgaggccttgagccacctaagccatggccatggcccgaggcctgagaatagaagtccactatgagtctatgaagtatagattttcaccatctatagcttggcccaaaagtgtgttgggctgacccgcctgccttacttcaaattatcaaacctctccattaggatccctttaatttctacgatattattcacaatcttgtttgcttagggtgtggacatgtgattgcagagtaattgatacatcaagcaaagttcaagatggaaaatgatcgactactggatttctactactactgtttatgtttgactcgactaagtcgatggacccgcagtcgagtatgaatcagtagttctctagccgcatccagctcgattcagattgaactctctggtttgacttcacacgtaggctgttccgattcatccgcggttgacaccgtgctaaacctgcgaatgccattgaggatgcggcgggaactgcgggtggcccatcgcgatcccggagtgcagcagcggctgcctccaggacgcgaccgcgcccgccggtgcgtcgtcgtcgtcgtcgggcagctgcctgcggagcatgacgtaggaggcgacaccgagcgccgtggcggcgagggccagcacggccgcggccgcgaagacgccgtccttgaggaagtagcacaccggcgcggtgtccctcgccacgttggcgttccacgccgccccctccacgaacagcactacggcgatcaccgccgctatcctgtacgcacgcacgcacgaacgcacgcgacacttgtcgtgagaccacaccgaggttgcgcatgaaagcagtcgtcgctgcgtgcttaatttgctcaccatgaggcaacggcgaagacgatgccgacgacccggttggtcttggaggacgggatgccgcggggcttgccgttgccgcagcagcagccgcagccgccgatggcggacacggtgacctgcgccagaagcagcaatacggcggcgcagagccccagccttagcgaggggttctgcgggtacaggcactcgtcgccggaaacccgcacgtccgaaatctgcaaaatcgatcgttcaactgtcagttgttggccacgtatatgcgccacggcgcatccattccaatgaagcaagaacgtacgcttcaggggccaggagagagatcggcaatgtgcttacagtgatctttgtgctctcggcggcgaatcccagaatggcgctcagcaaccccagggacccgacgacggcggagacgacgatcaccgtcttgtccattttcccggaaatccttatccttcccacctctctgtccgatctttatccgtggtgacagatcagatttgtgtgag

SEQ ID NO: 5504 - DNA, 1501 bp, Oryza sativa
tcagaagttaacagagggaagcctcttaattacatattcctctctctcctctcgcgttgtcctccacgagcgactcgggaggcgacgacgccgccgcctcttcgtcttcagcgcctcctcccccgcctcgccgccgcctgagcgggtgctggcaaagccgtgcgcccgcaaggacggcggcggcggggcctctctccccttggcgcccggcggctggggacgccgctcgtcggcgacggtggtgcccagatccaccatggctggccggatctgggggagcggcagtcggtggcggggaatgaaggtggcggcggtggacgacgcggcgcgggaggtggcggctggggacgccgctcgacagtggcgatgcccagattcgtgcggtgctggctggatctaggggagcggcagccggcggcggggaaggaaggtggcggcggtggacgacacggcggcggcggctggtggcgactgcggctggctggcgtccgcgtcggtgactgcggctgccgacggcggcaggtgacggcggcggctgactgctggcgagaaggcggctggtggcgaggcggcggctgctatggtgactgctgaggcggtgacggtggcggcggctactgatgcaccggatggcgacgaggcggcgactggcgagctgtggcggcggccgaatggctgctgtggtggcagttggcgaggcagcgccgcggcggtggcggccgtgtctggtggcggcgactgccgacggtggcggatgcggcggcggggaaggcgcggagaagtaggcatggcagcggggaaggatgcggcgacgggggtacgaatgcggtgtcgacgaccggaaacgggcgttgatgaccgcgaaattgcggcggtggcggcgccgccggtggaaggaggcatggcagcctcagacggctagtcgagggcgtggcagacggctgcatttggccggcgcggcaatggttggaggagggtcggagaccggcttggcgcagagaggcgcagccgatggtagcggaggccggctcggtgcgagaggcgcgggcgacggagatggaggctggcttgacgcgagagacgcggccgatggagggaggccggattgacgcgaggcgcgtccggtggaggaggcctgctaggcacgagaggcgcggccggcggtggaggaggcgaccttggtgctaggaggagctgccggtggatgtggcgcggtcttcggcgcacgaaggctggccggcggggggcgccggtgcagtggtcccacatgtcggtagaggttgagtggtggtggagcattggtgcatcaaccgtggattcgtaggtgttgagcagcgggtgaaaacctagcccggccttggccgggccgacaacgatggttaattccccttcctgagggcgttgtcgtgctgtctcatccctcacgggtggttgccgggcgaaagcccagtcttggctcctttgagccccgacggacggcggcggtggttttccgtcgctt

SEQ ID NO: 5505 - DNA, 1501 bp, Oryza sativa
gccgcgtctctcgcgtcaagccagcctccatctccgtcgcccgcgcctctcgcaccgagccggcctccgctaccatcggctgcgcctctctgcgccaagccggtctccgaccctcctccaaccattgccgcgccggccaaatgcagccgtctgccacgccctcgactagccgtctgaggctgccatgcctccttccaccggcggcgccgccaccgccgcaatttcgcggtcatcaacgcccgtttccggtcgtcgacaccgcattcgtacccccgtcgccgcatccttccccgctgccatgcctacttctccgcgccttccccgccgccgcatccgccaccgtcggcagtcgccgccaccagacacggccgccaccgccgcggcgctgcctcgccaactgccaccacagcagccattcggccgccgccacagctcgccagtcgccgcctcgtcgccatccggtgcatcagtagccgccgccaccgtcaccgcctcagcagtcaccatagcagccgccgcctcgccaccagccgccttctcgccagcagtcagccgccgccgtcacctgccgccgtcggcagccgcagtcaccgacgcggacgccagccagccgcagtcgccaccagccgccgccgccgtgtcgtccaccgccgccaccttccttccccgccgccggctgccgctcccctagatccagccagcaccgcacgaatctgggcatcgccactgtcgagcggcgtccccagccgccacctcccgcgccgcgtcgtccaccgccgccaccttcattccccgccaccgactgccgctcccccagatccggccagccatggtggatctgggcaccaccgtcgccgacgagcggcgtccccagccgccgggcgccaaggggagagaggccccgccgccgccgtccttgcgggcgcacggctttgccagcacccgctcaggcggcggcgaggcgggggaggaggcgctgaagacgaagaggcggcggcgtcgtcgcctcccgagtcgctcgtggaggacaacgcgagaggagagagaggaatatgtaattaagaggcttccctctgttaacttctgaaacatcggcgagatggaggcccagccgcccgcgcgtgcgcagccgttggtggcgattccttccgttattcttgtagacaatagacctacacaactttttaaaccaatagataaatcatgacttatcagattttgttggctagttccttcgctgtggggatttggcaaaaggcgcgtcgcgtgcggcgctgccattttatccgcacgcacaacccgcttggaacacactagctagattcgtttagataaatcacagccatattttatctcttcaatttgatcagccgagcttatctagctgataatgcacgcgtagagtgcgccgtggtcgcgtcatttacagtcatgggctaagctcatttcctaagctcgctaatcacactggtggagaaaccctttgtagtcccggttcata

SEQ ID NO: 5506 - DNA, 1501 bp, Oryza sativa
aatgatgctagccgcgtaatctacgcgagccaccatgctagttataatacatatgagagaaacaatagacccataagaaaatagagtggcgtaggtagatggaacatataaaaactataaacaaaatctcaaaatagaattttaatgataattaagaggagggacgacgagcagttcgttaagcagcacggtctcgatgattggcgggatttctagaaagtaacaaaaaaacctcaatgataattatgttcgatattcaaatctcaacgataataaaaatgagaggcagcgggcgggccgtagaggagtacatggtggcgtttggtgagacttctaaaaattataaaaataaaacccaacgatacaatgaactctaaaaccacaaggtcaaatttgtaaatgacggagaatgaactccaccaccagggaaccgtgagactcccctttgtgagttcggccgggggcagcggatgagattcgagtgcttggcaagcggagctgtgtgatcttgagggggttaggcccctccaagacgatgagacaaaagaggattatacaggtttgggccactgagaagcgtaataccctactcctgtgcatgattgattgaatgtagaatacaagtgcttggggttgcgagacccaagcgccagttcgctcagaagtccccccctccaccattaggcctggacctccttttatacctcaaggggttaccacatgggcccaacaacctaacctagctccggtggagaagtattataatctttacattaaatgcatgtcttatctcttgacttgggaagccaagcacacgtcgtcttgatgatggggcctgtcaaatcttgccgcctgacacgggggtgcccctgtcagtcaccatttaacgggtgaagacttctggtctcctattacaccgggaaacgggagccttgctttgaccagagcgggaggaccgaatccggctgggataagaggatgagaacctctcaccatcattatttgatgggatatgtcgggctgcacgccgcctgacacacgcgatggtgcgcctgacatcaagggtcccatcagtcattcgaccggtcacagaccggttgagtgcactgcacaccgcattaaacgcggcgtggcgcgaccgctcgggacgccataaatgcgggtaggtgggcacctggaggcggacacctaacccactgtacgtggtgacctagtgtcacgcccagaaatttaacccaaatttccagactattttgcgtattaaatccctgtccaggaccagccagggtacacaaaacgacaagtaatatacagttccaaacgtaaaataagcgtaaaatacttacagaagaggcacttagtcctcacaccgaaacaaaagcagcagcagcggaaaaaaaaacgatcctagcggggcttcagctccactccacaggccaaactcaactggggtctgagccttggtcctctaactccatcttcagctcagaagcactacact

SEQ ID NO: 5507 - DNA, 1501 bp, Oryza sativa
cagcgatccttcagggataaaggacgatttttaacaacaagaatataactgaacaactttgattatatttcagaatagtactctcaagcaaaatgataactcatgtatgctagaagaagaacggaaagctatccataacaagcacaaattgtgagcctttcagcaagtgttgataaaatttatgatggcataaactaaagtgcttcctcaacagcatttattttgtccatgcgatcatcaaatttatatttatcatcactaaacattttgttctaatctggatggctagattagattactctaattcagatgagcagaactcggcatgcccttaatgcagaaaaacaaatctcaattgataattctgttacagaaaacaggactaaccaattgatggtcagatgtgctaaagcaaattaagcgcactaacattgaacaatggacaattacagactagagatacgagtatgaaagtagcgatctagtcacggtattagatgcgtcaactccacgatttctatgaaaccctagaacctagacttcaaatcgaacaggaaaaggtgagcaagcgagatctactcacttctcgtcaagcttccggatctcctcctcgatcctgccgcgcatctccgcgagcagcgcagcgtccgtctccagcacgccgccggcccccagcgactcgtacagagacgccatatctgacgccaagcacatcgatcagatcaaatcaaatcaaatcaactcaagcgccaaattcccacacacacacacacacacacacacacacacacacacacacacacacacacacacacacacacacagagtcagaagcacgcggcaagcggaagctgccacggccattgattcgagtggagggggggggttgaggttttctaccatcggatttgactgcggcgaggacatcggcgcggaggtcgaccttggcgaggtcgtccacgtccgggtgcgagagcaggaacagcttgtgcgccagcaccaggtgcggctgctgcttcccttcctcgcctacgccgccgtccatctcgccgccgcttccgccgccgccgccgccggagaagagtcgcctcgcttctcgctttgcttccgccgcaagaagagattgggagagaacacgagagagaaggagagaaggctagtttcgtcctccaaagtttttaattcgggagagtatttccaggctactacgacgttgcagagcgacgtggtcttatctgagacgtccgtaccacgatccgacggctgtgcggggggccgagatctagtacggcacgtgtacaagggcaaagcgcaacaccgacccgagtccaaactccaaaccccattccgtttccgagttccgacccgcgccgccacgccacgctacatcccgagctctcaccgagagacccaaaaccctttccaccgatggccaccgccgtagccgccgccggcggtggcggcggcggcgagcagccgcgcaggaggaagccggcgccgg

SEQ ID NO: 5508 - DNA, 1501 bp, Oryza sativa
ttatgtgtcttattggcatattttggtagcaaaccaaacactagccaaactactatttaaaataccaacaatttggtagggcatcattttagcatcaaaccaaaatggcccaccgtttctcgtgcggggaactcagccttactatgtgtgtcatccaacatctctatgataaattttggagaaaatttgcgaaggtaaacgttgcaaatatgcaggcaaccgaatcatcgcaacaactctcggcagcacatctcccctcttcttcctgagtactctgggccaatctgccgccctccgccgcacgcgccatccgatggaggaggcgcaggccgccgtgatggcgcacctggaccaggtctcgggcctcgtccaggcgctctccgccgagctccgccgcgggatcggccccgccgccgacagccttctcgccttcgtccgcgccgtcgactggacggtaactaactccccgatccccagattagcggagatcaccgatttccagccgccgcgccgcgccgcctcctttctcttttgctgatgattcgcgtgccttgtgcttgtggcactgaggctatttcaggaaccatggctgatttgcttgatggtattccatgcgactctgttgctcacggccgtcgggttgaggaggaatgccaatttccagctcttcatgctgtttcttgcctgtgagttttcttgtttctttttgcatatttttgcagtatgtttaggactgagacattgtcgtcggagaagagaggctagggtataataatattttggtagtataatcttccatttgcataaaccgaaccttgtcgtagtaattgggtcaatagcaactaacagtttaaccgagttactgcatttgcttaaactttagcacatacagcgctcacctagatgctgctttgagcacaaagaagttaaagcagaattggccactaaacctttctaaagatgtgatgccttggcagttggcacaagacaaatattcaggatatcgcaatgcgaactatgataagggtttgagtggaaagaatgtgataaaattatgtcaggaggctaaaacttgtaatgtgaaaggaatgcataaggctgaaacttgtaatatgaaacagagggagtgcactataaatgatcaacattttattattctgtcaataatgtagaattagagtattcttggtgtctgctagtgtgccactcaaagtctactacagagcttgagtttgtggctattgtgagtttctataattggtatcttctcaattctgatattaggaagagacaacggatatctcaggacgttaggtggcagtaaattatctagaataaaaacctggttgtttgattgatcagagtaggctgcttggtttgattaattgtctgattggttccatggttgcctatctgcagattcaggagtttatcttgctgaaaagataaatagctatatggcagagcactggaagagcattgccacacgaaattacttcga

SEQ ID NO: 5509 - DNA, 1501 bp, Oryza sativa
ctttatgtgccatgtcagataaataccgagttaaattagccatgtgagcaccacgtcaactgaaaccgctgtctaaactggcttgagacttattttccactggttttgtatctggttttccggttgaaggacggaaatcagattcattgacaagttaagggacctcggatgaacttatttctgcccaaaacaaccttactgtttgaagaaaaataagcagagaagcccatttgtatggctggccttagccctttagttggcaaaagcccaaatccgtgttggatcatatacaaccagcttttgccaaaacatgttgtttctcaaaacatagtacgtattttgttctgtgtgcacgcttttcaaacatgttatttctcaaaacatagtacacattttgttccgcgtgcacgcttttcaaactgctaaatggtacgtgttttgaaaaaaaattatatatgaaagttgctttaaaaatcatattaatttattttcaagttttttaagttaatatttaagtaatcatgcgttaatctattgctctgttttgcgtgcagaggagagaggtttccaaccctccaacagaacatcatgtatataaacctaaccgttaatttggcatgttccttctacagcatgtgagcatcaagatagggtttctagtcagatggtatataaagtagtatctttcaaacttaattttttttaagaatgtacgatgctcaaaacacgtagataaccaaaggtcccccgtcatcaaacctagtaacccgtcagcggtatattcatctttatcacatactgtattaaaaaagactcttcggtcacaaaagcaattgccatttactaaccatctgaaatgtaccattgtgtatacagttatgaaatgtcatgccgtttagcagttaactacaccttggtatcaaaatatagtaatttttagctatatgtctgaaatgcttgtctagataaatagctataaattactatattttgaaacagagggagtaacattttgctttgggcaaaactgtcagcctgataaaacaaaattaatacttccaatgacatgacaggaaggatttttgagttttgaagcaatagggcattgcggaagcaaaagattatggttctggaagaaggaatgaggggaggggcggggcatcacttacctattgttggaggaagcgaagcgccgcctctgggtgaggaacaagcggaagatgggcgagttttcacatcatagatcatctccaccgccatcgccgcggcggcgctggtggtggtagcctggctcgtcgctcgcttgtctctctccggcaaccgcgaaggagcaagcagactgagttggagacatcggaaagatgatcaactagttttggtccgggcctcggggccgtgggctcagtgaagcccagggacaatgtcagattaggattgttgcatctgatttagttttttttttgggggggggggttgtattgagggaaagtgttgacgaaaa

SEQ ID NO: 5510 - DNA, 1501 bp, Oryza sativa
aagttcaagacccgatgatcgctccatagcttctttttttaaaaaaaaaaatggtcaaaaggcagacgctcgtatatacacatcttgcctctatcaacacttttaaaagactaagtgctatactttatttatattaacaaagtaacacggagtacctctaagagactagggccctatttgaaagattagctcagggataattttgagagctaatgtttagtcattaattgataggctaaacattagcctagggtgacatgtttggatccatgggctaatttaaggctaaaaggcagagagagtaaaaagagaggagagagagacatgctttttatggtccccacacaaaattagccccattagcaccccttgaaggcgctaatgttttgagggggactaatttatattagcttaaaattagcccacctatttggatccttgagggctaatttgaggctaaaaggtgatggctaaacattagcccatggaactaggtcgggatattttgagattgatgccgtcaacgtagacttgattatgtggagattgactaagtcacttgagcgtaccttttagagactgaactagtatatcttaagattcaatattgatgaactcaccatatagcacctctaagaaacttaggaggcatctcttgaaatcactatcaatgttaaagaactcaccacggatgatttctgaagaccaggtcacatatcttgatattactatcgagattaatgaagacaccataggtgtcgatctcactataaacaaaaacggtatatcgttgtctatccctgaaagaaaatatagctcaattatgtgtattatcatttacatatgtttataggacctgaattcgtgttccactacaaataacacaaccagacgagctacctccagtttgtgctccctagcctaattgtaggtattatcattcacgtgatactttgttgtgaatttatgatttggggaaaaaaaatcaacaccgaataggggtggggtctctccgtctctcgtactaatcgatatcaacggtaattgcagcaacacatctattaccaacaaaaaccaaattaatatattcactaaaagaattaattttatcaaattcttttaatcttatcgaaatattaagtgattttcgctatcgtacagtgtcgacaaacctagttaatgcggtaaccggccgcttggaacctactccatctcttacagaatagtctatttctccttccgtatgtctcaaaataagtttaattttagtaattattgtattcgagtttttaaaagcacgagataaatgtattgggagcactaaggaataattatattaggatttgataaaatgggatagtctagtttttttatttttattagtatacgtgtgataagtgaaaaataattttattttggaacggaaggaataggtcgattagacggcatcaatcgatttgcataaaaatatgtcgaccttattatctcagaaaatgacaat

SEQ ID NO: 5511 - DNA, 1501 bp, Oryza sativa
tttcccccctcccgcggcccgcgccccctctctccctctctcgggtcgtaggcccatctctctcaagtcttcttttcctcccccttccaactgtctctctccccctccccgacaggtgggacccatgggccccacctgtcatccccaaccttcggcctccctggccggcaaccgcccatgccgccattgccgccccacatagcggcgttttctcgcgcgcccatgccgctcccgcgcgcgtgtgcgacgtggtcgtcgcccaccttcttccccaccatttccccccactcgtcccacaaaaaccggcgccggccgagccgccaccaccccacgtcggcgtcccgcttccgtcagccgatcccgcctctcccggccacgatttccacctcccgagctctataaaacgatccccgcacctccttctctcttttcccctctctcccgagccctcccgtgcccggaaaccaccgcgacaccgccgcaccccatcgccgccgctcgccctagtggtcgccacgccgcgtagccaccgccgtaggctccgccgcacggtgccacacctcggcccccgctccgtttccccattccatcgccggaaccacctccccaccgcgctccctctctccaccactcaccgacgagctccggccgcccctcctcgccgctctagccaccgccgccaccgccggcatcgccccgccgagctccaccctggcctccgctccattttccccctccaccactggaaccgccattgcaccaccacacccgagccgcttcaactcctcagccaccagccgctcgccgctggcattcggagccacgtccggccgtgccgacgccccctccgtctccgtggtgtcgagccgcacgtcggccacccctctgtcttcgcgaatcgccgccgaaaatacctcccctctgctcaaggtgagttcggcctttcccgccgggttccggccgcctttttgccgtcgttccgcgtcatctccctcactccagctcccttctataccttccccagctcctgccggttcttggccacgctgtggtcttcgccgggaatcgccggagcgccatcccaccgtcatctcgaggcgtccgccgtcaccttgctcgctgtcggccgcctccttccgctgtttgacctctcggtgagcactcctctccctctccctcttcctccccttcgctggccgcctcccgggcctgcccgtgacgcgccgtcgccgccggtggccgttcgaccgggtcgccgccgccgtgctccgcgccgtgccgctgctggctgtgccgggcagccggcttgtaggatcaaggaggccgactagagggggggtgaataggcggttttaaaacttaatggcacttaaacaaaactaacctaagttgctagggaaggtgaggtgcaaggttaactaagcaactaagttaagttttgcaaacctaagtgatatgggcttaaatatgtctctatgaatataaatagcacaaatgtaaa

SEQ ID NO: 5512 - DNA, 1501 bp, Oryza sativa
atcccctttcctggtttcctccatattctcctcgataccaaaaccatccatccatgaatccatgtgagatgtgatcttggagcccccggttttggtatcctccagccgctgttagcctacagtttattgctcgagaattctggagcattcggatatcgggagtagattctgattgcatgttttgtaaatggttataattttatttaaaaaaccaacaagttacatattacattccacaaacatgcatgttaaaatttaacttctacaaattgcaacagaaaaaaagctatatgtagttaatgtatatttgtacaagttaaattcaaccttatatatatttgtatatcttgttgatttttttattttcttcatacttatttgaatgacatacaaataatgaggggatgtattagagtatagaataatgtccctacggctatcatttcagtatgcagcccatgtgtgcgtgtgtctgaaaaatcctaaataattcaggccaatttgcacacgcccagcaaacaattcaggctgctagctatagctagctagctgaccgtccaatcattgcaggatagatgccgtcgtcttcttggagagctccatgatcgagtggcagtagaatcccagtgcgagtgtcgttgatgcgagtggcagccatggtccatggttggtggagctgcctctcgagcgagcgagcttgctcactgtgcaatgtacaatgcactgtactgtgtcatagttgctgaacccagacattggcagctggtccaggttcgatcatctatatggatgcagctgcattatattcacgaccatgccacatatgtaggcacaactacataagaacttgtatggtccaatatattgagtacaaatgatttaatagtataaactactttattttttcacttaaaatttataagtttttttacacacacctgctatgtaacttatattatttaactggtaattggtcataaccaaagtacatagatttttttaaataatgattagaattgagcagcaatcgttcgactgcaatgcgtctctcatgcgcataaatgagatccagtgacggcatgagcatgtcccaattaaatcggattaactctcaaccacgaaattactcgaaagtgctttttaattttctatcctttttgcacatctatatactactagtatatagaggcagtatataccgtaaagttctctctctctttttatattgcatgaccatgcatgcgtccatgtgacatgtccagcttgccaacaaagaagctaggctactgcagtgatgctgatcgagtgatcatcgagctcacggctcacctataaataagcagctttgcctctcaccactctccacttcacttcacttcactcttcagatttcagacaaacacatacagcagcatcaccagctcagttaattgcaagcaagaataaacaagctcgatcgatcactgtgataatatggcggggaagctgtaccagctgatgt

SEQ ID NO: 5513 - DNA, 1501 bp, Oryza sativa
attaattaagtattagcttgaaaacttaaaaagtgatttaatgaaaacttgaaaagcaactttcttatacgattttttttggtaaaaaaatgtatcatttattagttcggaaagcgtgtgcatggataatgagggagtagaatttaggaaagtgtagtgccgaacacagccttagctttgattaagatcacgttaactgctcacaatttatgaaaacaaattgattcggttaaatatgtgtatattagggaggtttttgcaacaaatgatttatgtgggggaacgtaaaacttcaagtaattttatggggtgagttttgcaaattttcctctaaagaattagtagatatatgatctaggagacatttccctattttctccatcccaaagtatagctatctttagaggtatatatggagattaagaaaacaagtatagtgaagtggtacatggttgtgattggttgagatggtaaaaggtagctttggacaaatttaaattgtaaaaaacaattgtatttaaagatggagggagtagattcataataatattggtcctatgtggtgaacttgagaacttgatattataagaagtagcagatgagaattaaaaatgctgagtttgttagcttttggtttcatagtttattttactgtgtggagcggagtggttcggattttaaagcaatggtttactagtgtgaagatatgggtaaaacagttgtgcttgcaagactatgatcattcctactactcctatattctattgactggcgatcgaaatcaaagaaattcttggaattagattaggcctggtaagatccattgaaatcaatggtggcacactggcgataccggtcctcttttttcctcactcgatagatttcacacgaaaactccagtcctaatctaatttcaacagactcgataattttttaaaaaagaatatatattgtgttgctgtaaagaacttattgggttatcttcttttgggcttatacttcttccaatcaaatcaaaattatttcctttttgttttgaggggaaaataactttccttatgattgcaataaacttgtgagaaggactaacaccatcattcctagtcctcttgccctacatcacaaatcaaccaggaaccaacaattgtgagaatttcatgatttaaaaccgaagatccccctttcaaattgtccaatcacaaattgaattgaaggtcaggcctgagctcttgatgcaatctacagatggatcaagttactgtcataatcagtattaccctttggagagaaaccattggtagcatcatctctcttttcaacttttttcttgacataatcagttatcactcttaccctttcgagacacatgtacgttaaagcgatctttaccaattttaaataactgtgtgtatccataattgaaaccgaacattaaaagagaaacagaaaagctaatatttatcaaaacgtcggattgaacagagcagacatgtacagatgt

SEQ ID NO: 5514 - DNA, 1501 bp, Oryza sativa
tcgtcgattctttgtcatcggaaaatccatagcagcggtgtcatgataaagattgggataatgatgattccgatttgaagtggtgtgtaattcagtcgagtcatatctcctaggtctgaagtcgtcgaagattttttgttcacgcgattcgcctcttggacccatctcatcgaaaccttgaagcaccatatccccctacctggcacgccactttcgacgggctatagccgcctacggtatttgtagaatatggaaattgttagtgacatggtatacgcgagattgaggtaaaagaggcaggagatggggacttttatacaggttcggaccacgtaactaatgggtaatagccctactcctatcggctgaagccggtgttgccttttatatatcaatatcacacgagtacaatattggagaggacttaatctagtcccggtcagcttagcaacatagaactctcacatgtggtcggcggctagtgtattctgcctcctcgaatatcacacggcgagattgaaattgtattgtgtggcttgcctagatccgtattggttttttcttcgcctcccgtgtgtgtcgtctctcctactgggggtcttgtatttataccctcaggtgtcctcttgtctatgtagaattagataaccaagtatggatacgataagagtggtgcttgtcgtgctcaagtaggactttgcttctctttccttattcggaacaccgtccgtaggtgaggtatgatttcatgtaagacttgtatatggtgggtctcgccgagccaaaaaaaatattaatgatgtcttatctataacattcacttttcaagattgaacgaaattttaatgaagcttgattctttattcttctgcaaatgcgaatgaattgccttgtatatattgagtctgcaagatgttagcttgaagcaaaggtatatagcgggaaacacgcatgtggataagtctgcaaaatacatttgcatgcgcaagttactaatactcttacaagaacaaccaggattctttctgaaatactttggccctatcatatttaggacccaatgcgttacttttgtacgctgtgttatcactgcacgtaataattagcaacaaaaggcgttcatacagtatatgtactagagtatgtcatttcacctaaactgatagctacatgctaattgtgtatatctaacatgcgctgacggcattggatagcaaaaaagtggaagaaatatttatggatggtttaatttctgaaagatcatttcacctaaaattgacagataacttctctaatatctataatatatatttaaataatgtgaaaataatgatttgatattgcttgcatgttaattttaaaaatacaacaaaattgttaatgatatgtgctaattattgatttagccatgcgccatccgcgtatatatagatggtaatggggtacaaatgcttcacactgaaaagcagtcccgaactaagcatggccggtgtggatgcca

SEQ ID NO: 5515 - DNA, 1501 bp, Oryza sativa
cacatccttgaatacttgttcttcttggtgcatgccagactctgcaacagaagcaatttcttcaacttcgcatttttcagtgtaagctccaccatccaatttgttgcattccttgaaatccaggaacgaggctttctccaaactgaaatccaccgaattctcctccatttcatcaagaactttcttgaaattgccagaagcctgcgcctcccactgcaagattctccgagaaaccgaagaaagcgatttcgcgggaggctcgcatttcttgatctccactgagacagggtcacactccagtctcttctcctcaacgccatcactgaacccatcgccatctgatgacgaaccaaagctctgtcgctgaatgtcttgcaccgacgtgtcgctcctcgatgaacaattctctgaagaaaaatgcggagcacttagctggtttagatcctcgagaacgaccttcttctcctcgattccgtccttgatctcgtcaagaacctcttgatccatggagatttgggcgtcaatggcggcctgatgccatgggagctcgagctcggtgtggtcgaacagcacggctggcttgtgttctagaatgaggcaagaatcgccggtgtcgcagagctcacccatgatctcgccgacgcggagcacggaggcggcgtcgccggggccgaggacgaaggagcagagctgggcaaggagcgcgacggcgccaccgccagcgccgtccgggtccggcctgagctcggcgcggagcgcgccgacggcaatgccgaaggtccacccgagcgagcacggctccggcggcgagtcccccccgcggcgggcgccggcgcagggggcgacggtgacgaggacggcgaggaggagcgcggtggtggcgaggagcggggagaagaagcaggcgagcgcgaggaggtggcgcgcgaagaagagcgcgtacgcggcgtggagcgggtgggacgcggcgaaggcggccacgccgagcaggtcgtggagcacggacagcgccagccgcagcggcgcgtcgcgttcgaggaggtcgccatcatcaccgccatcgccgccactgtcggcgcactggcgcggcgccaccattgtcgtcttcttcgctcggtggggcgtggcttggcttcgtcggctagtagctgctacctaggcgcggccatgggtgccacggagcttggcctggacgcgcacgcaatcagtggaggcagcatggcgcgttgcggcgtggtgccatgtggtgtcgcacagtggcgatctttggcatggagggggaaagagatgaagaggagtaaaaaagagaggcaaatttgatgatgatgatgagatgagagagagtggctgtgtgcgggtgggttttgtggtgatttggcgggagggtgtggcagtggcacgggttcgcgccatgtgtaattatacggaaatataatactactagtaataataaggattacaaatggttggctccaccatggtttgaatcttttgggatttt

SEQ ID NO: 5516 - DNA, 1501 bp, Oryza sativa
ggcctacgaagattcagaccgaactggcaaccagacccaggtcccagctcgtcccaagccaacccaggctaaccattccacattttagttgttaagcaggttttaagaatttaaaacactaacttgggtacattgctaggcttgcccataaccgagggcacggcaattcgaatagattatactctgatcagaggtgtacatctttacccacaagacacgtcttcctcacgtgtaaccacgcgccacataccaccacggcatatggacagaagacgtgacatagttcccaacccatcctagccataaacaagagtaccgacccaaccctggctacggccgggattcccgagacaggtaaccaaggttgaacccctagcagcaggacaccggccctgtgccatgacatctcgactaccgggctgcagctcgtgtagccttcatttgtcctagagatgtccatcgagccccgacttcatccatctccatccctgtacctttgtttatgaccagactgagccacaaactaagccttacccactagacatatggaagtacggtagtgctttgcaacagaggcccgaagaccatgcacctcgagcccagcctaaaaccattttgagggttttgaatagagtgggaggtgtgtgtccatttccacatagtccaaccattccataatgtccaaattatatgagcattcctaaagtctaaggttatgaaaccacctaatgttgcctaattaatcagcgaagcatctacctaaattcatactagtggaaccatgaatagagtacccactagttggggttttatttttcctagggtaagcaaggtgataataacaatagcaatgataataaggtcataacaaaggtaaataggcatggctaaataaaacagtgataacgcgtgaatttaaataaagcgataatgcagtaatttaaaccaaaataattttataaactgggattcaatatgttcaaggatgatgtgacttgccttgctcgctttcccaaacgtcggcttcgacatccacgtagagcggatcttccgaagctgcagcgtctacacgagcaacgggaagaaaaaggcttttactctaataaactccatataacaagcaggaacaaagcacaaaaatgggttcttgacttcttaaggaaaacttagagacttgaacggtccaattccgagttcaaatgaccaagttatggccatttgaagtttatgtgctctttaagtgaatatttgcgaatttcttcatttaaattttaattaaaaaaaagggtttattgcgtgagccggggggagggggcgcgcgggccgggtccacgggagtggcgggccccacgcggcagcccctcggtccacggtggaccgggtgcacccacgggctcaccaaccggcaccgtgggccccacgtgtcagccgcacccggaggcacgggcggctgacggccgggccccactcggcggccacacggcgcacttggaggtggcca

SEQ ID NO: 5517 - DNA, 1501 bp, Oryza sativa
ccctctctctttccccccattttcccctctctctctctttatttcggatggaaacccccctaatcccgccggcgccattaatggcggccgggtctcccgcaccggtttccttccccgccggctgccctctctcactcccaagcctatataaaccctccccgcacctcccttgtccatttccgccactcgccgccctttctcccagccggaatcgagctcgcgccgtcgtcctctctctccgccgtcgccgtcgacctccggccgggcctacccgctcgccgggaccgtcccccgcctcggcgtcgtctcctccagcttcgctgcaccgccgccgaccccgtccactgcctcgccgagctcgccgaccgccggaacgccgccgtcccagtcaacccgagccgcgccaccgcctccctccactccgaccgcctcctccgtcgccgccgtcgacccggggtgagccgtggaccgccgcctctttcccccttcccttcccctctcttggccgacgctccgccgtgccaatggccgccgccggcgaccataggggcgcgggcgccgcctcccgccggccgcgccaacgtggccacctccaagtgcgccgtgtggccgccgagtggggcccggccgtcagccgcccgtgcctccgggtgcggctgacacgtggggcccacggtgccggttggtgagcccgtgggtgcacccggtccaccgtggaccgaggggctgccgcgtggggcccgccactcccgtggacccggcccgcgcgccccctccccccggctcacgcaataaacccttttttttaattaaaatttaaatgaagaaattcgcaaatattcacttaaagagcacataaacttcaaatggccataacttggtcatttgaactcggaattggaccgttcaagtctctaagttttccttaagaagtcaagaacccatttttgtgctttgttcctgcttgttatatggagtttattagagtaaaagcctttttcttcccgttgctcgtgtagacgctgcagcttcggaagatccgctctacgtggatgtcgaagccgacgtttgggaaagcgagcaaggcaagtcacatcatccttgaacatattgaatcccagtttataaaattattttggtttaaattactgcattatcgctttatttaaattcacgcgttatcactgttttatttagccatgcctatttacctttgttatgaccttattatcattgctattgttattatcaccttgcttaccctaggaaaaataaaaccccaactagtgggtactctattcatggttccactagtatgaatttaggtagatgcttcgctgattaattaggcaacattaggtggtttcataaccttagactttaggaatgctcatataatttggacattatggaatggttggactatgtggaaatggacacacacctcccactctattcaaaaccctcaaaatggttttaggctgggctcgaggtgcatggt

SEQ ID NO: 5518 - DNA, 1501 bp, Oryza sativa
tgtggatgccatcggtgtttggggcagtttctggtgctgtgatcgacaggcgagacatcttcacgtcggtgcaatcctccactgaaatctggatttgctggctgttcaccaccttcaggttctccactttcagaataaagtgcttccctatgttcttagcaacacagccacaggcatgtccaggaaatcatactagcaatcactgctgctttcaaaattttcataatgaatactacctacatccctcaatgtttgacgttggacgtcaaacaaaaaagaacggagggagcactttgtaacactttaattttgtaccatggtgacttgtatataaaactttactgtatcatgatgattatgggggcagatcatacacaggacagtaaaatcaccatctacatagcaatctggaaagttacctctttgttggtcattggtaccatgccgccccttctccaaacaaattaagttcaattattcaaagaatgaacctaacaaggcataataagcaaattatgaaaaaatgaacataacaaacaccagattaagcatcaactgttcggaaacctgagaaaggaaattagagttgatttttcccccttcactcttagagtatgaatgatcaatgcattagaatgtatagtaaaagatttgttcctggaaagaagacaagatgatagtaataaacaaaaggggcaaaaacaagtgcaccacctagtgatattgccgctgcaatcttgactcctcatcctcctatttttcctaggtttattccacacaaaaaaatataatatatcaaaaattggaagctgaaccggcttgtctagctctgttggtgataatggaggagaaattaagagaaatggaagaacgaggaggacaacgcatatgcaatggttttaccaccatggagctccaccaccttcttcttcttcaaccgccggttcggtcaaatccaggaggaggcagtcgctgctgctactatgcaacctgattcccagtcaatggaagttgccgctcgtcgggggatggagcaacaaactgcacagcgagctgtccgcgccatggaagaagctaggggcaaccctcatcgccatcgccgccgccgtctcctcggtcaccgctgccgccgtggactcgacgcgggcggccgctgcttccatcgcgctggatgcagtgcccaccatcaccggccgctcgtcgccctgcccttgaatgcccagcctaacgccgttcccgccggagatgacgccgccgccgccgccgtggggactcgccgcggcggcgggggatcgttttttttttttgttgttttttgtgtgcgtgttcatttcttttctcgaaaaaaatggcccatgaaagattccagcccggcccactaagaaactactcctcgtaaagtcgtaaggcccagatgacgcgagagcccgatcggacggtccagatagacctgatcgcgctataagaggggcgcaccacgcactcgtcgcaaaaccctcag

SEQ ID NO: 5519 - DNA, 1501 bp, Oryza sativa
ccctaactggaccttcggcgcaaagcaaatagtgggagagagagagaaggggggggtgaggattggaggacaaattgaggatgatagaagaatgaaccaaaagtaaattatattatagggcttagtttggaacatgttaagttgttgagatgtgttgtttaatgcatcgacatgtgtcagaagtctgtctaccaatattattgaaaaactatagattctatatgataggatataatccagaacattcttccattcacctaataatgttactcatctttttggtagttggtttttttaaatggtgttcaacctaggctaaaatattaaatctttgttggtatagtggcattgtgttgggcggtatggttaaacagaaaatggtgcagtctttaatggctcgaaaacgaactcatttttataggtgattttcaagggggacatcttgggcgcaacattggtcgctgctgcttaaagagaatcatggcaataggctgaaagaatgctgcaagccattggaatctagagattggagttcttttctaagtttggttggaatgtgagaaagagaatagatgtgtagtttcttttctccttgagtttgttgtttaaatgattttatctagatggttgtgtaccctcttgtaaaggggagtgggtctatgtgctcatatttagacttttggccgtgtacatccttgattccttgttggtgtagagaccaggttttaatccattatgtaaaaattcagaacattctttcatggtttcagagcaattcttgtattatctcagttacgacctacagatggggttgtcaattgtttgatgccctaatataatgacatgtcattgagataccgatggcatatctcaaactttgaaaaattataatggtatggttccaaattaccctataaaataagaccaactaagacaagaattcctgtatgaaattaggaggtacttctttttgcaaggaaattagtaggctagatgaaaggatttaccaaccaattaaggatgatcaaaacatccccaattaagcttgagaatggtagttccagagctgtcagacattccatacacagtatgcatggtcctctgaacgtcgttgcatactatttccagaaatccattaaaaaaatttctgttcttccccattcttggaagcaggttgtccatctgattactccatgaattctccatactttcattaagatatctgtgagaaatctcctgaaatctgcattgttttctcttccataggctaccttggagccccatacgtttccattctcagctaagagctaaacatcttatacctgaattttatgcttctagattcatcagagacgagtgatcggaacagatcatgctgctacatctagattataccacgttgacattcccatacacatgccattttttcctgataacatgtcattagcaaagccattaggcacataatgacttgtgaaactgcaaatggaagcctgtggat

SEQ ID NO: 5520 - DNA, 1501 bp, Oryza sativa
ttactattatcggtgcctggttccttatacaagttaatttcttagggaaaacacgttcattcagagaaccaatagatttatgttgtcgtgtatcatttgtttttcttatgttattttctttcccattggcatgcgagcacttctagtgtttagcgtactcatattcatgagggtcaagcaataatagcttcctctcatttctcatcgtcgaattgaccgtgacagacagagtattcgagataatcacaaacgatgagatgagaatattggggatttgcaaattaatcaggatacaattaataatataccagtcacatttagccatacgtgatatagaggtggatttgttatcgaagagaggtaaaaccattacttattatttgaaacgtaattgctaaaaaactgtcacgagtttttttggaaaaaaaaacttttagatataactatagtatagattgcaatgcaatagttatagtgaaaaaattatagttacattataactgcattataactacagtgtaagcacggtaactccaatgtaatttctatataagttagatataaagttacatatactattttaatacttatatataagttacattatattttatttatagtagaattatattacaattatactataagttatggttaccgttatacttgtgacagttttttttaaagatatagtcccattttgaaattcttagaagagactgtgtgggcctagcaatttccccgcaacagccgcgatccatgcccgcgcggtgatttcctctgtcggtgcccgaccgccaacgcccgctgacacgtgggccccgcttgccctccagctcacctttcgtctacctcccgcctcacactcctcccctcacctcctctcctcgattaaattaacccccgaaatccaccaccaaacgctcgcgagattaatccgattttaatcctcgagatttgtttaatggcagggctaatctcgccccaggccttgtagaaagcgacacccaaaccaactcacctccattggtgaggtgccctgtccttttctctctcctcctcctcctccatagttaagctccccaccaccactactactagtagtagtagcgctgccacctcccgctccactcccgcgtcctctgctggaagccttcttctcctcgccgggaggattccaggtaatgcccgctccgccgccgccgccggtgactctgctctggtgtgtttcttgggtatcagttcttgatctggatgttgttcgattcgtttcttggcagcgcgggatgcggcggtgctgatcccggtgtgcacggatcttgggtgtgattcggtgagctgagagctggtttgctgctgctgcagcgtgcgccatggacggcgacgcggatgccgtggtgagtgccccccgcccgaaatgccgatgggttttcggccgcatctcgtgtggatcttgtggaggagactccagattttgatttgatttggttttgatttggtt

SEQ ID NO: 5521 - DNA, 1501 bp, Oryza sativa
tcaatccagctcaaaatcttaacaaatgcggctacaccactaaaccaaaattcatagaaacaaaggtaacaatcaaatgaagaaaaaaaaattgaactaccattttgaaatgggagttcaatttttttcttcattttattttagataaattcaggggttacattggtcacccttacattaataaatgcaaaagaaaaaaatatcatccttaccaaaaacatcatcttagttaggttgaatcggtaaacaaggagaaaaaggaaaacatcggtcgccctcacacacaaccgctgacaacaccattgccggacctttggtttacttggcactcgccagcattaccggatgtagtagagataattaacgtagtatctagctaaagatgtcagatctaactaatgagcatatgattacgtcgaacaatttttgccacatgggcaatttgccaggcactcttgaatcgacatccagcactcattatcctttacacaacaaaagttcttatctatttgatgagggtccatgggattgtgaatgcaatctttaacatcagctcctgtttatcaagggaacatacatattgtcaaaatagaatgaaaatgcaataatgtacatgtaaattcgattaatctattcaagatgaaattttaagtgtggtgccatcaaaacgacatataaatgaaaagcaaattagagcccccttcctacaaaagtaaaatagaagattcattagttaccctcgataagtgcaggcatggcagaacacactagaagaagtaacaaaagtccttggcagctgtggttcaccatttcttactgatgagctaatatgtgctatatgccagattgtattgtaattgatgtgtgtatgagacattaggtccgagtttgatatttatagatagaagaagtatagaaagagaaaaaaaaccagtaaatatatatatcgttttgttcggaaaattccctaccatcaatgcctctgatcctattgtttaattttattaacacaccaaaaaaagataaaagacaattatggcttactatgtatggcttcttcaatgaccgatgcagaataaaaccttaactatcgcaaaaccagaataaaacatttgctatggcggatgaggataaaaccttagcaacggtggaatagcgcaggacaccatttgaaaaaccatattgcaaattgcgctaatagtcgatagatagaacttgcacttgttccaattaaacggttggacttggagatacaaaacacactgctgcagtagctcttcaaacctagactttgcaaggacacaattccccgtacagttaaggtggtgtttgaatcttctaaagataaaggtgaagataaagattaagtgtttcacgtaaaacgaggtggtaataatatgtgatcaattgagttttaattattactaacttgaaaaatagattaatctaacattttagagtaactttcatatagaaagttttcgcacaaaacacaccattt

SEQ ID NO: 5522 - DNA, 1501 bp, Oryza sativa
tccaaattatctatagctaatctaataatccattcatataatagttacctataaaaacatactacaccattaatacccggtctcacctctcatacgcacacaacaacttagagtctgtgttgcacctggctacaaatctgtagcccactttcttctctctctcttctcttttcttctcgatatgtggttatagctcgcttatagcctgctattatacttgctctgagaagtgaatatttcgctcttatctttcttatctcctccacctcatcatttagtactactatgtatttcctccgtcccaaattataaggcctatatattttatacattcttcaatgacatactttgaccatcaatttatcccatgttatgtttccgataaatataaaattagtatcacgtgaaagtactttaaaacataaatataaatctagtgatataatatacataatatttattagtcaaaagttatcaggtttaatttttcttaaaaagaaggtgctatacaaattaggacggagccagtagcatcttgtggctcgtacttggatggctatagtacctgccgtattccgagatcactatgattgtacaaacaccggcatgcacccacctggcatttgctggcgcaacggaggtcatgcaggtgcaggcgcctcgagttccggcgcccacttcgcccgcaccaatggcggccaccccccattcctcgcccaaggccatgcgcgcccgccgtgccacagcctccctcctctctccctccctcccacccccgcgtctcctctcctccccacccgccccgcatctctccatcggccggatcggcaggagagcgcggccgtacgcacgtacgccgtccccgcggtttcttcccccccggcgcccagcccgcccgccgggcggcggcctctcctagcaacgtaacctcctttgccctcctccatcgatcgatctatcgatctccttccatagcgttttaattaaattatgtttgattggtcgagagattggggttcgaaccattgcttctgttgttgcaggttgccgctcgatttttttttgtttttcttttcttaaagtgcctgcattatacatttgctaagttttatattgatataatatgaaaaataatttttacaagattgcagccatggaaggctgtaaccatgaaagaaaaacaaacaaacacgcaacctaggagaaggtctagcaccaagccagccgccgctaagcgagatcgaacgccgctagaattttttttgttttcgttttgatttgatttccgttagaaatggcattccccccaaaatttatgaatttcgcctgctcggttttaacttgccaacaacaattattaatgtatcttgctttggagaaaattcgtagctagatagtgcatattggaggtggaatcccttgatttgatcgccattgttgtgtttgcaattattctaattagcttttttttttgttttttgctctgctaaatcaattctgc

SEQ ID NO: 5523 - DNA, 1501 bp, Oryza sativa
agagataaggcgaggagtttgaaagaaacattatggcggtcaaagaaacacctgatgaagctcagaagcttgaagagttcttatgcgtacgaagagatgctgaaatgtgtttaactggtgaattttcgtctgttggtttgccgtgtaaaaaccgtttgatcaaggcacttgtctgcagggtgcctgttttagtctaagacgatgaactgactggtttttgtttgctcgtttctaagttgttagtgacacataagttaagtttgcagttcattcgccagtgtgtattgtaactttgcaataaggcacctgcttgatagctttcttttcatattgttcttcgacaaatataagtgatgattattacctgtactttctcagtttcacaatgtaagtcattctagcatttcccacatttatatttatgctaatgaatctagatagatatatatgtctagatttattggtatcaaaataaatatgggaaatgctagaatgacttacattatgaaacggagggagtactatttttttagcattcgagggtataattttgaagcatgctatagcatcaagattacgggttaactttctttagttaactcatgctctttattttgggttctgttttaatcagtttcgaggcaaaaggcatactacaacagagaattactgtgcacaagctgctcttgatcaattcaattttgcacaacgtccatctttggcataagcagaacagagcgacagataaaaatcatgtaaaggttttttcaaaaatcaatagagataaattaatggccaaaatccatttttgtgcatacttttttttttcaaaaaaataataaaatacacggtagagataatatatttacgagtttaggacggcctgtagagacaaaaatagtcatcacaggaacagtccatcttgtgagaaacgcgtttttttttctttcaatttttgcatttggattgggttggagattaaattaccattaatagattgagagcgaatgaattggtgccacgtgtcaagagaacgaacgggcttgtcgcaggagaactggtcactgttgagatcggctgatccgattaatcctaattactcctaaccattaatccaactataaattccttaaaaaaggactaatccaactcccctaaactgcatgcatgtcaccgtcaccgtgtgaaaaaaacccccaaaaaaaccccccggaaaactctatcctgattagttctagctagtaactaatccgatctgcttaattaaaccccttcagttaatctgttcgttgaccaagtttaattcaaattcaattcaattttaatttattttatctgcatgcgaatgcatgagatcactccaatttatccacatcttatctccattaataaaatcctctatatatactcgaccacctcttggtcatcttcttcctcatcatctccatttgattgatctcgtcgtcgtcgttgacgtcatcaatggcgggtggtttcgccg

SEQ ID NO: 5524 - DNA, 1501 bp, Oryza sativa
cgcgctgcccctgcggcaccgcgaagtgcggcgcgtcgacgaggcggacggggcggagcgactcgacgatccaccccggcagcggcgacgtcgcgtccttccgcttcggcggcagcagcacgccggcggtggagttcgggatcgccgccggcccggcctcgaagtcgccgttccggatcaggttgtctgcagccagcaatggcgtcgtcaaatccaagaagaggaaggtcaccttccatggatgccatggcgttgggttagtttacctttggatggcattggcgccgggagctccttgaaggcgacggcggcgaggagcgggccgcagttgaggccgtcgtcgccgtcgtggtcgtcggcggcggcggggttactgaactcgacctgggcgttcctctcggcggcgcggaacccccacgcccaggcgtcggcggcgccggcgccgtagagcgtgcgcacggggacgtcgccgggagcggagaacgacggcgacacggcgacgcgcagcgcctcctcgcgctcgccgtcgcgcgcgcaggcgcgcgtggccgcgaacgtgagcgcgtacgccgcgccggggcgcaccgccaccgcctgcgccgccgacgcgcgcgctcccaggcggagcgcgtgggcgcccggcgcggcggcgaagtacatcccgccgggctgcggcccgccggagacgtactcgacgcggccgcgcagcgcccaccccggcagcgagtccctcccgacgatcaccgtggcgttcatcttccgggggctcatcgcgaagttgccgttcaccagcacgcctgaaaatgccattgtccttacattctcaaacatcacagccatgagatttacagccgcatcgtttggcttattcggcatatttataaatgaaaaataatttgtaaataaaacttttatatatatatatatatatatatatatatatatatatatatatatatatatatatatatatgtatttaacaatttacaaacaaaggctgaaaaataaactatgataaaaagacatcaaaatcaattccaaatttatattaaaaatttaaattttcacttgtaagtataagtataagcgaaaagttgagactgttaattatttattgcaagaagagagattcgacaacacaccattaccatcggcggtttgagcttgagatcgaggaggcggaggggcggcaacggcggtggccgcggaggaggagagaggcaggagaagaagcaggaacactctagccatgagctccattatttttgaggtttaaggtttagagtttataatgaaaaatgcagttcgataatttgattagagtgatgctgatgctgccatgtatatatacaggatggcagagaagacaacagtgaggaactgaggacacgtgtacttggaccggctaaagctgctttagagcaagtaacttgctgtaattaattactcatccactcaaaattactgaccactaacaaaaagaaagcagtgcacggtaac

SEQ ID NO: 5525 - DNA, 1501 bp, Oryza sativa
  unsure (1)..(1501): unsure at all n locations
ctatgtgcaccggactaccgcagatatttgagtttttgaccattcagactcagcataatctatcctactgattgttgaaaaaaagattcaagcttaagtgtttcctcaataaaaagccagcctacagctaaatttattatattagattatatattatctaatattaggttggtcttttttttttacggagtagtattttaaactcataggtttttttcgctacttgaaatgtggtgcagctgtagctagcaagaacagtttctaaagcatgaaaatagcagcggactgcagctgcactattgtagctaacaagtttcatagtgataaaatgaggttatttttttcttttccatgaataatattaataccataaggtaaattaataaattgttctttcaaaaaaatactctcttaaataatattattataacattgagacttgatgtgacctttcaaggaggcatttatttaaggatatttcgacacgagaattttatacaagattttcttagaatgtagtcacttcttttaaatttcatgtagaatccccttttcaatggagacataaggaatgaaaagtgatagcctcctaacttgaatcaatttgttatgatggtcattgatgtgatttatcgactaagccaacaaagcttagcatgtttgtcgctatcactttagtatgtgtaaagggaatctcattccacaacagataagttgaataaaaatccctccacgacttagattccaaatttcacaacaagcatataactttcacgagacaaacgtgaaatatccgtatcatgaattaccctcttttaaaaagtactagtctcttctcaatagattgatcggactaaccaccccattttacaccatttgcattcactcagccgtattatacctagtacgtaaatcagaatatacataaaaaaagctctaaaccaccgttaacctatcgtcaccgtccgcatgaacaaaccataaaacccgacctcaaaccacgccccatgaaccaatatatagacacaatcctacccgtaacacactgttggggcttcaatagtttcagtgtacaatcccatgtgttgacatagcctcaatcccacaaaacagtgcccctcccccctgtttgaggacccacagtggaattcaacccccccccccccccttccttttttncttctttcaaccacctttccctcccatcccctcccctactttctctctctaaaaactcccatgaaagaaagagagagagtgtgtgtgtgtgtgtgtgtgacctgagtgagtgacagtgtgaggctgtgtgtgagctagctaggaggcagctgctgtgctgcagccacagctcctgtctcctcctcacgagagaaggggagacgcgaggagctcggcggcggcggcggcggattggtcggtcgccggagcgagcacgtcgacggcggctgcagcgccaagaaagccaagaaaccaccggtgatgccgccgcctgccgcgttct

SEQ ID NO: 5526 - DNA, 1501 bp, Oryza sativa
cctataggtttatcctaaaaacctttcattttgcccacaaggcggatttttatcttagtttatctaaaacagctccagtagccggttttgatttctaaacccatcttgatcaggagttttatcaaggtcgagttgattgacgcttcgttcaaccccgtaaggctttaggtgaatcccgatcatgtgcggtggtgtgaccgaaaatggcgtcgaaaatggcgtcaacagatggtaatctttatatttcaccatactattgtttatacccttagtggtttaaaaaccaaaactgaaaaagaaaatggtgaaaattcatgcataataatttaaaatgaagttttaaaatttaaacactcaaaatatagcattcctaggagtaaaaatgtcaaaattcaaaaactggttaggactctctttgagagagctggagattctaagtagttagaatatgaaaaggctgggattactagcttctgattctagtttatttgttaaattatacggtaacaaattctcagaatctaagttatggagtaagttataaccaagaccgtttggggaagatgggagattttaggaagttggcacaatctccctccaaaggcaccgcaagcagcaagcgccacgcgtgagttcaccaacctgctttttcaccaatcttcatgctgaggggttgtttggttcttaactaacattgtcttaactcacattaggcaagtgtggcttgccatacttttttggcctacaaattgtaagccacacttgtggcaaagtgagacaaagcctatgaaatgtagggtaaggtgttaaaaagtgtggcttaccacaactacggcaataaaccaaacacaagactaaggggatatggtaacctaaactgtggtatggcaagttaaagtattaaaccaaacaaccctttaaggaattgcactgatcagacagtacttcctccgtcccaaaatgcagatagttttgaggttagcacaagtattaagaaattagatgagaatgattgaatgaaatgcgtgattggttgaaaagagaaaataggtgaaagagaatggttgtggttggttgagagggggaggtaggtgatgttagaaatagctatattttgagatggagatagtaggtactactagacagtcgttgtcacaatccagatacacgagtaatcaacaaatcttggtatcatgtcaggtcacagtgctttacaccgtgtatgtatgtcagttgcttgtaagggggataaagggtctgttgggggagcttctagctgctgcagcttctcccataatcagaagctccccaaacagtacagcttttggtccagagtctaagaagctatagttgtagaatttagaaaatgaactaaaagctagaagctgactaccaatcagctgcttctcataattttaagctcccccaaacaggcccaaagagaccattacatgcatggacaaagatggtgctcccatttacataatgataattacatttg

SEQ ID NO: 5527 - DNA, 1501 bp, Oryza sativa
gtttaataccacctcactagtttagcaagaatggaaccaacttataacgacttgttcctccaaacatatcactcccggataatcccttttacatgaagcgatggtgaaagtgtaaatgggtagtatgtataagtaggcccacccgtcagatgggctggctacgttgttctagagggtggactgttacaaactgagctcaaccaccaattataccgttcccaatgtgggaccaccaaagaggtagctagcaaagtacactacctaggcagcaagagatcaccagcggcacaagaacaggcctctagctcatggcttgaatgtgtgagaatcatagattatttatttctaatctataacatgatggctttagtctaaaatgatcaccctaattctaatgcggaattggataatggacggtgttttgttgacagacatggagatgttgttgatgctatgaatagtcgatagttttaagttggttatttaatttggatatagactgacaaatgattatattcttctaattgattaaattctacttttggatggttgataggattatttacaagttattggaagaacttgcagcatgtggggtatatggttatactacgtgacatatattcatgagtggagttcagagttttggcttgtctccaggcatacatatacctaggcacaagtccagcgcaaaagcatacaaggaagatcataacaacatgtttcccttctctggaaaattttgttggcaacagatgccttctccttctttcagcttctgcttctttagtcagtttggaggaagcagcaaatagttgatgatatgagaattccttctacatcggcttaggtgtagcaacacgactttattattattattattattattattattattttacaaaaatataaaatagatcagtccctcaccacaagtagagcaagttggtgagttattgtaaagttctacaaagctaatttaaaagttattgcattaacttatttcatattacaaacaagagtgtcaatggaacaatgaaaaccatatgacatactataattttgtttttattattgaaattatataattcaaagagaataaatccacatagccgtaaagttctacatgtggtgcattaccaaaatatatatagcttacaaaacatgacaagcttagtttgaaaaattgcaatccttatcacattgacacataaagtgagtgatgagtcataatattatttttcttgctacccatcatgtatatatgatagccacaaagttactttgatgatgatatcaaagaacatttttaggtgcacctaacagaatatccaaataatatgactcacttagatcataatagagcatcaagtaaaactaacactctaaagcaaccgatgggaaagcatctataaatagacaagcacaatgaaaatcctcatcatccttcaccacaattcaaatattatagttgaagcatagtagtagaatccaacaacaa

SEQ ID NO: 5528 - DNA, 1501 bp, Oryza sativa
agaggagggtcagctgtggcaagcaagcaagcagacgcgggaggggaggcgcgcagcaggcatggtgacggggtagggcgcagcggatcgagatgcgaggatttttttttgggggggtggggtggggggagagaaacgagtcatccaacccaacgcggatttagctagtttccagtgccttggaacagccgccgaaacggtgtcgcgcatgcgacctggtttctatgtttttgcttctttctcttcttttattccgttgccacatcaactttttgtctagttggcagcctaattaattctatggaaaccaggtgacatggagggttggggacatggtggaaaaaaccggaacgggccgacagttcaaccggaaaaaaccagaacccgttcagttcaaaagaaagaccggacatgcatatgacccgctttgaaccggcagaaccggtcggtttttctatgaaccggtcattaaaccgtccccggttagaccgaacaagccacaataatcttgaaatgggccttgatgtggcccaattggtctgcctagagcgttttggttggcaaaaatcaatctcctattctcggcacgtgtgatatacaatggtaagtgagatatacaattctcggcacggctacattacaaggtgtcgcattgtgtcaatgtttggttaatttgctagattcacataatacatgccaggaagttcagaacaatgtgttgcctttcaccggaaaactttgttggagcaaatgccttcttcttttttgcttctgcttcttgagtccatgtggaggaagcagtagatagctgatgatatcaggattccttctgtgtctgtgtaggtgtagcaacaccactataatttttatttagcaacacaatatcaatttggtctataaaagtatgaattaaatcaatccccaaccacaattagagtaagttggtgagttattgtaaagctctgcaaagttaatttaaaagttattgcattaacttatttcgtatcacaaacaagttttcacaagagtattaatggaacaatgaaaaccattgaacatactataattttttttcttactgaaattatataattcaaagagcataaacccacacagtcgtaaagttccacgtgtagtgcattatcaaaataatagcttacaaaacataacaaacttagtttcaaaagttgcaatccttatcacattgacacataaagtgagcgatgagtcatgtcattatttttttgctcaccatcatgtatatatgatgggcataaaagttactttgatgatgatatcaaagaacatttttaggtgcacctaacagaatatccaaataatatgactcacttagatcctaatatagcatcaagcaaaactaacactctaaagcaaccgatagggaaacatctataaatagacaagcataatgaaaaccctcctcatccttcacacaattcaaacattatagttgaagcatagtagtagaatcctacaaaaa

SEQ ID NO: 5529 - DNA, 1501 bp, Oryza sativa
ttgattatttttttctatttttattatataaaataatactccatctgtcccccatatatatatatatatatatatatatatatatatatatatatatgggggacagatggagtattattttatatatatatatatatatatataaataaataaaagaacctgatactggatgggataatccctagttaagttttttaagataatgataaaactttcagtatctaaactaactagacttgcacgctaaaatacctggatttgaacgaattattatggagtggctacttaagcccggtttcacgtattgataggagtatgaagtttgtgtgttaaattatatttgttctaaaattttggatttcatctaaataataggaaaataatgatttatttaaatgttattaatataatcgtgaatccagatctaacgatttatgaagttacgaatatcagtttcaaaaaattttggatctagagctacgtgcctatgtcgaagagggccctaatttatggtttctaattttattttcttctattatatgaaagatatatggcacatcctacttcaaatatgtcttttaacacatgttaaaaaagacaaaggctaataaaatgctctaacatcactgaaaacttttaaaagcgtgcttttatcgtagaggagatggtaataaataaagtttttgagaaaataagtccaagcatgcaaatttgtgcatcatcattcttcttcaactacgaaatacttcctctatctcataataagtttatttttagctcattttatttgttttaaaataaatttaattttagagtaaccattgcatcggagtttgtgaaagtagcgaacaattgtactccatttgaagtagataaaatcggaaatggttacattgagatttgataaattaagggtttgttaggcatagctctagctctatctctcctgaaattatagtccaatcaaacggtttcagtttcacccaaaatgcgagcggagttggttgaaatacttttacaaaatgaactagagatgtgaaactgggtttaggcagctccacctccacaactccatttcaaaccctaactcctaaagttaaatttaagatattgagccctatcaaatgagaagttaaatttataagttagaggcctaccaaatagaatgcgtgtttggtagggctccaactctcaaatttaactctatgagttggggtttagagtggagctgtctaaacctagctccacctttttagttcatttatagagcatttttgtcagcttcacttctttttgaataaagctaaaattatttggttggactctagcttcaggaaaaatggagctagagcaaaccaaatagttcatatatgttcttggcagctctttagcttacaagcttcagctatatttaaaatataaaggttggtttaaagttatttcaactttcttccgttgttttctatttttcagcatcatatcaactcaagtcgttaaaagt

SEQ ID NO: 5530 - DNA, 1501 bp, Oryza sativa
gattatttttttctatttttattatataaaataatactccatctgtcccccatatatatatatatatatatatatatatatatatatatatatatatgggggacagatggagtattattttatatatatatatatatatatataaataaataaaagaacctgatactggatgggataatccctagttaagttttttaagataatgataaaactttcagtatctaaactaactagacttgcacgctaaaatacctggatttgaacgaattattatggagtggctacttaagcccggtttcacgtattgataggagtatgaagtttgtgtgttaaattatatttgttctaaaattttggatttcatctaaataataggaaaataatgatttatttaaatgttattaatataatcgtgaatccagatctaacgatttatgaagttacgaatatcagtttcaaaaaattttggatctagagctacgtgcctatgtcgaagagggccctaatttatggtttctaattttattttcttctattatatgaaagatatatggcacatcctacttcaaatatgtcttttaacacatgttaaaaaagacaaaggctaataaaatgctctaacatcactgaaaacttttaaaagcgtgcttttatcgtagaggagatggtaataaataaagtttttgagaaaataagtccaagcatgcaaatttgtgcatcatcattcttcttcaactacgaaatacttcctctatctcataataagtttatttttagctcattttatttgttttaaaataaatttaattttagagtaaccattgcatcggagtttgtgaaagtagcgaacaattgtactccatttgaagtagataaaatcggaaatggttacattgagatttgataaattaagggtttgttaggcatagctctagctctatctctcctgaaattatagtccaatcaaacggtttcagtttcacccaaaatgcgagcggagttggttgaaatacttttacaaaatgaactagagatgtgaaactgggtttaggcagctccacctccacaactccatttcaaaccctaactcctaaagttaaatttaagatattgagccctatcaaatgagaagttaaatttataagttagaggcctaccaaatagaatgcgtgtttggtagggctccaactctcaaatttaactctatgagttggggtttagagtggagctgtctaaacctagctccacctttttagttcatttatagagcatttttgtcagcttcacttctttttgaataaagctaaaattatttggttggactctagcttcaggaaaaatggagctagagcaaaccaaatagttcatatatgttcttggcagctctttagcttacaagcttcagctatatttaaaatataaaggttggtttaaagttatttcaactttcttccgttgttttctatttttcagcatcatatcaactcaagtcgttaaaagt

SEQ ID NO: 5531 - DNA, 1501 bp, Oryza sativa; identical to SEQ ID NO: 5528

SEQ ID NO: 5532 - DNA, 1501 bp, Oryza sativa; identical to SEQ ID NO: 5527

SEQ ID NO: 5533 - DNA, 1501 bp, Oryza sativa; identical to SEQ ID NO: 5523

SEQ ID NO: 5534 - DNA, 1501 bp, Oryza sativa
aggtggtgtctaggagtcgtcagacagcctgtccagattcgtagtactagtaaatctcttatctgatcctaggttcttatattttgggacgaagggggtaactaacaccacatgctcatgctaaacgattggtttttttgcaggtcttgtttagcatatttactgttgccatggtgatcacctatgtttgcctggtaatccacgacgacctctccttgatccagacattgttctttctagtggtgtgggttatccaatggctagttatttttgtgatgacatacagcgcatttgatgatgcgaatcaagagtatcgcaaaagatacaacttggtcgtagtcaacgcttggttttgctagttcacattcaatagggtgagtactatgttatcaatatgtatatataggcaataatattatatttgtaccagagcatagagtgaccattgagcatggagttacctgaaaactgtcgacgggggagacccgtagactatattctaaggatatttgggtacgttggtatgaggatctacgcgatacgacatcaagcacacaaaaagacaaggattaactagttcaagcccctcgtaaggtaatagctctaatccagtttatatgggattatagaggaaaccacagagtacaaaagagaataactaaactccgagattactgacgagatccttgtcgagagggactcgacaagatctattggcgaatagacttcaagtcctccggattacttatgtggttgcgggtgtcttgcgctcaggattcaatgccctataccccttagggggtatgtatttatacctagatcaccttgatttccaggtagaactcggagacatcggaccccgcacgatacattatagtcttctctccctctgagtaggatagtaggatattgatatggccctacttgtgaaggatatttcccatacgaattgactgatttccttaactcacacgaatcctttccgtatatcataagataagacatattgtattcatatatctcaagactcataggatagagggtatgcattatcttttaaccctgacaaaaacaataccatcagcgaacacagcaaaccaatagtcatctcttgccaaaaaagatcataataaaaaattatcaaaattttctcagttgacattcagattagttaaaagcaagcattcacttaactacaatccacacacatccagcactaaaaatgaaaacactctaccaagcgttcagcaacaagatgttcacagcgtcacagaaatagtagaacaacatgtatttgaggtaagcaaaaaattatatacactttctcttgttctccatactcacataaacagtagcatatgacaatatgtatttgaggtaaacataaaattatatacactttctcttagtctccatacatttttgttctgatttgtatattgactttgtaatactgtaacagcttcagatgggcaaaatagaaacattccacctgttccac

SEQ ID NO: 5535 - DNA, 1501 bp, Oryza sativa
agagacggccggcgaaggaatctaccgtgcaccagcggcaggtgcagctgctgcatcaggtacgtgatcatgttcgtgttgaagccagccgtggcgaacctgtcgcacacatcgttcgctacattggcagagtagtgtgtattttttattatacttaaaattttatatatgtaaatcatgtccaacatccataactgaggtaagacgaataatttagttagttggactgtacacaatatgttaggtcatctaaatatccaatggttagaaatgatggactaccgaattaagtaaaaattgagagtcatatattttgttttttttctcataacttctactattttttttctaatttgtatccctatactgtacacatattcataattttctatgaggaattatccatagctatgaccaatcgatgtctgccatcaaataataaagttattatatattttttctatataaatcagtagaaccattaattatatatggtagtatatgtaatgtcttttataacttaggccatatttggttaatggggctaatgcattagtccctccattttagttcctaagaatccaaacaaggtgactaaaagtgcatattggattatataggggctaaagtgacagcctctttcttctttctccctcagtccacatgcctttagtcttttttagtccctgatccaaacagtatgggacaaactttttaatctgaggactaaatgatccaaacaggcctaagttttttctctttccatatgaaacttcaagagtcatgtcttaggtaccataagttaccaaccccaatcttcaataggtaattttataaataacaattaaattcattttgtaatgctaatgaagagactcatgaaaaacaatcacaattttgaaacattgcagatattatttcgctggtatactgtccctataagtttctcaaattcatcctacatacggtacatgctcgcgcgaatgcgcgggctaccttcctagttaataaaacaggaggatgatctgaactcgaatagattatgtacaggtgtatgtatagaatgaaaggagaaccacattatgtacaggtctattattatcttaaaaaaaagtgatgtagaggtgcacatgagtaaaatagttgtaattacgaatagttgtgaattgtttattcttcgattcatatcattatgattagaaatagagcttcaaaaaatattatgattcatccttcaggattgattagatcgagtccttactttacttcgggttcaaattatactacctatgtaaggcgatgaacacaacggcatagaagatctgcttagctccagtgcaggtccaaaatattgatgagatgcgggtgtgacagtcagtttgatcctgcaactgacataccgatataattatactagccgatgccaatactgaccaatgtcaatagggttttgagcaatcggctatatgttcaatgtagatttctacacttgagtaaataa

SEQ ID NO: 5536 - DNA, 1501 bp, Oryza sativa
tattaaaataaggcattcctccaaataaaaataacctggtctgattgcttgcgcgtttcaagatttttgctctggaaatacttagcataaccatagagtgagagctactattataatcaaaatagatgaactgaaagaacaaaataaactgaaatatacatactatctgtcagctgtgagtctgtcctaaaaggtttccagaaaccaaaaaagatatacttgttccttcccctattcaactaaggttgttcacttgcttactcaatgcattcccccaaactttcaataagatatacatgatcaatctttggccatgcgaaaattcccagataggaagtctgtcccttactaagctctctttgagccccaagtgtttcctttttgagctaagagctcacatctgaagtatctagacagttgatttttgagagaaacatgatcaaacaagagcataggtcatcatattgtgtttcaatggaatttttgtgtaattaactttcactttcaattaggctatgttaatatttattcttgaggccaggttgtacatcagtcaggggttcagttttcatgtaagctgaactctgaagtgcagcagtactgaagaaattttattgtttcaattgagcatctttgctaagtaaaatttatctcctaatgtccttttttctctcctagtggtgaaatttgagagcataaatggctaatttggaaggaattatccttaaaaggtagaccttttgctgaagcaaaacagaaactcaggattcaggcacaggtgtgttcggcacccaagtttcccaaccactctccctcgttttccgcgcgcacgcttttcaaactgctaaacggtgtgttttttaaaaaagtttctatacgaaagttgctttaaaaaattaaattaatccatttttgaaaaaaaatagctaatatttaattaatcacgcactaatgaatcgctccgttttccgtgcggcacccatccagggaatccgaacactgccatatatttcggttcccatgctgacagaatcttgtgatactacaccccaaaaatccacaccaaactagctaatcaaccacaagcaacctgagtagaaaacatccaaagatttccaacacgtatcggcgcatataaatagctcccctgatcaaaccaatggtctccatcaatcaccacatcaagaagcagcacatccactttacttcatctctgacttgtcataacttgtcaaatttagtctgagaaatggcctccactgtgctcattgtctctgcatctctccttgcactcttcttcttcttgcatagtgctgatgcagatgttggcagtaatgtgttcagcatacagagctacggggctcatggagacggacgacatgatgacaccaaagtgagtacaatgcaatgacaccagaatatgtcaaaaggtttttggttcaggagcaaatcatagtttctgagatctaaccgttgttttttcttgtgtcaccttgcatag

SEQ ID NO: 5537 - DNA, 1501 bp, Oryza sativa
gtcaaagaaaaacaatctcctattcttttataatacatgtgtcatcatatatttttggcatgatcttgtgtgtgcatatctgtggctaatctacatgtcaatatatcttctcagaattttcgtaaattgaacaggtgcaaattcaaaaacttgggacacacatatttttattaaaataaggcattcctccaaataaaaataacctggtctgattgcttgcgcgtttcaagatttttgctctggaaatacttagcataaccatagagtgagagctactattataatcaaaatagatgaactgaaagaacaaaataaactgaaatatacatactatctgtcagctgtgagtctgtcctaaaaggtttccagaaaccaaaaaagatatacttgttccttcccctattcaactaaggttgttcacttgcttactcaatgcattcccccaaactttcaataagatatacatgatcaatctttggccatgcgaaaattcccagataggaagtctgtcccttactaagctctctttgagccccaagtgtttcctttttgagctaagagctcacatctgaagtatctagacagttgatttttgagagaaacatgatcaaacaagagcataggtcatcatattgtgtttcaatggaatttttgtgtaattaactttcactttcaattaggctatgttaatatttattcttgaggccaggttgtacatcagtcaggggttcagttttcatgtaagctgaactctgaagtgcagcagtactgaagaaattttattgtttcaattgagcatctttgctaagtaaaatttatctcctaatgtccttttttctctcctagtggtgaaatttgagagcataaatggctaatttggaaggaattatccttaaaaggtagaccttttgctgaagcaaaacagaaactcaggattcaggcacaggtgtgttcggcacccaagtttcccaaccactctccctcgttttccgcgcgcacgcttttcaaactgctaaacggtgtgttttttaaaaaagtttctatacgaaagttgctttaaaaaattaaattaatccatttttgaaaaaaaatagctaatatttaattaatcacgcactaatgaatcgctccgttttccgtgcggcacccatccagggaatccgaacactgccatatatttcggttcccatgctgacagaatcttgtgatactacaccccaaaaatccacaccaaactagctaatcaaccacaagcaacctgagtagaaaacatccaaagatttccaacacgtatcggcgcatataaatagctcccctgatcaaaccaatggtctccatcaatcaccacatcaagaagcagcacatccactttacttcatctctgacttgtcataacttgtcaaatttagtctgagaaatggcctccactgtgctcattgtctctgcatctctccttgcactcttcttcttcttgcatagtgctgatgcagatgttggcagt

SEQ ID NO: 5538 - DNA, 1501 bp, Oryza sativa
tgtcattgtcggtgttaaacaccacagcgtattgcttcgttggtttctcgttcctgacggacaccttggaggcgcgagcgcccctccgctagggctgtcgacgagccgagctcgagcgagctcgtctgtctaggctcgagctcgatacaaactcgagctgagcctataaaatgttcgagctttctgacaggctcggctcgagctcgaccaagctcgagcttaactaccgagcttgatttttaagtaaaacaatatatatttcaaagataatctttaaaaaataattaatttctagttcatcatattagtagaagaggaaaaaaaaaataaatatataatgtcaatataaggcatacaaataacttattagatcttctaatttataaataacaacaaaaattatgtattactatgctcgttggaagctcgagctcggctcgacaaagctcgcgagcttagggaaaggatcaggctcggctcatctggagctcgagcctaggacgagccaagctcgagcagcttgcgagcctcgagcttttttgacagccctaccctccgccgactattaggcttcctccctgccaccgatgaacctaggcggcatcgaccactaggtgatgaccaacgtggaggggtcaaaggcagatgaagatggtgatgaggttggcgaggaaggccatgcagggtccttatgtagcattgttgccgatgtcaaggagccagaagctgatgaggtagacaatgatggcatcgaggcgggtagagcacagggtgatggagtcgccgaagattcgaacgaggtcagtggagaatctgacgatgagaacaatggcggcgataatgaaggggtgctgacgaccgaggctggcgaatgtgtacgggatgccaaggtcctagacatagggggtcggtagggagagttgcagcgccactcaaactgcacgccgcatgccaccgacaccgcacgtagaagcttccatatggagggcactagagatgggaagagaggagggggggaggtataataagaagattgggccactgacatgtaggtcccacgctgacttaaccgcacgttagccaaaactgttctcagtactaccttgggatctaatgtgactcggttttacaagattaggtatgcaagcattccggtccagggacggttttgaaactcgatgacaggatgagtgacctcaagtgaaccttttccacttgcagaacactagacatcacagcccaagtcttacccaccacaagcccaacacaccacactttaggctccttaggcccataaccatctacctatgagcccaaaaactacggcccaattaggcccacggcttggcccaacttctcagcgaaaaccctaaccccgtcgtctccacggccaccttatataaaaatccgccgccgccgccatcctccctcctcccctccgctctcccacccttcacgccgccgcatctccacgccccggcgatccgagcacaagcaagca

SEQ ID NO: 5539 - DNA, 1501 bp, Oryza sativa
tctccatgagccccgtagctctgtatgctgaacacattactgccaacatctgcatcagcactatgcaagaagaagaagagtgcaaggagagatgcagagacaatgagcacagtggaggccatttctcagactaaatttgacaagttatgacaagtcagagatgaagtaaagtggatgtgctgcttcttgatgtggtgattgatggagaccattggtttgatcaggggagctatttatatgcgccgatacgtgttggaaatctttggatgttttctactcaggttgcttgtggttgattagctagtttggtgtggatttttggggtgtagtatcacaagattctgtcagcatgggaaccgaaatatatggcagtgttcggattccctggatgggtgccgcacggaaaacggagcgattcattagtgcgtgattaattaaatattagctattttttttcaaaaatggattaatttaattttttaaagcaactttcgtatagaaacttttttaaaaaacacaccgtttagcagtttgaaaagcgtgcgcgcggaaaacgagggagagtggttgggaaacttgggtgccgaacacacctgtgcctgaatcctgagtttctgttttgcttcagcaaaaggtctaccttttaaggataattccttccaaattagccatttatgctctcaaatttcaccactaggagagaaaaaaggacattaggagataaattttacttagcaaagatgctcaattgaaacaataaaatttcttcagtactgctgcacttcagagttcagcttacatgaaaactgaacccctgactgatgtacaacctggcctcaagaataaatattaacatagcctaattgaaagtgaaagttaattacacaaaaattccattgaaacacaatatgatgacctatgctcttgtttgatcatgtttctctcaaaaatcaactgtctagatacttcagatgtgagctcttagctcaaaaaggaaacacttggggctcaaagagagcttagtaagggacagacttcctatctgggaattttcgcatggccaaagattgatcatgtatatcttattgaaagtttgggggaatgcattgagtaagcaagtgaacaaccttagttgaataggggaaggaacaagtatatcttttttggtttctggaaaccttttaggacagactcacagctgacagatagtatgtatatttcagtttattttgttctttcagttcatctattttgattataatagtagctctcactctatggttatgctaagtatttccagagcaaaaatcttgaaacgcgcaagcaatcagaccaggttatttttatttggaggaatgccttattttaataaaaatatgtgtgtcccaagtttttgaatttgcacctgttcaatttacgaaaattctgagaagatatattgacatgtagattagccacagatatgcacacacaagatcatgccaaaaatatatgatgacac

SEQ ID NO: 5540 - DNA, 1288 bp, Oryza sativa
aaacatgtcgctaatgttgcagcaaactgatagttttgttacttaagttgtagttttctgaaatttactcattgaaatattatgttaattatgtgacatgatggtttgcggaaacaccagggatcggtcgacctgcagggggagcaaaaatcgggcgctccccccgccgcacgacgcgcgcatgccgcgctagcccaccacgcaccacgtgtgcccctgtaaacactcgccacatgtccccaccacatacttcgttgcaacaaattacctacatattttggaaatcgtatattaagggaattcgtttcaatttttattccacaaaaatatttcacctagtgtactcataatgcttcactataaatagatctaatgttgtagtgaattcaaacattctgttgtaacaaattacccacatcttatagaaactctctgttaagggaattcgtttgtttttttgttccacaaaaaatgtttcacctaatgtacttgtaatgtttcactatatatgaatcaaatgttgcagtgacttgaaacattctttcgctatttgctgaaacattgtttttatataaggtgaaacaatgcccgatttaaacgattgaaacatttttgatctacttagtaaaacaattccgatatacttggtgtaacaacgtgcaacatttaaaaataattcaataataagctaaatatttttttcattggaaaatatccatgtgcgttcttgttttaaatatttaattgcaacaaatttaatggtgcaatcggatcatgaatggatagataatttaagagaaaaaaacatgcatgcatcttgttgacgtcagcatgacgtgggcgcccgatttaccactccccatcgggctctcgacgcctagtcttctccgatgatttaacatgcttgcattttaaaatctttaaaatttaataattataaaattatagattatatagcatgtttgcataatgtttaaacatagataatatagtatgttttcgtgatgtttaaatgtaataattgttagtggataatgatatgtcatcttgttagtagaagatgatgtggcatcttttcttgttaagctttaatatttagtgggttgtaactttatagtaagaggatgttctccggtagtcatatgaaaggtcatatgaaagggatttattttagtcttatagaagtgtaatatcagtctaagaagttcttattagtatatatgctaggggtaaaaaaaaagaacctagtcctacttatctagatttgccttttttcctcacctttagt

SEQ ID NO: 5541 - DNA, 1501 bp, Oryza sativa
tgcaagatcaccaacaacggcgactcgttagcagcagcagcgaagagcggcagaggagggggaggaggaggaggaggggagacccgaagcgccgacgtgcttcccagcccacttctcccacgaccggcgcgcccacatccagtccgcggccattgcgggggcggtaaggttcgccgccggggaggcttgcggcggtggggggtaggggagcgagatgcggcggcggcggcgtggctgccggcggcgatggccaagtccccctatgatgtgagggggtttgctccggtggagcccggcccaataggcccatataggcctcctatcggcccgtatcctcctatcccagaaattggaatattagggtttgccggtttgggttgaaattcgaatttgacataaagcgagcggtttggaggagaggtgaaatttggctggtgaaatccaaacgaaatattggacccttgagaaatgatgcacaccgtttaatatggagtagaacccacgcacaattcgaaaatagagaaagtattgggtggatacgccagcacatggagggaggggctgaaatttttttgctactatcttagcttagcatgtgcgtccaaaacttagttccaaccatcttagggcatgtttagatccctagcaagttttttcatcctatcacatcgaatgcttggacacatacatgaagtattaaatactagaaaaaagaaaaactaattacacatgttgtgtttaaattgcgagacgaatctgtcagggttatggataccacatacacaatagtaatcgactaagctcgacggggcccaccacctaccatgtcttatacggaaacaaacctcgtatatagaaagagttccggataagaaaggacaagaatagttctacatggaaacgacaaggactacttaaatcgtattcatatttatctccctagtcttacttggacaagggggcatctatgggtataaatacaaaccctcctaggaggagaggggacacatccaccaaaaagccacaaagccacaagccaacacacgccgttagatatcgacatcagagagtagcctagccatacgccatccggtgcctacggaagcgggcaagagggatctagcgccatctctgatctcgctgagtacagattcaaggaggaagactacccctgtcgtcgactacaagttggttatctagctgccaagtcgacaacgaccagatatgttatcccaaatattgtatttgtgtgatccagatgaataaagagcaacaccggcttcggtcaacaggatgtagggctattacctattagataaggggtccgaacctgtataaaaatcactgtttccatctcttttacctcaatctcgcatataccctggtaccaacgatccccataccatccaaacactgtagtcgcgatatcaaacgtcgacaatggcgtgccaggtaggggaattttggtgcttcaagatttcgacgagatgggttcaaaaga

SEQ ID NO: 5542 - DNA, 1501 bp, Oryza sativa
taatggattagttataaagttggctacaactatcttctcctccctctatctctcacctatgcatttaatgtatttgcctagaaacttgtattaagctagctcttacatgatagccaacattcttgattttttttgttataactcactattatacttgctctaatctatccacccgtcgcgaatcaatgccctgcctgctcctgcttgttgcggccggaggcttggctttgctgctattgcgtgatccacggcttggatatgtgctgctgtgtgcttgcacgcgtgagagggatggagagagagagagagagagagagagagagagaggtgggaaggttacatcagccgaggccccgcctcgtcagtggatggatggatcctttcgtgtccttgggcttccgtggggtgcaaactgcttcgtgtttttgtaataaaccccctggtttctgaggaaatgctcctttgtaatatgagaaacgcttaggctgagttagtttccttgctttgccaacccatctctcttatttttcacgcatacgcttttcaaactattaaactatatgttttttataaaaaaaatataaaaaagttgcttatactaattattttcttaaagaagctaatatttaattaatcatgcactaaccatcacttcgtattgtgcgctcacccacaaactcagcgtaagagcaatccccgcatgattattgttgaaagctggagttgcgtatagaagagaaataatgcattaaaccttcacaatacatgctataagtagctatagtgttttaatgtgccacggagatcatcctagatacatttatattgagacgcatagagtagtttgtaaaagttgaattttatatacatagagaaatataatagatacccatatttgtttttaggccaatagtcgcgccaaaataaaactacttacattgtctcggtcggctgcctggtgtagcgctgccatgcagccagtcgactgttacaccatgcagcaaatgaagctgccgtagacgtcaggcgagctgcaaggcaacaccataccttgtagccaaacaagcctcatatcttagtgcgtgcggttttgttgggcccaactattttggagccgtcgccaattataggtctggaatataaccccctttatttagattttctttcttcccgttaacttaggtgttatagccacgccaaattttggcctatatggaaatgtaattaagtctatagataacatattatgtggagataagaatagtacaccctccagttcttttttaactgacattatagcttaatagcttttgtatgggaaaaatcgacgttttagctcaaggctcagtttcccagcactatccttgcatgcatgcaaacacaatacactcccgaggcaaacatttgttgcttggtttccatctgtgaccaacagctggtactccaggagtaaagatgcatgcatctgctgcttcattttcatcctcgaatgtatttaata

SEQ ID NO: 5543 - DNA, 1501 bp, Oryza sativa
tctagtcggttggcaaaccgacgtcccctgcgacggcgatgacttgaatcttggttgatctcgaattgttgatgacgatggttccgatctcgtcgggacacgtactcttgccgggttggatctccttggtccaaagtagttgaagtatctctcatcaaaaaatccatagtgacgcggccatgacgaagcttgagatgacgagggtcccgatccgccagataatgcacttcggttgggttggatcccccctatagccgaagtcgtcgagtagctcgttattggagaatccatcttttgaacccatctcgtcgaaatcttgaagcaccaaaattcccctacctggcacgccattgtcgacgtttgatatcgcgactacagtgtttggatggtatggggatcgttggtaccagggtatatgcgagattgaggtaaaagagatggaaacagtgatttttatacaggttcggaccccttatctaataggtaatagccctacatcctgttgaccgaagccggtgttgctctttattcatctggatcacacaaatacaatatttgggataacatatctggtcgttgtcgacttggcagctagataaccaacttgtagtcgacgacaggggtagtcttcctccttgaatctgtactcagcgagatcagagatggcgctagatccctcttgcccgcttccgtaggcaccggatggcgtatggctaggctactctctgatgtcgatatctaacggcgtgtgttggcttgtggctttgtggctttttggtggatgtgtcccctctcctcctaggagggtttgtatttatacccatagatgcccccttgtccaagtaagactagggagataaatatgaatacgatttaagtagtccttgtcgtttccatgtagaactattcttgtcctttcttatccggaactctttctatatacgaggtttgtttccgtataagacatggtaggtggtgggccccgtcgagcttagtcgattactattgtgtatgtggtatccataaccctgacagattcgtctcgcaatttaaacacaacatgtgtaattagtttttcttttttctagtatttaatacttcatgtatgtgtccaagcattcgatgtgataggatgaaaaaacttgctagggatctaaacatgccctaagatggttggaactaagttttggacgcacatgctaagctaagatagtagcaaaaaaatttcagcccctccctccatgtgctggcgtatccacccaatactttctctattttcgaattgtgcgtgggttctactccatattaaacggtgtgcatcatttctcaagggtccaatatttcgtttggatttcaccagccaaatttcacctctcctccaaaccgctcgctttatgtcaaattcgaatttcaacccaaaccggcaaaccctaatattccaatttctgggataggaggatacgggccgataggaggcctatatgggcctattgggccgggc

SEQ ID NO: 5544 - DNA, 1501 bp, Oryza sativa
acaagaacacatgaacatctaatgatacgtggatgatgaacatactgtgtcaacgaagctctgataccatatgatgcgaacatactcgcgaggggtggcccaatcttcacggcagtaggtttgaagcaaaagagcaccagcgcaaaccgtactcaagaggataacaagctacgagcagcaagtggataactagctttatacctagcaaggtcggatgtgaccaagtggtgagggcgaaaatgatccgaagcctcctggactccgacccgtcacaccgagcaatcacagaaccataatctggaataactagctttttacctgccaagattggataccacttccggaataactagctttataccagccaaggttggatgcgaccacttccggaataactagcttgcgaccacttccggaataactgcttgatacctgccaaggttgaatgcgaccaagtggtgagggtgagaacgatccgaggcctcctgtactccgacctgtcaaaccgaccatcaaaccgagcaatcacagaaccacaatccaggattaatccacacaggaggcctgagagccaaaagcacgaactagggggcaccagaggagccttctaacaagtctaaaagaactcacaagaacaaaggggtaagacacttatgcatacatgaggttttcaattgaataaaagttctctaatggaaggaatagaggggtatttttattaggaacatccctcctagcttaggtgtgaacataagaagccacgttctggtggtcaaggctaacataaatgagaaggcaaagtgtttttctcgggttcgcgcatagcccttcagctcctgcgcagccttcagtaaaaatgctataacttcttattggataaagatattgaggtgggatttgatgcgttggaaactagacttgtccctctttcctgcccagccttcattaaaaatgctataacttcttattggataaagatattgaggtaggatttgatgcgttggaaactagacttgtccctctttccaacaatgtatgccatgcaatccgtcacttgattggctaggtcgcacaagccttggaagttgagtctttacaacgtaaaccatcttcttgttagcatagacagctgctggttgggcatgggttgattcctcctcggcataacccttgtcgtcctcaacgtaactcatccttcttgacgtagtgatgatatcctcaggtgtaaaccttagcaatacaaggataaagcatttaggtagtataaaattctcactaaaatttgggttaagatgagtaaatagtgagttcacctcttgatgtattttcctagcacggttgcacgtaattagaccaagatatgtttgatcgttcatgctgagacataatccattaacttggtttacatcaagtgtagctgggatgtcctcatgagtgtatagatagcaccaaataaatctagcatcaagtctccaatcagaaacaaagagaaatgatgttt

SEQ ID NO: 5545 - DNA, 1501 bp, Oryza sativa
tcaatatgttggtgatgtcttacatcgtaaatggaagtataaaacttttgttccctttacactactggagaaatcatctttgctgggttggtaaaaaaatatattagccctggttccaatagtaaccgggactaaaaaaaacatttttagtcccggtttaaaactccaacgggactagatgacctttagtcttggtttaccctcttatagagtctctgccttgtcagagggttatcaggggctagggagccgagaatctttagtcctagttggtgttaccatccaagagtaataatgataaaagttaaagttgtcgtttatttaaaaatgagagattaacatgtaccacgtcaaataacaaaacaatgaaaacatataatcgatataatgattctcatttcatatcttaaccattatattttataaacccgtcgaaaacttacgatagttattttagaaaaaattcgcttttatattttaaggatagagggagcaccgttcttgtgagaatattggtaccggtagcctgggactctttattagtaccgatcagccaaccaaaaccttgtgttagattaggataattattcaagacggcgtgtcttgttagcctttcttcataaagctccgcccatggacatatcggccaggcttcttctgcgattgaaaacgacgcaggcgtctctcatgttaaacattcttttgtataggatatagcaggtgatttatcttgtacttaactggtagtcgaaattttggcaatataaaaagggtaacgaataagctataaagtggatgggttaggaggcaaagctctatagatactctataatcataactgactaggactacgggacatgatataaaagttaacataatacccgagtccttatctatatatattctatccatatgaactatcccctataccagtcggatagcatagccatatggatatacggtatccataatctctgatgtggataagggttctcggtcttccgaaaggttatcgtggagattatgactaccgtatatccacatggcaatgctatccgactattataggggatagtttacgtatatggaatacgtatagataaggattcgggtattatgtatacttgtgtatcaaggtaatgtctgtagtcccagtcggttacggctacagggagttctagaccgtaagggatagagttccatattgtgatccgagctcctctacctatataaaggggggtcgggacgtccccttagagtagatagaacatcatacacaatcatattttccatcaatacaaacacggtgaaacatctcgccggataggagtagggtattacttcttattgagaaggcctgaacctgtataaaccctttttgccatctaacccatccactttcttagcttgtacgcaaccccttttattattgccgaaatctagtttcgacagttggcacgccaggtaggggtagcgtcaattttttcgccgactagtgcga

SEQ ID NO: 5546 - DNA, 1501 bp, Oryza sativa
aatgatttaatttattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcacaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgttaaaggcagaggttccggagacctgctctcccgatcgctggtgcacgccggcgagcgggatggagtagtctacgagcgacggcgcagtacagagtaggaggcaaaccctagattgattttcgcatatactgcgtgaagacggcgggtcggtttatatagagaagggtcgcttgatcagggcgcccgcacgatctctactgcgcgtaaccgaaccggataagtcgcgcgtaacatatactgcgtgaagacggcgggtcggtttatatagagaagggtcgcttgatcagggcgcccgcacgatctctactgcgcgtaaccgaaccggataagtcgcgcgtaccttatccgaactccacgccgtttgcacgcaccggatttttcggaacgtttccaaaacaaaaacgaatccgaatttgcagcaaaacaaaactgcaaaagaagactgcatctgcgcaagggtgaggagccaatttttcggaccattcgacgcgtacatcgtgcacgcgcgccgcctgccaggccaggcgagcgagcgcgcgcgtgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacattcattgcctcgggttataattaattcatgatttcactgcttcgatgagctgatccatctatcgattgattgatcgtgcaggagctgaacgacaagaagaggctggcgacgagcggcgccaacttcgcgagggcgtacaccgtcgagttcggcagctgccagttcccctgaagtaacagaagcatcaacaagcagcaccaatagaggcaggtctgctgctcgtcgcggttcctcacaccgccgctcttcgccatctcgtcatcctcgtcgtcaatcgcgtgtcggccttgtcgctcactcgctcgtcgtggatctgcttgttgcccgtggccgcttgtcgctcccgctccccgcctccacgggcgctcccgctcccgctccctgcctcatgcgcgctcgaccatctcaaccccgcctgctccgccaccgccgccgcctcggcccagcagcaggacact

SEQ ID NO: 5547 - DNA, 1501 bp, Oryza sativa
aatgtaagggtaacaaagataataacatacagaggtgttaaatctaaaccacttgtagaagtagtaaattaggagcaaagcttgcatgtagatgtagtagtaaattaggaacagatattgaagtgatcatcatatcataaataatcttatctgattatccacaggcacccctcatcctggccctccacgtgtacgttgctgatgccttcccaatgacggttgagggtgttttggacaattcccatagctgtaactgtcatatggaggctataaatagagctctccttcacacttcacaacacacaactttgagctgaattacaagaggctctattgtatcttttgtacattagaataaggtagaaagtgagggaaagctctggaggggtgcccggaaggtttggcgctctctccgacttctttctcgacgagtgtagcttcctaggaggaattctggaggagtaccggagctgtcggtacactctgctccgggttcggagaaccttcttctattaggtaagctgttcctttcttatgttatttaattatttagtctgagtaagatatattttcatctttgcgggttcattgtttagtattcatattaagtgctctagtactatgactctggataaagaaggaagttcctgtacaagtattagagtagtaattaataatttagacgtggtttctaggttagagattacctttgtttgttgtgtatcccacggatttgtcagaggtaggcggcaggtggtgacagccctgaatctcgtcctagtaatcctccacgttcggatacatcatggagctatagccggaaccacactggcagaccagtaggggtcggtgcctgaagcaaccgataggaaattacctttgcttagcttagataattaaaacacatagaaagtcctctctagcctgcctagcctacctatagttgttgtccttggattgttttagccttaggtagattacacacgttccctgagttcgatatacttttggggtcacccgaaggtgaagtgctatagcggtattccgtgcgcttgcggatttacctgtggtcgtaagaaataccaacaatgagtctacaacttaatttcttccaaaactcttcttgccgattttaacttaaactcctttcattttgcagaaaaagaagctagctgctagaaagaaacctgcaccacctccatcggtaacatacctttacaaattagtaaaatttgccacaggacacgtaaaaattgtggtcttttctgtgggacactcgaagattgtgtatttgctcgtggacaccgtaaaaatgtggtaattagctggaggacagcggtcgtattattttattatttgttgtcgaaacagagagagaaagagcgttgaaattaccaaaatgcccctgcacactgttcttcttccttctctttgcttctcttctctttttcttcttgcacaaacgcacgcttgcacgcagctcaatcgagccatggccgga

SEQ ID NO: 5548 - DNA, 1501 bp, Oryza sativa
gtcgagcgcgcatgaggcagggagcgggagcgggagcgcccgtggaggcggggagcgggagcgacaagcggccacgggcaacaagcagatccacgacgagcgagtgagcgacaaggccgacacgcgattgacgacgaggatgacgagatggcgaagagcggcggtgtgaggaaccgcgacgagcagcagacctgcctctattggtgctgcttgttgatgcttctgttacttcaggggaactggcagctgccgaactcgacggtgtacgccctcgcgaagttggcgccgctcgtcgccagcctcttcttgtcgttcagctcctgcacgatcaatcaatcgatagatggatcagctcatcgaagcagtgaaatcatgaattaattataacccgaggcaatgaatgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctggcctggcaggcggcgcgcgtgcacgatgtacgcgtcgaatggtccgaaaaattggctcctcacccttgcgcagatgcagtcttcttttgcagttttgttttgctgcaaattcggattcgtttttgttttggaaacgttccgaaaaatccggtgcgtgcaaacggcgtggagttcggataaggtacgcgcgacttatccggttcggttacgcgcagtagagatcgtgcgggcgccctgatcaagcgacccttctctatataaaccgacccgccgtcttcacgcagtatatgttacgcgcgacttatccggttcggttacgcgcagtagagatcgtgcgggcgccctgatcaagcgacccttctctatataaaccgacccgccgtcttcacgcagtatatgcgaaaatcaatctagggtttgcctcctactctgtactgcgccgtcgctcgtagactactccatcccgctcgccggcgtgcaccagcgatcgggagagcaggtctccggaacctctgcctttaacgtcctgcaccgggagaaggcggcaataaggtttttgggaagcgcttcgcgcgactgctccctgttcgttcgcgacggctcgccttcctcttcgctcgcgtgtttcgtgccttcgtagacacctgtgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 5549 - DNA, 1501 bp, Oryza sativa
tataaaatatatttaaagtttaaacacaataatcataatcataattctttaaaaagaaaaatttaattgtaatatcattttagcccaatccttttcttagacacgttactatgcagcccgttactatgcagccaatttaagaattaaaccaaatataatttaatttttttattgaaactttagctgggcctcttccccgagctaggccgcatttggcctggcccatcacagccgcgccgcctcccgcctgggctccaggcccaacaacctgggcctgggccggcgttcgaccccttacgcacggcctcgtcagcctgcgtcgggagcgagccgatccgagccgtccatctcatcggacggccgggatcgctcccgcgcgggacaaaaccggcgcggcggccgccccccgagaaaccctagcccccattctctcctcttctctttctctcacacccgcggcgacgtgagcgagacgacgacgacggcggcgaaacggcgcacgacggggtcggtgatggtgccaccgagccttgctcgccggggctgcgtgccgccatagctggcgcgcatccccgttgagcgttgctcgacggtgccctaatgtacccgccggtcgctcgcgcaagggagatctgcggcagcgacggcgagacggggccggcaacggctacctcagcgacagcaagcatgcaaggaggagccgggccagcacggcgggtcacgaggccgctcggggaccaagtcctcgagcgcacgctcgcctcttacagcgtcggtggcgacacggtggttgccaccggccaccatggcccttaggtaagcccgccgcgctccttttccccatgattttagggttagggtaccatgatttggggaatttttttttggggggggggggtttactgttgctagggttttggttcttggggaatttctgagatttgcatgaaatttgccttccccttcttctattttcttcaagccgaaaccctagtaggcctaatttcgtttcttatacctcaggattgcatgatttgggctcaattcaactttaacagagggatttgggcatgaacacgaagaacaacttgaacataaacactaaaacaaatttaattggattgcacagaacacttactgagttccaatttgaggccaaccttgctctgataccattgttggattgcatgatttggatcggtttggcacaaaatggaactacaaattggaatgggattgggtcataccttgatctccaggagttcccatgtctctgtcttttgttcttctttcttctcttttcgtttggaagcacagagataatcgtgtctcggttcttccctgtgttttcagtgggttttgcttgatcgggtagcaaaggaaaacttagggtttaatacttaggtatttatctctatttatagccactatacacagggggaaccggcactagaagaggcggtaaatcccccgatcagggatgttcttgagaggtcgatca

SEQ ID NO: 5550 - DNA, 1501 bp, Oryza sativa
cagacgtagctgtcagcgcaagacattatcatagttgattgattatttctaaatgccttttagaacatggataatatcttgatccgacttctgaggttttcaaactcttgttgcgttactgaaattgtgtacaggctgagaaacctgtagaccctagcaatgaggaagagaagacgaggtcttcagaggatgatgactctggcggggagggcactgctgaggcagtccggaccatacagccgtcagtgctgaactggaagtacatcaccgtggcattcctgatcttgttagtcgctgtcttcatatacttgccactcccagaagaaagcagctccgtttgaagaggccaatgcaatgatggctaatgtagtctgtagtgtgtacactatttacatccctgttttttttttctttgtttgtttcaccccctttctgctcatagaataagcaatttttggtgctgtagactgtgatatgtagtgttcagatctggcctgaactcggtagtgatgcactgatgctcctggatgagtgattgtaaactcttagtttggctgccattgcccagtcttttggcctctaagacaaatggttatgacttgtgagttgtgactagtaaatttccttctgttgattctaattatctgtagactaacactaagaatgatgacgtacggtactgagcggaaactcttccaaagctcctgtattgatgctaagtgccatcagaattatccggtacagctgaaacttgtgacaggaagcattcctaagggctgttcaatgcgtgcccctggatcgttccccagctcacaccgtccgcgtagaggtggccaaatgggccgggccaaacgggccgcgcgcggcacggccggacctgtagcaggcacggcccggcacggcctgctacagtaacgggccgtgccggcacggcccgtttggccgtgccgtgcttgggccgctggccgagcacgcgggccggcacggcacggcacggctactgtagcgggccggcacggcacggcccggcacggcacggcggcggcccgtcaggcgcggcaggcgggcggcggtccaatgggacggcgacacgtggcactaacggctatttgaccgttgaaatttgaaaataaccgttgggaggctaaaaaattcataaaaattccgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 5551 - DNA, 1501 bp, Oryza sativa
ctgtgcaatccaattaaatttgttttagtgtttatgttcaagttgttcttcgtgttcatgcccaaatccctctgttaaagttgaattgagcccaaatcatgcaatcctgaggtataagaaacgaaattaggcctactagggtttcggcttgaagaaaatagaagaaggggaaggcaaatttcatgcaaatctcagaaattccccaagaaccaaaaccctagcaacagtaaaccccccccccccaaaaaaaaattccccaaatcatggtaccctaaccctaaaatcatggggaaaaggagcgcggcgggcttacctaagggccatggtggccggtggcaaccaccgtgtcgccaccgacgctgtaagaggcgagcgtgcgctcgaggacttggtccccgagcggcctcgtgacccgccgtgctggcccggctcctccttgcatgcttgctgtcgctgaggtagccgttgccggccccgtctcgccgtcgctgccgcagatctcccttgcgcgagcgaccggcgggtacattagggcaccgtcgagcaacgctcaacggggatgcgcgccagctatggcggcacgcagccccggcgagcaaggctcggtggcaccatcaccgaccccgtcgtgcgccgtttcgccgccgtcgtcgtcgtctcgctcacgtcgccgcgggtgtgagagaaagagaagaggagagaatgggggctagggtttctcggggggcggccgccgcgccggttttgtcccgcgcgggagcgatcccggccgtccgatgagatggacggctcggatcggctcgctcccgacgcaggctgacgaggccgtgcgtaaggggtcgaacgccggcccaggcccaggttgttgggcctggagcccaggcgggaggcggcgcggctgtgatgggccaggccaaatgcggcctagctcggggaagaggcccagctaaagtttcaataaaaaaattaaattatatttggtttaattcttaaattggctgcatagtaacgggctgcatagtaacgtgtctaagaaaaggattgggctaaaatgatattacaattaaatttttctttttaaagaattatgattatgattattgtgtttaaactttaaatatattttataatgctttagttaataataataaaaataataagtgactttattatatggtaaaattctcttttatttatctgtttattttatgatcattacattatgtttattacttaaagttattattattttatgcattgtgagtttatttgcgctgcaaataaatattgtaattaagtgtgacaaacaattgtcattctggccaaagctgattgaattttatttgatcacaaaattttattaattcaattcaaatctggccaaagttgttctgattgaattaataaaaggagttttttttaaacaaattaataaagtgtggtttgtatttattattctggccaaagctgttatggatttgaccagcatcttatgcctcac

SEQ ID NO: 5552 - DNA, 1501 bp, Oryza sativa
ttaatgaagccaaaataacccgtcgttgaagattgcatagcaattttctcatggccgccgcggccgtggtggattggttgactggagggagctgttcgtctttgacgccttgacgggttcccgcgggtaaggagaagtaggggccaagaaaccctaggtttccagttgattggagggtttgactgctttgcagcgagtacaaaaactgggctcgacggcggccatgtcgcagcactctttccgcctccaaaccactggagcagccgcagcaagcaacctcttcttcttgttctttcgccgcctcacaaatcacaatccccccggtatgcaaatgcaattcctccttgttcaaatgttgaggatgcgatacttcatttttgtttaaatttttttagggttgaggggattatgtcaagtactgtagtaacattttggtttgcgttttttttccatgtgcttcatcagggtgtaaatgaactaaggggaaggaagggttctagactggagattgcattctggtcatataccaaggtactagatttttgctttgattgtgataaatctacaggaacgaattagattgtagataagaatcacagttttcaatagcctctgtttgcctgcaaattatcatttaaatatcaaatctcgttgtagcaaacttggaataatcccataccttcaattgtttttgaaaaaccaacctctttgcatgtatttcatcagaaaatgtttaaactcaggtctgagttattatttcagaaattttagtgaattagatatgaaaagtgaaatagggacgagatggctaatattgaagtagatatggactatccatataaacgaatagatatttcaaaattgaaattcgaatataatcttgccattaaaactagactaccaaatgtgctggggatggggatctgaaggtttacagcagtgtggccaacttccaaaaacaaaagctttaaaatttaaaaagcatgacaacctgaaacatttcctgaaaggcatgtcttttctgtgatagttgtgatttagtgagaactttcaacaaatttgctctgtacatattattgaatcaaaataatctactcatagatggtattgtctgttaccctccttgctttgttggattttgctactttgcatcaactatagctttccatatacttcacaagataactatttatctgatctgtttcatgcgactttctttgtcttgcattatgcaaataattctaacttttttgccacaatattctgttattctgttgtttactctcagtaaccactttattttctatcacaaatcaaagctgttcacaagtacagtttatttgggggttttgcatactgcattttaaatcaatctaccattggaccatacactggattcgtttgtagtttgtttcaggttttttgtacattacaaaaaatgtttatttctgtatttaacacccttttgttggttcattaggaaaagagaaaatgtcatcta

SEQ ID NO: 5553 - DNA, 584 bp, Oryza sativa
tgaatttaaattccaatattagtttatagacccaaagtttataggtccaaagtttacatacccgtttctaatttgaatttaaatttaaacttaaatattagtttatagacccaaagtttacatacccgtttcaaatttgaatttgaattcaaatatatatggtgtagtagcaagagaagatggagagataaaatagtaagggggaggggcgggtgatcgctaggaaggggagagagcgatcacccgcccattaggattacccggtttaacgtgccacggcaacgaaagtcatatcggttttaatatagttagagcgattgatcgatatatacttcccgtttaggttgatggttacgaaatacgaaattcggctaatagttgagggggttacattggactttgtttcattccagcctaacaagaactgtagaatgaaaaccttggcccaacccaaacacaaatagtcttgcgcaagactgtgattattattagtttgttatctatctatctatctatctatctatctatctatctatctatctatctatctatctatctatctatctatctatctatctatctat

SEQ ID NO: 5554 - DNA, 1501 bp, Oryza sativa
tacctaacctcagacgctgctgcttccatggtgatggagctccatctcctccaaaatttgcaaagcggagagcctctctctgttaatttggagtttggagggagcagagcagaggcaaggcaaaccaggtgcagaactgtggactcactctggtctcggcctctcgggtcaatccattcctaccactctcgtgttcccctctcgccaccggacacagtgaaccctagccggctagccgccatggacggcgtccagccacttcgtcttctgctcctccccatattgccgcatacaacttcgccggccggcgtggctggctctcgcgccggccttctctccccattcgcctgacactgcctgggctccctcaggccgctaccgcactgggccgactggcgcccgaccgccatcgccaaggctcgcgccgccgtcgcctcggcccagtcgccaggtcgcaccgccgcatccagcctcgccgctgcaccggccgctgcccgccccgatccgccggccagccgctccgccccgcccgtttcccgcttctaccagccgccgctggccccgctccatcggccggagagagagaagggagaggatagagagagagagagaggagggaggagtgaggatgacatatggggcccacgtgggtcccaccatttattattattattttgtgtgtgaaattgacatgtgggtcccatgggttttattatttttccggatcaaattgccacttaagcgccacgtcagtgccacgtcagatgaagaccaaatcaaatcagccacgtaggcgccatgtcagccaaaaccggcctcaaaaccgtcgagggacctcatctgcaccggtttgaatagttgagggactcgttgtgtctggatttccggttgaggaatgaaaattgggttcgttgacaagttaagggatctcagatgaacttattcccctataaaagggcagactgtacaacaaactcggcccgaataaggccgcatccagcgcaacctcggcccaaatctctactgtgtttttttttctttttcaggggaaatctctggtgtttcctgttttcacttttgggtgtgaaaaaatcggtgatgctgcccagcccttgccccaagcagtgacggagctaaaattttctcaaaagtagggctgaactagtataatttacattagtttatctttttatcttttaattgttttcaaattttaaatcacaatttcaatgggtatttaggctaaggagtagaggctctagccctaactaccctactcctatatccgttcctaggcctaagtgtggtcagacagtcttacagcttgttcgagtattagatataactattagtagagctcaagccagcagtgttttggaggcccaagagactgggggaattgatcgatgtgacatcctgacttaattaggatttggcatgtgtgaactataagagcagtgcacgcacatttaataccacgttgctagtttatcaaggctgg

SEQ ID NO: 5555 - DNA, 640 bp, Oryza sativa
cccattgccagacgagcaatcgctcattagccgtttcgcgttaaaccgaccaaaattctctattgatggaacaaaattctcaggctttggcccattttagcagcagtagagaagtactccctccgtctaaaaaaaagacaaatcctgagtttccatgtccaacgtttgactgttcgtcttatatgaattttttttataattagtactttttattgttattagatgataaaatatgattaatactttatgcgtggcttgtctttttaattttttttatattttttttttcaaataatacggacgatcgacatgaaacccaagttttgtttttgtttttttttaatgaggcggcgggacgtcattgtcatcgtcctcctggtcggcggccaggcgacgagatcctccgggcatgtctttcccggcgacccggccctgccggctgccgcctctccaccctccacacccccgcctccccaccctccacacccccgcctccctcccctcaaacgcggcccttccatcctctagatctgtcagtccacggaccacacggaccccgcttggcgaggcgatgcgttcgtccaacgcggaccacgaactgtgtctccctgccgacgttaccgcgcatcaagattaggtg

SEQ ID NO: 5556 - DNA, 1501 bp, Oryza sativa
cgaaataacctccacaacccgagcgccttcgccaaaatactatattagacagaaatacacttggatcttcttccttctccctccaatgttccaatgtcggaagagctcgccggtggctctccccgtcaagcgtctaccctttttttaagcactacgaggcattgaggcttattaggtatgggcgtatggcggccttgtacaaaacggcgtccacgtgggttgcagccactgagttcttctccatgctgagtttgccaatgatgttatcgatgtcctcggttacgccatcatcgacgacaaggaaagggtaagcgttgaagccgtcctcgtcttcgaagtcaaactccccaaggtcgtcaacggtggcgtcagcctcgggtgttcggtcgccctgcctttgtctccacccatgctcgccgccatcctcgtccctcttcgccccgccgccgtcctcgcctccctctccgccgatgcttccacttttgtccccgctctcacccgtcgtcgtccttgttttcccctccaccactgcctacctgccaacgcccccactgctgccctcagctctccttcggcgctgcctccgctcccgcccgccaccctgcctttgtctccgcccatgcccgccaccgtcctcagctcccctctgtcgctgcctccgccccgtcgccgtactcggctaccctccccattgcttaagtgatatagagagagagagaggaggtgagggagagataagatagataggattggggaaagagatagaaaggatgagagattgacaagtagggtcacggatttaaaaaagaattgctaactggactaccgcataggatcaaaaccactttgaattgagttgagttgggaggtaatttatcatgtattaatagttgagagtgaaagatactcccttcgtcctaaaataagtgctgttcaagtccaatgtctgaccgttcgtcttatttgaaaaaaaatatgattagtattttattgttattagatgataaaatatgaatagtactccatgtgtgactattttttttatttttttcataaatttttcaaataagacggacgatcaaaacactggacactgatatctatggatgcacctattttgggacggatgtagtatatgattttcgggtctgagaagttaattcgtactcactcaatagtttagggacgtaatccagacttttccctttttttggctgatgtagtatgcattactatatgggcgaccactggcaacatggtcccacgtgcgcgcaacgaagtagacaatagatggccatatgacccgaggcccgatagccccgcccaaagcacggccatttggccccggcccaagcatggcatagcccaactagtgtcaagcctgtgccggcacggcccgacagttaggtcatgcctaacccgaggcatggcacgataaaaaaatactagagggatccaaaatatacttaataaaccatataaggcaaagcaaaaaaaaaag

SEQ ID NO: 5557 - DNA, 1501 bp, Oryza sativa
aacttacttcatgcttggtgttccttgattttaaactcagacatgcttcatatatacttggtgtttcttgattctcaaactcgaacatgctccatatatgcttggtgttacttgattcttaaactcagacatgctccatgtatatttggtgctcctttattattaaactcagacatgtcacatgctccatatatgctctatcctgcttggtgttgtttgctttactatatttgtaaaagaaatgaacatgcaaactgtatagctcataatagtataagtgatatatcttccacattaagtgtttttaacctactctttttatttatttattattttaggtcactgttcacatgttggatgacacgatctcagtgtgtcgattgctgtacttcagcaagcatttcgatattgccttatttgaaactgtaggagggctaactataccgattatgccattgaaatctgatttggaatatggccaggatttctgtgtgctcaccagagacataaatatagatttgatttgcacaacagtcaaagtgaagtacttagatccgtatgagcaccaacacaatcactatatgttcattggtggttccattcccaaggtaatgatggtatttaaaattttaaattctaaatagttagttgcacttgtctataatctcaatgtggtatttaaattttgcttgcagtgtggtactggaggtgcattggcagatttcagtggaaacactgttgggatgttattctgcaccttgcccatggttgcattcctaccgagctccctgatcctcacgtgcctaagattgtggaagaagtttgggtaggcatttttatttttgttcatcctagttggctatatacacttgcttaattcagaaacttaggacattagtttgagatatgcacttatgctgccagcacaaactatttcccttccattcaacaagtttacatttaaacctgtacagtatgttatattttatataatataaaaatgagtgccaacttaatatgcatatgcacaatacctctgtccatttgctctcaaaaccaaatgtacggtagaattcacagacagatacatacaagtgaggtgctgaattaagaatgataggtgtgagactgttagattcaggttaagaatgtggggataggtttgtaatggcctctattcaacatcaacaagtactgactgagatgcaaagtgaaatgtatttatatgttttaggcatgcacttctacaaccctaaacatgtgatacactataattcttgtatattggacttattatgtggtatgattatgccatctgtagcaaccaagtggcattcagcagctagtataaattagtaattattaccatctgaccatcatgtttacagaaaacacatcaactgctgtttttttttgtgtataatatttcactttagatataattatcttatataaaataaatttaatagtctaataatttcatataggcaaattgttcgac

SEQ ID NO: 5558 - DNA, 1501 bp, Oryza sativa; identical to SEQ ID NO: 5554

SEQ ID NO: 5559 - DNA, 1501 bp, Oryza sativa
cgccacgtgtatgccatgtaggaccaaaacagctccagattaagtcggggggggggtaattcatccggtttcaatagtgtgtggtttaatatgtttgttggaggactgagaggcccctccttcttcagttcggccgggggcagcgggtgtagtttgaggaagcgagtatgctacaaagaaacgaggaggggggtcggggccgtgtccaagcggcgagacggcaaggattagacaggtttgggccgctgagaagcgtaacaccctactcctgtatatgatgatttttctgagctttggaagtctctgaatctctggtgtacaagctagggttgagtgtttttactccgactttggggaggatccctgtgattcttcatttaatggatgaagattggaggcttgcatgcactgggaacgtcatcccaggcattgcacctctcgtcaccttgatgggacagggcataccaaccgcgcgtggcttgccgctgtcccatctcgtccttgcaaggcacgctcgctccgcccacattgaatgcggttaggtgggcgcggaagggtgcctactaatcgcctttgcatggcggccacgtggtgaccaccccgaggggtcgaggcggcccgaccctctgggtcaggtatgggcggcctccactcgtccatggacgcgacccctcggggcgaacgccacgtggatgccgagggcggcacctcccctttaagcacggtacttctggtacccccaatccttatcatcgacaatattaattcgtactatcgcaatagttggagggtaattcatattttttctaaaagatattgctatattcttctataaacttagttaaagcttaaaaaaatttgactaaaaagttaaaacggtttataatatgaaataggggtagaataacattttttaacctaaaaccaccttaatagtttaactctttatattttttcacatggttagtatatatcgtagagcccactcataatttaccaatcccaaagaagatacctcgggcatgggtccctggaaatccccaacaaaagggccagtacgtgcgtgaatctggtagagtatggtaggagtactctatactcctactccgggtcatctacgccacctcccacatgcacacggattacataagcctcacgccccctcctctccattactccaaatcccctctgattagaaagagagagtgaaagcgagccatagatagatgctacgcgtagcgctagggagtagtagtagcagcagcagtcagcagtgcagtggagtacggtagtatagggagggctggtccaccgtcgcagtccgtcacacaccgggaggccttgccatcaatgcggaggggtcgggccgcattgattgcacatcttgtcctcatgccttgcctttccaacaccttaattaatggcgcccatgcgtgcctccaaaacctcccctgtttcccttccccctctccctctcccttgctctctcttctttaacctg

SEQ ID NO: 5560 - DNA, 1501 bp, Oryza sativa
tatcgtatccgcatgtctccctcccgttgcgtgcttttttcttgtgtcgcgttaggttaggtgggagcaggaggagttattggctttatgattggtctagctcattatttgctgggcgatccacacactcgtgacaaagtcgtaaagcaaccgtgtcaccttacgaactctcacgatggctggccggtgattttcaccgcgccatgtggtcgtgaatttgtgaacatggtgcagccactacaacaaaaacctcgtatagaggcacttttgtagaggcattttataaattgcttctaaaatcagaagttttatagtgtagagacactttatagaggcactttaaaaattgcctagaaaacttttactctagagacatttttatatcattttgttagattttatctcgtagaggcattctttcggcactataaaatgcgtctaatatataaaggcattttgttgagacattttaaactatgtagagacactttttagaatgataatgtgtactaaaggattaaatataagtaactaaaggaacaagtatacaagtaatgacatggagttgagttggttagtgtatcaaagattagaatgatttaaccaaaagatcatgagttcaagacttatcaaaagcaaggaaactattttattctcttttttggactggttttatatgtttgcggtacaatttagtgtctctaaaaaatgcctctaccatcttatagacattttataaaatgtctcttcgtctgtagagacaattcaccataagacacttattagacattttttaaaatgcctctacattgttgtaaaggtatttgataagtgcctctacagtactagaaaaatgtctatacagagtatttttcttgtagtgagcaaccgccatcgttttgcgtacgatcgacagattaacagaacggcgatggcaatggataaataaaaactctaataagaacaaggaatccaccgtttgcaggatgccaccaacttagatctaggatcacaaaaaaaaacagaggacatcataacatgtagcgcatttgtggcgtaggtaacatgtgttttcttccaagttcaatacaaggtgtgatttattccatgataatcatgagaatgaatcatttcagtgagttcttggttcgttccataattcatcacaggatttagtgcaaatgttctttaaaacagtcagcacactatatccttcatgcagtatacagcaaatacaaaccatccaatcaagagagaagagaaggctgccatccctattaggaaagccagccagccattaagatgccaacgcgtgtcacagttagaaaaggaaagaatgaacgaacaacaggcattttatccacccattggccatgcaaccaaacaagagcagccacattcaacacattccacttcacggagccattgtaggcaagccgattcaagcagtttgccacaaaatgagtagcaattgcaggtgaacagattatagaactttgat

SEQ ID NO: 5561 - DNA, 1501 bp, Oryza sativa
ccaccgtgaacagaacgatgccctgcttgttgtccgcacgaaaaaaaccttaaatctataaagatattagtttttggtgaggtacaaccactgcatcgctcctctcgccacgcaatcacggtactgttgccctgttcatgtgcttgctcgccgttcgatgaacatagctatgagtgtttctagccgtccaacgtacggatggagacatcgcttctggtcgcgtattaggttccagtcagccatcaggtctcttccctgtttatcgtactagtgttgctttcctgttaatctcgcgacacatgtatgtgagcggtcgtgcaagcatgcagaaggaggaacggcgatttcctgggacgacgctctgcaactaggcatgagaagtttcgatcaaagttctataatctgttcacctgcaattgctactcattttgtggcaaactgcttgaatcggcttgcctacaatggctccgtgaagtggaatgtgttgaatgtggctgctcttgtttggttgcatggccaatgggtggataaaatgcctgttgttcgttcattctttccttttctaactgtgacacgcgttggcatcttaatggctggctggctttcctaatagggatggcagccttctcttctctcttgattggatggtttgtatttgctgtatactgcatgaaggatatagtgtgctgactgttttaaagaacatttgcactaaatcctgtgatgaattatggaacgaaccaagaactcactgaaatgattcattctcatgattatcatggaataaatcacaccttgtattgaacttggaagaaaacacatgttacctacgccacaaatgcgctacatgttatgatgtcctctgtttttttttgtgatcctagatctaagttggtggcatcctgcaaacggtggattccttgttcttattagagtttttatttatccattgccatcgccgttctgttaatctgtcgatcgtacgcaaaacgatggcggttgctcactacaagaaaaatactctgtatagacatttttctagtactgtagaggcacttatcaaatacctttacaacaatgtagaggcattttaaaaaatgtctaataagtgtcttatggtgaattgtctctacagacgaagagacattttataaaatgtctataagatggtagaggcattttttagagacactaaattgtaccgcaaacatataaaaccagtccaaaaaagagaataaaatagtttccttgcttttgataagtcttgaactcatgatcttttggttaaatcattctaatctttgatacactaaccaactcaactccatgtcattacttgtatacttgttcctttagttacttatatttaatcctttagtacacattatcattctaaaaagtgtctctacatagtttaaaatgtctcaacaaaatgcctttatatattagacgcattttatagtgccgaaagaatgcctctacgagataaaatctaacaaaa

SEQ ID NO: 5562 - DNA, 1501 bp, Oryza sativa
gcacatggtggatggaccccgtgtggaagagatcttcacaacgggcttcacgatgtgtgtgcagcgtcggtgtttacaaagaaaattggaagaagaattagagactatggttgctacagtagtatgcagtatgcacgtatgtgttgcacatgtgtactgcatgtggttgtcgacatggtccaggaagcatatgcatgtatgtgtggtgcatggcatccacatgtgtgttgatctgcggaaaggctagttagcgcgcgccggcggcacgcgccctccttcacgctcttttttttttcttttttttttttactttttttcctcactttttttctaatttttttttatctttttagcatgttttgagtttgaaagtttttaaattttgagttgaaaattttcaaatctggatttaaaagttttcgaatctcgatttgaaaattttcaaacttttcaaatctggatttgaaagttttcgaatctcgatttgaaatcgaatctcgagttaaaagttttcaaatctcgagttgaaagttttcaaatctcaaattgaaagtttttaaattttttcaaatctggacttgaaagtttttgaatctcgattctcgagttgaaagttttcaaatctcaagtagaaagttttcaaatttggatttgaaagttttcgaatctcgagttgaaagttttcaaatcttaaattgaaagttttcaatttttttcaaatctggacttgaaagtttttgaatctcgattctcgagtttgaaagtttttaaatctgagttgaaagttttcaaatctcaagttgaaagttttcaaatcttagttgaaagtttttaaaatttgactttaaaatttaaaacttaaatcgaaaattttcaaatctaacttcaaaaattttcaatatgttggtaaaaagatctcccaaaaaaatctccagaatattttcttaattactaccattagtgttaagtatattaactaatatacgtaattaagactaaaagggaggaagtgctcgccaggtccttttcccggcgcgcacgcgcgcgctagcactccccgttgatctgattggttggtttggcacccaagctggtctacacgggtagatggggctcgttggttggctgcatgccgagtgggctggcccaggaagcagcagcgggcggtgaaggcctacgcgcgaggagatcgagtcccacttggtgtgattatctgtagccggggcggctgcaggttttggaaattgtattttgctttggaaatcgagggatgagtcctattggaaatacgagctctacttctactctgagtaggagttttttaagtataaatagatgagaggttgaggctagaagcatatcagctttttgggagagaaaagttagggtttgctttgagctttaattctagttcaagagtttgatcctagtaggtttgtttggtcttgttcgatcctacattatcatcaccttccgtggcttccgccctccccgccttgct

SEQ ID NO: 5563 - DNA, 1501 bp, Oryza sativa
gaagacaataaaaatggaacaaatctagcccaaaacaggtaacaaaatgggctctttcgtttttcatcggtataagtctatttgcatccctcatcttttgtccttgattgagtcacatccccaaccacaaaaccgggtataacacctcccataattttttaaaaccagtgcaaatggactccttggatggttttgaaagcagttttactgacgtgacatgcatgatctctcctcagtcgtcattgacgacccagatgtcagtcgggtccacagcgagattgtattccgcaccaaggacatcaagctcgccatcctccacccatggcgctactcgatcgcctccccacgcgtagttgctcgccgcttctcttcctttgcaactttgccgccgcagacgacgccggtgtcttatcccgttgggaacctcgttggtgctagggaggggaactaccgctgcattgccaagatcctctcccgtggtcacaattcatgctcgtcgtcgcggcaacgcgagagaaatagaagagaggaagaaggagaaggaggttgataagtgggtcctacctttttcttttatcattgtcatttatatgtaggatccacttctcttttcacttctttgatgactaggctaccacgtcagtacacttaaactaagtcgacctaccacgttagcaaaattactttccaaaccacctaaggtgtcaatttgcactgttttttaaattgtgggaggtgttataagcggttttgtggttgagggatgcgatttaaccaagagcaagagatgagggagacaaaatagacctattcactttccatctcagacactgcgaacaaggcatgaataatgatcgagccgaccataaagcaaggtcacatatacttgttcattcgttgagaagggctgatgacggcaagggaacagccaacacgtttcacgtggaaaatagaaatagcaaatctgaccgatcgctcgtccctcgctcgcgcgcgatcgcccaatagcctttttcttcgctgtcgcggcgccctggcacgtcatgagagtcgtgacgcgcatagctgcttcaaacaccggtactggcacccaaaaaccggtatttttccttcttgtttaaaatcgaccatcactcgtttgaccttaattactggcctgtggacttgcatggctggttaattaggccatgtgcagcgtgcaacttggacatggtgtagtccgtgtccgcgctggagttcttttccgtttagtgtacgtgccggggtgagagcctgagagctctgtaccgaatccagttcggttttggtaaaataggtactagtaagtacaacatgtattcggaaaacaatagacgtgcaccctataaataaggtgtgcagttgttggtctttcacgtactccagcgtgaggaggtaaattaggactcgcccatcatggctggaaagaagaggcagaacaaaagaaatggaaaagtgtcaaagccacaagcggagcctaaga

SEQ ID NO: 5564 - DNA, 1501 bp, Oryza sativa
tctcgactccccgaactattgaaaccggtgcaatttgactcccttgatggttttggagagtggtttcgctaacatggcgctgatgtagcaatgttgacctagtatgtgggttgacgtggcgcttaggtggcatttgaattaaaaacgtatacgtgggacccgtttgtcattcacacattaaaaattgtggggcccactgacatgtgggccccacatgtcatcccctccctctcttcttcctcccttcttcctcccttccctctttctttctctttctcttctctctccttcggccggccgcggggggcacaggacaggctgtagcggcggcgggcgagggccagagcggcggcgacggtgggctggatcaactactgtgtaccgcgtcgagctcaccttccacgacgaccacgtcgtgacctgcctcgccacgacggcgcgcggtggtcaccgcccaacgccccagcgctgtccgtggcgcgcaccacgcaggccaacggcgtgtggttgtagagctcaggggcgtgttccgcatcgtggccagctcggtgcccatcacgagggaggagtcgcgccgtcgcgcgtccacaactacagcgtcaccgacgacgactgcctcgtccacctcaacctcggcttcaagttcgaggcgtgtcacgccccgaactagtcccgaccggaactagcccgtgacactccaatttagcctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccaggacttggaccaaacatcacaggcgcgacttgggaactaggccgaaaccctaaaactcatcgtagccggcttgctcctggaagaactcctcatcagcatgatccgcttcatcttcttcagcaactggggggggatatttatatagagcaagggtgagtacgggggatactcagcaagccaggggaaataagtgtttgatgcaggcttcaagggaaggctgttgtttttgcaattgattttatttgaactcttttatgaaaacaactaagtgagtgcttctcaaacgacacggatgagacagtgcgtctcgtccggtcggagtatgtgcaatgtgtcaatctttaggatttaaacaaggttggcacccggccaacagctttttcaacggccacccgggccaacaacttttcaaacggccacccgggccaacaacttttcaaacggccatccgggcctagctgatcccatcagctgtagatttttcaaacaccgaacccccttttcacacagcaacttcacaagcagtagtcaaaccaaactacgctaggaatcacctcacatccgcccatgaccgtgggcacggctgttcgaacagtttgttaacctctgcagagggggtacactttacccaca

SEQ ID NO: 5565 - DNA, 1501 bp, Oryza sativa
atacagattgtaaaacttaaagaatttgagatgggcaatttctctgcctagtttataatatgatattttggaattttcggccaaattttggaaatttttgtcctagggatatttcaatcattagtacaaaattatacagtactaacagaatctaaatggacggcgatggtatattatagaatttaagcaaaatacaatgacatgctgtagaacttaacaaactcagtggcatattatagaacaaggacaaagtcagcggcacacaatggattctctctaaaactaatatagttaaattgtttcttttttatccaaaacaaaacatcttttacctaaatatgttcagagaacttcgaaagaagtaagaaaaagaggaggttagtcactagcccaaacacatgagggtggttgctgctcacaactatggtatggtatatactcacattaatcgataatacactagtattattaaaattgttctttgtagtgaatggtgtgaaactaaaaactttaaccttttatattcttctgttgttccatcttcttctttttttcttattcttatttatttttgataataatattgctacagaaaacactattacttgcacatgaatactaagcagctagctcatgtgtgtatgctccgtaatatatattacctatgtttttacatgaggaataataactattatttttgttaatgatattgtatttataaaaggtatctgactagttttttttaagagaaagatatttttgctaaatataatctagaatgctataaaggttaataatattaaacgatatagtcatataattttttttggataaactagtgatcaacacttgttatgaatccaatgatcataatgcactatatatattgttcaagtgagttgtgacattcactatttactagttacatgcgtatgcattacaatgagatctacatataaaaataagatttagtttatttctagtcttgtttttatgatgtattggattttttttacatttctttagaaataatattgtataacaactaaataatttattgttttataaataaattattttatcgtacccccatctataaaatcctacgtccgccactgccaaaaatcccttcttcacattagcaactctaccagtcaaactcgatttctgcaatataaacagaattgaattgccatcgaatttcagttcaatagtgccaccaaattcgtagtaaaaaaagatcatgaagcagtgtgtcatcgacataattatgacatacataatatgttaacagatggatgacccaaacataaagtaaaataaaatagagaaatgatggaacatgcatgaataagaagaacacatatagcctgatgcatggacgaaaatagagtatcagacaacaccgaatccaatcaaatgttgcatcaaagctggttggacaagcaaaatgaagtgacgcagacaccgaaataattatatgtttgttacgagaaactga

SEQ ID NO: 5566 - DNA, 1501 bp, Oryza sativa
ttatcctcggcctattcttcctctttgcctgcttcctgtctctttgtcttccggggaagtctatttcttatccctcccttcttttgtttttagcccagcaaaaaatctgttttgcttcccccgcgctacagtatcatcttccagctccagacagagcccgacccagccgtcctgtgcctgtgcagccgccgcttttccctccaaatccggcctcccctttcgatcttttccagaattagttgaggggatttgtttccctttttcttctcttccgtttcttctaaggaatcggattttatccctttgattcgagttcaaatcggtcggataaaccttatccccgaaccggcgaaccttaaccaatccgccgccaaatcctctcgggtccgagccgatctcctccagctttggctataaatagaacccccaagacctcctctttcgtttccaacccctagctcgagctcccgttccctagccgtctctccccgcagccgccttctctctccgccgccggcagccgctccagccgtccctagcatccggtgtagccgtcgcctccggtcgccgtcatcaccaccgggttcgcaaggaggagaagaagcccggccactagttccttttcgccgtaacccgctggaagcccctcgacggcgtgaatccgatctactccacctccggccgagcctcgccgtcgactccgtggtttctggacgtcgtcgtcgctttcttcggcatcgcagagccaaggtgaagcccgtccactggttttcctccgctaaagattgccggaacgccgctgtcatcgtcgaccagtacctcaccgcccttcggagttcgtcgccggctgtctcccgtcgtcggtcgtcgtcgtgccgcccctcagtgagttctcctcgtcgtgctctttcttccggtgccttcggttcgcgacgtcgtgccctaggttgccggcaaacgttggaacccgagcctcccgccggtgatgacgtcatcaatgatgtcataaagcccttttcttttctaaaataaatcgtgaatccttttctgtataaggctaaaatcagtttaatcttgtaaaattcataactaattcacatgaggccattcaagtctctaattcatctaaaatcatgatctccatgtttgtttatttttatgtgctgtatattttgtttttattagtctttttctcggtttggcgtgttagcttgtcgtttctgtcattgcgaaggatcgtgagtgcgtcggaagttgttcagaagactaattgaagaccgattattgcaaggagatcccaaacacaatcctttgagcatgttgatcctatattcaaattctctatttatttcaactgtgtatttattttcgaatgtcaccgggtggtgtgaacctattcctttgttatggtcaatttgcattgaatgccctattccttgatacctcgggtaataaattgattagcttgaaccttatatattggtttggttcagctaaatca

SEQ ID NO: 5567 - DNA, 1501 bp, Oryza sativa
atcgccgtccatggcacggcttccacacgaccaccggcaaaagaaggctcggttgggctaacggaggacatctacgcgtagaggacgatgacgcgaactcaccggtgcaaagaacaacgacggacgacgacgaacgacggccggcgacgaggttcgacggcggctcggctcgggtcaacaatggcgacggcgctccggctgtcttcggcggctgcgaaggggcggccggggttcctctcctccgtgcgcacccaacggcttcgacggatggcaacggcgacggctaccgcggcggcgcgacgcggctggaaggtcgccggcgacggcggcggctagggcaacgtggcggcagcgctacgggcgacgagggagctcgggacttggggcaaacggaagaggacgactaggggatgctatttataggcatgggtggaggagatcggctcaggaacggatggatttggtgaaggaagttaggatttatccgagttcacccgaataaaaacggccaaaattcgtgagatagataacgaatttgatgggggtttcttcgggattaggtagaggagatagagaggaatccgtttttgcaatcaattttggaaggggatcaacagttcggccggatcgaacggagaaggtggcgttgcaacgcacggcatcgggcagaacaggggctctggaggaagaagatgacactgttgtgagagggaggtaatgcagactttaggatgggctgaggaagggagagagaagaggaaggaatgggctgaaaagggcccaagctgaggaggaggatttttattacttttccaaattaagagttgagctccgaaaaatccgagaaaattccagagagtataattaaccatggagaatttaataaaacttaaatccagccatgctttatatttaggaaattttatttctcacatttaacttcacttgtaaattaatgaacatttaatataaattctaataataatttattaaataatttataaatcctaaaacgaaaatcaggatgtgacaatgaggtacgggcatgccagtcagtttaattctgcaactgacaagagatgtcaagtagcagcaattagctgatagattgaacgatcggttgttggagactaggagacccgggcgcggatcatgataatctcaagtgggccaaaagtgtgtgtcagccgatagcggataaatgatggtttggtgtagaatcagttgaaggatccaatgctagtacttagcactgaatgcatttggtcattgaggccagccgatgttgatgggactgaacggtcggttgtaagcttgttgcagaattggatcggttggaaatccgacacaaatagactcaaatagttagataaacaatgaagcctttgttacaatcagttagcgaacttttcattatcaaagacaatcgtaatagattagacttaaccgagacggtataagattgaagttgatatagatagatttatccaacaactaacta

SEQ ID NO: 5568 - DNA, 1501 bp, Oryza sativa
tctggttctctctaatactaccggtattattaggggtaaattagtaatttactataatatcatgtcacttattattaggggtaaattaggagtacctgtcacttatttatgtttctccccacctaaatcaatctacgatcatccattgcaccgccatcgctcatgttccataaaaaaatctaaaaaagaaggaaacaatatttattcactactaaatgacgattatacccctccgcacatttttttgacaataatgtccctccatatttctactactactaactgaaatggtagtataaatagatctaaaccctttgatcaaattagatcgaaagtctactagtgaaaagcattgtactggggctcaatctttaggccatttccaacccaagacattagacatagtttctataagctccacatcatcaaactactattccaatacaaacaccactatttcatacttaaatttaatactacttatctcacatgatgtcttggatattgcgtagaaaccatgtctcatgcaagacatggtttccttctcttttctcattttttcgcttgccacatcattttctattctaggtagcagcttatttaatactatagacaccattctagtcattgagttaggaatgacattagggctcatcgaacaagcccttgctacataataaattgagcacaaaaaccacagctgtgttcggatatagggagttgggaactaaactccccgcacggaaaacggagcggtccattaactcgtgattaattaaatatttgctaatttttttaaaaaaaatagatcaatatgttttttaagtaacttttgtatagaaacttttgcaaaaaacacatcgtttagtagtttaataaacgtgcgcgtgaaaaaggagaggggtgagttgggaactctaagttccgaatacacctggctaaccgaatcttgtgcaacgaggaccgaggaacaagctttgggcgtttccatcctcattgcgccacatcctcatgcaatggctgcaatgccgaccttagctcgaactatcaagtactccctccgtttcaaaatgtttgacactgttaactttttagcacatgtttgaccgttcgtcttattgaaaaacttttgtgaaatatgtaaaattatatgcctacataaaaatatatttaataatgaatcaaatgataggaaaataattaataattacttaaatttttttaataagacgaacggtcaaatatatttaaaaaagtcaacggcgtcaaacattttgaaacggagggagtagagttttcgccgttggttcgatatatatatataggtgcagtatttggttggaacttaacccatgccaacttcttctctctctctctcttctcgcttggttatatcgggcatcatatcccactagagatagccgctacatattacagctacctattcgattgcaggagaagatatatatagaagcaattagcagggggaagatcgatcaaa

SEQ ID NO: 5569 - DNA, 1501 bp, Oryza sativa
atgtaaaattatatgcctacataaaaatatatttaataatgaatcaaatgataggaaaataattaataattacttaaatttttttaataagacgaacggtcaaatatatttaaaaaagtcaacggcgtcaaacattttgaaacggagggagtagagttttcgccgttggttcgatatatatatataggtgcagtatttggttggaacttaacccatgccaacttcttctctctctctctcttctcgcttggttatatcgggcatcatatcccactagagatagccgctacatattacagctacctattcgattgcaggagaagatatatatagaagcaattagcagggggaagatcgatcaaatgagagagagcaacaacaacaacaacagtgtcatacaagggcagcatgagggaggatcatcggcggcggcgctgcaggcagggaggccggagccggacgccctcatcaacagcatcgcgataatccgggcgttcacggcgaaggtcgtcgccggcgtgggcttcctggcgctgacgtggtcgacggtcgtcctcctcggcggcttcgtctccgcgctgcccatcaaggagttttggtttctcacgtttatcagcatgattcttgcctccacgtaagtcatcgacgaaattaaccctccccttttaacatatcgacgaaattccctagcacaaaactgcttatttagcatgagtgctagccagggttcactctatcggttgagtccttttgatcgagggtcatcgaaatcccgaaatttctgaatttagttaaattaatttgaacaaatattacctaaatttataaaaaaaattgaaaaatttcagccgaagttatatcgtatcggaggtgcggaaatttcggtccgaaatttccaaccctgctgctagcacggatgccggttaattagtgagtggtctaattccatcacagttcagtcttcgctattgacatgattagatattagtacacgttagtttatcactaatcgttaaataaattgtgactacgtcataagttatcacacatgagtcgtcacagtcgatatgtttaataaaacatttttttatcactagtaatacgataaaaatgattgaagaatatctagtcactagatatatctaaaatataatggtgacaacaagataattagtcactataaagacgcttactagctagtgaggatcaatggcttcatcgcacataaagaaatcactggtaatgcaggagtggtccaagggggaggacaaaggaaaaaggagagatgctacggatacgagggagagagagagagagagagtgcatggtcacaagaagaaataaggattaggcttcagctagctcatgatgaattgtatcatttgtgatttcgcccggttcttccgtccaggaatggggccaggtgaacccgcaagggagcggcgcggtgccattcccgtcgaattgatctcctgttccatcccattaccaaccctagtcc

SEQ ID NO: 5570 - DNA, 1501 bp, Oryza sativa
atttgtaaattgggtacaatatgatcaattggaatgcatgacttgccttgctctcgcactgatgagaccacagcaacgtcttcgaggaaccgtggatcgacgaaacggccgaaatctacgcgacaaacaaagcacacaagcaaaacatgttataagtctactaaaacaggaaacacaaccatttttaatggattctatgcatttttatgaatttactgagacttgaatggacttaatcggagctcgcatgaattagttatgaattttagaagattctctgtgtttattactataaaagaaaaagtctttaattaattattgcgcaataaaggtccctgctgacatcatccaagggagggtggtggcgccgacagatgagccccacttgtcatagactcaagggcgccggtccactgtggaccgagtccacgggaccgaggagaggtgaaccatgtggcgcacacgtggaaccgacgtggcaccacgtggtcggccatgcgggccacaggatggacggccacgatccgccgaaaggcagatcgggtggctggggatgggcgtcatccaagccggcccgggcatggcgcacggcggtggcgtccggctaccggcgaccggcgaccggccggcgacccgggtggccggcgacgcgggtggcggcgcatcgcggcggcgcggatgcgaggagcggcggcgctagagagaggaaggaaagggggagggggttctcaccgaggtgttcggccggccggagggaggcgacgacgaacagcgacgatgagcgaccgagagacggcggcgaggggcggacgagctccggaaccacctagggaacacaatgggagggattagagggagaagggtggtccacggcgagaggaaaacatggccaaaggcggcggcaatggtggaacctcaccggagcgcgggaagaagcgggctccggcggtggaactcgacggaggggaggtggacgaggtggacctcggccgcgcgaacccgacggcggcggtggtgtggtgcagtggcggccctagcagcggctagaggcggccggagtagtggaagagtcggcggcgggtgggtgcacggtgcgggagcggtggagagctcgggagaggccggcaagtgagggaaacgagagagggggttgtggggaagctttataggggcttgggaggggcggacacagccgggaaacccccctgatttggccggcgacgtgggggagtggggagagagttaggagggattcaaatcgaatcccgccctttgtgggcgcgcggcgcgggcgggaaggcaagggcggcgtcacggcgacgtgggcgcgggaaaggcgggtggcggagtgggcgcgggatggcagagtggaggaggtggggcgccggcggcgtgggcagttggggctccggctccaacggccggaggtaggagacgaccgtcaggtgggccccacctatcggcgaccctagggaggaagaaaggggcgcgggccggccca

SEQ ID NO: 5571 - DNA, 525 bp, Oryza sativa
gaagagctgtacatgaaatatatcctgaatgggcaaacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggcggctatagcgtcgcaatgccgaagtgggaggagatggaggctagcttgcttgagaggggtatcgaaccggccaccgctaattggccggaacgatcgaagttctggtactatgctcacggtggaacactcaaaccagctgatggctcactggtcttcggcgatcagatatgagaggctgcgcgtcgactaacagacgcagtggaagcctcttctgacggcacgtttcgaccggatagagagagggacgagctgtcactcgccctgcagactctagagcatccaggacaaacacgagggaaaggggtgattccttggaagattgggttcaaggaggacatccac

SEQ ID NO: 5572 - DNA, 256 bp, Oryza sativa
gaaataactaagaggtaattctcaccaagcaaaactaaattactcaaaagatatttctattataatcagagtaattaacagagcagaaagaaataagaagaggattattgataactccggaactcctccgacttcttctactctctctccctaatctaatatataataaagtacaatagagcctcttataatttagctcaagctttggtgtgtgtgaatgagggagaggagagggccgtatttataggtggagaga

SEQ ID NO: 5573 - DNA, 1501 bp, Oryza sativa
ctgctcccgtcgccggtcgccggacgccttgccgcttccgccggtcgccgcgccaccgcgccgccgccgaacgccgccacctagggtttggaatcaaatggggaattggggagcgggcgagcagcgcatttgcgcgtgagggtgaggcgtgagccgagcgagggactctggaggagtggggacaactaatatgtgtatatgtgttatgtgtatatattgaagtatagttgttttttgataaaaaaagttgggtattcctgggaatacataggcatcactgtagctccgcccctggacttctgagcggatgggttcgagcttagtttggtgctaggtttgctggaagatggggagcaaacgcgtgacacacatgggtaacgttgagacacgagtggtggcggttgggcatcgacagtggctgggcaaaggggtgctctgcattgggacaaagtagagcgatgagattaaaggctgggttgttggggcttcttcggcggccaacccaagcctactgcctcctacagtcctgcttgcgtgccctgccgtccttcaagcagtagccggttggttgctgatgcacgatgccttcgtagtaaagcaggacacgtacttgcaagcagtggcgtagctaggggatagtccctatgggctcgggactaccccggttttggcccagaaccccatccctccacccaaaattcaggcctaggcccaacagagacaggcccaagtagagcaggcgctagggttgaggagtggagccgctcagccgcaactcccttcgcctcgtgcgccgctgacgctcgtatcaagtctgcgaaggcgcaaggcgggtgtcgttcctcacctctcctcggcgactcgcagcgagccagcgatggtgggtcaccggctctagctatccgcctctcctcggctcctcgctggtcaccactgtcgttgtccgcagtcccagctcgagacccgcgcagatctccgctcccgctccccgtcgcagcggcaccactagccgcggagccgctggcgccgggagctcgggaggccagccaagatggcgagacatgagaagccaagacgcccccggcttgctagctctggttccatgtcgtgccgcagtgccagcttcctcaggaggtcgctgcgtcgctcaggaggtcgctgtgatggttgcccgtcgccgttggtcaccgactgtaatcttatttcctttcctgtagctgtaggtacctctacatctctacaactctactcctctagctcatagcttcattaattattctcagttttctcattgtctactagactactatcataatatcattgtcaatttgtgagtactaaatctgtgaatatgcaatttgtgcttaatgattagtgaatatgccattgtagtttgaatgattgataaaacatgaagaggggggtgatattgtcttgctcttccttaaccatcactggtggagaaaccctttgtagtcccggttcgtaacccccctttagt

SEQ ID NO: 5574 - DNA, 1501 bp, Oryza sativa
ttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcaaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgtaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatatatatatatatataaaccatgcagcaacaggggcatgcaaaaaaaaaaatgtcagctctatctttagtcccggttggtgttaccaaccgg

SEQ ID NO: 5575 - DNA, 1501 bp, Oryza sativa
gggcgtcttggcttctcatgtctcgccatcttggctggcctcccgagctcccggcgccagcggctccgcggctagtggtgccgctgcgacggggagcgggagcggagatctgcgcgggtctcgagctgggactgcggacaacgacagtggtgaccagcgaggagccgaggagaggcggatagctagagccggtgacccaccatcgctggctcgctgcgagtcgccgaggagaggtgaggaacgacacccgccttgcgccttcgcagacttgatacgagcgtcagcggcgcacgaggcgaagggagttgcggctgagcggctccactcctcaaccctagcgcctgctctacttgggcctgtctctgttgggcctaggcctgaattttgggtggagggatggggttctgggccaaaaccggggtagtcccgagcccatagggactatcccctagctacgccactgcttgcaagtacgtgtcctgctttactacgaaggcatcgtgcatcagcaaccaaccggctactgcttgaaggacggcagggcacgcaagcaggactgtaggaggcagtaggcttgggttggccgccgaagaagccccaacaacccagcctttaatctcatcgctctactttgtcccaatgcagagcacccctttgcccagccactgtcgatgcccaaccgccaccactcgtgtctcaacgttacccatgtgtgtcacgcgtttgctccccatcttccagcaaacctagcaccaaactaagctcgaacccatccgctcagaagtccaggggcggagctacagtgatgcctatgtattcccaggaatacccaactttttttatcaaaaaacaactatacttcaatatatacacataacacatatacacatattagttgtccccactcctccagagtccctcgctcggctcacgcctcaccctcacgcgcaaatgcgctgctcgcccgctccccaattccccatttgattccaaaccctaggtggcggcgttcggcggcggcgcggtggcgcggcgaccggcggaagcggcaaggcgtccggcgaccggcgacgggagcagggagctagaccagcggtggcgcggcgaggcattcggcagcggcgcgacgccgtggcgaggcattcggcggcggcgcggcgaggccgcgagacggcaaccgacgggcgaccggtgacggcgggagcgaggccacgaggccgaggggcaggggcgcggcggcggccggccaacagctgcagctcagcgggacagcgcccagcggcactgcggcaggcacaatttcaggtgacaaatcaagagttcaagattcaatcagtcctaaatccactcactatgtgtccatgtctgatgtttttttaccttagtctctgagtagtttctttttcctgtacttttgtagttctgtagattgaagaactctcaaaatgaagaagaaatcgattgatttgaagactttgtgggatagacattcaaagtctag

SEQ ID NO: 5576 - DNA, 1501 bp, Oryza sativa
gttcaaaaaaacaaattttgctccaccggcaagcacaaatctcccccaaaatttttctaatttttttaaatatttgtaaatttggtcaaaaatatgttaaaacttaaaatatttccggttagaaaacatcgaaattcatgaaattttcaaaattttggcaacaacagaaattttagtgtctattgaaattgcaaagccggatggtttcatgagtttactaaagggaaaatattgttttctactccctccatttcagttataagacgttttgactttagtcaaagtcaaacactactacaataaagatttttgcgtgcggtcgaaaataatttttctgcgcggatggtcggcccgctcgcacccaggggtctgggaaaatcgtgattttcacatgcaggtgcctcacccgcacgcgaaaatcggattttcgcgtgcgggcgcttaagctgcccgcacgagataataaaatatcgaaacaaaaaaaataaaaacaaaaccctaatcctaatctcccctgccctagccgaggcccgccaccgttgcccccgcggtcgccggctacagatctaccacccgctcccgtcgctggtgtcggatccatagtcgccagctgaagacgctcctcccctccgctagatctgcaaggggaggggaggggaggggaggggcatcaactcacatcgatcgctgatgccactgtcgcacctcctgccgatagtcacacctccacaccagccgttgacactgccacacctccagatccggcgcgggccgcctttgtcccaccacctaacaccgccgagggacgcaggccgactttgtccaactgcctcccgccaccgaggggggggggcttcctccttcccgcccccgcacgtcgcctttcgcagctttgccggatccaccaggcccccatgtttcccctccaccggatatgcaagggcagggaggggaggggccgcacgccgccgtggtcgcccgccgccaccgctgtcactgcccctcttcccacccacagcagagggagagggagggaggggccaagcgctgccgctatatcacccaccgctgcctgctgtctccgctgagtgggaggagaggagtggagtgggagagagggagagagtgaggtgggagagagggaggtagtggggcagtgggcggaggggcgaggggcgcgaaaggatatcgagcgctcgatgtagggtggactattttcgtgtagggtggactatatagtgacccgcacacgaaaattgattttcctatgcgggcgatggtctggcgcatgtaccccccccccccccgccccatttcctttgcagttccatttacagtccgcctagaaataaaagggtccggtatccaagaaaatctttcctgtagtagtgaaactgctttaaatttgaccaagtttataaaaaaagtagtaacattttcaacccaagataaacttattataaaaatatatttaattattgatttgataaaactaatttag

SEQ ID NO: 5577 - DNA, 1501 bp, Oryza sativa
ccagtttctatataactccttttatactccccaaatatctttgccacttaatttgttaccactagttaaaaaactgtcgctggtgccaattatgaaccggcaatgatagtgttttctatagtatcgattataagaatttctctataatttcatggtagaaagtccaactgcaaactgctggatcaactgagtagccaatactctttaccattgataaatgggaacatatcctatgcacacaaacttcccgtacacactccatacataccaactagcaaatatcgcagaaaattctaaaacaaatatgacacatacttccaatagtattacaactacatgtgaaatcttatctttaaattcattatattttagccgtagcaaaaaagacaaaattctgacagttttttacccttaaaactgtaagatttttaacttttttgttacggctacaatataatgaatttcaatacgagactttgtagatatgtgtagtactattaggagtaaatgtcaatttttttataaaattttttatgacattgttagttggtgtgcacgaagtgtgcacggtaagctcgtgtgcataggatatattgccccgatagatagccttaattacaagttgttataattccatcaactaactcgattgatcgctaccaccggttagataacattatgatcagttataatggagccagattgttcttatggaaattgaactagagcttagttgaatatgtattacaaattattttaacttgtcaaacatgaaattcattcaatatcatatcagaaactagtttccggccaataatttctttccaagtaatttcataactaaaggtgaacggaacagaagttagctagatttatttcccaagttttagtggctgtgtgctattaaaaaggaaccaatttttagttggatattgtgcatgatacatgtatgctctctcatggcacaaatatatatacatgcatgcacaataatatttctctatcatcttatcttatgttccactattatattgtgtgtgatgtatgcatggaagaattaattaaggaccctgttttctttagacatttattttggtgtgccaacatggttatcgatctttagcgaaagtatatatagaggatacgtggaactttgaattagggatttttcttgtaacctagtcaatttggacaaaatctgaaagactagcacttgaatccaaataattatcctatgtatcccagcaccattaattgtgcttcctgatcagagctactgcatgcgggattcaattttggcaaaagaaatattagctggtttaaagaatataaagagtgataaagcatctaaggaacctcttgattcttgaacaaatatatgtttgaatcatacatttccatgatcaaccttcttatcttcatgcagatcaaccttcttattcagcaagctaatgtatatgcatgcaatcaagttttctgaatgggccatcgatcactaatt

SEQ ID NO: 5578 - DNA, 1501 bp, Oryza sativa
gctcgcaggcgtgcacctgcaatcgggagagcaggtctccgaaacctctgccttcgacgtcctgcaccgagaaaaggcggcaataaggtttttgggaagcgcttggcgcgactgctccctgttcgtccgcgacggctcgtcttcctcttcgctcgcgtgctgcgcgccgtcgtcgacacccacaaccgcgagtagttcctgccgagcaatcggtttttccgccacctcggtacgtgttcgacatgttgcgcatatttgatctgttcatgttttactgcttagtttagatgtatagatctaatgatgcgttcaatctagtttacatatgcaatgtcatgatttatttatagaaattaaatcattatgtgcttataatttcaacaatctatgcgtccccaaaaagtctatttgggataggatatgatctatcctaagataggaatgccctgtttggtttagggactaaattttaatccctatcacatcgaatgtttgacactaattagaagtactaaacgtagactaatgccaaaacccattccataaccttggactaatttgcgagataaatctattaagcctaattaatccataattaacatatgtgatgctatagtaaacatgttctaatcatagattaattaggcttaaaaaatttgtctcgcgaattagctcttatttaatcaattagttttattattattctacgttcaatagttctaactagtgtccaaacatccgaagtgacaaagactaaaatttagtccttagatccaaacaccacctaagacaggaatctagatatctagattcgttgttctatgataggccacgtcatatcctagattatttctttttggaacggagggagtaagtatactatcgatcataatggcgacgtgaccaataatatacgtgtacaattaccaactgtgtactccctctgtcctataatataagggattttttagggaggtctagacaggctccttatctagattcgtcaaactatgatgtgccatatacttttaaaatcctttatattatgtgacgaagggagtaatacagatttatatgtgtgatatgacatgtagatatcttttgtgggttctcaaaccacggtatactaatatgactgcgatatgtttacgtaacctttatagcgaggtagatttattttcagataagtggaatcgactttgtacatagtaaactctaaataattagtatgtatgcactcatgaaatcggatcaatgatcttaattattaagccttgattttgcatataacgtgcgcacatgatcaattcaagtatcttatctatctacttcctccgtttcagattataagacgttttgactttgatcaaagtcatattgtttcaagattgactaagtttatagacaaatatagtaatatttataatactaaattagttttatcaaatcaataattaaatatatttttataataagtttatcttgggttgaaaatgttact

SEQ ID NO: 5579 - DNA, 1501 bp, Oryza sativa
agtcaaaccgcagcttgtaatttgggatggagtaaatgcttggtggcaaattgatgaggttaactccactgttttctgcattcttaccacccatcattaagtaatgagcaggcaggattgtcaattacagtgttctaactaacacaatctttgcctgggttcttgttggccttattcattatcggcaagctaacatattatatgaatagggtacccatagaaatggtcaggtctaatgattgattgcaaagttagttatagcatacatatccatgcatgataagtcataactatagtattgacttctaccttagctctttgttgctctctgagtgtacaagtaaactgcatatcttaaaattaattactctgtttgttggatgtaagtttctagtttactagttaattcttgctcttctagaaatgaactaacaatggcaccaagctttttgcacgacatatggctctcattcaattcccctctagaacacaagaggttttgcacacagggcataacacactcattaaagtagtaaatcgtataggaacctagccagctagctagaccaaaatccctattttcccaaccaatgacactgatcttgcacctaattaatattaaaccaccaaattaaatccacaccaaattaatagtggccctggcaccataaccctcctgctttctaatcagtgatgacacacacaaaacacaaaagctaatcatattaattaattaactaaatgcttaaagctagccatgctttgggacaaaacaagctgtggctcccctaggtacagcccagatgaatatttagcgagtgtgacacatttggataataaaagattaagacatgccctcaatgaaaggaagctgtttggtgcccatggagatgccaaatggagctttctcccctctcttaattctgctttctctacgtacgccgtacgtacatggaggcccccacattttttttctcttttaatttcctcctttttttattcatgtcttaaaaaattatatttgacgcatgcatacaccaagttaatttggctgcatacttgcatggtttgtgtataagtaggacaggagggtgtggcttgagagttcgtcactaccaccattctcttcttcgtctacttccagctagcctgagctctagcttagctctagcttagcctgaagaagctaagagaggaagcaacaatggagattgagagagagagcagtgagagagggagcatcagctggagagctagtgcggcacatgatcaagatgccaagaagctcgacgcagatgatcagctgctaatgaaggtcagttgctaccttaattatcacaaagttgtcttcttgtaagcactccactgtcaccatggacagttgttcactgtaactgcagaagcaagagcagagcttaatgtagatagatcttgagagtacttcctggcatggcattcattgctcatgaatgttcatgtgtgtgtgtgtatgtggtaatta

SEQ ID NO: 5580 - DNA, 1501 bp, Oryza sativa
aaaatagaccagtttaataaaatatttgttaatcgagccagttcattcagagttctatagaaatgaaagaaaaataaagcacttaatctcaagccggcggctccgccgcaagctgattggtccattttttacccattaacttactgctacgtgtcccttaagcatcttgtactgctgtctttatgccggagcaacgaaaacaacagtggcttctgggatgtctcgcgtctcatgcggtctgtgggccaaacactcccgtccagctccacattgacccatggaccatgcaagtgtgtgccctgtgctggccttagcccagctgtatgctgagttcccgcaggcggataaagtccactttgactcccttaaaaaataggccgaatctaattagtacctctcaaccagaaaaccagataagacgactcccccaagtattgaaaccagtgtaatttgatttcctcagcgattttgaagtgtggttttgctgaagtgctactaacgtgacagtgttacctggtattcgtctcatgtgatgtttaggtggcgttagaataaaaaaatattatatgtgagacctatttggaatttacacaagtataatatgggacccactaccatgtaggacccgcatgtcattcttttctctgtctaacccttcttcctcctctctctcccttatctctatcttttctttccccttcggccctagcggcggcggcagggcctccgcgaggggcacgcacggcctccgcgagcggcgttgccatcaacgacggcagcggcgagtcgcggcacaccgggcaagtggcgctcacctgtagccaccacaaccaccgcatcccgagcccgcgccagagctcccgacgatgtagttgccgctcccagccatgaattgcaccgcggatgagaatcgttggggaggaaatgatagaaacgaaattcaactggaagaacgaaataaaaaaaaaactgttatttatctacaacgatgattgggaagaaaaaaaggccaagattgcccaacgggtgccatagcatgggccaacggcagaggatgtgaacccagtgataaccatcaaacaccacgctgatgcagacctgagtgagctctctgaatattcagacccaacaggaataaactcttacagtctccacataatttacataaacaaactgcatatatactactacaaaagaagaaaaaccacataggtagtattatcagcataagacataacacaatagcaagtgcaatgcatcccgtttagaattaacatttccatattttgattacaagcatccctctctgtcatacaataacaaaacataccaactctggttgataacacattatacattacttttttttagatagacaaaaaaagagggatatgcctcggaatacttgggacctcctaaatgtctccttagcattcacgcaccgtgagcactgacgagataaatgtcatgttcacgaataaaaagatataggaacataaac

SEQ ID NO: 5581 - DNA, 1501 bp, Oryza sativa
agctaatacttaattaatcacgcgctaatggcctgctctgtttttcgtgccggagggattattcctcgtccctcactctcgatcagggcccaagtctaacgtttcatagttttgggttaattaaattatacagtttgctagtgttgaaaaataacattactacttctttatttacaaccatgccactgcaacacttttgaaattagatccatgccatgttgtgcacttgatatacattcttaatcgttttatgtgtactatatttccgtattgacctaagtacccctcctagaactcaagcaccggttaaatttcggtaaaaaaaatttatacatacacatgaaaaaaaagtataacaattttagaaaagtaaaatatgaagaataaaaataaagaaatggtggtggggtggttgccgttgccatccacgacgaccgcccgagctggccagctcgtctccttcgtcatcagcacgggcaacgtcgcagctaagcttgtcatcgccaccaaaaccgcacgtcgtaactcagctcattgcccacctctagatacgccagacccaacgtcgccgttgttggaccgcatgacgcagctcagctcattgctgcccgctagacctagcggacgccagacccaacatcgccgctgctagatctacagaacacctagaccttgccgccgtcaccactagatctcctcgtgttgagctcgcaacagatggcaccgccatgggcagcgtcgcagctgccgctggaccatctgtccttgtactgcgcccgtagcataccaccccatcatcgctaccgccgatttctccaccgctatcgggtcgcacgtcactgctggactaaccatccccgacgttgcggcccatcgtgccgttgtgctcagcactccggcataaggtaaaagagaatcggcataggtattttagtctataaaaaatatagtacacctaaaacgattcaaaatgtatgttaattgtagagcatggcatggatctaaatttgagagtattatattggtatggttacgaattaaggaataacaacgatatttttcaaaactagcaaaaatggcatgatccaattaaatcttgtttatttaggtattcctcactcctaattactaaatattccacctcagcaatcttctcaacgtgacagtgcaactgagatttttctagaatttactccgccaaaaaccaaaaaccaaatccctttttccatatttaaaaagaaaagaaaagaaaagaaaagaaaacgagagccaacacggtgcatctctcagccacacagccccacccgcgccatgtcactcgccaccgccgccgccggagcgcaaccgttcgtccgctcctcctcctccgccgccgcggcgtcctcgtcgcggcccctgctcgccgtcgccgccgcccgccaccgccgcccgcatggatctctcgccgccgccgccgccgcggcaaggcggcgtcgtcgtcgtccgctcctccaggtgcgcg

SEQ ID NO: 5582 - DNA, 1398 bp, Oryza sativa
aatagccggcaagcctttcttttttcccaacaccaagccgagccccgagcttctctcttctctctctctgccaaatgctggccatcgcccgatctccctcgtcggagcatttccgaccaagccctcgcgccactacattcgcctgggggaggcaaatccattccctaacctttcccttcgttttcccctccgagttaagccaccaccgccgccccctataccggccgaaaccgagctcttgttgtcgccgttccggcctcctccctaactccctctgccggccaccaccctcctcgtatgcgcgttgctcgggaacgcgcatggccgccgacgtcgccaccccccggccgccggagcgccgccgcccctctctccctctcctctcccttctctcggccctctgtgaagcgggaggaagaagacgacgggaggaagaagaaagaaaagaaaaagaaaagaatccctgacaggtgggcccatgaacagtatactttcgcaatttactctatttaatccaaattccaatctttagaaacccatatctcctaaaccgtagatccgattccgataaaacttggacctaaattcatctaaattcaaatccttcattttgatatcaaatttgctattttaagattttatttaaatttccttaatttattcaaataccatttgaataaatatttgatttaattattcttatatttgaatttccaatttaaatttatatttgtattccaaatatttccttttattttcaaaatacgctttagccactaaaagctgtcggttggaactttacgccttccatggggacgttcgcggttttctatccccgacgtcagaccgttggttgtaaagcccggcataaaccaaacccaaggtcgaagtgctgctcctggcaccccatgccttgatgcgtacagcggtcggagcttcactattccctcgacctccacagcacgccgcacagttagctctcgggctctgtgtgtgatcctagccgccactcacggttgtcggagtaacacttccgccccactaaacccacacaaacctcctatccctctagccgttatgctatctgttgacaccggctagagaagataccaaacctagtcattatgctctagcatcgactagcacaccaccaaaccctagccctcctaaccatttatcgttttcttgttatttatggcttttattgaaattggttcttcgtctttcttagtagaatctattttattttggatggcaacctgtggtatttcgaggatcggataatcaggttgcctatctcggatttatttgcgttggagcaaggcaagttattattcctcccctttgagcattattatcctatattctatatctctattattccatgcattacccatt

SEQ ID NO: 5583 - DNA, 194 bp, Oryza sativa
ttagggaatggatttgcctcgtcgaggcgaaggtagtggcgcgagggcttggtcggaaatgctccgacgagggagatcggccgatggccggcatttggaagagagagagaagagagaagctcggggctcggcttggtgtggggaaaagagaagggctcgccggctatttataggcggcgaggggcggtggatga

SEQ ID NO: 5584 - DNA, 1501 bp, Oryza sativa
gagaaagccctttgaggagtatatctgctttgtgaaaatatatgaaaacccaagagattgacgagaggaacaagaaggacttgagtcacatccgttccattcatcaattgcccaagatggtaagttagacagtgcaaaaattcataggtacaggtatggcttaaaataatttgtgtacttatattgtacatattttcggaaattttattccacattaatccttaaccttttcttgggacgagtaaagagctaagtgtggggatttgttgacggctgttaagtaccaaattaatgccgtcaatacctgcataaaaccataaatgtaaaacatccaacatagtggtagggtttatttctaacaatttccacgagtgttggtatatatttgtatgcaggtgacaagttactaaagttgagagaaaatatacatgaaggatgagaatataactttcatatccaagctaatggagtcttgagcccataaacccaataagatgcaatcatttgagccaatcttcagaagaatatacaatggggcccacatatcagtctctaggaggaagggctgggctagcagagccggccagggttcggccaaaccaccagctagtccatccaggcccatttttcacctggcagttgcaatcctcatccattggcggttgtgaccgtttctaccggtggaaaccgtcatagagaggacacttgtcaacacaagagagaaaatgctcttaggatgcttagcatctccacattcccaaggcatctctccacctataaatacggccctctcctctccctcattcacacacaccaaagcttgagctaaattataagaggctctattgtactttattatatattagattagggagagagagtagaagaagtcggaggagttccggagttatcaataatcctcttcttatttctttctgctctgttaattactctgattataatagaaatatcttttgagtaatttagttttgcttggtgagaattacctcttagttatttcctaatcagcgtgctagatcatcgttcactataatacagtaaaatagtgattgctttagtgagttctaaacactagaatagctattaattgcttagacatggtgtctaggtagttgatttccagtgtttgctctgtatcccacagtaggtgtgcagtgggtgtagaggtggtgacagccctcaagatcactaaagtccttcctgtccgggtacgtagtagagcgatatctgggagtagcgagctggccagtacccgaagtatcgcgttaggattaaagttaagctttccatagacattgtttctcaccggtgaatcctctctatcctttgcctatctttagcttcgtgtccttggatgaacctgactaggagttaacacacacgttccctatggaaatcgatacctgagaatactcctggggtgaagtactacatcggtattttccgtgcgcttatggattctatctgtcaggttaagaaa

SEQ ID NO: 5585 - DNA, 1501 bp, Oryza sativa
gtagctactattaatatatggtcccaccttgtcggagatatgggcccgggggtatgccaagtgagggaaagttaccttcccatccagccatgtggctctccagcctggccctccccccgcgcctcgcgagtctcagaagcagccagggggcctcggggtgccacgtcacgcccctcgggccctcgcgctgccttgccctgaggccctcgcccaactgccatgtggcggggggagcgagcggggaggagacccaggctgaaccgccatcaatgcgcgcggcgccccaactgtccctcaccgcatttaatacgctaagggcagacgtgcggtgccgtccgactgacccacgtcaatcgggtgtgaccagactgtgaccggcctatcgccggtcacgtccgattcgacaggcggccgcgcccccacgtccgtctctgtctccggcggagtggaggcaggtatgtcccgtcccatcagagtattattcggagttccctccacgtgaggaggaccgccacaagtcttcactcatttatgagggaatgacagggttgtcccccgtgtcaagcggggggtggcgctgggtcccgctcaaggacagactgctgcttagcttccgggcgaaggcacggatcgtggcccggtcgaggtaaagtgggtccccctcccgtgaaagagtaggtagaaccggcgcatgtggtatccccttgaactataaaaggaggaccttgcccaccgagaaaagggacgacactcagtaggcctgagctctagaaggagaagaccaagagcgctcttcggagttgaggaacctttgtaacactcaaccataaatcccacacacaggagtagggtgttacgctccatagcggcccgaacctgtataatcttgtcgccggcacgcgatctagaaaccctgagggcggatatacgatctcgagaggcgaaccctttccctcggccgaactcacaaaaggggatctcacgatctcccgctagagaggatcactcctcgacacacccgtcatacacacattttgtcttggagtccgtgctgcagctggctacagatctgtagcccgcttctcttcttatcttttatctcattaaaatatgtttatagctggctaatagtcgtagccgctctaatgttgtctggtattttataaaaagaaactcgtcaatctagtggacgagtcaatctagcaatgaaaccaaataggaccatgggttcggatatagtctgaaaccatctgatctgcaaacatctagtccactataatagttcagttaataatttattccaaactactcgtaaataacacgtagatactctccattggttttgctttctatgaccaagaatgttaataggcatagggcagctaaggttgaagccctatgttaaccccataactctcattatatatttaaaaaaaatgttatgtaattatgaaaaaaattaaacccttattaatttagctcattgttctgtggctagggg

SEQ ID NO: 5586 - DNA, 1501 bp, Oryza sativa
ataggaaaaactccccttgctgattcatttgcatccattgccatttgccaacaacagcatatcataatccaagcatttatttgccaataatttaagaactcggcaaagaaagtaagaatcaaattaagcaagaaaggaaatatcgttgactacttggctcatagcacaacaaagtttcagttaataattagtgcatgaagaaaaataaaagaaaaatcaagtgcctgtgcttaccaccatggtgagtgagaccaacaaacagaagggcgcggccacgacggtaattacgaaagccaacagagcaactcggtcatcagaagcaatcggcagaccaccaatcacatgaaggatggaagaagcaaattccatatgtttgtagtcagatttctgaaattttctgttaagttcagtgcagtaaacattttagatactcaaaccttatatatacagatacatatttagttgtttatatattgcttaatatcttaattttacaattcatctgcacctgtggtcagtacgtgtacaaacccagctggtttgcacatgcatctgtagattactatataattcatatagaaaagaaatggattagggaccaacatacctgtcattggctcgagcagtctaaacttcaacagcttttcaggacttctcctagcacaggaattgcttcaacctcagtccctttgattgctctactgatgtttgtatacaagaagaaggacaggataagaaacatcataagtcgtgaccagacccataatagactagagcacatatatgaacaaaatgaagaaggtgtaatatatgttagattgcgattgtgtatatttgtttccctcccttccttatcccctccgatattgtttctataaattggttgcggtagatatggaagtcttgggcctatatgtactctgtcatatcgataatgcaatctatcgtgatgagccaatcacactttcatggtatcatattagtttctttcctctgcttccgcatcttctccaccccagccggccggcgcctcccaccgccgccatggcttctccctcatctctcacagctgactccgtcctcgaagataccatcaagttcatcaccgacgccgtccgctcctccttcaatcccggtcctggcctccaagtcgacgacggcctgaccgatgctgtcaccggcaacgccgccgaccgcgccgcgaacgctgcccggacagccctcgctcttgtgctgctcggcctcttccagtcggcgccggctactgacgacgtcgtctcctccgcggtgccactatcgacgcccttgacggctgcgcccccgacgaccgtcgtcctcgcgtccgcgtcggcaccgccaccggtccctcctccgacttctgcggccgtactcccgcccgagctcctagcgctcctcgcccgactcggcatcaccaccacgtcggccgcccctactcaagacgccgtcgctccaccaccaccaccgccggcactcgacgccg

SEQ ID NO: 5587 - DNA, 1501 bp, Oryza sativa
aaacataccgttgatagttcgggaaggttctcatgataaacgagggagtagcaaaatccaaactccctttcaaactcagcctaaaggtttatggattgttcctcactggaataacagtcaacattaatacaatataagacatggttttgctccatctatacgcgctgtaatttggtgctgattgacctaattttcttcgaagtggatatgcagcaccagacaaataagtgctggaagaactgaagaattatgcgtttatttagtcatatgcgtttattaagactttgtagtgttacaggtgcttgatttatggaaccaaactaagcattggctagccaaaatttggtttgttgtctttggaaagatggttcaagatacttgccaaattcctagctttcgaggaccacttcggaatggaggaaaaacttaggaatttgaatcctacaggaatggtcacagtagatacctttggttcgtaggaatgaccaaatgggaaaaaaatagagtaaattccttgtatactcttaaaaaatcactcaatcaattttatatctctgaaattatccgatcacttctataccccctgaaatttcaatttgatcccttatacacccctgccgttacattttccttcattaatggtagagtactcggcttttaagtgcgactacgatcttttacacatttggatgaagcaaaaaattcgtcagactcttggtagagtctataatcataactggatcaaaaaaaaagcatgaatagattttttgaaaaagattagaaaaaagtaagtagaattagatttaagataaaagaaagttagttttagtaagaaaagtggatgaatacttgctcttttctcgattttagatcgtattttttggcggcatggccaagcggtcactgttaagtttggtggcaaatgtctttaatgtccttggtgatttatgtttgaatataagcttcaaaaacgattgaaaattttgtttgagtgcacagcatgtacattttatataactaatgagactaaatagttcagaaaattttgacataaatttctaaaatgaaacaaatgtaataaattaaaatttttatttgaaatttaataggaaaatattttttttatcgggagcatttataaaaaaaatatcgtgggttgtcctatctttgcatgattgctcctcatttttatgactttttaaaaaaaataaaataaatacatatttttatttcattatctaaaaataaattttgtcataaataatgtatcaaagagcaaactcataacaataatagtgtcatgcgacaaacttttacattttcaatggtgtaatttataaatttctatgttcattcaaagggtaaaatggtcatatttatagaaattagacggtcaactaacgctcaactgatgggaggggtatggaagggctaaaaatcaaattttgggtatataaagaagcaagcaaaattcaaaggaatagaaaggattagctaaaat

SEQ ID NO: 5588 - DNA, 1501 bp, Oryza sativa
ataaggcataagaaggcagctgcagctgctagctgctgttgttgttggtagtagttttttgggcaccaattttccatggagacgaaggtgaggatgagctgcaggttgggcactatggtggccctggtgctggtgggcgtcgtgctggcggcgatcctgcaggaggccaccgtcgacgcggcatcgtccagcagcgactcgccggcggcgaaatcgggcaccggctacctcgactacggcaacctcaaggcgaagctgcctccaccgggcgtcgccgttaccaagaggccatgcatagcaaaagagaaatgccgcggctgatcgatcgatcgatcgatcatcaccgacgtacccagacggatgaaacggatcgacgtacgtactgcttatggtgtcagcgtgttcttgttttttttttcttttcttttctttctttccgatggaattgaaacgtgtgtgttcttgtttttcttcttctcatggcatcgccttggctttctatatataatgaggtttttaatgtcactaattaattaaccacctgggatatataggccacattggtgaaaatccaactgtttgtagcgagtatagtgcgtagagtcgtgctccagcattattaatacatcatcacaccgatgattaattcttctcgttgttgttgttatttggataaattatgtgttttatcgttggtgatggaatctatgtagagcatcaacaaaatatataatccatatagatggggtccacacatattagctttaactattgcattattcattgtatatcatgccattgtagcattagaaggagagagagatgggagtagagatcgatgtattacttaatttattctatacagatagttcatatgcatatggatagctcatactaaggacatttataaaagccacttccgtaatatatataagtagatcatacaaggcttaataccgatcctatttttatattgtgaatatcctaagttgttttgttgataaatgcaaattctatgagatgccatttatgggagtgtttctcttccgattttgctaggttgtcccagtgccatccgttaacctctcacttttttttttctcacaatgccgaaacaaagaattctatataactccactagagtgtagcagaaaaaatggaacaaacgctcctaggaaaccgccggaacaaaagctttacgaagataaagcaccaaaagacggcaattgcaaagtatatatatatattcttttacgtaattgcaaagtatatactggtcggcagcagcattgtgcctttggttctccatatgatttatttatagatttgatctttttttcgtataattcctccaaatccagaggaaatcactagtgccgattttgatgatttgcttgttgatattaattatttggaggctcctatttcgccccgacatgatagttcatttgggtctgctacaacttccaccgtgcgtgcttatagtttgaatgcaccagac

SEQ ID NO: 5589 - DNA, 1501 bp, Oryza sativa
gggtggcgcggttcgtgtgcaacacctgtttctcctctctctccacgccgccatccacgccggcgccctcactgctctgcatctgattcccttgcctttgttccagcggggccggggcaaccttccaacgccccacctattgcatctgcgccggcaacaccctcgacaccatcgccaggggcgtctccgctggcctcgtcccctaccaggacatcgctgcgccagcaacatctccaacccaaacaagatcgccgtcgcccaggagctctggatccctgtgcctgggtggacctccttcccgatggtgacggcgagctcgaggaaggatgcaagcaagcgacgacgcgcctccttccctatgtcggcagcaggcacgagcggaggcttcccccggtggtctcgatgcaggaaaggagttggaggcgcccaggcggggttcggcttctccaaatgctaagccactaccgccattgttgtcctcttgtcccatcgacgtggtagatcggagcagcaacgggggcgacgatgaaggccaacgatgggggcggctatagggccggcgacggagtccaagacgaagacacctcccgctccctccttccttagctcggcctaggacgaggcaacgacggacgagggcgtaggtagtggagacagtggagggcggcgatggatgccgccacagtagccggtgtccagatcatggcacgggcgatggctgctgcacgcgctcagcaatgcctcggatgaagggtgtgcatggagaaacaggcgtggctcccatggatggctagccggctttggctggccaaactagccggctttggctggctaagtttggccagcgaggaagcagtttggatggcttggccattcaaatagcaagcctgttggagtacaattttagtctaaaattgccaaattttgacttgtgggatagcaagactcttgaagatgctcttatagctctacaatttctgaataatccttgaaagctttaacaaataagcatattcacacgactgatacgaggattaagtgcatacaaaatgagaaagccttatacattattaattaagtttaattattataaattaaaaaattagattatataatattttagaagaataacttttataaagttttcatacgaaatactgtttagtggtttgaaaaatatgttaacaaaaaccaacccagaatcaggcgtgagtaatcttgagcggtttgtaacatctatataaaaggttttctcataaatcatgtgttaacaagaaaaaagagcgcatattatattagcactctctctgttaataaaaaacttaacttaaccaaggacaaatgtgacttatcttagtagtatagtaaatataaataaaaggttaccgaaatttattcgagaatgctgggaatcggtaaccggcagggggtgggggtggagcaaaatacgcgcacgtgccttcccccgggccccccacatgtctctgctcacctgccacgt

SEQ ID NO: 5590 - DNA, 1501 bp, Oryza sativa
gatgtctaccgtagtttagccctttcgattgtatgtgcataagcttgttaaatttattttgaggaatggatggctttggtgtgtgtatgttaagtttgagccttcttgattcattacagttaaccttgtgacatcaaagtaagaaaaaaacaaagctagtgtggttagttttgtttattggactgcacattgccatgacgttccaagttaaccaagctattatctcactgcctaaatcgccttgaaattactgtttcatgttgaatctacctcttgaatgttgccattgatttgagtgtgatgagtgtgaaacgactgtaaagtttgaaccaccatttggggcaaatcgagagtaaaacgactttaaagttttgacttagccctctacgtagaaactttgtagacaccgagcaattccagttgagattttggggaaagtaaaaaatctcaaatagtcgcacagttcaatgctaatcttgtttgatttttgagcaaaacttttggcaatgcctacgacagatcgatcgtagtgtgcgctgtccaaagtaccaacatgagcaaacatcttcacctgacgacccatcggcaacggctactttgggcaccggtgaattcagcatgaaagaactgacgaaatcaagcagaaaaagtcgatactattttcctgatgcatcctaatcttattatggaggagtgtaacaattaaaattggaccgttgctttctaaataatacaagtgtaatgtgccggtgccacgttgaagagaggaagtatttttccttcagttacttttgaggcatctaatcaagctgaactgtaggcatgcattttcttttttcattttgagaggaccaagtgaagtttgtgaataaacgaatgaatcctatggctgtatacacacacacatattgtgagtgggcaggttgatattgtccatattgctgtcctttaaacaggtctagtactgatttacttcctccgacggcacggctattaaaaatataaatataggtaaaaaatgattaaaaaaatggtgtgattggttgaaaagagaaagtaggtaaaggggaatgattgtgattggttgagaggaggtaggtggagaaaaaactttattttaggacaagttattgtgctagaaatagttacattttaagatgaaggtagtatcttttaagtatattttgggggtaaaagtatatttgaggtgcctcgtccatcctccaacttttaaaaccaatataaacaagatcctcaatagttttatccctgatttggctgacgtggcgtctacatggctgctttgactaggtcttcgacccatgtgacattgacgtgacaatttgatctagaaaaaataataagaaatgctgggggtccactgatcagatccccttcttcctctctctgctctaggggaggtgaaagtgagtttgtttgtttcggtttccacgcgcacgcttcccaaactactaaacggtgtatgttttttttcaaaagt

SEQ ID NO: 5591 - DNA, 280 bp, Oryza sativa
aggggcattctagtctcttcaaaccgctttgcagagaaaataatatccaaaatagtaaaaatggagaaaatggcaaagtggctgtgatggcgcgctctatatttgcattttagcgaaacacgttttcggaatagcatttcagcgaaaccatgttttcaaagtggcaaaatgtccattttctcctgcagttcgccgcaagcagctagccacagcctcgggagggagtggggggtgggggggggaaggggggcggcgccgtccacttcagcttccagcacct

SEQ ID NO: 5592 - DNA, 1501 bp, Oryza sativa
aatatatcaaccaaatcagagcgatccaagagatcgaagcgatgcagccttgaacaacaccaatgtagccgatagattcactggggccggcgaaacgtaggacttaccccttcgccggagatcgaaagccgatgcagccccgcttcaagtgccaaattccgctggttgataagtaaaaacctcggtaaagagggtggcgatgcgccgagagtagttgtattgatcaagagatagtttacaatgactccgggtgtacatatttatacccatggggagatattagtctttgtaggacaagaaagaaactttcgtaaagataaaaggaaaacataaagtccttatcggacactaaacacatatttttctaaagacaaaaggaaactaaaaaactattcctaattaatagatatacttgtcgtgctgtcacgcccagaaatttagcccaaatttccagactattttgtgcattaaatccctgtccaggaccagccagggtacacaaaacgacaagtaataaacagttccaaacgtaaataacgcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaaatctccaatgatcaacgctacaccatgttgaacaggcccaaccaacccacctgtactacagtgcattgggtcgatttattaagtgtgagactaatcacggtgaatctggtcgatcgcccatatcagcgggcacggctattcgaatagttttactctggccagaggtgcacaactgtacccacaagacacaacccacggacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaccatgcacccacagcccaccattcagtcgcattttagttggataattacaaccacaaaaca

SEQ ID NO: 5593 - DNA, 1501 bp, Oryza sativa
taggtgttccatctatttatataagattcttccatggccaatgagatttcggtgatgaccaagctcgcaaaaatggatttcttgggtgcgaagagaacgaagagtggtgttcgactttggctgtgcgctactagttgacttgctgcttcatctagttgtactaataataaactaggtacaagtagacttctgttactggttgttccattaaaatttcagaaagatggacttttaaactagagaaaagttggtttgctagccatgtaatctaagtcgagctcacgtgtacattgacaacgattagttgattacgctagtgctaattaagtactgtttcaatctcagtttgttgcatggttaaaaatcaaatagagcattggcgtgtaaccgcggcattccgggggttgatgtatttttctttcagcaaggaaatcaaatttgtttttaattactagctatgttgctgtttagtaaaatattggtgtttatcttatctagttaggagtagttattagtcggataaacttcatcatagagcaatgaattgttaattttgcaagctgaacttctcatgtttggtcgaggtggattattttatatcatttgactcactaatttccgaattggtactgtctaacaattctgacttttgagtttggactcgcataattaacatttaacaagcgctgaaatccgtttttcaactataagcatctgcaaccacctcattgatccagtttaataaacaagaaatggcgaaaaaaagatcaccttaatggctgaaccgatcaaccttaactgtaagccataatcgagcagttagttcaaattgaaaaccaggttaagtttatgcactgtttattaaaaagaaaagagtgctgagaaagaaaggacagcacgtaaatgttcgactcaatcgatcgtaagccatgactaattagctcaaattaaaattcaaaagcggagctattatgtgtagttttctccttgcgtggaaccaatcagagcaagagctccaattgcgtatatcttcaatatccagcaacgcttattcagtagtatcgtgctgtactgctgtctggtaatggcccaattggtacaatgaatctagccatgtctggtcgtctcccccaacgactaacgaaccttcctaatccttaattatcttccactaataacactttaagtcaaacaagtaagatcatgtcgctaatcccacttgtttatggcaagtgcagttgtttagttggtgtagagatggtagatgctaactaaactggatcggcccaataggcccaagtagctacaatattggggcgtacgattaggcccatgtcattggcctccaaagcccacgatccccttctccttgctccgcctccacttagcttgagaccgctttattcctcgctcagggaggaggaggagaaggcgaaggcgaagcaaagcaaaacctcggaagagcggcagagcccactccacacgcggagaggagaccacg

SEQ ID NO: 5594 - DNA, 1104 bp, Oryza sativa
gttgatcccaatttataaatgttttaccgtttgcaaataaacatgcatgtcttgctaattacatgggaatagggtttacctatctgctcgcttgtgccatgtttacttgatatctatcctttgtcaaccttgggtgataaattgactagctcgtgttacttatgtgacctagctagaactatatgcttagccatgcttaattaccactagctcagtcgatgggataattgcagtattagacattctagtatcttgttgagccgcgtgctcgagacatctggccatgttttgtggttgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtccgtgggttgtgtcttgtgggtacagttgtgcacctctggccagagtaaaactattcgaatagccgtgcccgctgatatgggcgatcgaccagattcaccgtgattagtctcacacttaataaatcgacccaatgcactgtagtacaggtgggttggttgggcctgttcaacatggtgtagcgttgatcattggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagat

SEQ ID NO: 5595 - DNA, 1501 bp, Oryza sativa
ccttttgaggggtgggggtgaaaccttagcgtggtgtggatggttaggggagggttatgcgaagggtctcgtcacaatcactcgacatggtgacgtgtgcatcatgggcacatgatgacgcggtgacatgtccgtgggttgtgtcttgtgggtacagttgtgcacctctggccagagtaaaactattcgaatagccgtgcccgctgatatgggcgatcgaccagattcaccgtgattagtctcacacttaataaatcgacccaatgcactgtagtacaggtgggttggttgggcctgttcaacatggtgtagcgttgatcattggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgcgttatttacgtttggaactgtttattacttgtcgttttgtgtaccctggctggtcctggacagggatttaatgcacaaaatagtctggaaatttgggctaaatttctgggcgtgacagcacgacaagtatatctattaattaggaatagttttttagtttccttttgtctttagaaaaatatgtgtttagtgtccgataaggactttatgttttccttttatctttacgaaagtttctttcttgtcctacaaagactaatatctccccatgggtataaatatgtacacccggagtcattgtaaactatctcttgatcaatacaactactctcggcgcatcgccaccctctttaccgaggtttttacttatcaaccagcggaatttggcacttgaagcggggctgcatcggctttcgatctccggcgaaggggtaagtcctacgtttcgccggccccagtgaatctatcggctacattggtgttgttcaaggctgcatcgcttcgatctcttggatcgctctgatttggttgatatatttgcctacctgatatctcaattctatctctagttgcatttgtttagagacacatcggtttagttgggactgtcttggttaggttcgatcttctgtcttagccgatatatctctacaatcacaatgttgttataaatagatttgttatatccatcacattagacagatctatcggctcatcgagtattaaattatcatatacaatctcgtgctgcatcggttagattcgacctactagattattgttgataatataagtcttgttaagccgataggttcatgctaatg

SEQ ID NO: 5596 - DNA, 1501 bp, Oryza sativa
tatgcatgcccgggtgttcacggtaagatgacctcgcaagtcgaaatcatttctaccaacatgttcttcggcggtgactacgtacagctgacaagtacgtgacattttcctccccgacaagctagcgagatgatgattggaacgaccggtgcacgtgcgaaacgtttctggtagatgactgggaatataaattattcatacaagtcaattccgatctgaacgaaggacaacccacaaattatggaagtggtgtaataaatctggatcaactctgaatttatattgcaatcagttctgcgatctacacttatctatatgatctacacttatctatgtagtacgatttattttatctacaatctgaatggcctcgtaatttctggttcccaattttaagccatttttgcccgaaatcgctaataagcgactagtcgcgcgtgtgagcgcgcgcggcgagttcacccctactacttctagcctaacactgtttctataaacccacgggtctctgttttttgggcttcttcgtgtcgtgggctttcctgaaatgggctaatagccctcccgcgcgcgacacgacagaggaggcggcggtcggcgcgtatgggcgtacggtttcccttttttttgtttttttttccgtatcttttccggttttatttttttccttttttttcttcccgtatatttttgtgtttgtccgttttttaatagtatatgtatgctaaactctgtgtacgtataaatacaaactttatatgcatgtatacaaactttgtatatacgtatgcaaacttttatatacgtatatacaaagtttgtatgtgtattttttggtttttatacatacgtataccaactctgtatacatgtatataaagtttgtatacacatatatatgtttgtatacacttattttttaggttttttatacgtatacacacaaactttatatacatgtgtatatctttttatacattaaaagtgcatacatataaaaaattatgtatatatacacacgtatgtataatatatatgcgtataaactatatatatacatatgtatatacatatagtacgtatacatatagtacgtatagtagtatatataggataacagatcacactagagggggggcagctgatcgcgcgcgcggggcctcgcgcgactggtcgcggatcagcggcccccacttttgcctacgtgcataagcaagtatggcgtgaattctcgatcttcttcccggcctgttagtttttgggcctcaagaagcccaaccacgtgcaacgggagccctcaactctggacctcaagtccaacatcgtccagggcagcaacatccatcccctcggcctcatcgcggcagcgccgctcgtcgccctcccctcagacctcaccgccggtgcgcgggccacagttcatcgcaagcaactaagccacagcctcgggagggagtcggggggaagggggcggcgccgtccacctcagcttccagcacct

SEQ ID NO: 5597 - DNA, 1501 bp, Oryza sativa
gtttatcgcatatggctttcattgctggaagataatcatgaatagatatatcatttttgtcatttacaccaaaagccccatcttcttgcaaaacatctccattgctctcttcattgctgcccagtagttcaggctttatgatctcaattctctgttgtgaattcatattcaggtttttggcatatcgcgagagatacaatgagttagtattgatgatttgtttattctgggaagcatcttcggcatcagctccatgatctttaacctttataatagttgactgcctaacgattaacttctgcgactgaaggctctttacaataaagtggaagttgtttcctttcatacggaaagttttgcatagatcattttgcgttacaccagaagtcctatgagaaacaaaggaaaataacatcacagtgcaaatattcaaaatcaatcatcttctctgcctatatatacattacggaacaatgtatatatggctaacagaaagataatgctattctatttgaccatgcttcttatgtaatttgcaaatgcatgctaattgctaatgatcagaatatatgcaggttcctgcattaaactcacgaaataataaaggtaagaccaaaatacatctaaggaaatggtgtttataactatgccaaattgtgagtaaccccacccaattttggtttgccaagacaatcatgcatagtagctcagcatttgggaaaaaacctcccagttcatagaaccaccagctcatatgatgatttgctcaacggttacgccagaacgcacctgcttgctccgacccgttcaagcgcccccttctggacggcgctcaactccgatttcgcgaacctgcggtcatacatcccgaggaagttgtccctgagcgcggcgctagcgaccaaccgcaccccccgccgctcggcctcctccacgtccttctccaccgggtcgacgggcgccccgtccccctctcccacaacgaggctgatgatggggagcgcgatgaggcgggcccagaggacgcgcttggcatcgaggccgggagagaggccggccgcctcgagcgcgccgcggagcgccggccagaggtcggtgaccgggaggccgggcgagaggcgggcgcacacctcctccagcgccgccgagacgagcgcgtccatgcccccgcggctcgtgtagggtggtgcgccccggtgtttcgggaggtttagggttttggctacggtcgcatctgcctctgcgctcgaggagggctctgtggtcggaggaagaggaggattactcgccacgcgaagcggagctcgccgcgcttgccggcggtgtggccgcggtggggagtagtggatcgccggctttggtccggtgatgaggcttgccgatgatacagaaagagtacgggttagattgcacggcccaataggcccattaacgttagaaatgctcggctcaataggcccagtaatggccgctccctagtccacaaaacctagtgacgcgg

SEQ ID NO: 5598 - DNA, 1501 bp, Oryza sativa
gtttgaaaagctgttggccgggtgccaaccttgtttcaattctaaagactgatacattgcacatactccgaccggacgagacgcactgtcacaaccgtgtcgtttgagaagcactcacttagttgttttcagaaaagagttcaactaaaatcaattgcaaaaacaacggcctttccttgaagcctgcattaaacacttatttcccttggcttgctgagtactccccgtactcacccttgctctatataaataatcccccccagtcgctgaagaagacgaagcggatcctgctgatgaggagttcttccaggagcaagccggctacgatgagttttagggtttcggcctagttcccaagtcgcgcctgtgttgtttggtccaagtcccggcttccgtttcccttttgtaatgcagttgtgagatcgggatctgtccgcagcccaacatgactgtacatctactctataataaagagacctctgttgctgtgataatctgtcttcctgtgatatcagcactgtgtcctgggactggtatcgattaacaggttaaattggagcgtcacgggctagttccggtcggtactagttcggggcgtgacagcaagcaagcatgaaagacaacacaccgaatatgctagatatttgttggttagctgcatttgcaccgaaaaatgcgcgggacagacatcaaaactgtaagtctaaatatttcgaaattcgaattgcaaatggcgtaatcgagaagacttgaaatttcgtgttgtggttcactaggataaagacagtgcttacgcaaagcgcgcaacgtttgctgataagcaaattaagtcgactatcgaccgcgaccgcagacctactcgcgcgccgcgaaatttaaatagtttcggcccccctgacaagtggagattttctatgtctaaaatgtttatttgctcaaatccacacatggtttggcatttagttgaacaaaaaatccgaattcatttttgaaataaaaaaactaaaatccatcatgtttcatcgggccagacagcccacacagcattcaggcctcgttcttcgcactgggcccttatcctaatgggcctgaatgggccgggcctaggacccagtcgggcgcacgcgcgcgacacctgtgaaaagtcagacgagtggaccggttccaccacgacgcttccgaccgagccaacccaacccaagtagacgaccacccaacccaggctggcgcggtgcttcgatccccctctccgcctcgcgaatctcctcccctcccccacgcaactcgccgcctgcgctgccgctgctcgtgagggggagacgacgccggaggagatcgccgccgccgccgccgccgcctcggacggccgcgcccccccgccgcgcgtgtaccacggtattgcggctcgccattgctcgttttcggcttgctgtttcgttgcttgatccgatctgatcgatgttgattgtgtgttagggcttgggggattgattggtagcga

SEQ ID NO: 5599 - DNA, 1501 bp, Oryza sativa
atgttaatgaatctagtcacatataaatgtttagattcattaacatatatatatgaatatgggcaatgctagaaggtcttataatatgaaatggaggagtaacattttaggtagtattgatattctatcagttccatacaaatttaaaagcataaatttcacaaaactatagataatttgactaaactatcacaaagttacaaatttaaaatgatccattacaaaaccacaaatttaacatcaaatttatcaaaaaaatattaagatgtagtatgttaaaactatatattttgtaataaaagttttcagagttagtgctcatttaactaaaaaatatataatgtttataactccagtagaacattagtgctaagggtctaaactctgaagcgcatatgtagttttatgataacttcattagtaaatctatttatacttttgcgataccctattttaaattatatattttcatgataaattagtgctaaatccgtagttttctaatacgatgtataaaagttgtagttttgcaagatcaaaatatcagtggttttaccaaatttgtttatttttaattcttaagtgaagaaaactttacacatgcatgttgcatcttcagtctaaggctctgtttgaatataagtagtagtagttttttttttcagcacgcagaggtaaccattagcacataataaattgagtattaattattataacttaaaagatgatattatttttaagagattttctcagtccaacaaaaagtacctcgaggtaccggtacctcacggacctcgaggtactttttgttggactggagcaaatcttttttttaagttatatatagttttaagaaaaatacaattttagcattttaaaaaatatgctcaaagtaaacgagagagttgtgaaaactaaacaaactaccgaacggagcctaaggcatccactaaatttagataaccaaacccatatatatatatatatatatatatatatatatatatatgctccttttgtgaaaagaacattgctcataatataatagtttaatttcctgtatcattgagcaggttacaatccctttccgaaaggaatatgtaacagattttgtggaaatacaaatgtgcccttcccatttgggcttgaagaaggttgctacgcgctagaaaagtttcgacttaactgcagagcaggaaaactatttctggatcgaggagatgtagactatctcgtgaggaacatttcagtggacaatggatatatgagcgtaaccaacgagcagaacaattcaacttctaacggcacagagatcatggtagttgctcgtactatgcatggctcctcggaagatgaccctcagttagatctttttgatttaactcaagaaaatgatatgaagatgtggtgggctgtcgtgagttttacttgccaggaagctacgcaagacatcaataacaattcctatgcatgccgtagtgtccatagcgaatgcatcgat

SEQ ID NO: 5600 - DNA, 1501 bp, Oryza sativa
aagcagaagcgggagcaagagcaagagcaagagcaagagcaggagtcgcagcaggagcaggagccgaagccgaagccctcggcgagaaaggctgcgtagtgagcgtgtatcacgtcgcagccgcagccgcagccgtagccgtagcccaattcgtagaagagaacatcgcggccacaggtgtgtctccaaatcttgcttgcaagtgatgctacattgagttgtatatttgcgtagttctaggagcagatgccggagtagggtagctaaaggcttcatctctattgcgaagctcaaataccatgtagattaccctgctaagttctaaaaaattaggaactaaaaacccacttgtgtaaaattatactagcccagccctaggtgagagctaaatctggctccgcccctgcacggggtgtttatattacctgaatggtacatccaataataacattgagttcacacaatttttgtttgcctccattattgtgttcattgtctgctcttcactacattttggtcatggacatacgttagctccattgagggaaatggattgttaaccaaaatttggcttgtggtcaactggtcacggaggtgttaggataattgcatggcaaatgtatggtagggttggcgaaaagcccagaggaagaaagagaaacatgttaatttatttagttgttctgccaatcccccagacttgacccacctcaacccccaaggtattataaagcttgtttcagggttcagtcctattaagctataactatgaagtaagtttaaacttattaaagcataatatctttgaactgctggttcaatgatccaaccattattcagacctattagacgttgaattggtcatgtaaccagtttttagaatctgtggtatggattctggaggggcctttactgtttccatcaacaaatatagcatgaaaaaaaatctaaatggtagggcttaactagtgggataaatgttgagaaattttaagaaaaaaaactattattcatcagggcctgacgttgtcatctgtagttctctggtacaaatttgagaaacaaggctaactcagtatcaggaagtatggaatgtaataaccgcaactctgttacaatgccttaacagcgccctcactgaactgtgttatatttgtgataactagcacattattgaaagtatttcaaatcagacaatgctattctgaagcaaatgcaatgatgttttcccccatcagtatgagcccttggcagttgtcccactacatgtattatgtataatggtgtgcacttgtaatccatgatccacttttcaaattccaatcacattaaagacctgagcacaaatttacttagtgcagatacaccatgtatatccactagaaagtgtcaattactcgtgtcatttataaatctatgctctcaattaagaagacacatgccctttgaatctagttatgccaaatgtgtttttttttctgtatattggagtacaatctgt

SEQ ID NO: 5601 - DNA, 1501 bp, Oryza sativa
aagcttcagtctagggttggagctcccttgtaacacacaagcttaattccacacacaggagtagggtgttacccttcctggcggcccgaacctatataatcccttgtctctcactcgcttgcaaaccacctcgttagctagatccccggcggagacactagtaggaaatcatccatctatgacgttttgctcatgacgttgtataatttcgtcattgaatacagcatatctatgacgaaatttcatgtttcgtcatggatcactcatggcggagggtagacatcgaaactccatgacgaaatttaaaatggtctcataaaacaatagataatttcgtcacaaaatggtgcgcaccattcatgtaacacacttatgacgctcctttattaatacaatatgctgaaatatatttcgtcagttgtaagtaaatctctattctgctgttggtcccaccttgcatatgtggctatctaggttgtcattggaccccacattgtatacgtggcaatccagattgttattggaccccacattgtatatgcagcacaggtgcgttttcgggccagcagatgctttgtgcagtccacgtgaatttgtgcagcccatgtgtcaatctgtgcagcccatgtgaacttttttttcgcagcccaaatttgtgcagtccgtgaatttgtgcagcccatgtgtgaatctgtgcagcccatgtgaactcttttttctaaaaaaaatgctgcagcacttgggggtcgaacccacgacttgtgactaaccataattctagcttaaccactacgctgcaaggagctttcatgctgatgatgttttacttttagttttcctttcaattctcgaacacaagaatgattgaatgctttatgcgggcgacctagtggtttggtcagggagggaggggggcggtggcgcagggtttggtcacagccagggagggagggtggcggcggcgcaggcggagctcagtgggggcggatcctagccaccgggacggtgcagaggaggaggtttcttatcccaccggtgcagggaagggcggctccacaggctggccggcatcgtgatgtggagcatcgtggtgggtggcggcgcggtgaagtgatcttggtcggtggggctgcggagggatcccagtcggcgcgggggatcctcgacgactgagacggatcggctgctcctcgcccaccgtcttatcctagcacctcctctctcaatcctatcgtcagcgcgcacagcccatcaccaacgccgttcagtagatataaggtatgattttccataagtacattactctaagtatgaaatgcaagttcagctatgaaagattatgctttgtgttgtatgaacagagaaacaagtcagagtattatgaacaaatcaacatggtttaagtcatgtagcaaccagctgttccatctaatgttttagaaaatattctgtcctaaaaaatggattagctttgtttgcctaattgctttttttaacatgc

SEQ ID NO: 5602 - DNA, 1501 bp, Oryza sativa
gcgccgtacggggctcgcccggctgtgactcgcggtgctgggtgtggggatggcggcgcggcggcgacttgcggcagtgcacgcggctgccacggcggcgggcggtggtgccgtgcagggcactgccggcggcggctcacagcagtgcacacgacggccgcgactgcaggcggcggcaccgtgcggagtgttgccggcggcgcggtgcgacgccatgccgtggcgtggccgtcggcgcgacgccgtgcggtggcgtggccggtgaccggtggtgcgatgccgtgcggcggcgtgtctccgatccgtgcttgcattggtgagtttcgtctctgccacgatggaggatgccgagaaaaccccaatcgtttacatgccggcgactccaagtcggtgatggcggttttagttgggagtcaaaaaacggaacgaggaagatgcaaggaattcatttttgcaattcaatctacaagatgcaaagaggattatcgagtttcttacctttctcctacattggtctccggtagagcttcgtgtctgatgacgtatacaagattttggggtgagactctctttactattcaatcctccaatcaactgtacaatgagtagctcatttctctttttatatagtgcaatccactatatagaaagttctgtgatggcccaataaatatatttgggccaggcttttatgggccaatcccaaatttttttaacagtttccagcgtgtgtagaggatgcatgcacttgtgacttcgtgaattccttgatgtacaacttcgttattattgttattattgtttacttcgtggcgtgtgttggtacgtacacatcgtatactctcttaagtaaacaataataacaagttggctataataaccttgatgtacaactttgtggtatagaatattaaaggtttactttgacttcatcgccgtgacgttgccaatttaaagaacgtacaataatttaccttatttagaacaattcgcatcgtactttcatcgaattttcaaagttctctctctccttttgaaaggaaggcaagaagattgcctcaaatattgatagaacagaatagtttttcataattttgtggaccagttttattttgagaatttttttttctggctgcgcgcttgccttcttaaggaagctcccactgcctgtgttaccacacctgagccaacaacgacgaccagctctagctcgttgtagcaatatctcgttgtagccatttattttttttttccagcaggatgttcagagtaacacaacttctcaggtattgtatacaatatagccgaattatacacactatagctgaaactggaaagattttgttgtgatccggttgtgttgcagagagactaccaagagagttattggaacaaaaacaacttcccgtgcagatttaacactaagttgcttctccacggtgtccaatttacagaggttaatttcatctgccttccattttagttcttggatgatctcctg

SEQ ID NO: 5603 - DNA, 1501 bp, Oryza sativa
aaaaagagaaatgagctactcattgtacagttgattggaggattgaatagtaaagagagtctcaccccaaaatcttgtatacgtcatcagacacgaagctctaccggagaccaatgtaggagaaaggtaagaaactcgataatcctctttgcatcttgtagattgaattgcaaaaatgaattccttgcatcttcctcgttccgttttttgactcccaactaaaaccgccatcaccgacttggagtcgccggcatgtaaacgattggggttttctcggcatcctccatcgtggcagagacgaaactcaccaatgcaagcacggatcggagacacgccgccgcacggcatcgcaccaccggtcaccggccacgccaccgcacggcgtcgcgccgacggccacgccacggcatggcgtcgcaccgcgccgccggcaacactccgcacggtgccgccgcctgcagtcgcggccgtcgtgtgcactgctgtgagccgccgccggcagtgccctgcacggcaccaccgcccgccgccgtggcagccgcgtgcactgccgcaagtcgccgccgcgccgccatccccacacccagcaccgcgagtcacagccgggcgagccccgtacggcgccgttgcgagccaccgcacccccgccctgtgccgccgcgagctgaccaacggccgcgccccgcacagcgccgccgcccgattccgcgaccaccgcacagcgccgccgcgcaccgccacgcagcgatgtcattcgcaccccgcatggcgctgctgcgcgcgccaccacgcaccgccaccggacgcatcgacgcgcactgtcgccggccgcaccccgcatggcgccgccgcacgccgccgcgacagccgcgtgccaccgccgacagccacgcgaaatctccggagagaagaaaaagaaagaagaaataaggaaagagattagcgattttgcggaaagcctcctagattttctgaaaattagacgcatatctcccagcatggaacttttttgcgcataggaccctagaatttcggaaacgttcatttctaaccattccctgcatggaaaacttagaaataggcccttgaattttgcaaatgtcgcttatattccatatttaagcattttatgtcttataaaatttcaatttaaatttattaaggcattaattactgttaatgaatattttgaatattttgtttttagtatttatatgaatatatgcaacttttgcaccttttttctacgaatatttgtttgcatttctacaaagtatttatttattgaatattttgcacttcttattcgcattccctatgaatataaatattggaaaaatcatgaaatacttgcattcatatttgcaactatgtcactggcagtaacatatgaatattttgtcagttttgcaacagaatgtcagaatcacgaacaaggagttcgctgaactggcccagcatggccagagctacctgacctaggcatctgacgtccagatcg

SEQ ID NO: 5604 - DNA, 1501 bp, Oryza sativa
ctcgtcgcgttggtgccctctgttctcgccgccgtgaccgccggtgaccgtgatgtcccgagcctctcgccggtgatgacgtcatcgtgatgtcataaagcccttttcccttctaaaattaaatcttaaaatcagtttaatcttgtaaaattcataactaattcatatgaagtcggaattaagtagttcaagttgctaaattcatctaaaatcatgatctacatgtttgtttactttatgtgtactgattatttggtttttattagtctttttcttcgttttgcgtgttagcttgccgtttccgtcgttgcgaagattcgtgagtgcgtcggaagtgttcaagaagattaattcaagactgattactgcaaggcaagtcacacagatcctaaacacaatcctttgagcatgttgatcctatatttaaattctctatttatttcaactgtgcatttattttcaaatgtcaccgggtggtgtgaacctattcctttgttatagccaatttgcattgaatgccctattccttgatacctcgggtaataaactgattagcttgaaccttatatattggtttggttcagctaaatgccatatatatataattgcttagccatgtttagaaacattagatcattaatgggatgaatcacattacattattatttatgattaaatttaatggtagctcacgatggttaatcgtgattggttattaattaattgtcaactaaaattgatactggtgggttgtgagcacatggttttgaaggtcgtgctcatgacaattaaggaccagttcgcgagctactgttgtgagacattaaccgtgccaaccacaagccagcgtgggcaacggctttaccttttgtatagcatgattcattacggggtgccagactgagaagcggtgataagtccgtgggggtcgctggggagtccatgtctttggttatatttatagagggggtgattatgatccaggaatggtgcactgtggtgagttgtgttgtgcagagggtattgtcgcagcctctattcgggtactttccagtatcgcgacgcatggtagacatgatgttgaggctgtgtcttgtgggtacagtggtacacctctggccagagtaaaactattcaaatagccgtgcccgcggttatgggtgagttgagcaatgtttttcgtgattagcctcacacctctcacaataattattgatgctataattggtaataatttgcttagctcctggtttggagttagatctgtacagccggggttggttgttcaggtttggttgggcctgtgcagcattagggtgctgttcagtgttgattaaaattgatgattaattactctactgttttactactcttaaatctttgctaaatgctgtttttgcaaatgagcctatattatgccatcctttggtgtccttgtgcacttgcatatttgatgtgtggcttgttgagtatgtcatatgctcattcttgcaataatcaa

SEQ ID NO: 5605 - DNA, 1501 bp, Oryza sativa
ccctagtcgtcctctttcgtttgctccaactcccgagctcccccatcgcccgtagggccgccgccgccttgctctagccgccgccgttgccggcgatgacgtcagcgatgacgtcattaatcccttttccttagttttctctattagatgaaaatcgattaaacttccgaaattcataactaaatcatcgtaactcggattcgagtggttcaagttgctaaattcatctaaaatcaagatctacatgttaaaaatatccacatgtactgtttttgcttgtttttgtactattttgttgattttgttctttcgctttagtttccgatgttccgaggagagcgttttcgttgaggaaggttcagaagtgtttgcggaagatcaaggcaagtcacacagatctcaaacaaccctttgagcatgttgaacccgtttaaagctaatgttttatttcaacttatgcattattttcgaatgtcatcgggaggtgagcctttcccgattaattaatggccgaatatgactttattttcctatgggttataatttgactagcatggaccttatatattggattggttcagctagatgttatttatagttgcttagccatgcttagaaacaatagctcattaaagggatgaatcatactatattattaattatggttatatttaatggtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtgccaaccacaagccagcgtgggcaacggctttaccttttgtatagcatggttcattacggggtgccagactgagaagcggcgagaagtccgtgggggtcgctgggtagtccatgcctctggttatatttatagagggggtgattatgatccaggaatggtgcactgtggtgagttgtgttgtgcagggggtattgtcacagcctctattcgggtactttccagtatcgcgacgcatggtagacatgatgttgaggctgtgtcttgtgggtacagtggtacacctctagccagagtaaaactattcgaatagccgtgcccgcggttatgggcgagttaagcaatatttttcgtgattagtcacacctctcacaataattattgatgctataattggtaataatttgcttagctcctggtttggagttagatctgtatagccagggttggttgtttaggtatggttgggcctgagcagcatgggcgtgttgttcagtgtttattaaaattaatgattaaagtactctactgttttattactcttaaatgtttgctaaatgctgcttttgcaaatgagcctatattatgccatcctttggtatccttgtgcacttgcatatttgctgtgtggcttgttaagtatgtcatatgctcattcttgcaataatcaatcaaccttag

SEQ ID NO: 5606 - DNA, 1501 bp, Oryza sativa
atatgcaagtgcacaaggataccaaaggatggcataatataggctcatttgcaaaagcagcatttagcaaacatttaagagtaataaaacagtagagtactttaatcattaattttaataaacactgaacaacacgcccatgctgctcaggcccaaccatacctaaacaaccaaccctggctatacagatctaactccaaaccaggagctaagcaaattattaccaattatagcatcaataattattgtgagaggtgtgactaatcacgaaaaatattgcttaactcgcccataaccgcgggcacggctattcgaatagttttactctggctagaggtgtaccactgtacccacaagacacagcctcaacatcatgtctaccatgcgtcgcgatactggaaagtacccgaatagaggctgtgacaataccccctgcacaacacaactcaccacagtgcaccattcctggatcataatcaccccctctataaatataaccagaggcatggactacccagcgacccccacggacttctcgccgcttctcagtctggcaccccgtaatgaaccatgctatacaaaaggtaaagccgttgcccacgctggcttgtggttggcacggttaatgtttcacaacagtagctcgtgaaccggtccttaattgtcatgagcacgaccttcaaaaccatgtgctcacaacccaccattgtcaagttttagttatcaattaattatcataacacgattaaccatcgtgagctaccattaaatataaccataattaataatatagtatgattcatccctttaatgagctattgtttctaagcatggctaagcaactataaataacatctagctgaaccaatccaatatataaggtccatgctagtcaaattataacccataggaaaataaagtcatattcggccattaattaatcgggaaaggctcacctcccgatgacattcgaaaataatgcataagttgaaataaaacattagctttaaacgggttcaacatgctcaaagggttgtttgagatctgtgtgacttgccttgatcttccgcaaacacttctgaaccttcctcaacgaaaacgctctcctcggaacatcggaaactaaagcgaaagaacaaaatcaacaaaatagtacaaaaacaagcaaaaacagtacatgtggatatttttaacatgtagatcttgattttagatgaatttagcaacttgaaccactcgaatccgagttacgatgatttagttatgaatttcggaagtttaatcgattttcatctaatagagaaaactaaggaaaagggattaatgacgtcatcgctgacgtcatcgccggcaacggcggcggctagagcaaggcggcggcggccctacgggcgatgggggagctcgggagttggagcaaacgaaagaggacgactaggggatgctatttataggcttggattgaagagaccggactcgaaccgagaggaattgagccgga

SEQ ID NO: 5607 - DNA, 1501 bp, Oryza sativa
taaaaggaaagcgagtacatttcattttagttactttattatcattgtcttgttttgataatcatttaaccaatattttacctttcgcacttcaaaccaccctaatttatacatgaagaaaatgagcacaccataccgttgaaaatattggcgttacgaatcccaagacatcgatgcattaaacttccctacttccaactcttgctagtatcgtccgtatcattggtagcctctaataaccagtcacgtgacacgacactagccaaagggtttcattgattacgcagaaggtgactataagccacaacgtctattaaaaaaaactgcatgtaaaacttttttatatgcattcttagcgatttaaaagatactccatccttttcaggttttaagacattttgacttcagtcaaagacaaactgttttaagtttgactaagtttgtagacaaatatagtaatatttataatactaacttagtttcatcaaatcaataattaaatatattttcatagtaaatttgtcttggattaaaaatgttactacttttttctacaaatttagtcaaatttaaagcagtttgactttgactaaatcaaaacgtaaataacttgaaacagagggagtatgttgaaaaagaaactatgttaaaaagatcttaaaatttaaatttaaaatttaactttggcttattctttttagggcagctgatgggtccgaagacctttggaactttgactgtaaccccaacatagcttattggatgatccataccagcattgttcagttgttgtgtgataactcaagctgcgtgagtcgtccggttaatccaaacccttcgaacgcgatcaaatggttgtagcgacatcaaagagtgctttatgcgcatattactgatcctgtccacaaaaaagcctctgtccgtagaaacttcttccccaaatattggcacccactccctgaccaaacgactcgttcccacaagtccgccacacataacgaaagatcacctctcagaggctgtacgtgggacccactggtgtacacgaatgttcgggaccccacctgcagagagaaaccatgctcgatacgcgtgaaaaatacacctactacatcgacacttgacctgtgggagcccaactgggaccccacctgcagagagagaaaccatgctcgatacgcgtgaaaaatggagtactcctactcctactacatggacatttgacctgtgggggcccaacttgcagtaacaatagtttaatgtacgaactgggcctggatgggccacgcccccgcgattccgggaggggaagaggccgaccgtgcccgccactataaaagcaccgcctcgccgccgcacacggaggccgcagccgcactcgcctcctctcctccactcctcctcccgcatccgcggaaaccctagcctcctctctctctctcctcgttcactcgttcctcgcgccgccgccgcgacccgcgagcgggaggaggagccatgg

SEQ ID NO: 5608 - DNA, 1501 bp, Oryza sativa
tctatttcaaggaacaatgtcggataaatatgtaaacatagtatgtgatacaattatctctatgattgcctctagggcatatcattaacagccaccgccagcttctcattccatgaagctagctagcagacaatggaagccactgggatgcagctgacgcactcatcttccttttctccccacctccgccgctcccggacttgcattagagcgtcgccgtgcatgtcgcctcgctttgacgccaacctcgccaaatctgccccgctgccgcggcatcgcttccttccatggcagcctcgatgagccatcgggctgtaatttgcggatgccgaggaacccatccgcccacccattttggcccacacgaagagctgctccaccattgctgtggggaggtccaccccgtcacatgcaggccatggcaactagccgacgcagagcgagagagcacaccagtggcaagcagttggtggtgaccatggcacgcggtggccgccagcgcacaggatgaggagatcgagcgtcgatgtcgacagcatggctagaccatgacatggtggctggcgcaaggttcttccgtcatcgaagctctacagtggcatcctagggaacccctgtttaaccttggcaatttatcgaatcctatttgaatgacggcatgttagcgaagctagtttttttttcaattacatagatgcaaatttttttgactatatgttcatcaagtaatgagaaaccataaaacactagtacagatcctcccatcaatgaaggcctctcacataactgggttttgtgttccgtcactccagatttgcccgagacatgcacctaaggagaaaatcgcaatcgggccgaaataaacaccgacgtagatcaactcgtacagatataattgagttgcatatatcaagtgcccatcaccgatgagactcatctgtgacgggcctacgtttaggcccgattgagattatctctacaatctttgtcgggcccaacacttaagcctgcaatggatgagtatcatcggtgacgggcgacaaacacatcccgattaacataaatttaaggcctatcaccaatgagcagttatcgatgacgggcttattggtatgcccgtttgagataactgaacgcccgtgaccgatgttctttcattggccgttactgatatctattgtacactacaaatactccaccccattgttctctgaagttatcccactgttcactattttggtgagaggttgaagggggtgaatttttgtgtatttttccaagaaaaacagaaaattcataaagtcagtgaagaatactaatcaattctcattaatttagtaatacttatcctataagatgtttctctaatattttttcatttttgcaatgatgaatcgaagttggatatatgggaagactgtgaaacgtcatagcaaggagtatagaaatgatgtattaaattttataaatgcagcggaggaggataagaaaagaagaaaca

SEQ ID NO: 5609 - DNA, 444 bp, Oryza sativa
gggagcggcagcgagggacggggagacggagagcgagggggcgctcggcgcggcggcacacgcgctcacgcgcgcgcggcgcgcgggcggggcggagcggggcggagggagagaggcgctcggggcggctctcgcacgcgcgggcagcgcgcgggtgaggctgagcgggggtgaaggagcgcgccgggggagggagagagagagagagaaagagagcccgggagagagagagagagagatgggccgagcggaattcggcccatcgaaccccgggggaggcaaactaaactttgcggagggaaatcgatttggaaggatttggattcggatttgaactcgacgatagatcggggattgagatcttgagatggcacgggcactagacaacaagcaaggaaacaaatttcgcaattagggtttttaagagataattttcccgctagg

SEQ ID NO: 5610 - DNA, 1501 bp, Oryza sativa
gaaagacatcacgaccccctgtagaaaaaaaagaatttgttgagatggaagtacagatataatattcttaccaagataactgaaagccccaaccactaagaatcctattgaacctagaaaaagaatacaggcccagaaaaaattacctcttacacaataattcttttgtctattacatattataatatattttattttgtccaaagcaaaggttgagtattttgctactatatttcaagataaatgcattaaatatgtatagctcatctactgtacatattaactctaatgtggatctatataattagctctactattacacttgctctaatgccccccccccccccaccaccaatcgtattaaactgttaactacgacagttgactatattaagagaagactttccaacactattacagaagctgttgcggtctctttacagggagaaagaagaggagagacctacggatcggacgtccgatcaggagaaaaaaatcggacgctcgtcccagccatcggatcgagggattaaatctcgaccattgatagcgcgtcgtcactgttcgatgcaaacttctcccgggcagctgcatgcatgcaacttttcccgcgcacagaattgcatatgtgacagggatagttaatgtcccgcgcacagaagggcttcgattgggggaggagggcggcgccagccaccgtggcgccgcggtctgggggggcgccagccgttgcccggagacagaacagacttggcgaaaatttttggggggggggagaaagttggtggggcccgcagagggggggcccacccgctttaatgattgtgttgacctttatgttaaggcctcaccaatcccggtaaacaatcgtctcctcactcattaccacaaactatgctccgattcattttcatatattaaaactacatatgagcaattctatgttttgatcattgtttctctaccacagtaccacttatatatgagtagtaccaagaaaatgttaaacatgaaagcaattttcatgataaagctagtgaaatatttgtcatatattaaagcttaattaatgttgttgcatactcatatatctgactgtatgcttgctcagctcaacacctactctatttaagtaccagtactgattagtttacatcaaactcttaattttctagtactacacaattaagcctaacggttgctactacactactgccactgttatgactagtgacccactaattcttcacaagtcacgtaacgcccggaattaaaaatgtcacgcaattcattgcacagttgcagccggcacctccgcatttgtgctctacatttgtgcttgcttcacatgaaaaggctacacatgaatttaatatctcacacctttcccttgcgtacaaaattcagtcaaactcagctactagcatggagcctcaccgacacccctctctctcatctcatttacacattttttaaaaagtaaaaaagtaattcaaagaaa

SEQ ID NO: 5611 - DNA, 1387 bp, Oryza sativa
atttggggatttgttatttttagtaaatttgtactccaaatttatctgaatgtggcatcgcacgagtaacataatattcccagatactctttctttgaattacttttttactttttaaaaaatgtgtaaatgagatgagagagaggggtgtcggtgaggctccatgctagtagctgagtttgactgaattttgtacgcaagggaaaggtgtgagatattaaattcatgtgtagccttttcatgtgaagcaagcacaaatgtagagcacaaatgcggaggtgccggctgcaactgtgcaatgaattgcgtgacatttttaattccgggcgttacgtgacttgtgaagaattagtgggtcactagtcataacagtggcagtagtgtagtagcaaccgttaggcttaattgtgtagtactagaaaattaagagtttgatgtaaactaatcagtactggtacttaaatagagtaggtgttgagctgagcaagcatacagtcagatatatgagtatgcaacaacattaattaagctttaatatatgacaaatatttcactagctttatcatgaaaattgctttcatgtttaacattttcttggtactactcatatataagtggtactgtggtagagaaacaatgatcaaaacatagaattgctcatatgtagttttaatatatgaaaatgaatcggagcatagtttgtggtaatgagtgaggagacgattgtttaccgggattggtgaggccttaacataaaggtcaacacaatcattaaagcgggtgggccccccctctgcgggccccaccaactttctccccccccccaaaaattttcgccaagtctgttctgtctccgggcaacggctggcgcccccccagaccgcggcgccacggtggctggcgccgccctcctcccccaatcgaagcccttctgtgcgcgggacattaactatccctgtcacatatgcaattctgtgcgcgggaaaagttgcatgcatgcagctgcccgggagaagtttgcatcgaacagtgacgacgcgctatcaatggtcgagatttaatccctcgatccgatggctgggacgagcgtccgatttttttctcctgatcggacgtccgatccgtaggtctctcctcttctttctccctgtaaagagaccgcaacagcttctgtaatagtgttggaaagtcttctcttaatatagtcaactgtcgtagttaacagtttaatacgattggtggtggggggggggggggcattagagcaagtgtaatagtagagctaattatatagatccacattagagttaatatgtacagtagatgagctatacatatttaatgcatttatcttgaaatatagtagcaaaatactcaacctttgctt

SEQ ID NO: 5612 - DNA, 1501 bp, Oryza sativa
ctccctcctcgctccgtctcctccccctagctttcggtagtagctcgagtagaccccccgtagctagccggcgccgccccaaccgtcgccttcgctcgccgtgtgctcgccgccgtcgccgcccgagctccgtagcacccgctcgtcgccggcctcgctcggcgtagttccgcccaatccgacgatagcgtcgagttcccgaagccgcgtagatgctctcaccgacgggaatcgacccctcgtagcctcgtcgccgtttccctcttctcccgccgccggttgccgccgccgcaatccgccgccgtcgagcaaacctccggtgaatccgagccattggctcgcctccccctgtcgcgaacaaccgcccggtgtgctcgcttctgcccgtatcaccatggttcgcttcgccgctcgccgccgccgcccgccgtccattcgcggccgggtcgtcgtctaccttccgccggcctgcatggcagccacgtaggcgccacgtcggcgccagctcagcctagaccgggtcgagccgaccccggtcggtccctccccgtgcgcgcgttccaccgcgagccgtgaggctgcgcgtgggcccgtcgcatccgcgtccaccgcaaaccgcgcgcgtgcaccgcgttcctccccgcccgcgcgcgtgcgccgcgtgctccctccgcacggcgagccgagccgttgacaagcgggtcccacccgggaccgcgcgtggtgagcccggtccaccggactctctctcccctcccccgcgcgcgcgcgcgcttgggccgttttgggccggccggcccattaagctcggccgagccgccccagatcccttgggccgcaccctagccgcccgaggaaagtctaaatttcctccctccttccttttctttctcttttccaaaaaaaaagggatttaatttaatccttttttccgttagaccaaaaatccaataatcttagaaattcaatatcttcccaaccgtaaatccgtttgactccgttcaacttccaaaattcatcaaatctcgagatctatctaatggcacgcttagaggtcgttaatagggctttattttcgctgtttgttgagttgccccgtttcgcgtgtagtttcggagcccgaagacccgcagtgcgaggattttgaggatcaagctccagatctcgagcaaggcaagccacctttgaacatcttgagcctatatttgaaattcaattatgttgcttgcaaaatattatgcattgataggatcacacttaatctgttgtcccatctgcgaagcagattggcggacttacttaatttgtcgcatttgatccttccattgttaattgctataccatgtccccttgtaaccacccagttgcgcctcgatactcgcgcactctgtgcgagtatcgacggtcgccttcaaacttaaaatctgagtaacaacttgggtaaaactggagttttacaaaagacttggaaaacccgacacttgggtcggtgcttgcgaac

SEQ ID NO: 5613 - DNA, 1501 bp, Oryza sativa
agaggtctaacctcttggaacatttcctctgaatctatctctctcatctgatttctgcgtttttcctgtggtctaatcaaatggccattcctgtgtttttcctgtattttacattcctctgttttacaattgtattcctgtcagaatcctgtgttttctctattcatctgttttttcatttctacgattcaaaggacccaactgttgctttgtcacatttgttgttcaattctatttttatgattgctaactgcgaaggccctcttgaattgtagaaaaaaatatattctatcatattagaaacaaatgattctattatattctatcctttgaaattcatgcggaataggaatagacaatccggagtctatctctcttatccgattcttgtattattttgttttacggtctaaacaaacggtcatttctatgttttgttgtcttttacacttctctattttctctattttttttaattcctactatttaaaagggtcctaagagcaagtaaaaatctgtttgaagttctattaaaaaatataaattatcttaggattgtaacaaagttgatgttcgcctctgcttaaaaagaggagcagtcgtgcggataagccacggaaaaaaaacgaataaaaataatttataggtcaactttttatatccgtattatctacggtgcagccaagctagaaatagactagaacgaaacaaaccacaaaggtaagtctcttctaaaattaaaattttcaaaatttataaatgctgattattgttgataagccaataagcaaagcaatgagagacaactagactaatgcattcaatcgagagatcaccagttctgattcagataatttagtaccacacactttcacagaactgaaaaaaaatatcaacttagatcctctgcattagaggtactaacgcagtggatgaacaatgataccaaaccacacgatcacagtctaacgatccagatcacactgatactgtaggctgtagccataaattgtgcttagttactgtagcagactcggatcacgttccacaggaactctccgctgtacgatgaccggactggagaaatgtagagagatacgatccgttctaaaaatataaacattttgactctaacacaatctccgagatattattttaaccaacaatatctataaaagaaaaatattttaaataaaaagagttatatattataatagtttatttaatgataaatttagtaacatcaattttatataattaattttttatattaatagttaaagttaaaaatatttaatttatcattatactaaaaatatttatattttgggacagacagagtatattttttgaacacgataggacatcgtcattagtagtacatagtcagtgcaatttttatcagacaccgacaggtataagtacattctgaaccaagaaaaaacaagagcagtagaacacacttgggcaaaaaaaaaaaaaagtaacagtagaacacaca

SEQ ID NO: 5614 - DNA, 1501 bp, Oryza sativa
caagggcgagcagagcgtcgtcgtgcccatctgcttgcccaaggacgccatggacaagttccagctcgaggtccaagctctcaccgccgagctcagctagaccattgaaacgcagcatgtgtgttctactgttacttttttttttttttgcccaagtgtgttctactgctcttgttttttcttggttcagaatgtacttatacctgtcggtgtctgataaaaattgcactgactatgtactactaatgacgatgtcctatcgtgttcaaaaaatatactctgtctgtcccaaaatataaatatttttagtataatgataaattaaatatttttaactttaactattaatataaaaaattaattatataaaattgatgttactaaatttatcattaaataaactattataatatataactctttttatttaaaatatttttcttttatagatattgttggttaaaataatatctcggagattgtgttagagtcaaaatgtttatatttttagaacggatcgtatctctctacatttctccagtccggtcatcgtacagcggagagttcctgtggaacgtgatccgagtctgctacagtaactaagcacaatttatggctacagcctacagtatcagtgtgatctggatcgttagactgtgatcgtgtggtttggtatcattgttcatccactgcgttagtacctctaatgcagaggatctaagttgatattttttttcagttctgtgaaagtgtgtggtactaaattatctgaatcagaactggtgatctctcgattgaatgcattagtctagttgtctctcattgctttgcttattggcttatcaacaataatcagcatttataaattttgaaaattttaattttagaagagacttacctttgtggtttgtttcgttctagtctatttctagcttggctgcaccgtagataatacggatataaaaagttgacctataaattatttttattcgttttttttccgtggcttatccgcacgactgctcctctttttaagcagaggcgaacatcaactttgttacaatcctaagataatttatattttttaatagaacttcaaacagatttttacttgctcttaggacccttttaaatagtaggaattaaaaaaaatagagaaaatagagaagtgtaaaagacaacaaaacatagaaatgaccgtttgtttagaccgtaaaacaaaataatacaagaatcggataagagagatagactccggattgtctattcctattccgcatgaatttcaaaggatagaatataatagaatcatttgtttctaatatgatagaatatatttttttctacaattcaagagggccttcgcagttagcaatcataaaaatagaattgaacaacaaatgtgacaaagcaacagttgggtcctttgaatcgtagaaatgaaaaaacagatgaatagagaaaacacaggattctgacaggaatacaattgtaaaacaga

SEQ ID NO: 5615 - DNA, 1501 bp, Oryza sativa
attcttaccaagataactgaaagccccaaccactaagaatcctattgaacctagaaaaagaatacaggcccagaaaaaattacctcttacacaataattcttttgtctattacatattataatatattttattttgtccaaagcaaaggttgagtattttgctactatatttcaagataaatgcattaaatatgtatagctcatctactgtacatattaactctaatgtggatctatataattagctctactattacacttgctctaatgccccccccccaccaccaatcgtattaaactgttaactacgacagttgactatattaagagaagactttccaacactattacagaagctgttgcggtctctttacagggagaaagaagaggagagacctacggatcggacgtccgatcaggagaaaaaaatcggacgctcgtcccagccatcggatcgagggattaaatctcgaccattgatagcgcgtcgtcactgttcgatgcaaacttctcccgggcagctgcatgcatgcaacttttcccgcgcacagaattgcatatgtgacagggatagttaatgttttgtaagcaaactttaaactattttttctcttaaattattaatccaaatcatgatctaattgtaccattaaattcgttgtaattaaatctttaaaacaagaccacacatggatatattccaacgaaaaaaaattagcttattattgaattatttttaaatgtgcacgatgttacaccaagtataacggaattgtttcactaagtagatcgaaaatgttttagtcgtttaaatcgggcgttgtttcaccttatataaaaacaatgtttcagtaaatagcgaaagaatgtttcagttcaccacaacattagatctatacatagtgaaatattgtgagtacactaggtgaaacattttatgtgaaacaacaaataaaacgaattcccttaatagagtatttccaaaatatgtggttgatttgttgcaacgttgtgcgtggtggggacacgtggcaggagcgacgcagtggtggggacacatgcatgggcgcgggcacgggcgggaagcgcggcgcgtggaggtatcacccgattgtttggcgcacggatcgggcgctcgggttcaagcatttttggatattttatcaaatatcggacgcccgcccatccttggcgtctggcacattcgtcaggatgagcatcgtatgccgtttgcatgttggcttgtggcgcatgcatggcgtatgtcacatgcatgtatttttctactttctctctcttttcctttttctaaaatatgtgttcaatatataatctattacaccattttattcgtcataattagatctttataacaagatctcacatggatatattttgataaaaatatttattaaaaaatcaaacttatgttgcaccgtctaaaaaaagtttcaccacttgtgcagatgcgtcaacctagttcataaaatattccagagat

SEQ ID NO: 5616 - DNA, 532 bp, Oryza sativa
tgtatgtatatatgtatatgtagtatgtatgtatatatatgtatgtatgtatatgtatatgtatgtatgtatgtatatatatatgtgtgtgtgtgtgtgtgtgtgtgtgtgtgtctatatatatatatatatatatatatatatatatatatatatatatatatacccgcgtgttgcagggaattaataatttagatgtactcgagaaaagaaacttatggaagaaaattggtaaatcatgtcacttgtgatatctatctaaagcattgtaataattgatatgaaattgtaattattaatataatcaagcaatttaatataaaatataaaattttaatccgttagtataatttaatatacaaacttcaaacccaatgtacaaaacaatgtctttctttttcagttacagagataataagaggtatacacataattgtgaatgtgtctctttaaatacacgttcaaataaatgaagactattaatatatctcattgttaacgaccaaatttggtaatatcggcatcggaaagg

SEQ ID NO: 5617 - DNA, 1501 bp, Oryza sativa
aaatacaaaaatattttaacaaaatcaaatatttgcaaatgtattgtatcatatgattttttttcaatgtttcactaattgggacataatgtttcatgcagtgataattaccgttgcagtcaatactttttatatgttgcatctctggaatattttatgaactaggttgacgcatctgcacaagtggtgaaactttttttagacggtgcaacataagtttgattttttaataaatatttttatcaaaatatatccatgtgagatcttgttataaagatctaattatgacgaataaaatggtgtaatagattatatattgaacacatattttagaaaaaggaaaagagagagaaagtagaaaaatacatgcatgtgacatacgccatgcatgcgccacaagccaacatgcaaacggcatacgatgctcatcctgacgaatgtgccagacgccaaggatgggcgggcgtccgatatttgataaaatatccaaaaatgcttgaacccgagcgcccgatccgtgcgccaaacaatcgggtgatacctccacgcgccgcgcttcccgcccgtgcccgcgcccatgcatgtgtccccaccactgcgtcgctcctgccacgtgtccccaccacgcacaacgttgcaacaaatcaaccacatattttggaaatactctattaagggaattcgttttatttgttgtttcacataaaatgtttcacctagtgtactcacaatatttcactatgtatagatctaatgttgtggtgaactgaaacattctttcgctatttactgaaacattgtttttatataaggtgaaacaacgcccgatttaaacgactaaaacattttcgatctacttagtgaaacaattccgttatacttggtgtaacatcgtgcacatttaaaaataattcaataataagctaattttttttcgttggaatatatccatgtgtggtcttgttttaaagatttaattacaacgaatttaatggtacaattagatcatgatttggattaataatttaagagaaaaaatagtttaaagtttgcttacaaaacattaactatccctgtcacatatgcaattctgtgcgcgggaaaagttgcatgcatgcagctgcccgggagaagtttgcatcgaacagtgacgacgcgctatcaatggtcgagatttaatccctcgatccgatggctgggacgagcgtccgatttttttctcctgatcggacgtccgatccgtaggtctctcctcttctttctccctgtaaagagaccgcaacagcttctgtaatagtgttggaaagtcttctcttaatatagtcaactgtcgtagttaacagtttaatacgattggtggtggggggggggcattagagcaagtgtaatagtagagctaattatatagatccacattagagttaatatgtacagtagatgagctatacatatttaatgcatttatcttgaaatatagtagcaaaatactcaacctttgctt

SEQ ID NO: 5618 - DNA, 1501 bp, Oryza sativa
gcattagctagaaaatgtaatcctggaaaagcaaactatcaagagggagcaagttatcagtgcagtgagttagtgtacgatccatctctaagaatatatgagcaaaataacatcttggatcaaattcatcaaaccaaatctgagtcgatatcttgggaaacagggtgctggatgaagaaattcgcagcttgacactttcgttcttcttctgaaggagctgttttttcactggacaaatgtgttgaagtctgcacgagacaggaaaacaaaaccagaagagtaccattcgacgagaggaaaggtacatcttgtttggccttcggttgtgcgtataaaacaaatctaacccatgtcatgaacaacttttcggaaagataacgctcgggggaccttgaagatgaagctgacccccctagtggcctagtattttttctttaacaagtgaaggacaaaagatagcatcttctaagaaagagataatatagagcaatttgatttgaactcaaaggagtgcatctcataattaagagattaaatagatcaatttgattgtttgacgacaaagagaacattgctttggaccggaaggagagcacccccataatgataaaacactaaaacagggaaatgcgtgtacagtctcatcttttttttaaaaaaaatataaatacatatgtcagggttatggataccacctacctaatagtagttaactaaatctcggcaggactcaccacataccatgtcctatacggaaactgacttcggatatggagggagttccgaataaggaaagacaaccagagttctacatgaaaacgacaaggactactcggattgtatccatattgttttccctagttctacttggacaagaggacacctatggatataaatacaagaccccctaggaggagaggggaggacacacacgaccacacaatcaacacccaccacaatcaacagataacagggacaatacacacccatcacaatcaacatacacggaacatagatcaacatacaagccaacatacgccaagacaagacgccggatatcgacttcagggataagcacggctagtcccctacggtgtctccggatactgtcaagagagacgaaagcgttatctctgatctcgccgggcacgaactcgaggaggaagactaccctgttgtcgactacgagtcagaccttcagaccaccatgtcgacaacagttagataggctaccccaaatattgtactggtgtgattatggtgaataagagcaataccggcttcggccaacaagatatagggttattacctgacaattgaggggcccgaacctgtataaaaatccccgtctttgtcacttttaccttagtctcgcgtataccctagtaccaacgatccccatactatgcaaataccggaatcgcgacatcaaacatcgatagtggcgcgccaggtaggggactttggtgctctaggatttcgacgagatgagttcaaaaga

SEQ ID NO: 5619 - DNA, 1501 bp, Oryza sativa
ttaaaaataagtactgaaaatatgtaagaaacatcaaaatcaattttaaaattgaaaatttgaattttagtatagtggtttataacccatatagtgaacaattaatgagaccctgagacataaccacttcatttcctgaaaacaaccaatcaaattgcacaatatctatctatctatctatctctttttctaatgacttgtattagacagtgtgaaatttatattgatagaacagaaaaaaaattacaaaattataaccatggaagatcataaccaagaaaaaagaaaaaaaatgacccacgtaccgacaacactaatacatagacccagaagaaggctagcaccgaaccgaccgccactaagcgtgaccggtcgctgctagaccaacgaaagagtaaagttgacggcaaactaattaagctagtaccgatcgatctatcagtgaaatgcttgcaaattaagctccatcccagtaatgcaattaattaagccctccaattaacgaaacgtggatctcgcgcgcactcgcattattcttgcctccaaatcgatatgatatgatatgatcgtcgattgatcactgcagtggcgcggccggccgggataagatcacaagaaaactacttccattagcttctgttccatccattgttgccgtgagcgcgtggaccatccatccactgtcgtcgtcgccactgccgacctacctccatgtatgcagtatgcatatatgccctgacgtcggcgatcgatctcgatccctcgccggagcggcggaaacagcgacgtcaacggcagctaagctagctagcccagctccagttgtgtgacgtcgtcagctagctagctgccactgagccagccgaccattaattactctatccatcaaaaaaaaaaaagacaaactctgctttccgtgtctaacatttgaccgtccgtcttatttaaaaaaaatatgaaaaaaattaaaaagataattcacacataaattattaatcatgttttatcatctaacaacaatgaaaatactaattataaaaaaaatttatataagacggacacataaaatattaatcatgtttttttttgaacggagagagtaattgctaacctcacctcagctccagctctgctagcatgtactactgagcatgcagtgacacggacgttacgtggcacagtacagttctttgtttgacgagatgatgacccccagttgcatgccatgtgctgaggaacaatctactctacctgccgtcgtcgaattccgatggcgcccagcatacacatcagccaccagatttgttccatctctcttcctcgctaaattaaaaataaacagacgaaactgtggatcccaataataaaaacgataaaatttctgtcactaacgaaacaaacaggacagagataagaaaattttaatcaggccgggtcaggtcaatctctaaatcaaatttaaactattttaatttctcctccacgattagctcaatgcgtc

SEQ ID NO: 5620 - DNA, 1501 bp, Oryza sativa
acaagatcatcgcttaattacttttgccaattggtttgtattgaacgttgttttgatcatgagaaaattcattggcagggaaagcaagcggccattaattagggttctaagtttggggggtgacgtatactaattccattaattacccacccccaccacaagcactttaaatatgttatcttgctgccataaaataatcgccttccaaagtagggattatacgccagtcatgtgtagtaatttaatttacaccaaaccaaaaacacatcacatcaggacaaaacagaagaggagaatacttaatcgattttgctatatctcactcgaaagatttttttcttatctctcactcgattttctcactcaaatttacagtgcattttcttgtaagttacagtgtaatttataaaacttacactgtaacttttgtaagttacactgtaatttttgaatcttcacatgtaaattttaaattttgtatttgatttggtctttttcttgaggatatggtaatttaatgttcattatggtgtttcttaattgctttttgctttttattatatctatcgaattttaatacaaagattaaaaatctgtgtgatacgattataaaaatctttcgaaagatgtataggtactcccatacttaatttaaccgagagatatgcatgccatgcatgcatgggtgtaacactaccagccagaagctgctgttaaaaaaaaggttgaaataataaaaacagtaaaaagataaacattgaactagtagtactgtttaataatcacatttagatccaggaattttctcacaaacccctttgatttccagaagaacacatgagcccaaacaaaatttagtattatttcggcgtggaatttttcaccccaccccctctagatttctgaaatggcggagataacccagcttatgtacatggaaggcatggagctaagccatggtagagaggataggacggaggaagacgacgatgggacacgtggcggccccgcgggctaggtgcagagggcgccgacctctctgaggcgcgggacgaggcggccgctgaggtggaggcccatgaggccctcgaggccgccgacggggtcgccgccgacgaagagcgcggggagcgcggcgccgccgcccagcgccgcctcctcctcctccgccgcgccgccctccagctcgatgacggtggcgtgcgcgccgacggcggcgaggaggcgcctcatgacgtgcgccatgtagcacccccgccgcgcgaacaccaccacggggctctcccgcaccagccgccccaccctctcggccggcgcctcctcctcccccgccgggtctatcgtcaggctcccccgccgcatcatccccgccgccgccgccaccgcctgcatctccggccggccaccgcgcgcaccgtgaaatcaaaaaacacgaaaatagcggcggcggcggcggtggcgcgcgctgtctctcacctcgccgtcgatccggagaaggggg

SEQ ID NO: 5621 - DNA, 1501 bp, Oryza sativa
gagggcttaattaattgcattactgggatggagcttaatttgcaagcatttcactgatagatcgatcggtactagcttaattagtttgccgtcaactttactctttcgttggtctagcagcgaccggtcacgcttagtggcggtcggttcggtgctagccttcttctgggtctatgtattagtgttgtcggtacgtgggtcattttttttcttttttcttggttatgatcttccatggttataattttgtaattttttttctgttctatcaatataaatttcacactgtctaatacaagtcattagaaaaagagatagatagatagatagatattgtgcaatttgattggttgttttcaggaaatgaagtggttatgtctcagggtctcattaattgttcactatatgggttataaaccactatactaaaattcaaattttcaattttaaaattgattttgatgtttcttacatattttcagtacttatttttaagtcgctaagattatatatataaaagttttatctataaaatacttttcaatcactaattggttatggtttatactaaatcataggcaatcaatagactaggtcctcagccatcaatagtgctacggccaagctacacaacccaacgaatcacagagagatataattcttcttcttcctcctgtcctgcgagaatctccttaattgcccacaaataaatatgactagtacgttagtggagcagtaacaaagatttattcagtgaggttctagcttgtgattcgtagattaatttgttctgaacatgttttggaggtcaacgccaactttatgtgtgtgaggtcgtcgtacgttttaatttcgagattctctgcttcctttttatgctaccagtacaagatcaatgcgtctcatcgatatatcaatgtatctcgactagaaattaatcgcaccaatcatggactttcgtcatgcacggtccatcgtcgaattattgcgtttctagaggtcgatcggctttcgtcaccatgcacgtactagcaggccaccaccacgtacaccaccatcttcttattgtgtggggctactgactactcactccgtattttaattaatgtacgacgtcgttgtctttttaagtaatgtttgactattcgttttattcaattttttaaaaaaaatatgaaaatgtttatgttatgcttaaagaacatttgatgatgaatcaaatcacaataaaataaatgataattacataaattttttgaataagacgaacggtcaaacgttgaacaaaaagtcaactgtgtcagacattaaaatatagaggtagtaattattaagtgcatctatatattttctcctgcatgtatactataattgtaatagaaaacggcggatcagcaagcttttttggaacacaaattaatgactagtattttcaaatttcaatgtgtgttacagtttccatggtcttcttcagcgctgagcgagcttccagataggtcgg

SEQ ID NO: 5622 - DNA, 1501 bp, Oryza sativa
ccagtgtttgcagcatagctgatgtgcgtgatgatgtgatcgacattcaacaaaacgggtggttgcacgttctgattatatttatggttcacacgtaggcgacaaaaggacgaaaatgaggtcgctactcaaaaccttcgtgaagaaagtaggcgtcagaagtgaaaaactgcaccgaaccatacgaccaatcaaagaacctgggaaacaaaaacagaacaattgcaagttcatgtgtctgttccaagagaattgggatccgggagacaggtgatgaaattctactcatacagaatttgacgtaaatatgcaagattgtggagcggaacttgccaacttggtagaattcttcaggaggttggttgatgagttgtcttgtttgaaactttttgagttgaattgttgaacgctttaaaatagaagtaagccgtcctccttttttcatgagtttaagcatcttgagttcaaatcctgactaacacgcaattatcaaataaaagtttgcagcctaatcctattccacgcttaagatttagagcgtttcgcgtgagagaatgagtgttgcaacattagtgaattacccgtctctactcatcaacttaagctttcgggttaatttggttattacataggagtatatttcaatagaccaattgaagcacaagcatctccgaactgctgagtgctgagtgctgactggaagcagacaagaacttctctagaaccaccatttccattttccaatcagataggtgaccgtcgatgtcgtcgacgaccgcgcgtcgtcgacgcagaaaggacccgtaatcccgtattgtgcagggcgcacttcagaatcgcacctccggccaatcaccgccgctgtcgttgcgttcgccggcggcggcgaagggagaatctcttgtgcttgtcgatctcatcggcggtggagaactggagatcaatccgggccacgctgacgagacgaggaggagctcttcgactctccgtcgaggagcattgtacgactacctgtggctccgcatctcgccgtcttcaactccggcatcgtacgtacgccgccgccgccgccgtctcctcctcgcgcagtctcgccggccgcgaagacgacgcacatatcgcggtcgcggcgatgagtgggccttggcccaacggctcgagaaaaataaatgggcctcgcccgcaagcccatcacctgctcggcccagttagaatcttactcgcaaacgaggaggagaataatactaataatgaagtcaaatagagaaacccaccacctcgctcaatccaaaccccaattcacacgcgttgcggtctccgacgagggcgaggcggagctaatcgtcatctagggcaaggcggagctaatcgtgggtccgatggagaagccgtcgccgccgccgccggggaagtcgcggccggattgcgtcaactcgtcgaacccgtaccacgagtgctccgactactgcctccggcagatcgtgaagtccagggaagataa

SEQ ID NO: 5623 - DNA, 1501 bp, Oryza sativa
acagaccatcgcggttcacgtgtttgcacggcgttcgacttcggatcgatcgccttgccggtgaaacaccattaactgttcttgcaaatttatatacagtattaaggcagtgaggtagtactagccaggtgcattgacacccacagctcattgatctctctgtcttctccgtgttaatactgctgctactgtacgtatcgtgccatgaatataattaatgaattcatcatgggcatggagcttgacaagttgtgctcattcatgtgtgactgacatgtttggccgggtgaaaccgagtactccgtcggtcccagaatataataaattttagaattagacacggttattaagaaaatagataaaagtaagtggtggagggttatgattggatgggtagtggaggtaggtgagaaaagtgaatggttgagggtcgtgattggatgggaatataatgttggtagagaaattattatatttcaggacaaattttaagagctaaaagttactctctttgtcccataatataagggattttgagtttttgtttgcaacgtttgactacttgtcttattcaaatttttttgaaattattatttattttatttgtgacttactttattatctatagtactttaagcataaatttttgttttatatatttataaaaaaattgaataagatgagtggtcaaatattacaaataaaaatttaaaatctcttatattataggacggagggagtagttgttatattttgggacggatggagtactctccagctaccagctgacggagattgtttggtttaggggagaaaggagaaagaactctgattgatggggctgtgaaacgcagcgctactgtcagagttaagtcagcacagtgcagtgaaagctcttcgggtatcatcgtcgtcttgcgcagctagcactaggagcctaggacagcgctgttgcatcgtcgccgctggcaatggcctatactcggcctactagacgcctactgactggtagtgtagcacacggtgcgttctccgcaactccctcattttttaatgaacatgttttcgtgcgttttctaatatattctcccccttttttaatgtttttaagtttcttaaaaaagaaatcaaataaatctgtttttcaagtttaatcatatttcttgtactgcggtggtaaaagagcaaaagttaaatgagatctcaaaacggagcataagcatgtgttatttggatacctttcctaacttcactcactcgtcttttgagcatacgttttccaaattattaaatatttttctataaaaaattatatatatattttaaaataatcgtattaatttattttttaagttttttaaaattaatatttaattaatcgtgtgctaataaggtatgtggaaaataatcagttcccagcaaaaaaaaaaacgaacacaacttaaggtgtgttctatgttagaaattttctctcttatttttatttttaaaaagaaaatct

SEQ ID NO: 5624 - DNA, 1501 bp, Oryza sativa
gatcaatttagcaaattaacatcatggttgaaagaaggagtcaactttaatttaatccagcccccggttgtgttggattccggcgtttgaaagccaatgcgaaacgggaaaaacacgtgagcgcgcgtgcattgacaccgcagcatcctgacaaaaattcagttgagatttgaggatgaacatgcctgagacacgagtgttcctctcgctgcccggcgccgccgcgagcaactctgaattaatcaggcaccatctgctgtacatttttatgccatttattccacactgctgtacgtgtcgctgcagcttggtacgtgtacttggtaggctcaaacgtttggtagatctgtgaatctgttgtgatcaccattctgtagccaacgccaacgccaacgccaacgcgtgaatgaaccaacctacctctcgtcatgaagcacgaggcaggcgaccgtttcttcaccaacatcacatataatcgacgcaaagaaaaacaccgggttgacggaaggagcgtcccaaaaaaaaaattgaaaagtgaacgaagcttaactggtttgatttttttgttgaaccacgtacccatcaacaacaaagcgttgttgcgtttgcgctgcctccaaacattttttaagaaaaaaaattatgaacgtgttaggggtagaggttaaacattgtacctcagccttgaaaccatacaccctttatcactgcagtacatctgtgaataagcgatcttatctgcctcggccaatcgacggcgagcgatcggcgatcgggttgttgttggtggtgcactggtgcgctagctgggccactgctttgtctactcgtccccacccctgtagctgtagctgcctgctctgctttgccgtttgcactgtgcagcagctgctgctgcttgtgcttgtagtgagtggttgcgccgttgcgagctccgacccaccacacgacgccaccaacctctggttgccatcgcctcgccatcatccactcgacgcgacgccaccccgaccccgcctttaatactactaacctctctctgctgctcacgcccgatcgtttttgcttccttcagatccaaaccaaaccaccacctgcggcgcgcgccgcccgcggcgagagcccggcgccgatgaagcaccatcatgtggcgcgggggcgcgccgagccgcggcggatgggcaacgccgccatggtcatcaccatgctcctctccctctgcgtcctcacctacatcaaggctcgctactgctccacccccttccgtacgcttcttcctcctcctcctcctcctcctcctcctcctccttgttcttgatcgattcatggagtgatgagctttgattgattcatggagtgatgagctgtgagtaattgtggttgcagccaaggcggcggaggagatggaggtggtggagatcgacgaggattacgacagcacgaggtacaagatgacggggccgataggggaggaggacttcgacccgaccaggccgacgtg

SEQ ID NO: 5625 - DNA, 1501 bp, Oryza sativa
aatccccaaaacttaaaagtggactcttctgttaaactatcaacagaaaatttcgtttttttctttcacgcgcagaaagatcgctatctcccatgcacgggaacaggaggagaggggcgggagtgcgaaattggaagcacaactttcgcgtccgcatataaacggagcgagaaatcggaagaagggaactctaaaactttggtaatagagtaggagatctgttagagctgttttttggactaaaatctattaaattagttttgggaatcagataagtagtctgttggtgatgctcttaagtcaacaatcaaacgacgaaattcagataattacaaggagaaaagggttactgatcagtttttttttaaaaaaaaaagaagaaaaactacagatcagcttggtcccctgactttaatcaacgatcggtttcgtctggtggagaattcaaaaaaaaaaaagcctgagcaaatttaactatattaagtatttaccataaaaacacaccgaaatacttttgtgcggctactaatgaactcgggctgtttggttaaagagctagtactccctccatcctaaaatgcttgacaccgttgacttttttaaaaatgtttgactgttcgtcttattcaaaaaatttaagtaattattagtttttatcctatcatttgatttattgttaaatatacttttattatacatatagttttatacatttcacaaaagtttttgaataagacgaacatttaaatatgtttaaaaaagtcaacagcgtcaaacatttaggaaaggtgggagtacttagtttggtttctcgaattgattttttaattggtgtgacttgatgagaagcagattgggtatggacgtgtatggataagaagcaatgttctctttctccatctctcagtggtacttataaatagcatttcttgtaaccagttaataaaatccaatcttaaatatttcacagaaaacccacagaaacaagtcgagaaacaacctgggagatatcttatttttatgttttgaacatctacatagtctcaaaacaaatattcgatcattaatgtttataataatttgtgaacaaaaattattgaagataactactccagtgcttacggccagtttggcaagagaagggaagaggaatgggagtttcaaggagggagttaatggtgggattggtcatgggagttacatttttagtcctcatcccttgtttggtttcacattgaattccctccaagtctcacgaattaacatgcctctcccaggtaagagattggtgggaattcgacattttaattccccatcattccccatcctaaaccccctcgaattctcaagtcttccaaccaaactacagacttaaactcccagatatcataaactcccattccccatcaccaactccctccaaccaaacaggccgttaatgaatccattttttttcaaacggtttggttgttgccaatgttttatataaagaagacatccc

SEQ ID NO: 5626 - DNA, 1501 bp, Oryza sativa
cttacctcactcatctctttcacttcgccgaataacatccctcaaccgcaaaaccggctataatacctcccccatctccgtaaaccggtgcaaatcgactcctccggtggttttgaaagcggtttatgctgatatggcaggttgacttggtccgaatgtgctgatgtggcagccatgtcattaaagggattgaagatagaagtgggtcccacatgtaagtgacaaatgctaaaacaaaacggggccccctgtcagccccatttttttcttatcttcttcctcctttctaccttcttcttgcagccgcacgcacggaggccgattcggccggcttcatccaacactggcgccagttgatatgaggtggaagtcgctgacatgtgggccccaattgccaactcagcgagtcaaccgcggtctagcatccatgtcagcaaatactgcttgctaaaccactaaaggagataatttgcaccggtttttgaagatgagggattcattatacccggttttgtggttgagggaggcaattcaatcaagcgcaagagatgagggagacaaaatggacttattccatcataaaaataatgtggcatctctaggcccagtccattacagttcttcaccaatatttattttcctttttgttttttatccacctaagaaagggggaaactacatccaattcgaatccgataagaagaatcaaatccattgcgtgtagaaatggagaggaacgaattcgccggagatctctggttgttgtttccccggaccagctggtgcatttctccctgatgggaagagaagccagctcggttacaagccatggctccgcaccggcgcgtccggcttctacaccggagctcctcgcatcctcctccttcagtaacggcagcgacaaggttctataaataatgcttgtttgcattgtttgttgatatagaggtcgaaaataatgcttccattatcgttgtctagggagtggattttgatatcccgaggggacgacttctcgttgtttgtacgtcactcaaataattatgaaaaaaatttaaaaaatatattaatatgttatgttatattatatttaacttctacatttcacaacgagaaaaacatattaaactacagcttgttaacatatattcatatgtcaaatttattttttttccgttgcgagatgtaaaagttaaatttaaacttgtatgtttatggattgatatatcacatgctaatacatcttcttaatttatttttcataattatttaagtgacatccaaacaacgagaaagattccacattaattatctaaagcctcaatctctactcactactggagaaaccatctttggtcagttgcctaaaatccacaataatcctggtttgaattttaaccgggactaaagatgactttagtcccggttgaaagagctgacatcactttttactctttagtcccggttggtaaaatcaaccgggactaaagatcatttttag

SEQ ID NO: 5627 - DNA, 1501 bp, Oryza sativa
caagattatgcataggatgatgggacagtattttctacaccttaatgctatgacacctgagttatataaaaatttcataaaatttaataaaatagattacaataatctaagacactatacaaacatgtaaatccaaactcaaactacgtataaaaaacaaataaagggtgccatgacccttatattagaaaaaccttctatgaggccgtctctgtgtccgtttgagagaaaacgccgtgtcgcacatgaatgtgttttcattggacttcctttcccccgagtcccttccccgtgaaaatggatcaatctacgtaagaggaacgttcgacgtcgctaggccgctcgttcggcatcggacggacgcaagcaagcacggcacaccaacaggcacctttctctccgcccacgctagcaatatcagcccatcaaacaagggaggatttacagtgtaagcatcggtgtcggacgacaccgacgactttcgataaaacctatggtaaaactgcttatctatatatcataacactattaacactatagtctaagtgtaattagcatgctatgacaccgatagacacattatgacaccaacaaatcaattttctagatccgccgctaccatcaaacagcctcgctctcggccacttcgctcgccaacgcatggccttcgccgacggtgcggcagcgcatgcatggccgccgagtgcatgctccggcggtggcggcagaaggtcctgcacaccttcaagtctctcgatctcctccgtcccggcggccggcgagggagaacccataacgaacacaccaatgcggcataaacatatcatgaatatattaaattggtaaagaatcaaaccctggaaatatcataactgtttatcactgactttatgcctgtgtcaaactatgcttcctttcaggcaatcgttggactgcgtgcagggttgcagctgttattgggggttggtgcaatttcctaactgtcatttacattggtaagaggctgctacttcaaaacttcttcccaaaatccctctcattcaacctctgaacgtcagaaatttcatgtctgtcactattttctgaatgtacgcagtccactgtattagcgacaaatgtcactgatatttcatatttgattaactggaacaggatttgttagtgctcacacactgcccgtcctctacgagaagtatatatgaagatcaagttgatgatttcctctgcaatattcttggcctgctgcgtaaccagtatcagaaactcgatcaagttgtgttgagcaagaaaattttgccaaattaattagttatattaaatctaatttaatatcacaaacatactttgtggtcactattattattgagttacagtggtatatgtttgactgtcttgatgtgtgatcactgatcaagttctgttgaaaccttcagcatatatttatattattcttccattatatcatcactatcagattatcagtgccccctttgtcagtagt

SEQ ID NO: 5628 - DNA, 1501 bp, Oryza sativa
ccttccacttgagcctatccttttcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagaattagatccaatgtaatacggggtatactatgaaagatatggcctcagttttgctgagaaatatgcatcaattacaatcatttgcatgaagggataaaaagaggaaatcagctactaggagaaaaaagcaaccgaaagaaaatagaacaagtgtagttcatctgttcttatccataaaatagaacaagtgtagttcatctgttcttatccataaggaaaagagcaagtgcaggaaattagagtagtagcaacagcatggccatataatagcagcaataagagcagtagcagggccatataacagcagtaggggtatatatgccacaggggcagcaacagcagggggagattcacataaacagcaacagcagagggaaattcacatagacagcaagggtatataaatcaacaagtgtagataatctgttcttatccataaagaaaagaacaggtatagatagaatgttattaagcaattcatccttgaccatttaacaagaagtacaggggcaacgacagcagtggtatataaatcatgcatatattattgtagataaaaaaatgaacaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactccattcaacatgtctagatatcatccattcaattcaagcaagtctagataataaaacagcccacaatcattgtggcagcagcagcaagggtatataaat

SEQ ID NO: 5629 - DNA, 1501 bp, Oryza sativa
acagcgaagccaaaccaaaccaaacggaacttacgcttcaaaagcagggtggattctggagttccgcacattgctgccggggacgcggagcgcggattctgcgaagcccgtggaggcgtcccgcctagagccgccggagcgcggcggtggctgaggcgggcgccgcctcaccgcgtcgccgtcgaccgccatccgccgcgagaaggagccacgccgctcgggaggcccgagacggagagattttccgctccgcatctccagcatgcaaatgggccgggctgaaggcccaattaaggcctcactcctttccgacggcccagtatttgggctcaccaacctctcctatattgcactttgtctaccattgctggacagcagtttttgtatgcgaatgactttattagtactggcatatgtcaaagcaattatacgagaagttggatagagaaatgttaatctgcaaccataaaacatctttagtgcactttttttcttataaaaacaatacaaacagttcatatacaagcgcacactcccacatataatgcacacctgtcacgtttgatagcaacaagatgccaacgtttttccctggagcttatggatacataaaaaatagaaagtcacccaagtcttaatacaatgatgcgtaatatttatgcgaattctccggaaaaaaaagtcagagagaatgcgttgccaagttcatgatctgcagccatcatcatctgatatttctttgtgcattgcggtatcgccgtccgtccaggctccaaaacagcccaggaacacatacgcccaaccaagtcatatccagcgtcccagaggcactgaaaattttcagaatcaaaatagatcaacaccccccccccccccccctctcactgtctctgcatccactcacctgatttaatttgaagcttcaatcaagcttcccgtatacatagagtacattcatatgcacagaactggattcaaactagttttttttagataatggattcaaactagtatacatagagtacatgtacatacagcataactgctgttggtacacacaacaggagtgcccgaatggattggctgtgcacttgtttagcagcacttctgattttctttttgattgcaacacttctaacaggatgactaagatcctgaaaaaaaaaacacatacaaaagggcatgtggataaataattggagtgaactcttttgttttgacaccaccaaggtgtaaccacaagacaattcaataagctcgtagacaactgctagtgaaacaacaaactgcacacaattctttagacgacactgaactgcagattttgtaccaggcaaggatagggatgaagattgaagaaactgtaccttgttacgaggtgattgcttgttattgtaggaatgacatgccacagccactgcaggcagcagaagaatcatgttctgaatgtttgaaacaacgtcccagcgaaaaaatgtttgaaacaacgaaacttgtgcgt

SEQ ID NO: 5630 - DNA, 1501 bp, Oryza sativa
gcaatattgttcagcttgggaatgggctttgtaagtctgtatgccctcaactattcttgctagttttcatcaggacacacattgaatcttagtttggtggcaagccacaaatgacatggcctaacatttgcgtactgtcagttcaattactacaaacttgaaaaatggattaatctgatattctagaacaactttcatatagaaagttttcacacgaaacgcaccgttttacggtttgaaaagcgtgccatgagtatccaaaagttaatccaacctaaggtaacttgatgtaacttgttattgcctacaatttgatgtaacttgttctttccataattcaggttcgcgagtatgtccctgatctcgcagaatcgatagctggcttaatcttatcatccaatgatcaagagttccaagatgagtgcatcgctcttctcggcctaggctcagatcaagatctcacagaaggggcggttagatcctgcatcggtgagaagatgaaccgtatcgtagagatgaatgacaccaaggagaacgtagagcacaacgcaccttatctgttcgagtgcgagaggttcgatgaagattatagcctactggatgaagacgacccagatgaggatatgattttcgatttctagcatttccaattgtctcgtagcactcctaatccagagatctcctatgctgtgagagagctttactttgaccagagaactttataaacactaacaaagactgctctctgagactgtttcctgcctcgtgtaaacaaaattcagacattgttacgtcaaaaattcagaaactgcaagtaattgcccatgtgctgagcatctctttctgttcgttctcgttcatgataatatctgcgttcaataactccatgaagattgtgtatactataagcatttttaaaatagtgccaagtcaaatatttttaattgtgactattaatagaaaaaaataaaaaaaaatcatgtaaaattaatattagtagatttatcattaaacaaactatcgtactatacaattatttgtatttaaaacatattacttttatagatattgttggttaaagtagcatctcgaaaaccgtgtcgaagtccaaaaatacttatattttagaaaggatggatagagtataacattacagacaaattacattatttttgtagaaaattccacaaaatttgagttgaatccttgccttcttgatatcagaaagacgcgtgagggcgtgaggctggatgcgtgtggcctcctgacctcgcgtcagactcagagccccatttgcttttacagaatgtgaagcgtcctcgtctcgtctagtcctctcctcctcctcctcctccctcctcctcctctccgctttcgctttgaccaaacccaaaccacgcgcagcgctcccatcgcccagggcaacgccacgaaacctagccccaccgactcgcctcgcctcgcctcggaatcccccaacaccagagcgcggcggcgacca

SEQ ID NO: 5631 - DNA, 1450 bp, Oryza sativa
aggtatttataaggaagaggggatagaaggagaggggggtggccggcttaatggcgacgcgacggcggcccacggggctcagggtgacggcgacgagtggcgacgcgacggcgcggcggcacggggctcgaggcggtgacgcgacgggcgggcggcgcagcgcggggcttggtgcggctcggcacggggctcggcgcgcgggacggcgacgggcgagcggcgcgcagcgacggcggcgtgacaggcgcgcggcagggcaagggcgcggggcgcgatgtggcgatggcgatgggcgcgcggcggctcggggcgcgaggcgcgcgcggcagaggaggggccagggctagggacgctctcgaacacctagcgtgcaatgaatagtgccaggtcccatttaaccctattttagcctatttcctatatatattttattctataaatccttatttttgcataaatgaagtttactctgttattctaaccaatgtattcaccctagattaatattacccatattttatttttatataatttatttgaatttttaattagggctaattcttattccatcgcacttaaatttgattgttaccaatatggtcgcgataatattttatttatttctttcctcacctaatctttattttaaattgtttttcaattatttatttagccaaatgaattttagggtttattcctaattacttattctttattcgcgattaataaactacgaaatcaaaatccaatgaaaaaggcgaataaaaccggcatgatgtaatttatttaaaaagtttttgaaggtccgtatttttagagttttttgattttgttggtcgaattttcagtgtgttacacagatccaacccaatccatctctaacaggtcctttttttgttcttcacaggtagaaaccacccaacccaatccttatctatctcccaccgacggtccgagaccactcatctctcgttttttcttttaccttatccatccctctctctctctctcatttttctttctttctcccgtcaatgagcatccacgcgccgagcaccaagtccggcggcggcctccgactccacgcgcgagtagcggccaccgccggccgcttcctcctccgcctcccgaccgccggccgccgaatctggccaacggggcgcggatccggccatcgcagcctctccccccaccaccggtcgcttcctcctccgtctcccgaccgccggccagcaccgcctcccccacctttcgaccgccggccgccggatctagcctacagggtgtggatccagccaccacggcctctctccccaccgccggccgcttcctcctccgcctcccgatcaccagacaccgtcgcctccccccaccttccgaccatcggccactggatctgggctacagagcgcggatccgaccaccacggcctctcccccgccccaccgcc

SEQ ID NO: 5632 - DNA, 241 bp, Oryza sativa
gccgcccgcccgtcgcgtcaccgcctcgagccccgtgccgccgcgccgtcgcgtcgccactcgtcgccgtcaccctgagccccgtgggccgccgtcgcgtcgccattaagccggccacccccctctccttcttccccctcttccctataaatacctccaccccctccccatttcttcccaccccattcccctcttttctcctctcttcctctcaaccgcgccgccgccttcgtgccgcagt

SEQ ID NO: 5633 - DNA, 1501 bp, Oryza sativa
ccggcgaaataatacaggtacaaataatatgcatccaagactggtgctccccataattatcgatcttcttctctcgcgatcgttcagtactattaagacagagacgatcgatactaaaaaatggaacctagcttgcttgtgatcgatattgatggaaatgatcgatcgatgcaggaccgaccaagcatcaaggggatcaatggcgaaaagaattacttcagctagagacccgccctacgtacatgcatgcatgcatgcaactacagcacaaacatatattaattgaccgatgcggatcgatcgagatgaacgttgggaggagacctatatatactagtactaattaagtactactatacaatagctatagtagagtaatatatagtggaggatatacagcagcagtagctaggctaacaattatgacaggccacttatcttaattttaacattttttggtcggatacacaactgagagcaagttgtttaatagtatagccaactaacagctccaaatcatatatagtcaatttaatagtcaattcatataatagttatctataaatatatatatactacagtattaatatatggtcccactcgttatacacacattgtgtgttggagtcaatactgcagctggctataaatttgtagcccgctgcttatctctcttcttttatcttttcgatacgtgtttatagctggtttataatataatattgtacgctatgataattgatacactagtactccctctatctacttttgatagtcatatttcaccttgacacacagaccaaggataagtaattctacttatcattcatttaaatatgctactagttattcctcgtaaacaagcgattcattaatatttacatttctcaatacccatgtagccaatcatgtgtggtagaatggagagtcacgcattaaattcgagaaagtcattaagatgatgggttgttgattgaaatatgactatcaaaaataaaattttcagatttggaaatatgactatcaaaagtagatggagggagtatatactaactcacaagtggccgaccaaggtataggggaagtagggtaatagtacgtaggagggatctagcaattaggttaggttaaatacttgggctgagccttcaatccctagctagctatatataggctcggagttgtactgctagcttcgccctagctccagctcatgatctatcagccggccgggcatgtgtgtgtatagatatatatatgaaggaaattaaccagaggctggcacatcaactcgttcagtccagttagagtgagccaagagcaagcatgaagaacactagtctgcagctggctcttcttctcgtcgtggctgctcttgtttgctgcctcccaactagtggcgcagaactccctggttgggcaaagccgcggctgcagcgtctcctgcgcggcggcgccagatcagcggcggcgcacggcaggcgttctccggtggtcgagg

SEQ ID NO: 5634 - DNA, 1501 bp, Oryza sativa
aagttttatgttgccatggatcttataaaatgttccatggcattatttcgatgtttcgataaacatttttctgatgtttcactagtttatttgtgaatgttgcatgtggtattattggatgtttcagtaagtattttctaatgtttcactaattcatttttaaatgttgcacgtgttgtttgggatgttgcaatgaatattttctaatgtttcaataattataactcgttgtttcacgtataatatataaatgttccaattagcaatataatcacatttataaattttatcagaaatataaccaagtgagatattgtaaagatttaattataacgaacacaatggtgaaatcggatggtagatcggataagtaatttagaagaaaaattagtttaaaggtttattggtagagaatatgaagagagagatttcatgcatgtatacacgagagtagggtataggcttgcatcatagcagcttaactacgatggttttttttgcatccaatcagacaggtgggtgagcaacgtccgaactgtagcagtcgctttttttgcatgcagttagacaggtgggtgagcaatgtccgatcttttgctaaatatcggacgtccgatctgtagcagtctccggcttcaattcatcgttgctgattcttgatgctgctgtagtgaacggcctgaaaggagcggatatatagcgaggccgtcgtcgaggtggtcaccagtgtagtcgcggccgcgtcgagcgtggtgaagatgtcggcgtcgaggctgtcttcgtcgctaacgcggcattcgttgctggatatatggcggcttgtgtgtgtgccttggacgtagatgcgtgcggatgtccttcttcatgctctcgtcgcagccgttgctgctatcctctgtggccttgccgtaattgttgttgctatcgtcacggctgcagatgagcacggtggtgtcgaggcctcccggtcggcctcgccgaggtggcaggctgtacagagcttgtcgtgttggcaacgtcacctctttcttcggtgtcgtcagtgacgaggtggcgatgaagacggcacggcacgatggtgtagaaggcatcccggccggatttgccgatgtcgcgggcagcatgggggtcgtgtagcatatatggccgcctggttctttgatgtcgtcggtgccggcgaggtggcaaagtagataagttcggtgattgctgcggtggtggagtaggcggtgttagaaaggttgttcctgttacatgtgttgttacatgtgataatgcatgagataataggataaggttggttcggttagtttgtttcagagtttgtttctttcttctatccgaatcaactgagattgatctcatctattgtaagccacgttgggggctgttcccaactcatattaacacacgtacgcggcctcgagagaggtgacaacgcttccgtattttctacatggtatcagagcgaaaatcgcatcgactggattgcatctagcga

SEQ ID NO: 5635 - DNA, 1480 bp, Oryza sativa
tataaactttggatgtataaactttagatgtatagaaatactatatatagaaaatatttgaattcaaattcaaattcaaattcaaatttgaatcggatataattcaaattcaaatttgaaacgggtatataaacttttgacttataaactttaggtgtatagaaatcctatatatagaaaatatttaaatttaaatttgaatcggatataattcaaattcaaatttgaaacgggtatataaactttaggtctataaactttaggtgtataaactttagatgtatagaaatactatatataaaaaaatatttgaattcaaattcaaatttgaatcggatatataaacttttgacttataaacttttagtatctaaactttagatgtgtaaacttgaggtgtataaactttaggtgtataaatttactaaaataggaaagtaatacggtgccaaaaaaggaaaccaggtagagggagggaggggggagggtcgctacccccattggcagggcgatcgatcgcccattagggctgcccgtataacgcgccctataaaaatttgaaataaatcagaaccacaagttttccctcccactttatcactgcaaaactacctccattaatcaatcatagatttagatctaaatatgccactattgtctcaatgattagcttggaggtgaagataaatctcagtgttcctattgtacttgaaagagataattcaagaaataccattaacaagtgtttagatccaagaaataccatcgacaagtatgagttctaagaaatgtcattgtacaaacgactttgtcccaaaaataccatcgatgttagggttccgtccattccgcgccgttaagtactataggatgaacggtgtatttaatggcgcggaatggacgaaacctaacggcgatggcatttttgggacaaaattgtttgtacgatagcattttttagaactcacacttgtcggtgtcttttcttggatttggacgattgtcattggtatttctcgaattatctcttcttgaaattagcaaccgtaaacatactatccaagcagacttatcaattattatatactaaagtttattaaatttcctacaaacgctctcaaacgctctcaagccgccacacgggactcctaaaaacactcgtatgctgccacgtggcattttaatatatgaaaaacatctagccatcgatttttacttaaaccagtgggtctattattttagacgattagattagtattagattagaaaacgttagttccccctctcatctacccgcatgtacgtacgtacgcctccctcatcttgttagttcgcaagttacgtgcatacccatctttttatacttcctactttttccttttatatttatatatttccatctgtaataccctagcacggtagatataagttgctaatagcacgccgcagaagcaagcaagcaggaaacgcgcgcaaacca

SEQ ID NO: 5636 - DNA, 1501 bp, Oryza sativa
ttcatgcctaatggtagtttagaagattggctgcatcctaaaccagttgaccaaactgaaatgaaatacttgggtcttgtccagagagtgactattctactcgatgtggcttatgcactggattatcttcactgtcgtggtcctgctcctgttgtgcactgtgatattaaatcaagtaatgtgctcttggattctgacatggttgcccatgtgggagactttggcctagctaagattcttgctgagggaagctcatctctccaacactcaacaagctcaatgggattcagagggacaattggttatgctgctccaggtaattatctttgctttatgactttacatggagaccatctttgctcagataaagcttggctatagacaaattcatggtgaattttcagaagatatattattttactttcatgtgatttctctcctagtttttttctttatatcacttaattttaaatttcataacaagtagcaggcctgatgttctttcaatgttaaatggaacagagtatggagctggaaacatagtatccacaaatggggatatttatagctatggaatacttgtattagagacagtgactgggaagaggcctactgataacagattcagacaagggttgagccttcgtgaatatgtcgagcaagctctccatggcgagacgatggacattgttgatagccagttaactttggagctggaaaatgaatgcgcattgcaggattcttcatacaagagaaagatcgattgccttatttcacttcttaggcttggagtatcctgctctcatgaattgccattgagcagaatgcggacaacggatattgtcaatgaactgcatgccatgcgagaatctctcttgagagaatacaggattgaagatggaagttatgtcaatgtaacattggaatgatcatgtggagataccatgcagcggtaatttttaaaatattgcagacattgctgtactcccttttaaagtacacaaattttactatggtctctactagactgtaggtaaaagatacgacaaacatcttgttattttttcatctgagatggagggagtatttcagaccgactacatctgaaatactcatttctgactaaagtcctgataaaaataaaaaaaatttgcaccatatatagattaagcaccaaatactttctctgggttttacaagttgtgaaccagtaaaagtattcgaaaaaaaaacactctgttttcagtttcctccaaaattttataggattttcacatgaaaccgttcaataccttaaagttcgtgcgaaattcctccaaaccgaatagcacccttcaaggtttaaaagccaaacaaactctgccagaatgacgtgtctgattgttggcttgtcgtagtccgccaaaatttgaaatttaaacttcatttaataacttcagagtttattttggtttggcttttaaaacctgataacacggcatgaattgtttttcgttgcatt

SEQ ID NO: 5637 - DNA, 1501 bp, Oryza sativa
ccccagacctggcttgtcctgagcgtcgcccgagggaatgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctctgtggtcgccgggtcctcggcctcagactggccggacttggaatggcaggagggacgcgacgagatctcgctgaaacagaagaaagaccagaagacaaacaagatggatgagtgaaaactcgcgttgagggaatgaatacggccacgatgggcgtgggacgaacctgcgagggggacggttaaacgaccaccttggaggggaaataaggtttccccgggatggttctgtcccccccatcttgcggagccgtttcttcttccgctccccctcgggctgcgacgtcggcgtggccccctccgggcgcctgctgctggtacgcgccgccccgccccctcggggaggagatgggggaggggttccttcctgcttcctcttcccccgggcgtcggcagggcggccgctccccgggcccccgtcgcggggcccagaagcacgaccccctcccggggtagatcgttcccccctgcggctcccgcccgcgccatcgtggcctcgaggagcccgctcctccgatgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgactccctggtgggtcctcatgtagtcttcggatccggtgtactcccaggcgccccggacgcgccgctggagcggcgcaatccggcgacgaaggtagtcgccgtacaccatggcccctatgagccccagggatcgcaggcccgccagacggtcgaggacggcgtcatagccatctcccagatctaccggcgcccgccagctggaggcctgcgccgggggctggctcggaagtcggaggcgcgcttcgtcggcgaggggggtgtagaaccagtcgctcttccagtcatcccacttcttgcggaggacgcagggaatgtagcggttcaacaccggccccgcggctggaagtagcaaccaccaaccaccgacggcggcgacaccggctgtacagtgaagaaccaccggaacagccgaaggggtgggcgcaccccgatgaacatctcgcacaggtgcgcgaagatggccaatgtcattaccgcgttgagggtgaggtgcgccatctggagatcgtaaaactccagaacatccatgaagaaagaagaaaatggcggaaccagccctgccattgcaaaagggaggaagaagacggaccgcccc

SEQ ID NO: 5638 - DNA, 1501 bp, Oryza sativa
tctcgaacaccaatggaggttgcggtgcgggagattgctacgtactggttcgagaaccagcaagcgagtagaatcatctctcgatcaccaatggaagttgtggtgggggagattgctacgtactggttcgagaaccagcgagcgagtagaatcatctctcgatcaccaatggaggttgcggtgcgggagattgctacgtactggttcgagaaccagcgagtgagtagaatcatctctcgaacaccaatggagtttgcggtgcggcagattgctacgtactggttcgagaaccagcgagcgagtagaaacatctcttcgaacaccaatggaagttgcggtgtgagagattgctacgtactggttcgagaaccagcgagctcttcgaacaccaatggaagttgcggtgtgagagatggctacgtactggttcgaggaccagcgaatgaacgtttagaattatctctcgaacaccaatgggggtgctagagttggtttattacatgtgcgtctcatgtggccaacatgactcacgcacccaacttatagcatatccggatgtccgttcgcaatcatgtcgggagatcaagccgacgacgttcgcgagaattgtccgttaacgaccttttctcgagtagtccagccatggccggtgctatgagataggtcgtcggtcttcgttggtaggttgggcgcgacgactctgcatttgtcgagaccgttctcgataatgcaatgtacttgaccacaacctactcgagtgctcaattgttcctgaaaaatattttctagaaggcaagcatatagcatagaatatcgagtatgtgctcaaaaaactgcatggatcttctagcattatcaggatataacgagcagaaaatgtcagacattatgtagactgtaaacaagcatgatttatacagaacaagacagagcgagcccccagcgttagatcgtagtcgatttaacatcggggacacccatgcaacagatattgttaaaacacatgctctgggtaaacataataaattattgatttgacaatgttgtatgatctgaatagatacgataaattgcatataaaatattgcatacctttgtagctacatgccggatgtatctacgaaattagtagatcaatttggaaaaccaatctaccaattacctattgcgtactcgttcgacatcatatgatctgacatcctttggtacgccgcgtatcttgaggcttggatgatctcgatagaccaagttgtcgatgacgatgatggttccgatctagtcggaagatgtacttggacaggttggatctccccatagccgaagtcgtcgagtagctttttgttggagaatccatctcttgaacccatctcgtcgaaatcctgaagcaccaaaatgcccctacctggcgtgccactgtcgacgtttgatgtcgcgattccggtatttgcatagtatggggatcgttggtactaggatatacgcgagactgaggtaaaagaga

SEQ ID NO: 5639 - DNA, 1501 bp, Oryza sativa
caaggcacgaggtgaagatcacacgctgccgggcctgaccacaagaaattctgccacgcccgaaggctcgaaatctcccggcaaccgccaggccctggccatgcccctcccggctaagctaggtgttccttataccatcggccccgcaggtggccggtaaccacctaggggttgagcaaaggcttcaggtccgacggcccccgtcacatgaagtacggccacacccgggggcccactacccttaggccatcacccgaccctggtcagagccctctaggagttgagcgaagacctcgggttcatgggcttcacggtccttgtttccttggtattgccacgtaggaggcttgtgatctcctgcctcagagcccggctccgcaggtgctgggtgcgcatctaggagcctggcacaggtccttacatcactcactctcgaccccagcacgaccccagccatcccggcatggagttgggaggctaccgggcttcgcttcgagttcatcaagtcaactccaacccgcgacgaccccagtcatcccggcatggagtcgagaggctacctggctttgcttcgagttcgtcaagtcaactccgccccgcgatgaacccagtcatttgtcacacccagaaatttagcccaaatttttagactattttgtgtattaaatcgctgtctaggaatcagctagggtacacaaaacgacaagtaataaacagttccaaacgtaaataaagcataaaatacttacagaagaggcacttagtcctcagaccgaaagagaacgacagcagcagaaaaggcgatcctagcggggcttcaactccactccacaggcaaaactcaactggggtctgagccttagtcttctaacttcgtcttcagctcagaagcgctattacttctaaaaaggggaacaatagcaaggctgagtataacaaccgtactcatcaagccatactaacgatgcagacgtgcaaggggatacaaggatggcttgtggctatttgtataaatgcggttgtaaaatattttattgagcaaaacagtaaaatagttaagtaattaaggtaacattaaatctccattgatcaacggtacaccacgttgaataggcccaaccatcccactcaaactaagtgcattgagttgatttattaagggtgagactaatcacggtgaatctggtcgaccgcccataaccgcgggcacggctattcgaatagttttactctgatcagaggtgtacaactgtacccacaagacacagcccacgacacgttttcgagcgccgacatgccaccacgacataccagaaagacgccgtgactggacccttcgcataaccccctctaaccaatcgcaccacacctccggtttcgcccccatccctagtaggcaacgggcagcccccatcgtgccacagtggatccgaaagccgatcaaccgaacaccccgaccgacccaactccatcacgcccaccctagcctgggtacgtcagc

SEQ ID NO: 5640 - DNA, 1501 bp, Oryza sativa
ttgactggagttgtcgtagatgattcttgttgtagacgttcgtcgatgtagccaatcatgtggtagtcgtggtcatggtagtcatggtagttgatgtagccgcaaatagccgaaggcggaaaaaaaaattcacgccatggtgtgaagacaaaaactgcaattgttagcatcttgcatcttatagatgtcagaggatgagagaatgccattggggacgtcttgcatatgtcagaggacgtcgttggcgatgaggccaccacttcagttggtccttctgcgccgtgaagcggtcatcacaataatgatgccgagttgatgcagtcgttgtcgttgtagatgacgtgatcgatgccgtcatcggtgacgcggtcgttgccgtcgtagaggacgcggtcgatgtcgtcgatgaagcgtcttgcagattaatctgtcagaggacgcgaggtgtccatctatgtggacgagtcggcggcggcgcgcttgttcctatgttgatgaagaccatcggcgatgttgtgtcggagaagacaaatgtatggctgatgtagaggaggaagcagttgtggcttgcgtcgcggccgttcataggagcttggcgaagatgatcgatgcggattgcttggtgtcttgacgcttgattctcctgtcacctgtgcaccatgtgcttctctcaattgagtagatggatgcaacagtagatggctcgatgacgtttggtgttcccgtcgctcgggcttcacggcgacttggacggtggtgctgtacgccacggcctcgccttctgcttgatgatgctattgagcgacggcttgcgacgaaatcgtcgtcgtgttggctcctagagatcgtagggttcgatgtggcaaaaaaataaattgatctaattctaatattggtaaaatctaatctatggataatttgtggagctaatagatgcggcgccccagggagattataagattgatctcatctccccagggcgacgcggggatcgaacgacgttggtctctaaggctctgataccatgtggaagaatctaatatgttgtattattgtgttttcttatattttctgatatattacatcgaccctctcatgaggtatatataggagtacataggggatagagacttggagtacaatacaagtaagagtagatttatctctaggattctatctctaggactctatcttatctctaggattctatctctagaatatatcttatctctataatttgtatttgactcttatctctaattaacatattatacttctaacatgcgcgaccggacggcataggatcggtgcctcgccatggccatgtgggaccaatgggaacggaagggagtgacgatggcatgaggttaaaacgtgggactggattgcgatcccgcagaatggtcgagcgacaccacgcctaatgcaaacgatcatgtacataatcaaataaacttattcctaatgcccatagcattagctaattagtatgtgctgtgta

SEQ ID NO: 5641 - DNA, 1501 bp, Oryza sativa
tgagagaatccttggtaactgtaactagaggtggctacaatgtgcagttggtttgacattttagccaacataaccactcaatggcatcgctagagcagctgaactatttgcaaatattcaatgccaaaaaaaaaagtctactactactatactctccaagttcagtgaaccatacaaaccacacacgaccaagtccctctccaagactgtttctagtgctcgattgttttgtttccgtagtcaaggactggacgttccatgccatgccattttgaccgctgaactatgcagaaagcgcaatattccggtggagaaatttcaccaaaagctgataatctggtaggtatgtttttcccccctaccgtaggcgggccaccccatggagcaacaacctcccccaccaacgcccccctgcggtacgcgctagaaatggctaaaaacacatggggaatggatcttgaactctactagtaacattatgtttgcattataaaatattttttaaaactgacaagatatattaatatgtgatatgccactctaaaatttaacttgattaatattgtaggcttatggagtttgatctcgttaaatttttatacttttcctaattattttgataatatgtaaataactagcgaactaaacgtagtttaactagttagttttcttgtgacggaaccaaatcacccattaaagttctaggcttaagatgggtgatattctttcggtgcaggcgacgtaatcatcgatagtgagacgttcatgattgacgaggatatgtcggtctagtgtttcaaaaatcgaaaatgctatgtatacgatttatatgtacgataattatacgattgctaacagatagtgaatgtcacgtgttacttcgttagaaacggctagaaaataccatgggatttggttgtgtaacgctacataatcgtatatacagtaacttttttaaaaaatgtttatagatgtattgtgtgcgtgtttatttatagcgatgagtatgcgtgttttatgattacctatgtttctgttgtgttttaaaaatacgaggatgccctctagaaattaaaattgtttcccacaacatccgcagtgaaaccgaagaaagacggcggttaagcctaacctcctccggaaacccggcaacgcgcggtgtcgcgaggaggcagccattaaacgcgccccgctcgtacgccgcgcgcggagccacagaccagaccagagcaccgcacacagcacagcgagcagcagcgagcgagcgagcgagacatcagccatggctgtgcctctgcctccccccaacctcatcatcacccttctccccctcgtctagacacccatcattgcccctccacgccccccgcctcctcctcctcctccccgatcgtctcctccttgcccttcttgcaccgcgcgctatatatagccagccggagctcgaccttccagacgcatcgatcgaccggtgttcgatctttcttgctgtggggatttc

SEQ ID NO: 5642 - DNA, 1501 bp, Oryza sativa
ccttagtatttatactagcttggttcggatacatgtatcacactccctccgtttttttaatagaagacgctgttgacttttcctcacatgtttaaccattcgttttattcaaaaattttatgcaaatgtataagatataaatcacacttaaagtactatgagtgataaaacaactcgtaacaaaataaattataattgcgtatttttttaataagacgaatggtcaaacatgtgagaaaaaaataacagcgtcatctattaaaaaacggaggtagtattttgattcggggcaccgtatagctgtatgactgtatcttgggttcgagatttttgagagaattccttatatgccactgaaaatttattggttttctgatatatcacttaaaattggttgttctcttactgagaaaatgtcagtgtgttataatgggaggaactatttagccttttaagatgataatatgttttttcttggtaaaattggatgatctttaagttatacactttgttcctagtttacaatttttatttgtccaatatatataaataaatattcagcaactataaatattgagattttttgtcgttctggatatatatatatcacgatgatgctctatatatataagcatgtcgagcaacttccagcaatcctagtcataataaaaattatatttttgtgcaagcatagattggtaaataataaaggtaattaatttacttaatcctttggattagataaacgtatgcagcctctcgttaccttgttgttgctgctactgcttgatggtttgcgattagcagatgatttgaattctggacaggcatataggagagagacatcaaagcgagctttgcctgctcgcgtcgcggctaatcgaagagcagccataatcaatgtttgcatgtaatttatcgatatgtgtccacgacatgctttgcctttctttctctcctcgccggctcgtgcgtatatacaccaatcagggatcggcatcttgttccttccttgtacgagacaatggggcgattgtgtgtgagaatcgtgcgcgtggatcgaataggaaacagaaaacgattcaggccacgccctaacgcaatcgttcgcaagacagataaaacacatggacgcatggatcagaatcgatatgtggcctgttcgctgctttgtaccgccgctgcgctgccacagccaaaagaaacaaaatactgtgtttgttggctacatcacagtaaaaataagagcagtcaaacatagccaagttatatgtatgagcgacatacaaaaattcatgacaaaaacatcttcaatttttataatagtagataagagatatgctgttagatcaaatttacacactgttttatgccattaccatcactctgactaacagtagtctttgatcaaactgttatcttttttataaatgacccaaataaccttagtactaactaaaagtatcaatgaaattagtatccctacatggtgaggacgagc

SEQ ID NO: 5643 - DNA, 1501 bp, Oryza sativa
tcaggccattgtgcaggtgatgtgaatagccaggtgacatttggtggcttccgctatggttgctatggttgaatgggactccgaggtaaaagctttgctctgcttgccagtgctagcaacagcgatgccctcgaacgtcgttcaccttcttataggtgttgctattggagcttcaactctattttaagggaattctccgggtgaaaaccttagattcgtttggatcggacggtgtcaccgttctgtcgatgtaaccttcttgaatgcttcgttttaggagtttttttcccttgttggactgctgttcttgggttcattatgtcaatgtgagggttttcgctggttatttataaattgaccgtgccgacgtaaggtttttgatccgattttccttataaaccgtgaattgtaggagctccttacttgttccctcaaaaaataatatatgattagtcaaatattaattattataaacttgaactatatatatatattgattttctaagagatttttttggcacaaaacaccccgtttaattgtttgaaaagtgtgctaaaggaaaacgagaaagatattctaagaaaccgacacttaattagttaatgcaaagtttcattgaatatagtagaaaaaattataagactataacctgatagattaaagttaggaaaagaaaaaaataacaccaccatcacgcaccgatgccgctatcccacacaactgaaggaaggtactagttcctgaaaaaaattagaagtttgaaaaaaagttgaaaatttatgtgtgtaggaaagttttggatgtgatacgatgtgatgtgatgaaaagttaaaatttggtggtagttgagggtgaactaaacacggccgtagtctagtaccgatctgatcgccgcgatgcggaaagatgtcaactctagttgatatttgcatcattgcatgctcattcgaactggtcctatataactcacttcatgccagcgcgctcagtctacaacgacacctgcttctttgtatgttaaatcatctacttttccaacaactgctcatttgacttcaaaatcggcatctataggccacaacttgtccctcttgctagatcacatcattctgtttggagatggcgatatctagaaggccaataagtacctctcgtgctcctgtcctctttttcagactctactgtttttcgttcgtttccaatagcttaagctttgctgcatttgcttttgcctgtggtgcgtagacattatgccagacgtagaggccggctcagttgttgatcctcctcaagcacgaagctgctgctgctgtgcctgtctgcgaggcaacacagggaagttccttctgcgcacggcaactgtggttatcctgttcctcgcggtccgttttggctttgctcgtcatagcgtcggggcaaagttagctgttgaatcagtggcctacgtcgccactgcttgcttatacttctgctccttctcaagctggaaggagaagacgg

SEQ ID NO: 5644 - DNA, 1501 bp, Oryza sativa
agggcaatgctttgcaagcttgtggtttctgatgcgggttaccagttgcggggatctgatctctgtgctctttactctttacctgcagagatctgagaatgatgacatattgagtaatccatttagcagcagatgccatatttaaataatacattatgaagggaatgcagataatagcacactttacgattttggaaatcttgtttccttgtatcattctcttaacgtttcctttttccacaaatgtaatatttgctacggttactttctaagacgtccaattgcctaatcactattagcaatataaaaaatgactaaagtccagtaattatactttgaagaatttgtatcttctcatggtgtaatgcaatgttcttactcgacaggttctactctttagattctggaaatgtggtttgtgctaatattttctaaagcattctatttgtgcatgtctagtttctctactcacttctaattttggttcaaaacaatggtctatttctgtttgatggatacaacttgtattgtaatactctagtactgttatcactgaaattttcagttaatcttttttgacttgtggattggtgttcttttttcgtgctacagaggatggaagaagtggcacatttatgattggaaatgaaagctttccagcatctctcttagatctcccaactgttatggagtcatacaagacatacaatgattcagtgctaattaaaacagctgatattggtcaggtaaaaggataagatttgtttaagatctgttttatcaattgtaggcttttaagaatcttacattgagtttgtaacagatgattatggtaagagaagaagatgatcctgctccagaaggaattgaatacacacatggtcttactcctccaatgagggatgcacgaaggcggcgtttccggagagagcctgacttaaatgtattcaatgccttccctttagctcctcatggaagcactttgtcaatcataactgttattgttccattcactcatgtttacaggcagaactggttcaccgagttgaaaagcatctcatgaatattatgcatggagtatctgtcagtatccttttggttttgatggttttatcaaattatagcatatgttaccttaattacagttgagtaaaaatttaattgttttttatttatatatctttagttgacaggttttttgtcgtttagtttgtaattggctcatgaacaaccattgcttgaagttactgctttttaatcagaagttaataaactatatataataatgagttccttatcttgatgacaatggtaataccatgaactttttgagcatggtgccgagcctaaacttcaacatctcgtattgttggaacttggaaggcaagcatcattttcttggtaggctgttatgttgaaataacaatacctgctactagttatctgactgcttctggttcactaattgactggttcttgttgagccattccatgccatgtt

SEQ ID NO: 5645 - DNA, 1501 bp, Oryza sativa
acgcgttgaggtgcggcggaagaactcgttgaggatggggcggtgcgtcgaggcagcagatgaactcgccggcaatggggatgattcgtcgaactcgtcggcgacggaggcggcgcgtcgtggagactgaaggcgttgggggccgcgcagctaggtgaggcggacgaactcgtcggagaagaccaccgtcgacctttcctcatctcacccgtcactactgcactgcgcaccattgccgtttgctcgtgccggaggtggaagagacggatgcagggtcatttttgtccaaaatggcattttggcgaagccgttctagttgggagtggtattctagcgaagccaatttaagtgatggtatttctacgaagccaatcttatgcgatggtagatatgcaattttctcccaggcgacggagagacagcggcacgcggcggccggcggaagaggagggagcggcgcgcagcggtggaggcacggctccggcggttgtgggcggaagaggaatcggtggcgggaggtggcccttgttgcggcggctcaagtgggacagcagaggaggagcggcggcggtcgagctcggtgacgttgtggtcgtcgcgtagcttccccccgctggcactgccgcgcaccgctccctcacatgtcatcctcactgctcccctcctctctttgtctatccttttcttttctttttcattctttttcttcttttgctttagaagatggcatccggcggccgccgcagtgacatcgtcgccgtcccgaccgctgtggaccaccgcagatcaaatcctcgcgccaacaacctctcctcatcagtgcaatcaatagccctcaagaaccgagaagaatggagcgccgaagagggagatcgaccccatcttcttcaactccggccgccggcatcaattttcgattcccgctgcttcggtgagcctcgcgttgattccttgcacctgtaccactctagagacctcactaacatcaggaaaatacatgcaaattagttagattggtggatcgagccgtcgtcgtcttccaggagctccgtgccgccgccaaaccattttctccatccggcgggtgggagggagaggagcggcggtgcgcgccgcaccggcggagagggcggcagatgggagcgccgcgagggaggaagcgagctcgtcgcggcagccggcgggagaggaggcagcgcgcgccggccaacgggagggagggagaggagcggtggtgcgcgagcgtcggcggtcggcgggagggcgggagaggagcagcggcgcacggggactagcgggggggagcggcgcgcggcggcccctaagtgggggggagaggagcggccgccgtcgcttggagaggggagaggagagagagatgaagaggggagatgaggagaggaggaagaaggggggtgagttggactgacatgtggggcccacgtgggtcccaccattttttattattttctgtgtgagactgacatgtggggcccacggg

SEQ ID NO: 5646 - DNA, 1501 bp, Oryza sativa
atattagagcacaaaagtaaaaacagcacacaaaatgacatgcatccctctaaaaaaaataaagaaaaaaaaagaaacatcatgcacgtatgatgtacgtatacgcgtatacgctacctctggcctgcaggccttgcagagcgtgccgagggagttggcgagggagggggtctcctcgcctctgccggcgccggcgtacgggaggacgtggagcagcgtgaggaagtcccccttgttggcgacgtgggtgagcgcccacatcatggcgtgcttggccccggaggtgtcgtccaccaccaccatcacccgcttcctcccggccaccgccgccgccgccgccgcggccgcggccgcgtcccccttccccccgccgccgccgccgtacccgcccctccccgccctcttcttcgaccaccgcttcgagcccctcctcctgcctcctccgccgagctccacctcctcctccgccaccacccctcgccccatctgatactgcgccgcaccaccgtatcccccgttgctcgcgctcagctgccgcaagaagtgctccccgccaccgctcgccatgcaaccaaccaaccaacgacctcgagacctcgatctcctctcctcctccgcgcacggcgatggcaatgcgtgcgtgcgtgctcccggccggcgcggtgcgagctagcgagtgagcgagcgatataagggagtgagatggagggggagggaccgaggagctgaaaggacaagggccgcttaaagagtgggagccaaggagaggggatgggggggtggtcacgagagcgtgttgcacccgtgctagctgattagtgaatactcctccactgattacttactctagctcatctttaaggttctagctcggcacagtaatctcctagtggtatactccctccgtttcgaaatgtttgacaccgttgactttttagcacatatttgaccattcgtcttattcaaaaacttttatgaaatatgtaaaattatatgcctacataaaaatatatttaacaatgaatcaaatgataggaaaagaattaataattacttaatttttttaaataagacgaacggtcaaacatgtactaaaatgtcaatggcgtcaaacattttgaaacggagggagtagtatatacgtgcagaaaaaaacttaatgcagacaaaagagtactgctgcatatctgtgcagagtgacacgataatatatcatgtatacataagcttcacgcgtacatcaactaataaatattatcgaaaaatttagaaaaatatgtgcatatactttcaataatattatacttacgtgtaaaatatgttaacattaaatttattatattttagtcctaagaaaaactgacaattttaagactataagtctattttatgtatgatgaatttaaagatgaaactttacacgtagatgtaatactataaaaatacatatgtgttttttaaagaatttttgggaatttattagttagtgtgcacgagaatg

SEQ ID NO: 5647 - DNA, 1501 bp, Oryza sativa
gcctttcttgtacacgctttttaaactactaaacggtgtgtgtttttataaaaaaaaaatacgtaaattgcttttaaaaaatcatattaatctattcttaaaaataactaatacttaattaattatgcactaatgagtcggtccgttttaacgtgcatgaaagattagttcccaacgccttaaaacgaatacagccttaaagagctaaaattctaggagaatttgaggctgccagagcctagaatccctctggacacggcctatgtacttcaggaacatatcctatcctatatgtacacaagcattctcgtgcacactaactaataaattcccaaaaattctttaaaaaacacatatgtatttttatagtattacatctacgtgtaaagtttcatctttaaattcatcatacataaaatagacttatagtcttaaaattgtcagtttttcttaggactaaaatataataaatttaatgttaacatattttacacgtaagtataatattattgaaagtatatgcacatatttttctaaatttttcgataatatttattagttgatgtacgcgtgaagcttatgtatacatgatatattatcgtgtcactctgcacagatatgcagcagtactcttttgtctgcattaagtttttttctgcacgtatatactactccctccgtttcaaaatgtttgacgccattgacattttagtacatgtttgaccgttcgtcttatttaaaaaaattaagtaattattaattcttttcctatcatttgattcattgttaaatatatttttatgtaggcatataattttacatatttcataaaagtttttgaataagacgaatggtcaaatatgtgctaaaaagtcaacggtgtcaaacatttcgaaacggagggagtataccactaggagattactgtgccgagctagaaccttaaagatgagctagagtaagtaatcagtggaggagtattcactaatcagctagcacgggtgcaacacgctctcgtgaccacccccccatcccctctccttggctcccactctttaagcggcccttgtcctttcagctcctcggtccctccccctccatctcactcccttatatcgctcgctcactcgctagctcgcaccgcgccggccgggagcacgcacgcacgcattgccatcgccgtgcgcggaggaggagaggagatcgaggtctcgaggtcgttggttggttggttgcatggcgagcggtggcggggagcacttcttgcggcagctgagcgcgagcaacgggggatacggtggtgcggcgcagtatcagatggggcgaggggtggtggcggaggaggaggtggagctcggcggaggaggcaggaggaggggctcgaagcggtggtcgaagaagagggcggggaggggcgggtacggcggcggcggcggggggaagggggacgcggccgcggccgcggcggcggcggcggcggtggccgggaggaagcgggtga

SEQ ID NO: 5648 - DNA, 1501 bp, Oryza sativa
atatacatacatatatatacatatgtatatacatacatatatatacatatatatacatatatacatatgtatatacatatatacatgtatatatatacatatatacatatgtatatacatatatacatatatacatatacatatacatatatacatatacatatacatatatacatatacatatatacatatacatatatatacatatatatacatatacatatacatatatatacatatacatatatacatacatatacatatatatatatatacacatacatatatacatatatatatacatatatacatatatatacatatatatacatacatatatatacatatatatatatacatatatatacatatatatatatacatatatatacatatatatatatatatatacatatatatatatatatatatatacctaggtgtctatggcattaactacattgctatgtaggacttttagcttatgtggcactatattaattaagagagagagtgaagagaggaagaaactgggtctcatgcaagacacagcttcaacacgagaacatatgtactagacactatcaagttttgcattgggagaaaatagtgtctttataatagatgaagaataaatataattggtagaaaagagaaatgttgtatttattaatggcccactttaagaaaccataggttgtagagtgtagtttctattgtgatgtcttattaacatggcaccatagacactgcttatgggcactatggtttggactgccctaaaggaagtcgtttaggataatgtttaagtcaaaccttgagaatataaataataaataactctcaagttgttgagtttgaaaatgtaaaaattatatgaatagatttgtcttgaaaaatgctttcataaaagtatacacatataacttttcaataaatatttttatagaaataagaaggcaaagttgtgttttggagaccgtgttgctgtctaaaacgattttctttacgagtacggagagagaatgtaccaggaactatagtctatagtaggcaaagttgcggttttccatgtgaaaataaatgtttcatgtgtttctccgcatagaacgggccagttcttcaatcactacccacgtgtgtaattatccatttttattttgttattatactattaacatatctgatgatttatttatacatacacatgttgattgggacctctcacatggtggtacttctaaccacacaagaatgtgactaaaatacatttaaagatgaattccttatatatatatatatatatatatatatatatatatatgctgttgaaaatttacccaatcctttgttagtgagacatatcagcggcttagaaaagatttaggtgaatttccagtgacagagaaccagaaggaatgaaaatgatacgctgaactgacggtatcagaaaaggtagaattagtctaatttctccttttatgccatttgttttcctagt

SEQ ID NO: 5649 - DNA, 1501 bp, Oryza sativa
atcgagtgtttatcaacgataaatcataaaatttcttaaaaagttatttttcccgttgcaacgcatgggcacgtgactagtagtggaaaattttgattaaaaatatttaattaaataaattaaaattttaacaaattttggctgaatttttaaaaatcctaaattcaaatcttacaaattgcgagaatcataaacatttgacaggggcaaatgaatgaaaagttcaaaaaaaagggggttaaaaatcaaacctttttatttgaacaaaatttggctgaattaaaacagttctatattaaaaaaaaattgaggtggcctgtctgtgcatctgtggaacatcattgtatatcatgctcatgtatgaaatgtttaatgctgacaacttcacatggtaatgtaacatcaaaaagagcaatgacaatttaacacaagttatagacccaaaaacaacaagttcttccaaagatagaaaacagatactgctgccaactggcacaaatacatactcctacggtaccaaccgtatttttttcctaaaaaacacattctctgtagcccaatgctgtcagagtctcagagatacacagtaacacaaaggacgggcatgttattttcggtaaatgaactactaccagatagtaggacttcagtaaattaaagaattaaaacaccaactcgccacagctgttcagatttcatccgaaatttgctccgtcgaaatgtgtagtcatctaccctatagttcaacaaatactttcactcattctttcattcatcactcaacggtccagattgtctcggtgaaatctcaacgattgagatcgctcccacctcccacctccctcgattgcgcgctcctcttcgccccctctctatcgctctcacgcgccgccgcccctccccaaccccgactcacgcggagccaccgccctcgactgtcgccgctccgccgtcttcgcatccgtcatctccgccaccgatccccgcgccaccgccgtcgccgccgccctcgactgccgccgctccgccgtcatcgcatccgtcgtctcaccgccaccgattctcgtcgccgccgacgccttcctcgcctggtagctgccgagaccttcctcgcgtggcggggcgcagccgcgcaggcgtgcagcacaggcgccaagcagggcaggggcagggcggatggcgcagcagcaccaagcagcaagcaaggcaagcagaagtagtagcagccatcaggccatcacgcccaatctcccatcagcagaaaatggacagaaagagaaaagggaaggcactggcatcacaaagaggttgtacttttttttatttgacaatttcagaacattgcaatttcaaagtgtacaaatttattactgaaattgcaattaaatattttatttttaggatgcttgtacattttgtttcactcattgctttttatcttatcaaactaatcaatctttgctatttgtttttcagattctacatatgtatctatcctcat

SEQ ID NO: 5650 - DNA, 1501 bp, Oryza sativa
caatcacaaccattccccatttaattttttttcacatattttctcatcctaaccaatcacaaccatatctcatttatttatttatttcatctacttactcatcccaaccaattacaaacatccctcatttaattccatccctctatttaatacacgtgaaaaactttagaattgcatatattacgagatggaggcagtaggattttgaccatcaggtctatattaaaataatactttataagacctgatgggtttacaattttactccctctatttcatattataagtggttttgatttttttttcactagtcaaactttgtttagtttggccaagttcatagaataacttagtgacatcaaattagtttcattaaatttaacattgaatatttttttataatatatttgttttttgtttgtaatgctactatattttttctataatctttgtcaaatctaaataagtttgactaaaaaagagacaaaacgacctataagatgaaatggagggagtacaataatactctccaggataaatttacgcatataatttttgtttcttttaaagtaagcaattgaaaattaaatttattgatgactataattttagaagtttcgatcaaattatagtcccttcgtttcaaattacatgttgttttacgtttgtatttgaccattaacttctagaaatccatatagtccaacaaaatgtaaattatatatcacaatcatatttctcatgttaaatctaaaaatataaatcgtatgatgttaaagtatgagtttactcatatagaaattgatgatcaaataatatttgatttaagacaaacccagacagctaattttaatcttaaacctcgaataaatattcatgaggcaaatcctctgtaagacaggtaggggtaggtgcctcccatttaggtgattaccagatttgcccttcgtactgcttagagtcatgcaccggcacggttacggcaagacccggcggatccgagccatctgacatccccactacttctgccgtcctccccagaaaacgtgtcacccccggttcgcggctcggccgcgtcgcgtccagtcccgcaggggcaaaaccgtccttcagactctcctcccgattcgtcgccgcccagcagtccgtccgccccagaggcccccaccccccaggtctctccccctcccctcgcatccataaaagcagccccgagccgcgcgtggccccgaccaagctcgatcgaagctctcacctctcctctcttctcttctcttcttccgcgacacgtcttcgccgccgccgcagccgccgtcgggcgtcggctctcctccacttaccagaaaaccgaatcaccgagaacttctctctctagtattcaaggcgagagattcccaccccgcgattcccttgcaggccgccagatttgtgggccttgtgggggtgggcgctccattaaacccgagagaggggaggcacgcgcgcccgccgaggggcagcg

SEQ ID NO: 5651 - DNA, 1501 bp, Oryza sativa
attctaaagccaaaacacagtagtgataatactaaatcatggttccttctcggttgcttcatcggagacgtcgtcattgcagatcttcattgttatctcgatgggagaagaccagcgaggatcatacccttctcccaccttccttttttcaccgtatcctttttctaccttcttgcacgtgtagtcttccatggaactctcaacacgtcggcaaccatcacgtatgtattgaaacatcatcatgatggcattcgcgtggcccatgtaataattccccttgtttggtgtttgccctgacgaaggctgcaccttcgcatcatccttggagttcattgactccttaggtgtggcttgatgtggtgaaaaatccacatcatccatggatgccatgccttactacaatacagaagaagtaggagatcaataggtgcaaactaaagtatataataatttccaacacataagagatagtttggagaacgataccaagaaaaagattggtcaatccctcaaaagaaaatatggttggcacagtaatcagggcaatttttttttcttgatttgtaaaccggatgcaggcaattttaaacatcagattctacaacagtgcgaagattgacccacgaagtatacatttgcactatttgcaaggggtaatcattatggaagaaattacctataccaaatagaaatttagtagaatcagccaaaaatttcgttgattgtgcagcaaacaatagtagttgacatggtgtcctgtcagcctgaatttttcttcggcaatctgaattttcgtcctatagattaaatcatttgaaatgaaaggttaagtcaggttgctagatataagcaatcacatagaaaaattgacacaatagaattatctgaggtaggccatttcttccccacaattttacaatgaaagattgacgataaatgttaacaagatgtgaagtatctcatccaatgacaacaatgaaaccccccaaaaaaaaaaaatcctaccacacgaatgagattaacacatgaaatttagttgaaatgcaaaacaggctttgaattagagttttgcatcacagatatccatgcacagtgaacaatgtttgataatgaacaatgggggtttagtcaacaaaggggattcctaaagccattatgcatctctatgaacagcggtggaggacggaaaaaaaatttaggtgtggccaataaactaccacacgcgagagttaacacagaacaagaattaagaaaaaaaaaattcaatgcacaatattgtacaatgtaacattatatcagcaagtcatagtaacaagcacttaatcacaagttcacaattcatcatccatttgcaaataagtgtaaatataaaggtaggtactcaaaaatacctcaagattcactgattcaagctttcagccgtacatcacatatataaactaatgaggatagatacatatgtagaatctgaaaaacaaatagcaaagattgattagtttga

SEQ ID NO: 5652 - DNA, 1501 bp, Oryza sativa
atggagattaatgtaatgcgattttatgatactatcaaataataaatggacaacagaactctcactagacaaaaaaatatattaattgaatgatagcacagaataacttcaaattgcagaagactgtcattgaggccgacaaaaaaggtaatctgaacaattcgtaaaaccaccaagtccataactaaaatacaaggttattaatcctcgtccgtccaacggcaaataattgcagtaaacaaatcagaaaaaaagttttccatgcgagttccgtgagagagctctttcgacaacgaagcattgcgtaaagaagcgcaaaacgggagtactagaaatccaggaacgtcagcatcaaaatcacgcttttcttgtcgttcctcaaggaaaagaaaatcgaataactaaataaagcactcacaagccatagaattagccatattaaaacggagataatgagtactataaaaagcaagaaatagacaaatcaattattcagtcgaggtcaaaccaggaacagtaaaaacaaaaacctctacttctcacttccgcgaaaacacattaaagacaatttgctgacaattgcggcagcaaagcagccattaaaacagagggagaaaaaacaaaatttcatgagcaacccatctatttcgtgacaacatataataactcattggaattaacaagaggcagaacgaaccaattcagtgccaactatgaatacaaaaataaagcacttctgcgctgaccatcaccaaaattaaagctgtaatgcagccagtatagcaggactgtacacaagagactgcgcaagaaaaaaaaaatctgaaacaaagcagcggcgagagttgtgatggcgatagggaagagagagacagagaaggttgcgaactaacctgtatcggcggtcgtagggggagatgatgaagcggcggagcttgatgcggcggttgctccgcgcgccgagcgacgggaggatggcgctggagatgctgtagtggctgccgtcccgcgacagctccctctcgagcgccgggtccccgccgccatggcccgccccccacggcccgcacgcgggcatcatcctgctgcgcccgtcccgcctcacctcgctggcctcgaacgcgtcgccggcgccgaccctccggttgcggccccacggcccgcacgccgccatccgagcggcgccccacctcgccattgcgctgcccctcggcgggcgcgcgtgcctcccctctctcgggtttaatggagcgcccacccccacaaggcccacaaatctggcggcctgcaagggaatcgcggggtgggaatctctcgccttgaatactagagagagaagttctcggtgattcggttttctggtaagtggaggagagccgacgcccgacggcggctgcggcggcggcgaagacgtgtcgcggaagaagagaagagaagagaggagaggtgagagcttcgatcgagcttggtcggggccacgcgcggctcggggctgctttta

SEQ ID NO: 5653 - DNA, 1501 bp, Oryza sativa
gcttttcctccattctctttcttccacatcaccaaaattatttacatgcatggtaacaaagagcttgttactaaacactgttatacatgccctaataaccgtagtgaactattaccatcacagagttgatattacaacgacatccttacccttctcttcctctcatgcaccaatagatggtgcatcaatgtgaggacgctatgtgagggaaacgtgttttagactcttgagaagatatcccctcttttgttcaagcactatctaaatgattgttaaaaaatctcaagaaaatgacaacattcacaacacatatataaacttctcaaaagaaaaaaagaagtcaaaactcaactttgacggaatgatagatgttacaaaactctacattatcaatatttttttagagttcttcaaaaactacttacattgaaattgagagaaaaacttagacgagggggacatcccctcctcaagggattagaattctctcacacattaaaattgagagaaaaagttagacgaggggaacatcccctgccccctcgagggattagaatcctctcccgctatgtgagcttagagctcaatgacaactccaaatgaagaacgtactcacaaaagatcgagggaaatttcaatacaatccacttcaaaacatcaacccaaattataaaaatgtcactgcaaaaagcatagcgatcgaccttaccgttggtttgtctatattaagcatttccatgcatccaagtccattcgatctcgttaatggaaagctggagttgtacttcaattatccaaaaatactaagcatttcctagatacacattttgatgcaagccctcacacaatctctgttacagttttgttgatttttgattccatctgctagaatcagaaaaggggatgcagttcttctgatgtacaattgactgatacgattgcaccatctcttaatttacaattaaatctgccactcatataattgcattcaactgatgcaaatatgaacgattgcataaaagtgtgttaacatgcatgcaaaaacagtatggtgtgccaatataattaatgtgcaaacagtggcatgaaaaccatagtgcatgatatatatatatatatatatatatatatagctatttctaaagtgtgcacactaccaacagaatcttatactgatatcaagctggcctaaaagaaccattataaaaccacgaggcaaagtttagacagtatcaacattaattagaaaaccaaagtttagatatgcatatggggtgcgtgtgtatcatccaaatatgtctttcaagtaaaaatacaacacgagaaactgatagcctagagtggtagcatttctatcagtatcagattcaaattaactagacagaagggaattgcaccagattgaaagcatagctatagctagcagcatgcgtagttgcgtacagtacgtgatccggccagctcctgggtctccagggtgcatatatcatgcaaacaaata

SEQ ID NO: 5654 - DNA, 1040 bp, Oryza sativa
gggggggggggggactgctgggagtctctttcggttggttgctgcagctgctgtcccgcgcacagttcagtacgaggtgcatctgaacagaggttcacgcggagtgtcacgagaccgatcatggaatcagtggtctgttaatttcttttgaaattcacgatttttctctccttcgtatggaatatccggttttactaagggcttccacgtaaaatatcagctcagagatactgttcatgagggaccgagatcaaattacggataaatcggaggactttttcgtaaaatttccaaccctaacattgttcctatcctacgtggcatcgcccaggagtcgccccatgcgcaccccattttgttctgtaatagcacagtatggagtcgcgacgtggtcaggctacggttgggacaatagattaaatggttttcaattcatatgccttttaacaagaaaaatgcattccatatatccaacttcagggggaaaaacaatgatataccaatacttgcacattttcgattacataaaaagaagtacaccacatacacaacattgtttacaaataattcaaaaaagtcccgggaattaaacagattgtggagatgaaattgtggatgcatgcaccccatccatcagcgttgaaatcctggtggccataatacactcacatggatgcatttttaatacaaaattttttatttatagttggctttctgtttgtttttgttttagaggatgtattcacacatgtgtgggcataatggtgtgcacacgcgtacacgtcttctgtataatagtgatacattgatgataatatttagaggtgacaattttcctttgaaattagatacccatcgtgtccccatatggggtggggtgagtttcccacttgcaggtacatggggttgaatggtgtgttccacccacacgtgactcatgggccctaaaattattcaagacaggagataatgtttacaattaaaaaaggccatcaacccattaagcgaattccaacatgctattattatcagtatcatta

SEQ ID NO: 5655 - DNA, 1501 bp, Oryza sativa
gaaagcgtgctagagaccggtacgcagcattgaccccagagcaaaaagatgataggaacaagaaggcacgtgaaagaaggaaaagaaagaaggaggaaactcaagtttcaggtacaactgtaatatttatctgtacaaattaaaatatgtctggccaattatgcgaaacaatattataaattctcgtcgtgtgaacagccccacttggcgatatttcaaatataagcgctgttgatataatgaagtgccaattggaagtgactgattcttccccgctgcatcaaggaagtaatgtctttattgtttgtacagtttggttgaacaatatattattcgactgaatggaaattgatagttctatgtttaaatagaaagtgaagcttcccatcttaatatcacaccaagacgtctcccatttacaatcatcaacaatgtagctcactatggtcccaacgaagtaccaatgagtcgcttcactcaaagtacctaaacatgaatacttctgactttgtagttgataattcaggtatgctaatatctttttattaatgggattacaatgctgttgccatttataaatttctatattacaatatatattactgactatgttacaacaggatgtgaaaatcaatatgaatccagtttttttgaaggcagcgatcaaaatgagtgcgaccacgatgacgacatctctctaggtaacacattttacttcatcacatgttttttttatataaacttgtcaaacataaaacctctttgcttacatatgagaagtgcgctaagttagttattattatctattcatgtttgtacaatttaatatttgaagtgagcaaacaatcccataaatctactcatgatgatgttggcacatcactagataatgaattggtgcgtgcgccaaccaatgagacaaaagaacgattgcagtcaaagctagctcgagctagggagaagtatgcaactcttacaccggagcaaaagcaagctaaggtggaccaacggagaacacaacgtcaatcactaacaaaagaacagagactagagttgaatgcccgtcgtagggttgcaaggcaatctatgccagatgtggaaatccatgatatgaatgcttgccgtagatcaagacgacaaaatgttactcctggggaaagatctgctcatctggcacgacgtaacgcactctatgcagctaggcgtgacaaaccatgcgctgaatccattgcactagagtgccctgagggatctatcccattgttgctaaatccaacgccttgcttggaaacaaccggtgatgtgccatctacatcgagcctgcaaactgagcatgctgtagatcatcaggcgcgatcatgcacattcaatgatggtatcatctatatatgttttcattcgtactcgcaatttgggggaatttaactatattccacttttagatttggcaactatccaaatgcccttcttaagtttgctcttaattttttgcccctcttag

SEQ ID NO: 5656 - DNA, 1501 bp, Oryza sativa
atcaataaataatttataggtagaggaaaactctcacatatgcgttcttacggatttaaaagctaatgggagattgtttaaaatgagaaaaaaaatccttaaaatcaaatcaaaatttaacttttcgactgcggcaagtaaccaaaaagcaaacggtgagcctgaaatggacatgatttctctctctggcttttgaatttgaactagtccacccagcaaacggtaataagattgtactcctccacgctggacggaataaacaagggagccaaagagtccagaagaatccacctcaccaccacgcgcaccggtaacaaacaggttggcattggggattggacaggtctcacgatttcacaagtgcgaacgggggtggagaagccgacaagatctcgcggtacaaaagccatcaacgccttcctccccttcctccgatggagccacctcaaaagcccccgcccatccaccgccacgcggcgatccaacccccttccccttcgccggcgcagcatcggacctcgccgccgcggcggttcttctgagcggggccggggcggggcggcagctggggattcgtcccgtgccccgtgctcttcctctgcgtgggccggggcggagggagggaggggaagtcggtggtgaggtggcgtgttgtgtggcgcagatgtgagggcggaggaatgcagaggtcgcggagagcccttctgaagaggaaggcggcggcggcggcgaaggaggaggaggaggaggcaggggtgggcgtggctaccgcggcggccgccgggaggaggcggcggcggcggctgtacggcttctccgtctcgcttgtcgtcgcctgctgggtcgtcctgctcctgctcaaccccctcgtcggtcatgggaacggtcaacgaggtacgatttcgttttggccttcgcggaatcaatttttgatcgatcgtgcttggtgggtggttgcgtggtggtgcgaacggtggttggggaagatggtcgttcgctgaatcggccgaacgtgaatcgcaatattacgcggttacaacatagatctatatatgcgcgtttcatttctgaattctgaataaacatcatggttttttgatgtcctgatgaaatttccgctttaattttaccatttttgaaagatatcgcatgtcaataattttcaaattgacgttatgcgtatttctcggtgtcgattgggctcatgttcggtgctgtctgatttctgcagatgaagggatttttgcggatgaaggaagctctgatccctcgtttgattctgttgagcctaccttgagcgaaggctctgttgattcagttgtacagcaggagaatggggaaaatcatgcgttgccaggtgatagctgtgctaaacccgatgaaaatcatgtgctttctgaagagacactgctggagaaagatcagctttgctccaatgatgaggcacagggtgatagcatggatgctctgcccaaggataacgttgatcagggtgagaatc

SEQ ID NO: 5657 - DNA, 1501 bp, Oryza sativa
gtggtgcagaaggaactaaccaaaagaaatggggggtgtacattaaaggcaagtcaccagctatgtgacgggatggaggtcatgtgccaaaggagatttgcatacctcaagttcccctatcttcttgatttgatcacagtagcgttcctgaaagtcacccacctcctttaataatcgctcttgcattgcactttcccgaccttttgttgctgccaattcttgctcgacataattcagtttgtcctggcatgttgccctctcatcctctgaagcagtaaaaaaatgtttattgattacctttaagtatgtgcatgcaattgcttcgaatgtaataagctaacacctatttctaacagtagattgcttagagcagtgaatctgattcaatactacgtgtccttcctactttctgcgcccggcaaatcaaactaaacacaactaggaagaaggtaggcccaaactccgtgcatgcttcaagtgatacataaatgtatcttgaccaacggatatagcaaatcgaacttaagaaggtacacatgcgaaaaaagaacagcataccactcttggataatcgttcctccatatcatcaagtgtggctcgatactcctgaacttgcttctctgcagtgtccaatgccaccataaattctgatttcacctacgagaattacatacaagaaaaaagaacacaccagtatgtatatatcaatatggtacactggcatgtaataacgcttactgcaacagccacacacaattattcgctccacgccatctatttccttacaaattgatcaatcaatcgataattgtctacatttttgatgtggcatgcgtggaatcaactgagctaagcatatcaaatatgagactacctggagctaaatgggagctcgaggctggagtaacaccgaaattactagacacgctatgcttccaccgaccattgggctaagacaacaatagcagtagaagataggggcgaagcgatctcaccatctgacggcagtggtacgtgcagaccatgtcatccatgggctccccggggacgccagcgggtacgagggcggtgggccggtcgtagagcacgaggcggcggtcggaaacggggctccgggtggtggcggtggcggcggcggcgtcgacgtcggagtccgcccgccgcttccgctgcggtggagtccggagaatcatctcgctggcttcgccgggggccgcggggggggggggggctcgggggttctagaaggttcctctagggttctaccgcagggagattggggaaggtgagaggggaaggctggaatgggtaacgacgagggatttgatttgaatccgcgcggatgcctgtagaaccagtggggaaagccggaaagggtgaaaggcgtccgttccgatctccgttaccccattcccacttttaccccaattcgtcggccctctgtttatagggttaattggatcatgccattacaaatatggcaaataaaaaaatgtcact

SEQ ID NO: 5658 - DNA, 1501 bp, Oryza sativa
tgcatgcagctgcagacacaacactatttgtgttggttgcgcaacaatgaaattaattgcagtcgaacaaagccctatgtactaagattttaagatatctcatgtggttggtagctagacaagtacaaccgtttgttgaggaggaggttaaatgttactccgatccctccgtcccagattgcttaacgctttacctcttagcgtttgtccttccatgctttgttttggcattggagtagtaacgcttgtactagtgacactacttagggcatatacaaccgaagccacctctagagtgctctcactaactaagggtattctctggggaactcatcttccaatggaggatacccctaatgggttctttaaaatttgatgccacttgatggagatactccagcccgcaacgggtatcccaacccaagaagccacatagacttttttcccctcctacccctacctccatccgtctctctcactctatctctcactctctttcatatttgcccctctctctcgtgctacttgtcggccgtcgccgcctctctctccctctctttcccacgtcgctgcccgtcgcgccattgccatcttccctgccttgcaccgtcgctgacctccccgtctcgcaccgtcaccggccggagcggcagatccggcgctgtcgtgggtggatctggccctccgcggctagatcgggttggagcggtgccgtccgcgccgcaacgaggagacagtggcgggcaggcgccgatgttgttgccggggagaacggtgactcgtcgccttccacctcgccggcgccggcggtactctctgtctctctctctctcttcggcggctggcgagggtagaaggggaaaaatggggggagaaagcgatgtccacaggctcctcccctagccacggccgacccagtgcgactcctcgcccggtcccccaaccgaggagctcatagagccgcgtcccctgtattggggtcgtggccctctgctaggagacggcttgacgacaagcaccgacggcgtgagcagggacatggtccaggggtacgcattgaacatgtccttagttaactctatacttaaaaaatattccttgtgtggctagtgccttttgtggtaatcccctaattgaaatgacaacatgcaactagtaataatgtggggcatcgtggtaattttcaccttaagctaatttaccactacaattctgggatgaccagcaattttgggatggagggagttgactgttttagttgatattgttaaaagctaaccttataattattcggtcattatagatttatagttaaaaaccaatatattttgattcatgtgaaagttccttctgcatccttcagcctttttttagtttgagagtagaaattacatctcacggctgcactttttgaaaggtaaacgaactatataaagggtgactataagaattcaactaatcataaaaaaaaacttgcgttctgaaggagcccttaaaaatg

SEQ ID NO: 5659 - DNA, 1501 bp, Oryza sativa
caaaaagaaaagacaaagaaaaataaaaggagaggaaagctactcacccacgactctgcactggtcacaatacacagatcgcgatcggagcacatcctcctcaacgacgttgagctccacggcgccgccgccgccctcctcgtccccctcctcgccgacccgcagcgacaccctccacgtcaacagatgcggcggtgccgcggcggccgccggcgagaagatagaggggagaggcagcagccgcgcgtacctcgcgaggaaccccctcaccgcctcccggaacgtcccggcagccccgccgtcccccgccggcgggaacccagcgaagtccctggcctccacccgcgtcctcgccctcttcagcggccggctgttcaccaccatctcccccttctcccccgccgtcggatctcctcagatctgccttcctccctcgccgccgccgtcgtcgtcgtcgaaccagatcggaactcgggttagggtttgcggcggcggcggctacgagataaagaggaggaaggtgatggggtcgattccttcgaggggaagcctggccccgtacgccgggtccttgaacaccagcgctctgcaatgaattccgggcccaccggtcagcctccggcgtatggtggaacgggtgtaggtggctcgcggcgggatgggctcgtcagggtcgtggcagagcgctaaccagggttaagcgttgttgggtgggtggttgggttgggttgggttcgacgggccgagggggtactttccggaaagtgagcgggagaaatgggagggaataaaggcttgggggtacgatggtcatttcaggcccctggttttcggaggagagggtccgcggggaaatcggcgtgtcctcgtgtcgccgaaattcccggaatgcccctcccctcggtttgaactattccaccagtacagtagtagatccggttagataatgctatgttgggccaccaggtgatgacgtggcaacaccccaagccaatactactcttttttttttctcactactatactactctttagtataatataatatactccctccgtcctataatataagcgattttgatttttacttgtactgtttgaccattcgtcttattaaaaaaagctagaattattatttattttatttgtgacttactttattatccaaagtaatttaagcacattttttgttttttatatttgcataaattttttgaataagatgagtggtcaaacagtgcaaccaaaaattcaaaatcccttatattataggacggagggagtacatattcgttatattatatagtttctcgtcataatttagattgttatattgtgagatagaggtattatatccctagtatagggagtagcacaattatcaaactctaccttagtaaaaaaaaatataatacaaaatgtgacataccatagtattagaatttgaaagccgaagccatgagattagtatcgcggacctgtttgggaaagtttttagcag

SEQ ID NO: 5660 - DNA, 1501 bp, Oryza sativa
ccagctgttaggccgagcccataaatatattctacagaattgaaattttctcatgcacaacgccgccatatatacactattgaccaaccttctctaatttctacagtaaaataaattctttctcgtacatattttttttagttacaactagctgctagctcagaatgtacggcttatacatgcatggttaattattaattgatcttaatcaatgtgaaaaataagtgatttaacttaaaataaaaattaacttttgggtccctgacaatataaaagaaaaaataataatcagcgtcaaagctaattaaataaggttaactcatatttttgttgtacgcttgtacgtactagtagcttactactatctcttcgcatgcagaagtacgtgctacttgagttgttccaaggtacgtataggttattgactaaaaaaagaaaaataatatgtgtggtgaccaacaatatatatactgacaaataacaaaactaattaagtttttttaataatggaataaatcccggcctttgctaaaaagtagctacagccaatttttaatttaaaaaattcgctcaacaaagggcacaaactatcctcagagaacaaaacagaaacaacgatgcacgcatgactaaagtaccaccaacacaagatataaacccaacaattattgaagtctatatatttgtaaatattcattcatagttagcgaaagtctgtataaccataactctaggttacggcatgcagtatgcatgaatttgttgtcttcatcgtacctttgtggttatacgtaaaaccggagcaaatattttgctctaaaaagctcatgaaatttagatgcgattttgtaaaaagccacataacttttactaagttgtagagtccaatatatagcagatgcaggagctaattaaatcaaataaatgataaatatattacatgcatgcatttagaattattcatcaatcaactgcaggcctgataaaattgatttctctacagcatttgtagagctattcaatatttttaaccctcacatcagtagttctgccggcgagaatcacgcatataagcattgactttcatctttcaagcacccgatcgatctgaaaattcagcaaacatataactgatgacttgagttgtacgtgtttgtatgattcaacaatattggatatccaagcatattgcatggcaaaatctcagccaatgagatttaattatggcaataatggtagctagtacgtgtgctggagatgtagttcatctttcttgtgcaaaaataaaataaatagatcgatcggcgactcgatcagtcgtgcttgtttgaagtttctctccacatctagattttgcaacacagtacaatattcagacaaaatcgtagatttttcaacaccatgcccatctataaatacgcatgatcgattcctagctctcttaattaacaagctatacaaattaacacaaagattagaagaaagcaagcaacaatggcgt

SEQ ID NO: 5661 - DNA, 1501 bp, Oryza sativa
ttatttaaaaactaaatttagagtgcataattagtcgacatggtattgttaattaattactaattactatagtaaaacgctggataccacgaagggacatggtagcgatcaagagaggaatgagcgctctaggagtcgaacatgagacgtgcccgcgctccacagcagccccttttgccacctgcactagcacgcagtctcacttcctaaagtatcaactatcaagtaaatacattggaacattaaaataataattgataaaggtactaggatgattctatatacaatttagaattagactacatttgagttttgtatctataaatgcaattatattgtttattatatattaaatggtatttaaatataatccccaataaataagataactgattaacaactaatattgttgttaacgcgaaaaacacgcaatggcctaagagatatgcttaactctagtgcaggtccaaagaaattgccttcaggttctcagcgtgctagctggtttgattgtgcaaccaacaagaaagaaaaaggaaaaagttaaatccaccaacgatagcagatcggctggattgccgatgacgtatcttccggagccatgccgatgtgacttgcatcggaccagcaagggaagataaaacgtagagattattagatctacttgattggctgtagatgtcaatgatacatagcctatccaacgaaacacacttagatcgggtgattgggatagatcggatgttatgccgagacagtataaatcactcaatatctaactgtacctcaaagcagaggttacgtaggttcatagcatagttgatggggcaaacctaacgtgtatcggctagtactccgataccgctttatactaagatatcagcgcagataaaatatacaaaacaaagatcaatatggcaagcagggtgcattaacaaattgatatatagaaagcctaatatgctttaagcgaatgagatcttcatataaagggcagatttagacgatcaagaaccgggtagggaaacaaaacggctaaatcaggtaagatcggctgaaaccccgatactatctctattagtaatcaaagaaagagctagataagacgtctcaagatagcacttaacagatcgaacctaaccgatgcaacattaagcgtgaaaagaaacataagatctaagcaaatcaatgagaactcattcaagatggtagatatactgcacaatctagcttggtgtcgatatctaaatttatcggccgttttcgatgatagaggctagccgatgaagttagatgacgaaatctatctagattatacagcatatatgataactcggtgaatcacataaacaggattagagtgtcataaagatgtaagcactaatccagagaacacaaaccgccatagcaagctttacctctttgtcggagatcgaacccgatgtagcccaactcgaaagcaaaaactcgtcgaaacaatgagaatagaaaagggtggcga

SEQ ID NO: 5662 - DNA, 1501 bp, Oryza sativa
tatggtggatcagctccgccttggcatcctccccggcggcgccgagcgcgacgtgcagcgggaggaagtggtccggcgacgggtgcgccatcttaccgttcggcgccttctcctcgtactgcttcacgtcgtcgtgcctcccgcccgcgaggagcgcctcctgcagccacccgtcgaactccgccgcccactggggcaccggcgtgccctcggcgacgggcgccatgcagctaaggttgtgcgtggcgttgccggagccgaggatgaggacgccgtcgtcccggagaggcgccagcgctctgccgagatcgtagtggtacgcgccgtcgcggccggtctgcagggagagctggcacaccggcacgttcgcctccgggtacatgaacatcagtggcacccacgcgccgtggtcaagcccgcggccgtggtcctccttcaccggcccaaatccggcttgctccaagagctctttggccttcttcgccacatcaggggcgcccggcgccgggtattccagctgcatgggatgccatgcatgcattattcagttttttttttaaatttttgaaaggagggaacaagctttgcctcgtgatcagatcacaaggcaacaaacatgatgcatgcatggtagggaaggacgaaacgcgaacagttggacctggaacatggacttggggaagccatagccctcgaagtcgtggatggtgtcattgttgccgcggacgacgttgacggtcggcgtggccgtctcccagtggcccgacacgatgaggatggcacgcggaggctgcgcgcccgccaccgccgccggtagccacgacctgaagaagtgctgcgccggcatcgtgtcgtcgatggagagcgtgggcgtgccgtgcgataggaagaaggtgtccatggcccccgcgccccgtagtcccgtacgttgtgtactcctcgtcctctcggtttcggaggccactccctgctagctgcttatcttatctcgccggccgcgtcggtgtcggtgtggtcgcgtcggcgcgcgcgtcgcgtgtgctgccggccgggttgggcttggctttggctctgcccccatatccttctatttatatacgcgccgcgcgcgcatgggcgcgtggtgcgttgcaacgtcgccggcagccgatgaggcgtgcgttggttgcagatgattgggagtgcgttagttgcagatgattgggtcagccgatgaggcaccatcgtacgtactgtacgtttcacagttgtgcagtagtagttggtcgatatgacttccgatctactactccagtctactagaccgcacacctcacctcaagttgccggcagcaaaagctgcgcttgaacagccagcagctctcgcgttctaaatggatgttaagctttggatatagatagaatatgcatgatggagcaaaattctcacatggttgaattaaattaaatattataaattgctaacaaatagtatagaaaaagtggtctaagcattcaagta

SEQ ID NO: 5663 - DNA, 1501 bp, Oryza sativa
aagaaatttatgtaatcaaatttttatgaaaagttaaacatgaagcatgtcatattaatccatgatacccaatgtgatatttgcccattgtagtggggcctgtctgtaaatatcattgtgctttaagctagtttaataaagtatatactttcttcgtctaaacaatatccaattatagagatataaaaaggtgacaatatcatctgaggcttttggtctcagttagtcttgcaaaaaatataaaaaaaatgcttttgaagtttttcacaaagtttacttttatattgttaaaaacacatatataaaaaatttatttataaattattttttatttataaatataccgtttgtgacttaccagaacaaggagagaagagtctgttcatcggtccatcacggccggacaaacctcgccgcttcgcttcgcttcaccctttttcggttcgctctagctcctcatcccgttatgccttccccacctgccgctaccccacgcccccttcctctccaggtctcccccctccccttgtgcgacttgtgtcgaacaccgcagccgccacccgtagacgcgacctcagcaaccccacccacttcctctccgtgggcgcccgccgcgcgtcttgcccccagatccggcgcccaccccaggtaaaagccctcgcccgagctccgttgctcccgatgcgcgcgtgcagggagggatgggatcaggggaatgggattgggggtttggggcgggatggatcagttgaatcggctgcgctagtttggaactcgaacagcttgcagtaggataggtgggttgaatggtcgcaggtgttgcgcttttctgatgcggtttcgtttgctgctgctgctgtgtgaaggtagccggttgttgcttgcacgcgtggatcacttacagaaccatgcggcggtaggaacttgggcaagattccagatggttcgcttgtttggtgagctcttgtagcattgattgtgctccgttcgatttcattttggtgcaatccctagcactctaatttttcttgcttggaataaatggtgtaattattagactttatttcagttattaaacttacaatgatcgatagttatagttcagtacttcggttaccctgtttcactgtgctgttttgacttctgttatagcatgctgaaaactgaacttgccaaacaggcaattgatggggactttccttttttgagccagcaattataaacttataattattgatagcaaagttcagtattccagttactcaatttcatactgttcagaatactggctaaataagtcaattcatgttgttctagtcttgtgaggcttccttttctcctgttccaaactattgtcacggttttcctcccgatgtgcaaacattgctttgttttcacttaaatttatttgactcatcttgtatggttagttacattttaatatggcttaaaaccataacggatcattactgcagctttcttatgaggattaataatggga

SEQ ID NO: 5664 - DNA, 1501 bp, Oryza sativa
cttttatttcattgtgtttttagtagttctgtaggagcataaatatagagtagatgtaggaagccacaactattttgtgaaaactatcagtacactagtacaactttagctatgcaatttcatagaaactgcatcgatgataacatgatttaaacagaaagatgcaactttatatgtccaatatatttgagcccacacgccatacacatatgcaatactcgtgttgttgcatgtcgggtttattatgtcatacacacgtagaggatggagttacgattttcaaataaattattgtcattttccgtaatagctcgacaaagttgtaacaaattgttactttttagcctgtgttcagctgggctaggctgtggtagcagccagtttgaactaccgcagccgcagcggctacaacagtaagtgcctctgaataaagccttaatcatgagtaaattgcgttgatgacatacaaacttgttagataactatgatttagtacacatactagaaaaaccgtgtggcttcgccacgcatggtaaagtgaacctagctcattcgactttagtggagtaactaattagggcccctttacttgaaagaaaaatataggaacttttattctgtatagaaacgataaactttgctataggaattttttctatatgattctttgaaccaaaggattattgaaaactattgagtcttatcaaatttctaaggaatgcccaaattcatacaagttttggagtatttttaacatgaggttcaatatcatgcgaagtctcttatgagtttatctctctcatctaattcttgcatttttcatacggtccaatcaaacgattatttcatatatttttatgtgttttataattctttgttttgcgcttgattttttgtcagaattttatgttttccctattcatccctcaatcttcgtttcaaagtagccctcacaagacatatataggttgcattggaccgagggagaacagagaaagggacaattttgtttgtacaattgtacccctactttgatgtcaataccgattttaccctacattttagggttgttgttttttgccctatttttttcaataaatgaggcgtttacccctgtttttgatggaagtgagtgggattggacttagtgcggtaaagaattagagaaagaaagagataacgattttttaaattattgattgacccttttacccctagaaaatatccatgtaccgcttggtgtccctccaggcttgggcacttggcatcaactcttcccttcctgaacccgaatccccgttgtgaaacagtggcggcagtgtccgtgggccggccaggcaacggggacgacccgagcaagtgcaggccacctaacccagttgcagcgtgtaggaggaggctaggcattgtacaagaggccatggtagagaggaggacaatggcggctgctgtagctcagcgtagggaggaggtgcggctgctcgacgtgtcgaggaggcga

SEQ ID NO: 5665 - DNA, 1501 bp, Oryza sativa
gccgcgttggcgccgccggcggcgaggctcgccaccaggaccacgacgaggagcactgcggaagaggcggccggagctgacgccattgttgcttgctttcttctaatctttgtgttaatttgtatagcttgttaattaagagagctaggaatcgatcatgcgtatttatagatgggcatggtgttgaaaaatctacgattttgtctgaatattgtactgtgttgcaaaatctagatgtggagagaaacttcaaacaagcacgactgatcgagtcgccgatcgatctatttattttatttttgcacaagaaagatgaactacatctccagcacacgtactagctaccattattgccataattaaatctcattggctgagattttgccatgcaatatgcttggatatccaatattgttgaatcatacaaacacgtacaactcaagtcatcagttatatgtttgctgaattttcagatcgatcgggtgcttgaaagatgaaagtcaatgcttatatgcgtgattctcgccggcagaactactgatgtgagggttaaaaatattgaatagctctacaaatgctgtagagaaatcaattttatcaggcctgcagttgattgatgaataattctaaatgcatgcatgtaatatatttatcatttatttgatttaattagctcctgcatctgctatatattggactctacaacttagtaaaagttatgtggctttttacaaaatcgcatctaaatttcatgagctttttagagcaaaatatttgctccggttttacgtataaccacaaaggtacgatgaagacaacaaattcatgcatactgcatgccgtaacctagagttatggttatacagactttcgctaactatgaatgaatatttacaaatatatagacttcaataattgttgggtttatatcttgtgttggtggtactttagtcatgcgtgcatcgttgtttctgttttgttctctgaggatagtttgtgccctttgttgagcgaattttttaaattaaaaattggctgtagctactttttagcaaaggccgggatttattccattattaaaaaaacttaattagttttgttatttgtcagtatatatattgttggtcaccacacatattatttttctttttttagtcaataacctatacgtaccttggaacaactcaagtagcacgtacttctgcatgcgaagagatagtagtaagctactagtacgtacaagcgtacaacaaaaatatgagttaaccttatttaattagctttgacgctgattattattttttcttttatattgtcagggacccaaaagttaatttttattttaagttaaatcacttatttttcacattgattaagatcaattaataattaaccatgcatgtataagccgtacattctgagctagcagctagttgtaactaaaaaaaatatgtacgagaaagaatttattttactgtagaaattagagaaggttggtcaa

SEQ ID NO: 5666 - DNA, 1501 bp, Oryza sativa
cgagcagaaggcgcaacccgcggacagcggcgcggagctggaggtgtacaaccagggcatgttcaagacggagctgtgcaacaagtgggaggagacgggagactgcccctacggcgaccagtgccagttcgcgcacggcgtcaccgagctccgccccgtcatccgccaccctcgctacaagaccgcggtgtgccgcatggtgctcgccggcgacgtctgcccctacggccaccgttgccacttccgccactcgctcacccccgccgaacgcctcctcctccgatcctagctaaattaaggcagtgcgcggccagtcttttgcaccacctggatggtttattgctttcgcatgtatactatatacgattatacacacgaaaatgtacaaaaatacgaacatcgtaaataacacataagaggtacgtacagggtacaggaagccatatggtagagctagtagcaccgatattgtaatgtgaatatccacaaacaggattagtgttttcgtcagctcgatcgggttcagggacttcagattcgtcagtttgttcatattctgttcagaagacgtggtactataaggcccgtaaggacgtggattcgcaagtactacttcaaaagtgcaggtgtgaaatccccagaaagaaatgtggctgacgactgtcattttgttggtgtcatgaggctttttattaatggtatatagaggctctttgatagtttgatttcttcatactcgacccattgctgttactgcaattttccgttgaaatgaacagtgatttttgcggtatatacgtcggcatgttgctcacttgctcacagcaccgttcccttgtaaaaaaactgtgtaagaattagcgattctatactttgtgcatattgcctcatgacttaattttctgtttaaagtaacatattttaatatcttaattccaaatttgattgaggtggtgtgtgcgtgaccggccgcgagtggtagtggttgtggtggttagttggccaaggcactacgggatatcgccgtcaacaagtacaatcactcgaggtgattcttggcttagttctttctccaacttttccaattcacatccctcatgtttagcgtacgttttttaaactgctaaacgttatatttttttgcaaaaagttttcatatgaaagttgctttaaaaatcatattgattctttttttaaaaaatagctaatgcttaattaataatgcgctaatgagccgttccattttccgtgtgctaagaagcaacgttctctgttgttgggagctaatacatcaaacacgtaaaacggaacgacttattagcatataattaattaagtattagctaatttattttttaaaatagattaatatgattttctaaagcaacttgtatagaaattttttacaagaaacatgtcgtttaacaattttaaaaacgtacgcgcgaaaaatgagggatgtggttatgtgggtttttttattatttttatttttattttt

SEQ ID NO: 5667 - DNA, 1501 bp, Oryza sativa
aatcaatcgaatcgttattttacttttgcttctaattctagtttagtttatccatctttgtcgatttgcgccttaaatcgtctgccgccgctacgagagtgcgacacctttttgtaggtttgtcctaaaaaccttctgttttgcccacgagacgggtagttatttagaatcggctccgctagccggtttagttaccaaaacccatcttggtttagcttttgctagatttaggtggttggcaactctaggatcactgcaaggcgtttaggtgctgcgatcatgcttatcaacttgtcacaaaaagttgctaacaagtgtaaagctcgagcatatggtcgaaggatagctattgtctgcttcctcgagaagtaactcagcgagaatgaaggtagctctaggttccttttgacttctagcgggcttgggttgtcttgtcccctcttcttctacaagatcttgtatgtatacctctttgccctttgtccaagtatatattaactagggatgcgtcgtcgaacttagtacaatgtataaggtaacccatatatatttataactctaacatagacacacatatataattagtaatatatattggttcctacaggtgggtggattgaggataaactattggttcctacaggtttcgcacacacgaaaggagcacttacaatgttgggatggctagaactagccatccaatggtattaagataggagaacccaaatattttttttcaacccttcatttaatctaggtgaaatataagcaggttgagaggtcgaaactgggtctgctgggtgaaagcaatcaacccataccaaccgagttaggcacggttctcaaaggagcgcttactgtgagagaggtagggaagaaggacgattgtgcttttaagtactagagaaattcctccattctaaatagtgtttaattacaaattgtctgtcatccctgtctgaatttggggaagctggattcaaattcatacgtgtgaatatacctaggacctagttcaaatttgaaataaaacgcttcactgatgagaacatgattaatttgcaagagggaaatacagtacatacgcgtatatggatctgcaaaattagatagaaatgaaaagcccagcccacaaaggaagcgagatcacaatttctgggccgtcccagaaaggcaagtgtatcggccgataaacgaggcccatcaatcaatctgaccaattcagtcaagtcccaattcccaaataaattttcattcgacagtgtgatacgtataggagtatagaagatcgaatacatgaccgtatatatatactcctacgtaggaaccaagcgtatacgtacatgcatggccttcttccaaatgcagcaaccgtacgtggaaaatcgtctagtcgtggaaaccatggccgtcgatcgtccctcctcctataaataccttagccatggcgccacccattgccacattgcaagcagcagctagctagcagaagaagcaacca

SEQ ID NO: 5668 - DNA, 1501 bp, Oryza sativa
gagaggaaggcgagccgtcgtggacgaacagggagcagtcacgcgaagcgcttccgaaaaatattattgccgccttctcccggtgcaggacgtcgaaggcagaggttccggagacctgctctcccgattgccggttcacgccggcgagcgggatggagtagtctacgagcgacggcgcagtacagagtaggaggcaaactctagattgatttcgtgtctgttgcgtgaaggtggcgactcggtttatatagagataggtcgcttgatcagggcgcccgcatgatctccactccgcgtaaccgaaccggataagtcgcgcgtaacttattcggactccacaccgaaccggataagtcgcgcgtaacttattcggactccacgccgttttcacgcaccggatttttcgaaatgtttccaaaacaaaacaaatccgaatttcctacagcaaaacaaaactgcaaaagaaggctgcatctgcgcaagggtgaggagccaattttgcggaccattcgacgtgtacgtcgtgcacacacggccaagccaagcaagcgagcgagcgtgtgttccccctcttctctccaccacacatgcttcaagtggctaggaggcattcctcccttttaaggaggtccccctctcctagaataagcaaggtggtactaaactccacatgtatgccatctcatgaggtgggcttttgtgatttttcaaaaattaatctttgagtgggctttagcccatccattaattccaacaagttaattgttacactgatcggcatgcagacaaccactttgaatagagctcaatatccgcaggagaaacatacgcatcttcctcacctacagcttccaaaaagtcgcatatagcaacctgaaacttccagttctctccacttttgagcaaagctctgttttcaagcattgttcatagctttgtcgcaaaccttgctatgtgtttttttacaaaaattttctataggaaagttgctttaaaaatcatattaatctatttttgaaatttataatagttaatactcaattaattatacgctaatggctcaccttgttttacgtatcttcccaatccccttctctccaaactcagtcgggcacctctactacaaccgtatgttttttaagcaatttcatccaggttaacattggttggtacctttgaagaagacaaccaaaatatacgatgtgaattaaaataatgagtcaattatatattatagcactagaacatgattactcaagacacataccacaaatcttctaactttatcctcaatcaatgctctccgacatgaaaaatcaggaagctgcacatatctctcaaacctttgcctaaacaaaacaatagagttaatattaagaagtgcaatgcatacattgataaagaaacatttactattcgtacttacgagttgtaacattattaagtaaacatagtattgacttctgagaatgtttgaaagctactatcactgaatatgcgc

SEQ ID NO: 5669 - DNA, 1501 bp, Oryza sativa
cgtctcggtacggcgctcgttggagcctgtttggaggagacttttgcttcttttttttttcccattccatccctctgagctggatgttggcttgtacgcagggggcggattggggatcgtttgttcgatgccaagctatggtaggaaggagaaggaagaatggggattgaccattgcgtccgcaccggcgaccactgctgctccggctctgaggtacgtgccgtatgagcacctcgtcgatgtttattgggtccggggaattgctttccttaggtcgtggattacccaattacagaagagatcagggtttgacttggtcaacacaaactgcgtttgttgagtgttcactagtcacgttgtgctaattggaagtaggtgctgcaacctttctctgctactttaaccaaaagtcccatctgaagctgcaaaggctgctgattgggggttcaacaactgcagcttattgtaaaaggagaatcctgaatatccttctggtgatgtgctccaaccaaggtcccatgtggtcacagaacttaaagtttttttttcattatgaacacttccctttggaagtataggtatcttaatgttatcatgaaaacacagtaacaactctaaaatactggctttagtcatttagtatgagtaatgcttttgaaggaagtaaaatgtaaactagaagggatgaaattgatgaactattcaataaccatatagaatgggtatgctgcatgtggtgaatttgaagtacatggtatacgctagcaactgatcaattctcaaatttcctctaaacattgctatagatgcaaaaaaaaaaaacttttaaaagagtgactttgtaagtaatcacggtggccaaaagttcttgctctaccattttcagctgtcccaactagattaactcagtggattagttgtgtgagttgtgtttactttagtcatgcaatctgttgaacttcattgtatgcttttaagcaaggtggcatgtgtgcctatccttctaagctttgcatttcgatgtttaagggaaaattcatcattaccttctatattttgagtatcttctggactatatttgcatgcctcagaacaagatagaaagtgaattgattggaacttctcatagtattatgttctgtctctgtagtcagtcgaagtatttgctgttctgtttagtgcaatcatgacccattcttcaatcccctaatctgattgttttcaccatttttctgttgcaccttatgttttagtgttatggcatttctaatctgtagttcagtagtttatatttgagaaaaaaagcccagtaccttttgcaattaaattttctactaattagaccaaaaatttcaaggcgtgatagctagcatacttgctttccttacaggccacatagttatatttttaaatagtgcaatttcatccacatgattaatgatcctacagatcagcaaaactatattgctggcctttcttgaataatctcattattaaacac

SEQ ID NO: 5670 - DNA, 1501 bp, Oryza sativa
attttctgctggtatcggctaaatcgacttgctagattagattaatttagacatctaccatcttgaaaatcagtcaacggcttgattgtctagatattgtgtttcttttcatacttagtgctgcatcaatgcattttcgacctagtaagtcgtgtttagaaccatgatccatagcaagcttcttgatcactaataggggtagtatcggggttttagccgatcttacctaatatacatgtttctttcaggtggcaagcaagccatccatattgtattgagcactttgtgcttgactgcttgaagaaagaactgcattacgcatctaccctatccatcctataaaataacatcctactactagatatatcacatcctagtacaatgaatctgaatatgtctttatccagattcgttctattaagatatgtcgcgtccagttctagatttgttttttttaagatggatggagtagttgttgacggctgttaagtaccaagttaacaccgtcaatacctgcataaaaccacatatataaaacatccaacatagtggtaggatttatttctaacaatttccacgagtgttggtgtatatttgtacgcaggtgacgaaccaccaaagttgagacaaaagatacaaagaggaggtggtgaattaaacttccatattcaagcctatggagttttggacccacaaacctaatgaaacacattcaaatgggccaattgcaagtacatttgggctgaggggttctccaccaaagcccacgagaaaattcggagcaaaacgggccaacaagggtttggccgaaccacttggttcggtcgaacccgtagctgcgccgttcggccccaaacttcacaggccggcaattaccgacttgctatgacggtttctaccgactttacctgaataaccgtcattagctggacacatggcactaggaggatgaagatgctcattggatgcttggaggatctccactctctcaactcacctccacactataaatacccctctcctctccctcattcacacacaccaaagcatgagctgaattacaagaggctctagtgtattttattgtatattagaacagggagagagtaaagtaatggaagtcggaggaattccggagttatcggtaaccctctcttatctcttgtactttgtttattattctgctttaatagaaatatcattctgagtaattaaggtttacttagtgagaattacttcttggttagttcctaattagcatactggatcattgttcactatagtctatttatttatagtgattgctttagtgtttgatcggcactagagtagttattaattgcgtagacgcggtgtctgggtaattaatttccagtggttgctgcgtatcccacagtacgtttgaggtgggtgtagaggtggtgacagccctcaagagtacttaagtcctcactgtccggatacgtagtagagcgacatctgggaacagcgggttggcagt

SEQ ID NO: 5671 - DNA, 1501 bp, Oryza sativa
atgaaggtcaagtacaacggtcgcgaggaactgtgctacacagagccgcgtggccgctcccacatctccctcatcaccgcctgcaaagcctaccttcttcaccacacgccctcgacaacaatgcagacttcaagcataaacaaaaaaaaagagatggtgaaatgcagacttcaccacatgcatgtgcggcggctgcaacaataagagggccgcagcagagtacacggtggccgagttcgctgtgcacggcgacggtgatggtccctccacctccggccacctccgccgcccgcggcctgccgactccccctcccccccaccgctcccgccgccgacgacgccctccccttctttgcgtcgccgccaccggcagtcgaacctctcgtgacccgtgggtcgtggctccgcgcacgcccgccgctctgtcgtccgcagcccgccgccgcgctcgcccaccgccgctccgccggtgaagagaaaagtgaagaggagaagaagaaaagcgaagaggaggagaagaaaacatctatgaagctgacatatgggcctcatatattttttttaatttttttttctaactaggatgccacgtcggcgaaaccacccacgtatgttgtcatgggaccttaagtgcacggtttgtgtaagtttaggggtacatatttctgtttttgtggttaaaggatttaaaaaaatctgttgttaagttaagggaccttcgtgagcttattcccaggaaatatcaacccacaaatccgaggcctctccctctctccttcgctccaaggcctaggtcgatggaccggcccaacttcccaagctcactggcgctttttccctcagttgagtctacagtgcctcccgtatcccatttcaacttaccttttggcccacctgtcatagaataataaattgtgttcctctgtttacaattgacatctcaacatcatttttaaaaatttgagatttcaactttttttaaaaagaaaaaatggactgtttacattaagatttaaagttcttgcaagctgtcataaaaattaaaaatatttttaaactttggtaatgataatgatgttaaaaataaagttttagcttaaaatacaacttgtataaatagtaaaataaagagaaaaaaatattaaggtgcaaagtgaaccatttacaacttgtataaataccttttgttttttggtataatagtactccctccgtccctaaatgtttgacgccgttgacttttttaaacatgtttgaccgttcgtcttattcaaaaaatttaagtaattattaattcttttcctatcatttgattcattgttaaatataattttatatatacatatagttttacatattttacaagagtttttgaataagacgaacgatcaaacatatttaaaaaagccaacggcgtcaaacatttaagatgtttaaggacagagggagtagttggtttgaaagtttgggcgattatgtggagttactccattcagaaatt

SEQ ID NO: 5672 - DNA, 1501 bp, Oryza sativa
caggaataggccattcaagcacgaactttgttgagattttgtagtgaaaccactcgaattttacatacaaacaggatcctatgtccatgtctgacgtgaaatgttcaatcgctagcagtaatttcttggtagcgttagagtgtttcaaatgaagtgctatttttttttttacgtgccatggagcttattcatggcgcggtagcaatccaacagaatatgttagtcaagctaccaaacgatacggtagcctgaaggtaattgtctgagacaaaaaaaaactagtactgcctctatctaaaagtttaatacatatttcattttttagtttttaaataaattggacatatttactctgtgtgctgaattaaattgttagtcgaaatctaatgagttggcttaatactcatcggttacatgtatgtatatagttcgttggttttgtcacattgatgaatgagttaatttcttcttaattttgattataaaagaaatactccctccgtactcgtaaagaaagttgtttagtacaatgtttaagtcaaaccttaggaatataaatcatgaataactctcaaattgttgagtttgaaaatgtaaaaattatataaatagatttgtcttgaaaaatactttcaaaaaagaatacatatatcacttttaaataaatatttttataggaaaaagatgttaaagttgtgttttggagaccgtgtcgctgtccaaaacgacttcctttacgagtacggagggagtataccttaaacttttgggtagggtttgcgtgcgtgcgtccataggggtgagtgcgcgtgcgttgtgagtgtctgcgttgtactgtgtaattctcataaaaaatatttgtggagaaatggtgctaaatacttgtatgaggaaattacaccatggggctggaatatgcctcatgcgaatcataaactggatatttggatagctaacaagtgtaaggagaagtgttcagcctcaaattatttatttataaagcttagatatttttgtcacaggatgttattagtacacacctagtatatctgattgttaggactatacatttttgttcttgtgatgagactttggcttggagttgtcagtccactgattaaattgtacacaatatgtacctttccataggaaacgcaactgattgatcaattcaattgtatgtgttgtccttttcatgctacataatcgacatctcaaacaacttgatcgtagttctatcaaacaactaactaaaaaaagaaatcacacactctacatttgtgaaaaaatatcggcccggcgaaaacttttgtgaaaaaatatgtatatacatagtacacaataatttacctttccttgtcaattgtggcccattaccatcatttttttttctagttagacatttgcactttcccgtatgacataataatatgccaatttcttcgaaataacttcatcgcattttaattgtgccatatttttcttttacagatgtcccata

SEQ ID NO: 5673 - DNA, 1501 bp, Oryza sativa
gccttccatgggcttcgatgtgtgaagcccttatgcttgcatgttgcacttgcttaggaaacaacggtgacagtctcagcttccttggtacagaagcggtggcatgcatcgttgcaacgatcgacggcataattcgcttcttcattgctagaaactgaaaaggaaaacaaatgattcaatctatacattagctatatacaacaaagaatctttatttttttggttgaaaatcaatggtaatttaatatgatgttttttcttgcttacgagtgctcatggtgctgcacacagacgaagcacatcccagcttgcagaagtcaagtacctccgattcctctgcaaaatcatgtatatgcatgaataaatgcttgtaccaatagatattacaaaattaatagcccaaaagtttacacaaagagagttaatatgttttaatttgcctaggttagctggggtgaagggcgtggtgaatgcaagatagaaatatagataaggagagttaatgtttctaatttaccagcttcagggtgaagggtatggtgaacgtaaggaggcttgcaattcccatcaacaattttgcagccagaaagtttagcacaggtgtctcttgagccacccgcgaaacggcatgagttatagacgtttcttgctgtggtggatgggcaacaactctttgcttccacctggatcttctcttgttgcaggactaagcctagcactagcatacacatgatcaaactcttcactccttccatgttttctagcttgttttccaatgagatttagtcggggatcaacaaactaaagcaagagggctgaaaggctactgcttccttggtcttgtggttgtgcatctgattggagagtgcgacgcgtctatttatagttgaagccaacatcatgcccaagctgcacctgcatgatagagatgattatgttattttaattcacaatagttatattgatgatatgttctctgtatttgtttgtttagagaccaagctactttattgcatgacacatgtatatggatggcttggtacatgcttaactgctatcgtccagcgaaatatagaagaccgagtgtgtactgtgttctgtagactgcaactgatcccatttcatgcaaaacttttgctgcccatgtggtgaacgtgatgagaaatagaagcttaatcacatggcatcttctgccttactagcatctatagctagtagtactggcctggtagctaggtggctgttaaaaattttactaaaaaaaatgtcgctactacacattaggctaacctatgggtatagctgtttacaacacccaaattttagaatcgcatgtatccaatcgataatagtactgctgccagttaatgttgtatactagcagtgattatttcacacactagcaaatttaagtcgatggccacttgacagcaacaacacacgtggaggacatatcaaaagaaaacggcactaagctgttgtgaaaaaagaaacatataca

SEQ ID NO: 5674 - DNA, 1501 bp, Oryza sativa
aattatccaactaaaatgcgactgaatggtgggctgtggatgcatggttttgtgagtcgcacccatggcaattaaggaccggttcacgggaaaccctggaagacttacagtgctaccacaagcaggagtggataattgcttgatctgaagtatagctcgaccctttcctaggcaccagtggcgagggtgggcgtaatggagttgggtcggccggggtgtccggttgtccagctgccggattcaccgtggcgcatgaggggactgcccgctgacttgcgaggagtgggggtgaaaccttagcgtggtgtggatggttatgggagagttatatgaagggtcttgtcacaatcactcgacgtggtgacgtgttcgtcatgggcacatgatggcacggtgacatgccagtggattgtgtcttgtgggtatagttgtgcacctctggctagagtaaaactatttgaatagccgtgcccacggttatgggcgatcgaccagattcaccgtgattagtcccacacttaataaatcgacccaatgcactgtagttcaggtgggttggttgggcctgttcaacatggtgtagcgttgatcagtggagattcaatattactataattactcaactgttttaccagtttgctcaataaaatgttttacaactacctttatgcaaatagccacaagccattcttgaataaaatccccttgcacgtctgcatcagtttgctcaataaaatccccttgcacgtctgcatcattggtgtggcttgctgagtacggtggttgtactcagccttgcttttattccccccttttcagaagtgtagtgcttctgagctggagatgaagttagaagaccaaggctccgaccccagttgagttttgcctatggagtggagctaaagtcccgctaggatcacctttttccactgctgctgctttcttttcgatgtgaggactaagagcctcttctgtaagtatttacgctttatttacatttggaactgtttattacttgtcattttgtgtaccctggctgattcctggacagggatttaatacacaaaatagtctggaaatttgggctaaatttcggggcgtgacaaactagaggcccgattgagatatctaatgcccatcacagatgacactcttctttgacgggcttttattaaggcccgatagatattacttgtatgcccgtcacggttgattgttttagggccgttacagatatttgatgcacggtataaataccccccaccacctagtgtaactgtatcccactgttcactattttggtgggaggatgtagggggcgattttttgtcttttttccaaggaaaacacaaaatttccaaaagtgatcaaaatggagcaatcaagttagtaatattaatcattaattgagcaatttcatcatgtcttgcttttgcaatactgatcttataagatgtgcctctaatttatttttttttattttgtaattgatcacgtctta

SEQ ID NO: 5675 - DNA, 1501 bp, Oryza sativa
tgaggaaggtctgcgcctgcgcggcgagcagcatgtagaggcagaggagagggagcggcgccggggcgacccccgtgacggcgagccagatggggaggtagccgacggcgcagagggcggcgccggcgaggaggacgagccaggggcggcggcggccggcgggggcccatgcggcgaggaggccggagaggatgccggcgttggcgccgacgtccttgaagaaggcgaccttgtcgagggcggactggtcgtaggactgggaggccttgagcgccggggagtagacggcgaagcagtaggagctccccgcgaagcactggatgagcgcgctcgccgccagcgccgaccaccgggagcgcgaggccatcggcggcggccggagatggaattggttacgtggcgtggatgagtaggacacgtcgacacgcactccactcgcctccctcaccgtccgaatgtatcgtatcgtgtacagattcgttgaaccaagaggtaggacggagggagcatggagtattattagtctgaatgttcctgtaatatcggatgtttaaacattaattataaatattaaatatagattaataataaagttaattgtataaataactcacgagatatttttttagcctaattaatctataattagcacatgttttccatattatcacatatgctaattataaattaattatgctcagtagattcgtcttgcaaattaatctaaggttttagaatggctttatcattagtctatatttaatacttttaattagtattcaaatatccgatctgacaggaactaaaattttagtccctaatccaaacagcctagatacatggccccgtttgaatccacttaaaagagtgaagagtggatgaaattttggattaaagtagcacgcttttcaaagtgctaaacggtgcatttcgtgcgaaaattttctatatgaaagttgttctaaaatattagattaatccattttttaagtttgtaataattaaaactcaattaatcacacgttattactacctcgttttgcgtaaaacacttaatcttaatcttcatgagattcaaacaccaccacagtttatatttgcatctccatacaaaagatgcaaaaaccggcatgcagattggatgagttcacgcgaattgaagcagaactggtcaaacccacctctcaacatgtactattagcagtgtcagggttatgaataccacatacctaatagtagtcgactaaatctcggcaggacccaccacatatcatgtcttatacggaaacaaccttcggatataggaggagttccgcataaggaaggatgaatagagttctacatagaaacgacaaggactactcggattgtatccatattagtttccctagttctacttggacaaggggacatctatgggtataaatacaagaccccctatgaggaaaaggacacccacaatcaacatacacggaacaataggtcgagatagaagatcaac

SEQ ID NO: 5676 - DNA, 1501 bp, Oryza sativa
gggcggccgagagctgacaggacctggggaatcgattggaggcattagggagggaaatggatgatcggagcagcgaggaaacaatgccaaggacggtgaagagtggcggagcttaccgacgagagagggtgagggagctctagcaggtttctggctaaaagaggtggacgccgagctggccctcgctcccgtgaagccgaaggaggcggcgacatggtgcggagtcgaccggagaggcgacacagtgctgccggaggcgacaaacgcggcggcggccttcggtcgatggcgaaagaggtgtttccgtcagtagactgggcaaacgaggtggcggccggccttgctcttgcaaccgcgaagccaatggcgcaagcggcgagccgcggcgtcggttgaagcggtggtggtgggcggctggaggcggcgaattacggtggtggttcgggttggcaatggggtggtggttctggtgatggaatagggaaacggagctgaggccggggtgcggcaccacgcggtgaagctagcggtggcagtggcgcagcacggcgacggcgggagcggtggcggcacatggttggagggctccggagagcggcggcactcagttcagcgtggggaccacagtaggggcatggtgagctcgggaaataggggaaaaaggagggaggaggtcgagggcggcatttatagggtcggggagggcacgacagtggtggggagaggcggggcaccggcgacggggtgaagcactgacttcggcgaagtggcggtgcttcggcgccgattttgcgggaaggagtgggggaggagaggacggaaagtgggcgacgaggtcccacggtcgggtgcggccgcgcgaagtggaggaggtgggtagggtggcgcgggattggtggcgatgtggggtggatgccatggcggctggaggttggggatggggctgacaggtggggccacgggtccacctgtcggcgagggaaagagagaggagacgggagacggaggcaaaaaagactctaggggaaggaggccgagcgggacgagggagaggggccggcccaagaggagaagggaggagggaggcatggctgaagtggaaaaaggggaaaaggagggggattgggccgggagtggcccaaagacaaagaggggaaattttatttgttttctttttatttaattgattaaatgaaatccaaaaattagagggaaattccagagaatatatcagggcacaaagaatgttacaaaatatcctcggccatgatttttaaaggaaaatttttaattccctcaataatgtcacatgattaaattgctttaactttgatttaattcctaaaaaatgcattatttaatgatttttaatcctgaacaaaaatcggggcgttacactagagtacatggaacaggtaccactgatgttagaaaccgaaaagctttgtcatgacaaggctaatgtgtttggcaagcgcacatctactgcagtatgagtatc

SEQ ID NO: 5677 - DNA, 1501 bp, Oryza sativa
agatggggcccacacccacactggcaggagataaggccgagcccttctcccgccttctcctctctctctctctgcagcagcggtgggagaggtagcgacgcttcttctctctctgtgtctctctctctctgcggcagcggcgggagaggtagcgacgccctcccgtcaactagatcggggggaggggaggtgcagcggcggcggacgacatggaggcggcggcccggaccccccctccccccgccagatcgagcgagagaagaggtgtagcggtggtggcgggttggacctcgcctccgccagatccggtggcgtggaggcagcaagtttacactaacttcactcagacaatcacacaatagcatcatatatgaatagaaaccatctagaagtcatatccataaagcactgtagaaatcccacgaaaataatccgaaactaactcctacctggagtctgctaatctgaccgttgggcaacccggttagaccagtccaacaccactggtctgaccggcagtccccgcctagtctgaccagccaccaagagccgactaccgaaaacactattcaccgtattttcacaaagcactcacttttgacaattgttcatcaccacgattaaatcatcacatgattctacacatatctagagagaggaggcaagagaaggcaataatatatgttggtaaggacatagctacagtgacagaaagtgatgctgaactccatcggtatcgttagatttgtgctgatgtatatgtttcttttttcacaacagcttagtgccgttttcttttgatatgtcctccacgtgtgttgttgctgtcaagtggccatcgacttaaatttgctagtgtatgaaataatcactgctagtatacaacattaactggcagcagtactattatcgattggatacatccgattctaaaatttgggtgttgtaaacagctatacccataggttagcctaatgtgtagtagtgacattttttttagtaaaatttttaacagccacctagctaccaggccagtactactagctatagatgctactaaggcagaagatgtcatgtgattaagcttctatttctcatcacgttcaccacatgggcagcaaaagttttgcatgaaatgggatcagttgcagtcaacagaacacggtacacactcggtcttctatatttcgctggacgatagcaggtaagtatgtaccaagccatctatatacatgtgtcatgcaataaagtagcttggtctctaaacaaacaaatatagagaacatatcatcaatataactattgtgaattaaaataacataatcatctctatcatgcgggtgcagcttgggcatgatgttggcttcaactataaatagacgcgtcgcactctccaatcagatgcacaaccacaagaccaaggaagcagtagcctttcagccctcttgctttagtttgttgatccccgactaaatctcattggaaaacaagctagaaaaca

SEQ ID NO: 5678 - DNA, 1501 bp, Oryza sativa
cgccgcctaggtacggcccagtccaggccaattacgctttcgggcccaacatttcgctgaacgcaagtgacaactgctgggtcccagaatccatgcaccgaacgagccagccaatcacagcacaggaaaaccgaaccacgatccgcgtgacaccccacttctcgctctcccacccccagccaatcagaatccaggaaacccctccccacggatcgcgcccccacgatccgcgtgcgcgaggtcaaatcgcaatccaagccgtccactcccctccgatccaacggtccaaacccatcttccctcgtggaaaccgcgccgctccgcccaaaatttcccaaactcccgccctcctctcccctacttaaacacctcgcatcctctcgaattccccatctcatcccaatcccccaaatccacccgagcattcgaagcttgtagaagaagccctagcctctcctcctcatcaccgatggcccgcaccaagcagacggcgaggaagtccaccggcggcaaggcgccgaggaagcagctggcgacgaaggcggcgcgcaagtcggccccggccaccggcggcgtgaagaagccccaccgcttccgccccggcaccgtcgcgctccgggagatccgcaagtaccagaagagcaccgagctgctgatccgcaagctgccgttccagcgcctggtgcgggagatcgcgcaggacttcaagaccgacctccgcttccagagctccgccgtcgccgcgctgcaggaggcggccgaggcctacctcgtcgggctcttcgaggacaccaacctctgcgccatccacgccaagcgcgtcaccatcatgcccaaggacatccagctcgcccgccgcatccgtggcgagagggcctaggcgtgatctgctcgagaggctgtgataccctggtagttctagtggtggttcctgtgtctagtctgcacatgtagagatttgatggggttccttggttggtgtttgatctcagatctgtcatggcctagttggggtgttgcgtatgtaatttatctgtcttactcttatgtgatcccatggtgttggaatgaaatggaagtgaagaattctacttatcaccaaatccgaaaattctcctggagtttttgcttctggcatggctgatgatgttcttgttacgtttttagttttcctttttattaggaaatttccttcgaaattcatttgaattggccgctttccttttgtgcattttgctccaaatgcaaaggcgtccgtgtgtctgacaaggccgggcccactgtcattcactcagtcctgggagtgttgttattctcgtgcgcgttgtggttagtgggggtgcgaccgaatcccagcattagaagggaagggaagcttctttttcgtaccctattctctacgatcgccgccccccaagccaaatccacgcatcgacgcggcaggagcgggcggctgctgcgagatcggcggcgccgcagatctcgcgcccaccagcggaga

SEQ ID NO: 5679 - DNA, 1501 bp, Oryza sativa
gtgtcaaagggtggagatgtacttgatctttccattatcttaaaacacaaaggccaagacaggactttactaggaagttcaatatatacttagttcatggattagaaataatgatttttaaaaggaaatcttagcgtcaaactgttaagtaccgaccatgtcaaaaaaaaactagtgtaattttgttgcatactacatgatgtataagacataactcctattacataaacctgattgtttgtgaagtttttagacagttctctttgtctagtaatatgcactactatttcttctttgaaattggtatttctattgctgatcattttgctctgcaaaactaatgacatccacttaatttgtcacagatgtggatctccaaggccgaatacgatgaatctggtccaggcatcgtccacatgaagtgcttctaagtttgtgggcagatttgtaccattatcagctgattgagacgtgatctgcagattgtttgcatgcgtcccatggtttcagtagcacctgagggctgttggccatggggcaatgcggaaggtgaagtcaattggtgtactggaagaaatctgtccaggtagtgtgcagtgtaggtcgtctgagtcggtcagttttttcagacaatggcatcgcatcagggcattcctaatgtatgcaatggattgttgtgttgggtttcaccgggcaacaaggatgtttgcccgtgcagtttgaaagctttttgtttcgaattttctactagccgaattgcgggtcttaatgattgtacctctagttttgttttctctcttgaagataacttatttttgtgtacgtagtaaaggtttatttgtatttgaacgacttgtagtgttttggatgttatgctttcccccttgggactgagtagcttgtttaagctccctgagcgaaggcacgtatgcgaggatagtatcacctcgctgtttgggggtgaaaatgcacattttaacctctggtaaaccaaaaataccgtaaaaaatgatttgtgtgcgcattaacaacgccgcctaggtacggcccagtccaggccaattacgctttcgggcccaacatttcgctgaacgcaagtgacaactgctgggtcccagaatccatgcaccgaacgagccagccaatcacagcacaggaaaaccgaaccacgatccgcgtgacaccccacttctcgctctcccacccccagccaatcagaatccaggaaacccctccccacggatcgcgcccccacgatccgcgtgcgcgaggtcaaatcgcaatccaagccgtccactcccctccgatccaacggtccaaacccatcttccctcgtggaaaccgcgccgctccgcccaaaatttcccaaactcccgccctcctctcccctacttaaacacctcgcatcctctcgaattccccatctcatcccaatcccccaaatccacccgagcattcgaagcttgtagaagaagccctagcctctcctcctcatcaccga

SEQ ID NO: 5680 - DNA, 1501 bp, Oryza sativa
tttaagatgcttgcaacttccatgcaccgagctaaaagcacacaaagacaaaatacaaactcgaaacgagcccacggagttgcgtgtttaaaccgagttttctacgagccggagagggtctagggcgtctagctcgctgaaacccgcaaatgcaacggacgccaaaccgcactaaccatccatcattagagactggattaaacaaatggcaatcataatcctgcatgccggagcctccactagttgagcgcgaccggtcggctcatgggcgcgtgacacgtggctcccgtggcgccaccgcggcggtgacttgtcaatacgcgggtggtccgttccggccacgtaggacagggtggcgtccgacgtgtcaacttcctgtcggatcctggtttcgttttggcgcgcgtacgttttcttttgtttgcctgggctttctgggccggactgctaaaaaaacgtgcttatatcggcccatcatactaccgtctaaggaaaacgtattttaagattctttatggaatatttcaagatccttcggtgctagattatacacaaagtaataatttcatattttaaggtttttatagcatatagaagaataattctcgaagtaatttgaaatatgtaagaataattctcgaattaatttgaaatatgtattttcaaggcatcttatcaaagaggtgtatgtcaagtactccaacatttatagcgagtgatttctaatcaagaagccgtcaatgatcaattagcaagcgcctgatgttgtccagacaataatgcatccccggacgtgcctcatcggccgtgtcggccttatcgttgcggcacagcttgggacgcaccgaagttctacatattcaggacagttctaaaaaaaacatattcaggacacaaaattaaagcaatttaagctgatcaatcaatcaagcatacatgttcatacactcctcgtcgtgttgtgtgttctatcttgccatgcctacgcttttatgtacttgttttttcaaaatggaaaggaattgaagtactaaagcctgtttaaaataagaaaaagcgagaaaagggaattgcgaagtatatatagttatataagagatctgcagactagtggcaggcaagcagcacagcttaattatagttaactatgtttaattttcgtatagttgtttgcttgaattccttcagatttcgacctaaggagactgtaagagtatgtgtgagaaggcaacttgagcttatatactgttttatggcagttgctacttgctgttaagctaggttatccaaacagatcagccacgcacaatagttgatgtcgtcttgtatgcatgaccaacaccaacatccaatgccagatgcattcggggggtgaccagcagccctgtcatttgatcccatccactgagttcacaacgagcaatataatccaagcattactgcaagtggctataataataaggaaaaattggaatcataccattataattttacaaaattt

SEQ ID NO: 5681 - DNA, 1501 bp, Oryza sativa
ttctgcaagcaaccggatcgctgtcagcctatcaccgcctcaccggcgaaggctgacggggtcacgggagtaggttgcgcggtcggcttccaccgcacgccagcacgccccgtccaaaccagccggtggcccaccggccattaagaaaccgactccgacgtggccgttccggtttcggcaccgaaagtccgtccgtttccgttgccaacttgccaatacccaccgacccggcacgccagtccaggtcaggtcagacaccttcggcttggctggctcagtggttcgcccaggtcgcctgcctcgtgctctgccgtgccgtgacggtgccatgtcacgttcaaacggcgaggcaaaggggaggagggtagctgagcacacacgcggtccgtgcttctgcaggcgaaggtgacgccgcagaagactagtccaacggggcggcttccacgcataaaacggctccccttgctgcgctttccgtttcggctctcccatttgtctcgcgctcgctgtctcgcgtcagcggcggagctctctagaaggagcagaggagtcccccccaagcgatcgattcgatcccctccgccgccgatcgcctcgccgaagtctccgaggtgtaagcccgttcgatctctccctctccctctccatccttgtttcgatctgatccgtggaatcgcttcgctggatcgccggtagagcttcccgtgctttgttgtccgggtgatttttccggggaatttcgcgctgttttcgtggactgtttgtgttgacctcggcgtttggacgcttgcggttgatagctgtatcctctcatgactagcaagggaattcatggcgtttgtgtactgtatgttgtatagtctgatccttggtcgggttgtatgctgcagttgcagacagcagagcagttccaatatcacttctggagatgatctcaaactgcataatacctattctaatactttctatttcctttctaacaatccgctgcgcagctagttgtatgttacttcagtcgatacttgcatcatgcatccagaattccagacaaatagttgtatgttacttcatgttgtgttttttcctttgttaacatgaaacctctgatgtgtcacatcgtgattgtgtttacctttattgcgtagttttttttaaaagatccatactgccttactgaaatcaaagcgaactcaaatgaaaattctttcttattttgcatgatcatacattcagtcccaggtgccacttctaatggttagtcccatgttgtgttttttcctatacctgatcagttccctaatgatatgatctgtattttattggttgttcgttggcatgttgtaaatgtttagtgattgctacttcattttttttatcatgcactttatttgggcccaggagtaagctcggtggcacttaagcaaaacagtgcttaagttaatatgcacaataattgatttttgaatgcattctgaatactgatatttgttgcagaaacact

SEQ ID NO: 5682 - DNA, 1501 bp, Oryza sativa
tctcacattacttaaagtatctactattataaaaattaaaaatatttttgccggcactttggtaagtcatccatgtatgagtcgattttggaaatacaaaattaagtttgatcacttttgaaaatacatattgtttttaagtcgggtttaagttcgttcgtttttgaaaatatagaaagagtcgtataagaattctctttaaaaaaactctcatgctaacttaaaacgatcggacttttaattgcagcttatgaatttctaataaaatatatatctaagtgaacttctacagcgagtttcaccttaactagaccgtataagaacaataaaattaaaatagctttcacccgctgcaacgcacgtgtatttttttctagtaaaataaaaaatatgagaattcaaagcagataaggactctttcttttttttctttttagaaaaacaaggatggtagcccgcgtattcacgcgggcatgtatatcataagcatgtatttgaaaaacttaaggattgaaaatcaaccatataacacttgccaagctttagaagtacgttttcttcataaatttatttgctagctttgcttaaataatttttattaggtatttgttatcttcatactacgtaatatttaattcatctctataagtaattattattttcttcttcatcatttaaaaaggaggtagacttagtttatttagaaaatatgtctaaaagttcaaattaaaaatacgatgctttttctttttaaattgaatgttttgggacttttttttaacaaatcttaaaaaatattattgttaataatggaccattaagctagccctccttttaattggttcatattaacataatttgttatacatatatttatatatggatcaataaagatagattagatatatgtatatatcgtgatcttgcttccaggagacgtgcacatgtacgtctgacattaggaggagaggagttttgcttcctttgagatagattcaatggtttcaccaacttgagttatctatatttacaaacataataatgacccaacccaaagttatgtacttattaaatatctattttctaattaaaattgtttattattgcatattgttctattaaaatatatgtgttgttaaatagattgttaaaatatctatatgattttccgtataaatgtgttttatttcttttactaaatatagttagtttgggtcttgaactataaattttgtggtaaataatctaatgatctaatgatgtattatgtattttctacataatatagcatgaagaggagtaaggaaaggatatacttggcatacatacgtgcacacaacgtgcactggtgatacacaatacggatttaaagtgggtccactctatggttttcctttttaagaattattagatattccttaaatttattaaaacgctatgtggcgacttagaagcatttataggagttatacatggcggcttgagagcgtttgtaggaagt

SEQ ID NO: 5683 - DNA, 1501 bp, Oryza sativa
gccgccgctattcaccgcgccgccacgtcacggctgccaccgccactgacacgccgttgagaaggaagagaggaggaaggagaaagaggaagaaagaagaagaagagaaaaggtgcagtttggtataatttttctagaaatacattcaagggtaaatagtggtatcttttgaatatgtgtgaaattataatggcatatttccaaatacatgaatactagtggcacattttaaaaccggtaaatttttaatggcatatatccaattaacgctatatataataatatttaataatgaggttcatttgaaacctgttaggactaaagaagttactccttgattcatcgtaattacaatatactccctccatccctaaatatttgacgccattgacttttttaaacatgtttgaccgttcgtcttattcaaaaaatttaagtaattattaattcttttcctatcatgtgattctttgttaaatatacttttatatatacatatagttttacatatttcacaaaaaattttgaataagacgaatgattaaacacgtttaaaaaaatcaacggcgtcaggagggagcattacagttcgtatcaaagattatcaaccgtctaggccgacggcaacaacaagttgctccctcacctgtattgtatgctgagtctgaatctgacacctggaaaatacaactctaagttttttctttgcaaccggccggttttctatatatattggacacaaatacgtttggcagtactattccaactccgcatgcagtactatctcggcccatatgtatatataggaatatactaggacacaaaaacaacaatctacacacaaattgatcgatggagatgacggcagcaatggagggtgcagcagccggcggtagttcggcggcggggttcagcttgtcggcggtggcgagccttctcttcctcttctctatgcttcaagagcacatccccttccaactccaggactgcctcgccgcactggccgcccgcctccacgccctcctctccccctacgtcaccgttgttggagttaatttatttctagaacataccagcctactctctaactctctctactactcatgaaataaaagtcaaggagcaagtccttcctctgtgaaatttctagagtagtgtagacaataatatgttctttgtgagttctagtattttcatgcatgtaccagtactagttgtgttcaaaaaagttcctagccatcctataaataggcagctatgtcctagatgtgatgctgctgtccaacaatcaatgtaacgtgcaatacttgagcaaagcataaccagtttgtgaaacaaacacagagcttctctcctctgttctccttctctgttccattgctagcaaaataatcaacaacaacaactggtatcagagcgctcaggttcgagtagggcgtgacggagtagcacggcgtatcggtattgtcaattgaagctacaagtatggcttcaagttcgg

SEQ ID NO: 5684 - DNA, 1501 bp, Oryza sativa
aagcattaacaatagagtttgctacaatgtcataagtatagtagggtatcaaacttaactgccaaaaatgcaaatgctacaacactctcctttgagcatacctcccactaaaatggctgagttgaggtgaccccaatatacgaatacaattctccatgaggttgtgatagtaaattagactaaaatcgacgagggactcatctttcaactcaacagagaaaaaaagtcttggtggctatgatcggcttcacccgttagagggcattcatgtttatctttaacggtgttatttcattaattggtataagtggtatttttaaaatatttatatatggattcggaataagtgaaacatgaacacttagataagtagatattttagtgtatcaatgatgtattaggcttattttattggtacatatccagttttatctatttatagatacacaacttttaaaatagtaataataagttctggtgacgataggagaatttataagtaatcgggacagactgattttcttttaatcttggagacattcttatcatttactaagtatattaaaatcagtttatcttacagcataaaaaagatgagacatgacatcttttagcattatttcataaatcataaaacaataaataagatgcccgcgcatctgcgcgggcttccttcctagttatattgcattatatttctgcagcacattaaaaatatatgtagttgggcacaccaaacgaaaacataactcggtcaaatctgttctactgatctttttggtcatcagaacatttgcattatatttctgaaacttggtcaatattatgtgtatacgtacttttcaaggtcaaacactcgtgcatataaagtatattcccttcatcctaaaataagataagtattattttacatatactttaaacattaatttgttttataatatattataaatgactataaaatcaatatcatataaaaatactttcaaatatatagaaatctaataatcacatgtgcatgatatactaaatatactaaagtacttttagttcaattactagttgaaattttcaaatgttgattttacttgaaataaaggatatcttatattaatttttagttatatttgtctttcatgcacccaatctgattattcaggggaagctgagctaaataatagtacattattcaatttagttgtgtgcatctagcttactgaatccgtatagcaactctttcaaatgtaaaaataatattagttactgctgcaatgctattcatgtatgaagttccagtatattctctcttcatctagatttctcaacagttattaagaaataatctagactttttcagcagcatggcatgtgccattttgcatcttatctataaatacgcatgccccttcctagtcaatccacacacatcgatcgatatatcctaagaggcagtttaagctagctagctacgacttcgagagatcgatatattcaacaatgg

SEQ ID NO: 5685 - DNA, 1501 bp, Oryza sativa
gattcagtacaccgaaggtcccagaacttgtcatcgagttaaaaaatgtcctcaaatccggcgtcccttaactaatcaaaaccggtcacaatagtttctttcgtggttttgaccctggttttgtccgacatggcggctgagtcagcgtaggacccacgtgagccccacatttcaggatgtcacgtcatctctctgtttcccctcttctctcccttcctcctctctctctatcactcttctctcgtaggccggccgacgggtggggaggagaccgacggggtgtatcgggagaggaggtccgatggctggcaacgcggcggcggcggtggcgatgcggagcatcctgtctttcccctttctttttcctcttcttttttttcttctctttgacgcgggggagtagcaacgggcggcagcgagcagggttgagcggcgcccgacggaggcggcgtgtgagggcacgacggccggtggagtagagcggcggcaagtgagtgtgtggcagagggcggtggcggtaggcgggcgagcatggggcggctgatggaacggcacggcggcggtctgtggccagggggaggagctgggagagggtggcagccaccgagccaccgcctcctttgcgcccctgccttcgagctcctcaccgacgatcgcggccaccccacctcctccctttccacgcagtggagctcgccgacaatggaggatttggacttgggaggagctcgtcgacctccccgcatgtccgccgatcccgcctccgcgtgtctcactcgctcgctggcctctgccgtaggcctcggagccgccgtgtttcccgctgcagccgccgccaccgcccgccgccgtcgcggtgctaccctcctcctctcccgcggcagagaagactgagagagagaggaagggagagagatgacgtggcatcctgacatgtggggcccacgtgggttccacgctgactcagccgccacgtcggataaaactggagtcaaaaccaccgaaagacctattgtgaccggttttgattagttaaggaacgccgtatatctggtattgcagtttgaggacgttttttaattcgatgacaagatcagggaccttcggtttactttttccttctaaatatctcctcatcccccaccccacttcaattcgggtgtgtttagttccacgctaaaattggaagtttgactaaaattggaagtttaaagaaaaaatttaaaaatttatgtgtgtagaaaagttttgatatgatggataagttggaagtttgaagaaaaagttagaatctatagggggctcggatgtacaaattcgtttccatgacaaattcaaatcaaatccagcccataaggccttttctcttttcttttcttgtcttacaagtaggtctctctccttaacctcacccgattcacacctctcccctcacttctcccccctcaaatccccaaatctaaccggagaaaaccccaatctctcgccgccgccgccgtga

SEQ ID NO: 5686 - DNA, 458 bp, Oryza sativa
gtagtcattaatggactataacctttttcgttcataaaagcaaacctacatatatatctaactgtgctcttttagataaagagccttgctgccacatgtgcctaaccaaactagattatcaacaataagtatcatgtgcctaacaaaactggattatatcaaccaataagtgtcatgtatctaacagaatatatgcagaactcagatagcatctcatcgccacggacatgagaaactgagaatctctgcagaatgcgccttcgcatttgcatgagaacaacaacacaatcatcttccccagccccccaaaatcaccccccacgagcaaatgcatcaatcccctagcgcaactctgacatcatctgacgccgccgagagggggacagcatgagcggagaccggcaaaaccgagcgagcgcatagaatttgagcttacggccctggtacatgtccacagg

SEQ ID NO: 5687 - DNA, 1501 bp, Oryza sativa
tttactacagtatctgctgtccttctttcgcagtgacagaaataattgagagacactaattgctcatctccctccttaattaggattgtcccctgccaccacattcgtatatgtcagatgttctataccctgtcgtatgtacgtccgcctaaacaagggtccgcctaaccttttaatttttcgttttcacttttgtttgtgcgccatgctctattgaaatttagcatatgttacggtcgtaaatatatggtgttcagattgtagctaaaataaaccttaccaaaataattttagcaggatttcttatgtatttatcaatttaacaacaagctaaacgtaactattcttttagcaactttaccatggttaaaaatgacaccgaagtaaacagcccctttatcatttgagacatcgatcagtgttttggagtttcttccttccaacattgcaatgtcttaacagatcagtggtgtactagtacaaaactccaagtcgcggtttacaacaaaagaaaaaaaatagacgtttaaccctttttctttaccacaaggaatactccatccatctcataataagtttattttgtaacggagtttataaaaatagagaataattgtatttggtgtagataaagtgctgaaacagttacattgggattttacaaagtagagatattctatttattttaattttgtattggtagatataaaacgagtgaaaaataaatttattttggaacgggtggtatcttgcaagcatcgggctgccggaaccaggccggcccgagctcagcgaggccgagaaagcaatcgaacacggccaatcctcccctttcccctcgcacaccacaccgcggcaccgcgcgcgtcaccggcctcgctcgcggcgcgtcacgctgctcgtgcgtgcggccaccactaccaccgccgcgatcgctttcgcgcgcacacacacgcaacgcaccaagagtccgagactgcgcgacagggcgagcgaggggggaaaatggcgtgatctgcagcaaaacgagaggggaaaacgcaggaaaacgagcgggcgacgcaggattctgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcagatgacataacctaatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaatcca

SEQ ID NO: 5688 - DNA, 1501 bp, Oryza sativa
catataattagttaggtacgtaataatggattgtgaaataaagttaaatttgagttgttttgttgctaggtataggtatgaatcgaatacttataactaggtatatactcacaatttgaaaattttgaaaaatttaggcgaatttgtgtatttcataccatggtgcccgggcaccatggtgccccatatgagtgtcctatatatatatatatgtatacatatatatatatgtatacatatctatatatgtgtatatatgtgtatatatatgtgtatatatgtgtgtgtgtgtatatatatatgtatatatatgtatatatatgtatatatatgtatgtatgtatgtatgtatgtatgtatgtatgtatgtataagtggagagcgattctaacggaaatgtgaacggagcgttaaatatgagctatcttttgatgctattaaagtaaaccgtgaatgttcggtgctaaaatataaaaataggacggtgctaaaaaataaaaatgggaactttccatgctacgtaaccaattttgccgttatatggcttcagagatgaccacgtttgtagcatattgattgaaaacccgttcccatgcaatgtggcactcacattaattgtaatcttcatatttttctcccaaaggaattggctagcttgtactccagcatggattatgcatgtgttcacactgtgattgagattatacatgtagacatattaaacatgcccttcccaaagtgtgcatctcttgtgctgacactacagtcctattatacagtataggcacctagctgatcattagttttgatcacagaatacgaatttaacgcagagtggattaattagcctcagtttacgattagagtaaaggtttggtaggggagcaggtaatggattgattgcagggttgggatttgaccaggttaaacctcacgcaaacggcagatgcttgcatcgatgaagtccatcgtcagatatatatcgttaagatcagacattagtccaaaatatagcagataatctgtctaaatggacgtgatgccgtttttatgaacagattaagctagccacaaaggaagatattaaggtcaactatgtatcacaacagtaaaaaaggtttgtggaatgaggtgagaaaaatgttgcttctaaggaagaagctagtaaaccttcacaattcgcaagttgataaaacaaaattttgctttgttgttttggataagatttgttatgtctgcatgcttatatatccagcactataaataggaggcgctcactggttgcaaccatagcagtacaactagtcacagatacatagtaggacagaggctacaaattaaaatggttagctaattattaagtagcactcttataccttttttctttaatatttttttttattttctgaaatgctgcgtgttttaattgcatcgttaagatttgcctctgaacatgcacactattgcatatgtgtcataatcattgatgtgttttatttgc

SEQ ID NO: 5689 - DNA, 1501 bp, Oryza sativa
acccagatcatgcagtccggagcgtgctaccagcccagcaccatcggcggcgggggcgaaatcctccggcgcagacgcgagcagacggcgcacgacggggccgagcggacggcgcgcggtggggccgagatgttggcggcgatggcggggtggtcgacgaggaggacgacgactgaggaggcgggtccgggagccaacgctgtcgtcgtcgggcccagcagctgcaagcaacgccctcgtcatcgggccctcgccgccgcgcccttgccgccgaacgccgccgtcgctagcaccgagaagaagaaaggaggagagagatgttagagggagaggatgactaggctgccatatgtacgccacgtcagcgaaaaccacccttaaaataaccgagagagttattttagacgattttaataattcgagaaatcatcatatctggttttgtgatttagggatacgagtcagattggacgtatatttaagagagtcaaattagactttttcccttctttaattaacaattgagtttgacaatcgaaataaattaaatgcactgacatatgccctctccatatagtttttctttcaggccccttttttttcagggagttctttaacagttactgttaacaatctctaacaacttctccaatcgaaataaattaaattcacttacatgtagacatattaaacatgcccttcccaaagtgtgcatctcttgtgctgacactacagtcctattatacagtataggcacctagctgatcattagttttgatcacagaatacgaatttaacgcagagtggattaattagcctcagtttacgattagagtaaaggtttggtaggggagcaggtaatggattgattgcagggttgggatttgaccaggataaacctcacgcaaacggcagatgcttgcatcgatgaagtccatcgtcagatatatatcgttaagatcagacattagtccaaaatatagcagataatctgtctaaatggacgtgatgctgtttttatgaacagattaagctagccacaaaggaagatattaaggtcaactatgtatcacagcagttaagaagttgtgggagaggtgagaaaaatgttgcttctaaggaagaattaaatcttcacaattcgcaagttgataaacagatttttgctttgttgttttggataatatttgttatatgaatgcatgcttatccagcactataaataggtggctctgcatggttgcctacccgcacagaaccatagcagagcagtactacaagtagtcacacatacatagggcacataggatatacaaatcaaaatggtgggctaattattcctctcatttgcttcaatatatatttgttattttctgaaatgcatgcatggatgcatgttttaattgcattgttaagatttgcctctggacgtgtacactattttatataggatttttaattaatttttatctgtcattatcattgatgtgttcatttgcag

SEQ ID NO: 5690 - DNA, 1501 bp, Oryza sativa
gcggaggcagtatccctgcatagatggttcacccctgagtgaggcaggtgcgctacaatgggacagccgttgaggtagggccgagaggcgtgccctacatcggtgtcaccattggtaggactgccatgagtgtgtgagagagagaacttaacttgaaccataatttaatatgcgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattgcacttggctagactccaaattcttaacttgtgggggatgggatattgcatgatgaattttatgctgatggagccacatcccgagaggagggaaggtggacatcctcagaaaaccatgacgattcaatggcgggaagctatccttgggatcacaatggatggtggacagaaccgtcgttgtttaaagtgaacactggtactaaaatttgatcagtctatgctaggtcttaggcttatgaaaagaattgaaaaattagctttatgcaaaagaacctgaagcctttccttgaaataccttctatcatacgcattgttgttgtggtggcttgctgagtacggttggtactcacccttgctatttatatatcttttaggagagtgttgaagagaagcccttgtcggtacgcttgcgtatcccacaagatgattggagtgcggtcttgttctaggtctcgttccccagtcgactgcctgtggcatgttaaccgggcccttatattattttgtcttccgctgttgttctctgatagttgttggcctacctggccctaatgtaagtgtttaactcttttagcctaaattcattcgtgatatgttgtgatccaactatgtatgtgtgtaccaactactgatccagggattggtacagataaacacagaagatttccgatttccaaaatcgggggtcgacatgtagcgacgggctatggggtctagttccagttctccctttcctcttgtgctataacaaaaagagtatgtcatgtttgaagtttgaagctaagtcttctagtagcttttctttcttgtgttttatgttttcctctatagggggtttagagtctaagaacccatgtatgttttagctatgtatatccttcatggatatagaggccggattaatgaaaatccattatctaaaaaaatatggggcatttgcaaatttgctaccggttttttcaatattgcaaggatgccattcgaatgacagttctagtggtatttttgcaattttctagtggcagttttgcaataacgattcaaagtagtggtaa

SEQ ID NO: 5691 - DNA, 1501 bp, Oryza sativa
ttcaccacacttgctaccaatctctaatctccagtttgcatagttgaatactgtatcactagcaggttaacactgtatctatttgtactatgcaaatacaagaacagtgtgaagtttaacattttttatgattatttcaccacacttagttactaccaatctccaatctccaattccttagcattgtgtttatctgcacaatgcaaatacaagagactctgaacaatgtgaggtctgaacactctgaaccactgaaagcaatatactactatgctctcttatgcctctcttaatctatctttttagtcttaaagaaaactcgcttttactaccaatctctaatatccaattccataattgatcccccaaattaacactgtatttataatatgcaaatgctctctcgaagaatacgcatcaccgaacagtctgaagcctgaaccactagcatataacctcctgttatctgaaaaagacaccatttttaccatattctcttacaagaaaagcaaaaaagaaaacatctttttttttaaaaaaaaagacatttttcttttaccacatttatagcgacgtggatctgatcaccgtaaaaaaagatattttcttttaccacatttacagcgacgtggatccgatcgtcgtgtaggctcccacttctatccggccaataggttttacaaaatcgtacggttatcacacgcttatcgtggttatcacatacggtaaccttatccgtttttgaaatcacaatatatctcataataatcacacggttttcacggtaaccctgtgattcgcggagaagcgaataataatccggcgatccaccgggagaaaaagcagctcagcctcagcaccgcacatattctcttctcccatcccgcagccgcagctgcagccgcaacggttgcccgttggttggttggttggctcgcctccactccaatccgcgcaggcagcgacaactcgctgggggtgacggcgaccactcctccacacctgcgcgcgcgcagaaaagctactactactactaccgcctttccaccaccaccgacgccgtcatcatgacggcggcgacgacgacgatccacaccggcagccgcactggtggtggccgcggtggtggtgacgccccactgccactcactgatccacccggccgcgcgcgagctaagctaagctagtagctagctgcctagctcggctccactcgctttctgatcttgcttcgcctacttgtctactcccacgcacgcacgcacgcaccagcgctgtccctcctaattctcttctcctccctttcgctttcgcttttttgggcgcacttatctattggggtttggacggcgacggggcaaagaagaagaagcccaagaaccggtcatctcgagctctcgatggattcagcgccggtaggactcgaggctagttagctagcagcagcaagaagcggttctttgtttgtttttagctccgattttgggcctgcaagaagaga

SEQ ID NO: 5692 - DNA, 1501 bp, Oryza sativa
aagctaaaccctaataatctaggaaaatttttaacataaaaacaagctagataaaattttattaaatactttgcttgtttctctattttctagaattttctgggaattatttgagcaagggaagtatttttaataattggaacaacatttcacaaattattttaattaaaaagttccaaaatcccttccttaagttgttgggccgtttttggcccaactctctctctctctcgcccgcggccaagtcggcccagccggcccagccaacccgccagccgccccctccactcgggagaccgacatgtggtccccacatgtcggacgcttccctaacctctagcagccggccggccgagcccacccatgccgcccgagccgccccctttcccctccgaatccgccccaatctctcctcttttcttccggatttttgaggggtttttatcctctcatcctcctctatctttacccccaaaaatcggagcaaatcgttgagtattttatccgaatcgaactcgtttttgagtttatctccaaaaccgagtttttgatttcccgagctgatttcttgcgggaggagtccgatctcttcaatccaaggctataaataggaccccctagtcctcctctttcgtttgccccaactcccaagccttcccgtgctccgtagcctcgtcgccaccgccgctttgctcgccgtcgccgccggctatctccggcgccgtcgcgcagccgcgttcgccatcgccgtcggtcgccgtcactgtcgtgggcttcgccaagccgtggggaagctcggccaccctctcctttccgccgccgaccgccgtagctcgccgccggcgaggtccgagccgccgccgccatctcctctcgtcgccggccgtcgtcggtggtcgttagacgtgttggtgagcaccgttgcgttcgtcttgtcgtcctctacgtgtacatgtgctccaaaaccgcagccgaccatccaatctccggcgaggttgccaacctgggccggccattgatgatgtcatcatgacgtcatcatcggtttttctttttccctttttctaatagattaaatcttcgaaaaatcataactaaataaccgtagatccgtttcaggtggttcaagttgctaaagttttctaaaatcaagatctacatgttaaaaatatccacatgtactgtttatgcttgtttttgtactgttttattgattttagcattttttctttagtttccgacgttccggaggagagcgtttctgtcgaggaaggttccgaagcgtttgcggaagcccaaggcaagtcacacagatcccaaacaaccctttgagcatgttgaacccatttaaagctattattttatttcaactatgcattgttttcgaatatcatcgggtggtgaaccttttcccgtataagtaatggccgaagatgactttattttcctatgggttataatttgattagcatgaaccttatatattggattggttcagcta

SEQ ID NO: 5693 - DNA, 1501 bp, Oryza sativa
aaaatcattaaattgagaagaaatggataaaatggcattacaacatgttgcccctgtttgaggatggcattttaacgaaaccacttttgggagtggcattcgagcgaaaccccgttttgacaatggcaaaatgtcaattttctcatgacaaaacccttttcacttgagttctgcagaaccagtggcagcagcagccggcggcgagccatggcaagaagccagcaagccgctccgccgcctcacctccgtcgtcctcgccgcgccgccgcctgccgtcctatggtacgtagcctcctcgcgcgcctcgaaccccctcgtacgtcacgacggctgtgccctcgctgcagggaggcccccccccacccgttcggcgaaatgcgcagctggagcgctttgcctcggcttgtactctggcgtcgatgccatgattatgtcggtctccatgggtgatgcattcccggccctgggatcctacccgcaaaagagctgctgtcccgcggtgggtaattggtttattctggttatcgagtacaaattcgattagctggtggtaatgatttgtttgtttctttccatgatgcagaggccccgctcgatttcgttcttgcccctgccagaaggaaaagcactgggaggggaataagtgcacatcaatggggattttctctggctggaaagcaagcaaggtatggaatccaacatcgatgcttgcacaacatgtcttttttgctttgctgatgtctcaagaaacggatcaaatttttttccatgtcagatagcagaaggcactcacatagcttgctaccttctgcagcactataaatacgttgttgctatcttccacaccactacacacaaatagcttacagcccttgtctgcgaacaagaaaaatggccgttgtcctagatgcttttgcgtcctacgtcagcgacctgctcttgcaggtggccaaagatgaggtgggcatgctacttggtgtctccgacgagatcaccaagctagatgaaaagcttcaatttctcaaggactaccttgctgatgctgaaaagaagcgcatcaccgacaagcatgttgacgggtgggtgaggaagctgaagggcatcatgtatgacgccactgacatcctagagctctgccagcttaaggccatggagcagggttcttcagttgacttgggctgttgcaaccccttgctgttctgcctacggaatccattgttcgcgcatgacattggcagccgtatcaagaagctcaaccagagccttgatagcatatgcaagacaggtgccgagtttagcttcatgaagctggaagcctatcaagatcgaaggactgcctctccgctcatcagtcgtacaacatcaccggtgttggagcggtcaggtgtggttggtgatcagatcgaagaggatacatcagcattggtgaagttgctaactgatgacaaggagaccattcatgcggagaacaatagcctgttgttagccatagtgggtgttg

SEQ ID NO: 5694 - DNA, 1501 bp, Oryza sativa
agataacacgattagacccccagcaaccagttgatggtaagatgaagcatgagaattggatgatcatcaagaaatgaatgcatcaaattaaatgaaagagagcgaaccacctgaggctgttggtcttccagttcctcttcctgttgaaacagctgcagctggagctgttcttccttctgcttctggaagagcgcctcctgcatgtcctcaactgtgggttcagcctcagcaggtacctcatgcatctctacgattggcatgctatttttgattggtgtgtcctccattgctccatccaattgctgcattacaaaatatgcacgttcttagttgactggatagataggaacagaaaacaccaaacacacacttttcagtttagagctacaaatcaaattgtgttagaacccaattcaaagagggaagacgtcatattaaatcatacggtgtgtttggctctttgccaaactcaaccataccaaaatattggtgctgccaaaaattttgtaacttattgggtttgtacccaaaattttggcgttgccagttttttggtttgattgattttggcaaagtccatggaggaatactctatggtagcaaccaaacactagcctagccactcttgccaaaaattttggtaagcaatccaaggctaaacttgttatgtgatttatcctgtgattttttttggacgaagggcatactaatatactactcctagtcctagttttagtgttgtctatacagagaccgttgccgtatcactctcgagatagaacagtagtactactatgcatcaagcatcatgccgctagcatctcctatgttcatagttgaaagaatcgcacaaccaacaccatgtacaaagaccttccattcatctactctacaaccaaacaagaaaccacaaccgccaccatgtgttcttcatctagttcttcatcctcgtcctctgatattcatcttctagcgaggacgaatggtacccatgtgtgatatcgaggccttgtcgatgatttcaatcccgaacgaaaattggggcgtgacaccatacctaccttcccaaataaacaaaaccacaaaaggatagtgatctacttgctaaaattatattgaccaaatctctcatgttgcagcggcggcaatggcgaaaactgaggatgtgtgtgaattgtgatcaccctcgccatagatacatgtagaaggatagtaagccaagccgatgcaaaaatggcaagatatggtcagaaaaactcaaatagaaatggagaaggtagaaaaaaggctggcgatgataaagctaataatgtgtgagattgaggttggatgatggggatggcggaggtggtggcaacaatggtagtggcggtggatggacagaaaatgatgatggatgaagaattatttagggttgcacaagcaactatttatatgtaaaatattagtaagacgttaacccccaataaagcatgtgccacctgatttccatcagtgacca

SEQ ID NO: 5695 - DNA, 1501 bp, Oryza sativa
acgtcatatcaaatcgtaatgattagttctcaaattatcaaataaggcacttcacactgagaactagatgtctttggcagcagtgggtgactgaaaaactaagggtgggtctggaaaatgaagagcctgaacgatctatgtttgcaagttgcaacagagaaaggggcatgttctgagaacaaaaaaatggcagcagcaggtgcagctatgaagcaattttttttttaaaaaaatacagatcaagctcatcgaggcccagaattcgaagtgaaattcatgatgttcaataactaggagacctcaaatcatctactaaaacttggtcactgtaataatgattgaatcaagggttaattggatccatgccactacaaatatgttgattcagaaaaataccactacaattcgtctagtcgtagccgtgccactgaaattttacaaatttggaacggtgccactgccttcacgttttacatccatctcttcttattttccattttcttccttcgttctcccgtcttcttcctgcactgacgagccgcgagtggcggtgggacctacgagcgacggcgggacctcggcggttcggtggtggcggtggcaaaaagggaaggggaaagggtaggagagaatctatccctctcaccagatctggatggagttgaggcgaggcgacaccaccggcgatggagctccgcgtggaccccatggcctcagccgattgcccttcttccctaccctcgtcgttccatctccaagctcaaatcccaaaaccctacccatggctacctcttccaccagctcctcctcggcccctgccgtggtggctgcggcggctgaggccatcgacgggccaatccttagtgttgtctcaaaacggctccacgcactgtggaagaagcacaaaaagatcctccaaatggaggaatcgctcaccaacgggaggaagctgaacaaggagcatgaggaggtgctctgatccaagcccgttgtcgtcatgctcattgacgagtggatgcgcaccccgctcgccgccgcactcgccgaggagctctcctcccaccccgccccttccccatccaccgtcgcgccttccttcctcctccggcgctaattcctctgttgaggatctacttgcgctcatctacttcggctccctcttcgacgtgaagctgcataccgagttcgtcgccaccatgctcgagcgtgcaaggagtgggactgctgcatcacctatgactatatccgcccttgccgcctcatgccctgctgcggtcccgcctcacaccctgtcgcttaccggtcccgccactcatcggtgcgggaagacgatgggagaaagaaggaaagaaaacggaaaaaaaaaggaagagatggatggaaaacgtgacagcgattgtacagttccaattttgtagaatttcggtagcacaactacaaatagataaattgtagtggctgtaggatcatagtggtcgtggcatttttctgaatcgacata

SEQ ID NO: 5696 - DNA, 1501 bp, Oryza sativa
ctcaccatatgtttgcctctattgtttacatgcatgtggtccatcgattttgcttcctactatcatggatgtactattatggttgacaaataatgatattttaatatttaccaaacaccaaacttacacaatgtgtggcctatagtgcctttgtctttaaaattcatatatgaaaaatgaaagcatctacaccctcaaaaaggattgtgttggctatgtgttggatggtaacggcggatggtaaccctgaaaataaatcatatatagtgcctattgtgttggatgtgtttcctaaacccgcaaaaaggatgttaacgaagaagatcatctatcgcaacccgatcatcagtaatgcattcgaggagttggggcaaatacagtacaattaggttaaagaccgtactataaagaggggttggaagttagtagcttgaagtttcaaaagtgctagaatcaaggtgtggtgctagaatctaggtgtggtgcacactaggttgctagtctttcaaatcaagtgctaaaaacaagttagtaaaacctcgtggttgatcgtgtgcaagttttactacacccagaagctgtactagccggattgtctgagtgatgccgaataatccatgctagacttgtcttgaccgctaaaactacttaggcggataatcggctacggtgccaaattttcctaccaatgcatcatccaactacggtcatgtgttgacaagggactggccggactaaccggcagatcatgggttgtccactacccaattctctggcaatcagtagaaaatttgctagggcgacggacagtctgccaacccactcgaccgttgcgagtcaattttgtttgaactgtagtggactgtctgacattgtgcgaacaatgacctcccagataatccgaatgatattggattttccgttgcttgatagcccagcggctacttgcctagtgactattggaaaagtgcaagggaccgtacagttcggaccggtggcgggctgtttaccatgcttgatatctggctgcttttgtccaacagtcacaaacggctagtcagctagtttggggctataaatatctattgccttcaactccctaatatcgtttggaaccctgttgaggtgtgtaactgaagagagagtccaagagcaccattgagttaattgtgatcattttcttcactagtttggtgatagattgagtttagagtggcttagtgtgtaccaaataagggtcttagtataatactattccatgaaatatgaggtacacaaagacaaagttggttatcataggcatgttcaacagaaatggtaaatagtacttactacagatgaacaatggatgcacgtatctctattcaagccatcttcaaatcaattaattgagtacacattgcaatttataaaggtacaaggaaggcatttgaagttcgtttgcacaaagccacattttaaacaattaggagattaaaacataaaataataaccatgattc

SEQ ID NO: 5697 - DNA, 1442 bp, Oryza sativa
tggggagagaaaaggcggcggcgctgctagggtttcgccccccgtgtcgccagcgcgtgggcaacgcggggggggggggggggtttcttttttagtagtaacacatcaaactctagaagggtgggcagtggattcaaatcatgctgtttagtttttcttttctgatttccattaaacattcatatttgaagtcagttcattacagaaattcagaacggcaagcatttcacagacaatttgaaaagaaacactacttttgattagcaaccactaccttttcttgatcttgactaccggcaaaagaagcatatgttgtgctttatgtgattacccagtgaataagcaaaaatttcaaagagagctagcttaacaaatactccctccgtattttaatgtatgacgtcgttgacttttcaaccaacatttgaccatttgttttattcaaaaattttgtacgaatatgaaaatatttatgtcctgcttaaagaacatttgatgacgaatcaagtcacaataaaataaatcataattacataattttttttgaataagacgaatggtcaaacgttggacaaaaagtcaacggtgtcatacattaaaatatggaggtagtacaatattgtgttaactacagatggacagatggtttacatattgtctgtttctgctctgtacaatatattttcttaaaccataatacaataattcatattcaatcctatctcatcaggaaatctgtaaggcaacttgatacaatgttaataccggtatatatagatcttggatgtgcacactgacaacacaaactagtcctaatgaaaaattcagacatctcaataactgactactgagaaagctaaaacaaatgcctgtgccaaagaatttaacattttttagcaagcaatgtttcttaaaatagtgaactaaaagtggctgctatatcactgttcacacctatgaatcaggaagattcagtggtatgtagatctgtatcacatagctatcgctgttaatatgattaaacatagataagaattaaagcagagaaagccatacttacactcattctccagcagataactccactggtatgctattccttcgctagcctcctttgaagaatcagaagtaaacactagcaacctgtggttctttgcaaccatatctgtgacacttggccagtcctttccattagttggcatttctgagatagggtaccaatatttcgtcaagtcagcagcagtaaacaatttgctcaatcccatcgttgaatggacgtaatcctcaatgaatattgttattatctctgtcggattctcagatagaaatgcttccacctctttcaatgtgtcaattgctggttgctaacataatatttcatttaaacattagttttagagtgtaaacagactgttagcaaagataacgatgaatagattcca

SEQ ID NO: 5698 - DNA, 1501 bp, Oryza sativa
agataacacgattagacccccagcaaccagttgatggtaagatgaagcatgagaattggatgatcatcaagaaatgaatgcatcaaattaaatgaaagagagcgaaccacctgaggctgttggtcttccagttcctcttcctgttgaaacagctgcagctggagctgttcttccttctgcttctggaagagcgcctcctgcatgtcctcaactgtgggttcagcctcagcaggtacctcatgcatctctacgattggcatgctatttttgattggtgtgtcctccattgctccatccaattgctgcattacaaaatatgcacgttcttagttgactggatagataggaacagaaaacaccaaacacacacttttcagtttagagctacaaatcaaattgtgttagaacccaattcaaagagggaagacgtcatattaaatcatacggtgtgtttggctctttgccaaactcaaccataccaaaatattggtgctgccaaaaattttgtaacttattgggtttgtacccaaaattttggcgttgccagttttttggtttgattgattttggcaaagtccatggaggaatactctatggtagcaaccaaacactagcctagccactcttgccaaaaattttggtaagcaatccaaggctaaacttgttatgtgatttatcctgtgattttttttggacgaagggcatactaatatactactcctagtcctagttttagtgttgtctatacagagaccgttgccgtatcactctcgagatagaacagtagtactactatgcatcaagcatcatgccgctagcatctcctatgttcatagttgaaagaatcgcacaaccaacaccatgtacaaagaccttccattcatctactctacaaccaaacaagaaaccacaaccgccaccatgtgttcttcatctagttcttcatcctcgtcctctgatattcatcttctagcgaggacgaatggtacccatgtgtgatatcgaggccttgtcgataatttcaatcccgaacgaaaattggggcgtgacaccatacctaccttcccaaataaacaaaaccacaaaaggatagtgatctacttgctaaaattatattgaccaaatctctcatgttgcagcggcggcaatggcgaaaactgaggatgtgtgtgaattgtgatcaccctcgccatagatacatgtagaaggatagtaagccaagccgatgcaaaaatggcaagatatggtcagaaaaactcaaatagaaatggagaaggtagaaaaaaggctggcgatgataaagctaataatgtgtgagattgaggttggatgatggggatggcggaggtggtggcaacaatggtagtggcggtggatggacagaaaatgatgatggatgaagaattatttagggttgcacaagcaactatttatatgtaaaatattagtaagacgttaacccccaataaagcatgtgccacctgatttccatcagtgacca

SEQ ID NO: 5699 - DNA, 1501 bp, Oryza sativa
aacaaatggtaacaaatcaaattgaaaattttcaatataacaatattggtaaagacaatccattaagattgcgaataaccaacaacatattataagtttatgtggcatttttagtcggactaactctaacatatttttatctagtttcacgctaatagtgttgcctaaacatgatagctcgatagaaagaaaatataataaatttgctcgtacattggtccgttttagtctacccactctatttgtggttaagtgacatgattaaaatgttacacaaatttatataagtaggtataattcaactagttaggttccttgtggtagaaccgatccacttaggttcaagttctagatagacttgacacgagtgtttatatttttggctaattattctttcattaagtggtagacgacttactatgtgaggctgtattcgggagcgccacagaaaactatatatatgcattaacacatgattaattaaatattagctaattccttttttaaaaaatagattaatatgattttttgaaacaactttcgtatagaaaattaataaaaatgtatcgtttagttgtttgaaaaacgtgcacacggataacgagtgtaagcgcgcggtgaatccatacgcttgcgctgtgtttcttacaaagaaaaataactagaaaaaatgcccgtgcgttgtaacaggtgaagtctattttaatcttattattgttatatggtttagttaagataaaattcaccgtgggagttcgcttggatatatatatttttagaaaatcatgagctacagttaggagtccgattgtctcaagttagcatgcgagttttttaaaaaaagattcttatatgtttccttccgtattaccaaaagtaaacgatcttaaaaatcgactcaaataccacggatatgtatttccaaaagcaaacgaacttaaaaaccgacccatacacggatgacatatcaaaataccggcaaaaacatctttaatttttataatagtagagatagagatatgacacaaaatttaatttggaaaccttttttaagtagtactattagtggttgtttttgctctaccgttttgggttggaatttggaataaggaatacctctaggtgataggtccgagtccggacggaaccagctggaatccatccaccgaagtggaagcgccgaccacgtcacggatccttcgactacgcggacacgtgcacggcccatgtgtcccgataggagtcgtcggatggagggcggaggcggacggagggtgaggatccgataagggttttgggggcgggggtacaaataccggggctccccgggcctcgctgcctccctccctcgttgccgcgccgcagttgcagttgcagttgggaggcaaatctctctcccaacccttatcaaaccctaaaccgaaaaaatttaccccccaaaaaaatccgcaaaaacaaaaaaaacccaaatcggagatggcggcggcggcggcgcaggcgc

SEQ ID NO: 5700 - DNA, 1501 bp, Oryza sativa
aagaattaaaacactaacttgggtacattgctcggcttgcccataaccgagggcgcggccattcgaataggttgtactctgatcagaggtgtacatctttacccacaagacacatcttcctcacgtgtagccacgtgccacataccacctgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataatggaaaagaaataaacaaagttgaaatggtttgtaaaaagaaaaaaaccctaaaagaagttctttccccccccttttccttcttgggccggctcggcccagtctctccctctctctctcttccccccccctcggcccatcggcctgccccgcgcgcgcgcgccgctgacaggcgggcccgcccgccactctcgctgacgggtgggacccacctgtcatctccctcctcgcgccacgcccgccgccgcccgtgccctagcgccgccgccgccgccgaatccgccgcatcccgccctctccgcgcgcaataaagagggggaaatcactccccgtgattccctctcccgtttcccccgtcttttccctctctctctccctcggattccttcgaaatcgcgcccgcaatcctcgccggcgtcatcaatggcggccgagatctccgcggccgtttcctccctctccggccgcgctctccccctctcggcgctatttaatccctccccgagctccgcccctccgtttccaccgctcgccgcctctcctccccgtcggaatcgagcccgcgccgtcgcaccttctctccgccgtcgccgccgagctccgtttcgccgccgtcgtcgccccggacctcctcccgtctcagcgtcacctccatcggcttcgccgcgtcgtcgccgaccccgtccgctcctccgcttcgcccgccgaccgccggaacgccgtcgtcctcgccgtcccgaaccgcgccgccgccttcctccgcttcggccaccgtttccgtcgtcgttgtagtcccggggtgagccgaggaccgccctttcgcttccctctcctctccgctctctcgggcgccgctccgccgcgccggtggtcgccggcggtgaccatcggggcgcgggcgcgccgctcccgtcggccgtgccggcgaggccgccttcgggcgcgccccgcggctgccaggtgggcccggccgtcagccgcccgcgcccgcgggtgcggctgacgcgcgggacccacggcgccggccgcctccagccgcgtgctcccggtccaccaaggaccgagaggctgacgcgtgggccccactcccgtggacccggtccgcgcgctccctccctcggctgacgcaataatccgattttttaattaaaatttaaa

SEQ ID NO: 5701 - DNA, 1284 bp, Oryza sativa
tttcaatttaaacatggtatggattaatctgatctgcttaactgatgtccactccatttaaatatattgaggtagcttaggtaaggcagtgaacgaatataaagtatcctatagacatgtctatgttaagaggaatgatttagtttaataaaagattgatttgagaaaggactcatattctagaggtggggtaatttttctttgttgcatcgattcttctctcactatactagcttgtacacattttcccataatttcttttcaaatgtgcttataaatgaaatgcggcatcttggagtagacatatttagagatccaatcatattacacttgtatatattttgtatatcttcgggttctttagaactggtagacaaccgagtggcttaatttactgttcatgctcattcatatactagcttgtacacatttttccataatttcttttcaaatgtgcctataaatgaaatccggcatcttggagtagacacatttggagatccaatcatattacacttatatgtattttgtatatgttcggattcttgagaacgggcagacaaccgagtggcttaatttatttgttcatgctcattcatatactttttgcatgcatgtacattatgtggttttgcctgtctgctcacgtctcttacaaacgttttaagatttagagttcatttatttgttttgtttcggtatctcttatatgcctctttcttgtaatagtcgggttataatcatcttttcttttgtttaatataatatatgcactgattagatgaaaaaaaaaagttctattgctggtgcctaactgtatatagacttccatgcgtattatgcctaccatgcaagactaggggttgtttggttccctcccaaacattgccaaactttcttgccaaacctagccaaatatgtggcttataaattgatggccacaacttagacatggtttggctaaaaaatggttgtatgacatgtgggcctttgaattaaaaaactgtggcatgtcacaagtttggaagtgaaacaaacatatatcttaaaaaatgtggcaaagtttgctaaagtgagggagtgaaccaaacagaccctagtagccggttgtttttcgtttttctttctcacctgagaatgcataaaccgtgttggctccatgtcaaactaggaaatgtgaatcgcattagctcatgttaaacaatgcagatttatccaggttgacaggctgttcataaagtcaatgtgaggaggctgttttgattggtgtatccagggatttga

SEQ ID NO: 5702 - DNA, 1501 bp, Oryza sativa
cattattgatatttatttcttggttttcaaaagaaaaattaaaaaccgttgactgccagtggaatttgattatttttcattttaaaaagtaaaatttaatattttaaagttaaccaatttaccgagcaattaaccttagaattttgcaaggccaaaagcggagaggtttagcatcacatcaccaagagattacgtataatctcccaaaaaagttgtttttgggtttcctaatctgaaaatagatagccaaaaaactgatcccgccaagataaagcctaaattttatccctaaattagaagtggactcttctgctaaactaataaattttcacgttttcctccctctcacacgctctcctgcccccccccccccccagaaaaaacacgcggaatgacagattggagatggcaaacgcgctgtccttctccctcaaatgaagagagcgaaggatgcggggaagggatttcaaaaaaaaaaatcagatatgagaccggttggagcctttttttaccaaaatcctaaaaaaataaagtggactctaacagtttttcctgttttcctccctctagcgtgctctcctagcactccccctgagaaaaaaaaacacgcggaatgagagattggggacggcaaacgccccgtcgctctccctcaaatgaagagagcaaaggatgcatggaagggacttaaaaaaaaatcaaatataagatctgttggagctatttttttcaccaaaatccttaaaaaaataggattgtggatagaataaggagactattggtgatgcttttataaataccgataacaaaattttatttcacagcttgatattcagacagttagaattcgtagcttttataaaaacatatgcttcttccgttctataaaaatgatctaatatatgatataccatattgcaatgttactaatttagatatcatattagtctgtgttttatggaattgagggagtcctcctattttgataaattaaacttatcttggctgtcttcatacaaactcactttttttttctttttaccctttcaggcttcctaaaaaattaaaggaatgtgttctagaaggtccgataccaacagaagtccatctccaagaagaaaggaaacgaaagcagcaacagtgcagcacacggccgccaccctctccccccatctccgccaccaccgcgcacgacaaccggagccccgcattccccggcggctctccggagagagagagagagagagagagagagagccttccaccaccatcgacggagccagccggcgtcatcccccaccgtgatcgagatggcggcggcggcgacggcgacgctgcggtccgcgactgccgcggccgcggccgccgcgggggcgcgcaagggtggcgggctgcggtggctggggacggcggcgtaggcggaggcggagagggagggcggggccggggcgaggtgggagctctcggcggcgcgggagtactacgactaccgcaagtccgt

SEQ ID NO: 5703 - DNA, 1501 bp, Oryza sativa
gaagcggcaaggagcagcggcagcctcccgcttgccactccctctcctctcatctctcatctcctgtgtgatttccgcctctcctcctatttcttgtgtgatttattttgcgatttctgattggatttatgatgataccaattggactaggatttagtttttttagatttataatgattgggattggttgtgggatcttcagagcgaatgcgcgttaacacgggcgaacggcagatgaagtggagaggaggtgcgcatgatgcggacgacggactaagacgaacgaaaatcctcagagaagtcttatgtattttttaattaggtatagatatagatatggtgttgaaatagtacattattaaaataattttaactattttatttagatcgactccaaaccaaggttataaatacttgtgactaatatatgaccggcggaggttaacggttgtttttaacaaatgtttgaattagaaaaaaaaactaattatatgcatgttgctgtcaatttaaatccaaactagatacttctgacactatcggtcatcaatgattacatgctaaaaaatttgccacgacaaaagcgtaattcttcaaaaacccaacatgattaatgtatttatacatcataaatagataaaaaaaatcaaaatacaaccaaccgtgaaaaacatgtctccactctcaactccaactcttgtattcacatgaaacaatgaggactcgtaatctttaatctgttttagtctttttgcagttattttttccatgttaactaggatcattaatttcatatttttcttgtttaccaaggttctctttctaaaatgacaagataacttttgtggacaaagaaaaaagaacaaaatgaaaccatctctcccgatcccctctctcacttgaactgacggttgtcaccaatgttcattcagttcaccatctatatgtcatcttacggttaaatttctaccgttcgggaggaaactaaaagatgcctctcatctatacctaccattataacccactaaactcctaaaactcaacatacatcaacccactaaggtcaacatacataatccgtaatcacctaaaactcaacatgtaagtatgcatatagtaattacatctacaatttatttcattctaaaactcaatatacacatgctaaatcatcgttctcaaatcattttcacaatatttcaattcaaatcattttatcatttctataatatttaacatatatcctgtaacaaagcacgagacattatctagttaattaaaattttactccacaatttaaggtagtagccatcagttcaagtactgaaggattgcaaccaggtttaccaaaccattttgagcggggttacaaccaccccacggtaagatggttatcgtggtaaccgtgcggccaccgcgaggtttaccgtggtttcaaaaactgagaaaattactgcacatgataaccatgataaccacaaggttacgtaaatcctgattg

SEQ ID NO: 5704 - DNA, 1501 bp, Oryza sativa
tcatgtgcaactcaataatgcatattaaataatcatacacactgtcccttgtatacagacacatgtactgtacacatagctgtgtgagaattgattgaagcaaacgaaaaataaaaaaaaaacagagaagatcttggatggaatatttgattgagttggcttaataaacgtgtcaacgcaacaattcaactatttctcttgctaatttttctcttagaaaattagatacatctatttatgccccatatttgatatttccttttctgccccaccttaattactccttaccctatttttcattttcctgtccaagtggcttactccaatttcacctaaattgcactaatttagccatcctcttcagacacatgcatcaattttacaggtgtcattatttatgcatgaacttggaaataatatccgagggtgtgtttagttttttgggtgtaaaatttttgaagtatatggacgtacatttaaagtattaaacgtaaattaataacaaaacaaattacagatttcgcctgtaaactgctcgatgaatttattaagcctaattaatccatcattagtaattatttactgtagcatcacattgtcaaatcataacataattaggctcaaaagattcgtctcacaatttacatgcaaactgtgcaattggtttcttttcacgtttttaggcaaaaatttttggatccaaacaaggcccgagtataccaaaatatatctgacttaggttttgttaaaaactttcgacacatttattttccaccgtcaaatgttctttaagattcatgctaccgagataaatataataattgtgcatgcgcgaatagagaatcgaatccttgacttgctgctttgcaagtccactgccctagccacttatgatgctgggtgtttttggaaaaaaaaatcacgttacgtgttagttacatactagttgcattgtgattatatactagttacatttgtaagtttttcttctacaaaactatcgaatgttctacgcgtactcccaaaacttgtctgagtcaaaccaagtagatctgaaaatataacaagtagaagtactccatattgatattattcaaaatgaagaaatagaacatgagaaaaaataatagaaaaaacacacgtctttgcacgttgttgtggccctcctctcctcgtccactccctctccccaagccttcggaattgggaatggtctgaaaaaaaaaaaggagagaaaattatcatcccaccctggcgcctcctctccacccaccgactcccgagacaatgccgccgcggcgcgcgcgggcgcgcggcggcagcagcagccggcgccgctgctagatcccacgttcgccgcgcgcgcgcgcgggcggcctcgccgtggggctcgaggcgacgcgaccaatgcgcgagcacgaacggcgtgggcgagggagaggaggaggaggaggaggacgcgtgtcaccgatgccccccggcgaggacgccgacacggcgt

SEQ ID NO: 5705 - DNA, 226 bp, Oryza sativa
  unsure (1)..(226): unsure at all n locations
ccacctcctcctcctcctcccccgcacccgcacntcggcctcctccgccaccaccaccaccaccaccgcaatgccgcacgtggtgcccccatccagagcaccccctccccccgcaaactcggatctcttcaaagcttttccgcctcctcttctctctcctcccacccgggagttttgctccccgcgcggacgccgagctcgcgcgcccgctcgctcgcttcaacca

SEQ ID NO: 5706 - DNA, 1501 bp, Oryza sativa
ccagaggctaacgtaacctagctgatgaacggatccatccttcggatcggacggcttgcgatcgtttagccctcgatctgacggttacagctgcagtactaatttttttggacaaagatgatggtatataccagcttgttttttttttcaaaagatagaaaatggtattacttatgtgctcaggatagatccagcatgggtgtgccagagggacttgagtcctccgtgcccactagatcatcattgataaaaggagagagagtcgaaagaaaaagagagataggaggaagagtaggggttgaaggaggagatgaatttcctctctagttttattctagattcgcccctgatactcataatgttggaattaatgaatgggccttagcccactagaagattaattctttggaaatcacaaaagcccacctcatggaatggcatgcatgtggagtttagtaccaccctgcttattctaggagagggggacctccttaaaagggatgatgcccttctagccacttgaagcatgtgtggtggagagaagagggggaacacacgcgcgcgctcgctcgcctggcctggtaggcgcgcgtgcacgacgtacgcgtcgaatggtccgccaaaattggttcctcgccttgcgcagatgcagcctccttttgcagttttattttgctgcaaattcggattcgtttttgttttggaaacgttccgaaaaatccggtgcgtgcaaacggcgtggagtccggataagttacgcgcgacttatccggttcggttacgcgcagtggagatcatgcgggcgccctgatcaagcgacccttctctatataaaccgacccgccgtcttcacgcaacacacgcgaaatcaatctagggtttgcctcctactctgtgctgcgccgtcgctcgtagattactccatcccgctcgccgacgtgcacctacgatcgggagagtagatctccggaacctctgccttcgacgtcctgcaccgggagaaggcggcaataaagttttttgggaagcgctttgcgcgactgctccctgttcgtccgcgacggcttgtcttcctcttcgctcgcgtgctgcgtgccttcatagatgcctgcgaaaagtttcgaccgagcagccggtctttccgccacctcgatacgtgttcaatatgttgcgcatatttgatctgttcatgttatactgtgtagtttacatgtgtagatctaatgatgcgttcatgctagttttcatctgtaatatcatgatttatttatggaatagattaaatcattatatgcctataatctcaacacataacgtacgtaaactcacccctataaatatatacacatacttctatccttatccaatatatggtaatctcgttaaatgaaaattaaacggtgtgttaattagttgtccgacccagtactagacgagtaaataactgcgtaatttgcatggcagaaccgtgcttagaccaactactcaaattaattaacaa

SEQ ID NO: 5707 - DNA, 1501 bp, Oryza sativa
aggaaacaaagcaaaaaggttccatgaaacaagctgcacctctcctctcaaagccattggcagtccaccatggactagacactccaactcttccatcgaaggaaaattttcctcttgacccctgttgtcaatgccagtattcgcactatcacttgaatgcatttcttgactagtctcaaccttgtctacatcatagaactcatcatctgaatcctcagataacttgccctcttgaaccttcaccggatggatgacatccttcgtgtcctgattgccagaagcaggtgattgcttctcctcgacacgtacactcatgatctgctctatgttgcccagggatggtctgattggcttccatatctcgatcttgtgtggtccttgcacaatcttctcctgcagcaacgaagaaccgccaattccactgctatccacaacacgcccggcagcttcacccttctcttcctgtcccgatggttctgactgcctctccagaaaattcttccatctatcggatctctcctcttcctcctcctgcaaacacagcaccagaaggcatgtagcttgtccacaccagacaatgcagattaaaaaaagtcagggggcgcgtgtcttctaccttgtagatgcctgcatactccttgtaacgctgcaagtgttggggccgaactgcgaagccataggcatccctgcttcaatcacacagcatcagaaagggaacatttctccaaaacggcaactaactaccgcatagaacttcgatgattctagacttgtgcggttgtgccctctcctagattcaaaccagagatcaaatttcgtcaggtttaatcctatcaactcaatgcctgaatcaacagtggaaactgcttgctcctactgtcgtgcagcaggatgcggacgtcgaaacccagatctcttcaaaaaaaaaaaaaaagcaaacatcacggagctctcaactcgtgcaattccaccggcaaatccatcctatgcttcaaccctacactccttcgcgcggaggagatccagccctcgccgctcccgcgcacagccaatccctcgccgcattacccgaaaacctcagcaagaaaaaaaaagtgagatcccctcgtcgcggctcgccgaggagaaaccgacgcgacgtacagcaaccggccgaaacccacgcggcgcaacgaggaaggagacggcaaaactcgaaacacgccccccccccccccccaccccgggcgagagaggaaacgcaccgcttgtgctcgaaggcgatgaacgggaggctcttcggcttcatctcctcccaccccccgcagcagcagcagacggcggcggcggcggcggcggcggcggcggcggcggagtcggatcagtcacgagagagaaagagtgtgtgtatccgtacggaggggaggaagaaatgtgggggactcgaggaagaccacgcccaaagcaaactgatcagagaccgagcaggaacgaacacgtctcgtgggtttcgtctctgcgt

SEQ ID NO: 5708 - DNA, 1501 bp, Oryza sativa
cttgtttttcctttgcaggagaataaattgactgctttaaggtcagtacttaaagaccgggtcccatgatgtttatgggtgtgaaacctgggaattttacgcccaaaaactcacggctgcaatgagtttggtcactaatacgagcatcattagctatataggcaagttgggcgtgtggatcagggagggtactgtgtatcactcagcaaaagcatatgtgaaaactaacaaattatattacagtgtgctagaatgtatagatgctgtgatgtctctcttattagagtcttattatatagagagagagcgcagtgctttacttttgttagttactgagaatgtcttttcaaccaacaaaatgctatacctatctttcccaaaagtataacatagataattaattaagctagttcattaggcagaactcattaactcaaggctttgaacggtggatagatcgccagaaacatctatggcatctgatctttctcctagatatccagagttttgagtgacatcgacatcatgtaaaagtaaacatgttattcctgaatccctctctttaatttgttcatcttcagacaatgcctttgcaactagctcttttctctaaaaaaaacagaaaacattaattacatgacaaaacgattatcaatcacaattcttttccgataatgatcaacatgcatcacatggataataggtgcacaagctagctcgtcagaagaagcatgcgataaggtcaaagcaatcaaagcaaagccaaagctatttcggccggcggattgctgatcaaggtgtccatcgttgagcgggttgcatgctgcgagagagccagtgacactgacacctcaagctcgatcgtcagagtcccccctcaggtcaaacagtgaccacattctctgaaccttgaagctaagctagctgctgctaccgctcttaattcgtcagaagaagcagccgtcagttattgatcagcacgtgttcttcttcttcttaacccagcttaatcaagatgtcaatcgattaatcgatctgtcactcgatgatagagcaaatgaaatggcaaatcgactcctatttttgacagcaatgtctcggagagactgtttggtcagttggtcacgtccatgatgagcacgaacagaaagaagcaaatatgtgcggacagtggtagacatcaggtagaaatttttgcctgatataattaagcacgttaaccttgccctccaggtagtagtaatcaattgtcatttctgtcgttttcagggcatagatgcccttattagtgccatgatcacatcacaaacctcccggcccagaagtggtcaagttgttccttcaaagaatagtaaaaaaacacacacccgccccggctgatgcaaagttacaaccgagattaaattaattaacatgtgcggcaacagaacagcatgacacttcagatcactccgcctataaatacttcttgccttctcaatttctcaaatcatctccacac

SEQ ID NO: 5709 - DNA, 1501 bp, Oryza sativa
actaaaaaaatcagaccacaaatcgcacggactatgctattgatctctttggtcaattttaggtaatgtagactaggaagtaacctcaatcccccacagagcagcttgagatgcatattccgtatcttccaatagattaagtccacttggaacatggaagtcaatagacttgtgtttgctaggccggtgcttgtggtccttcgaggctgaaagcaactccaatgccataatctgatagctggaaccaataaaggaataccgatagtgtttcagatatcagggtgaaagcaaaacattgtttaaattttagtgatgttttaaagagcactgcactagagtacaaacaagctatggcaataaggttaccaactcccagattttggccaggagcacaggattgcttggcaactttagttaatccctcgttttactaagtctacaactaaagcaaagcagcaaacaagcaattctcagtttctcacccgatgatgcctccaatgcagtcatagaacacgtcgatgtcgccgaggaatttgagcagacgccggagaagctccgattccccgctctccgccacaccctccaccactccctccgagctccacttgccgaccaaagcagccaagctagacagcgcctgccgcagggcgctccgaccatcgctcccgccgttatggtggtgatggtgctcgtggccgcgaccgtcccagtcgagctccgcgccgagcacgtgttcctggccggcggcgactaggcatttgagcaggaacacctcccgcggctcgagcgcgcccagaaccccaccattcgacccctccccgaagaactcgaccacccgggtctcggcgtcgagcgcgcggagcttgtcggcgagggagcgagccccgcggaggcgcgcgcgcagggcggagaggcgcgcgagctccgccgcgagcgccaggtccccgccgccgcgcggctgctcgcgggaggtggccggcccgggcccaacccctcgctcgagtggcgcggtggagacgctctgcgagcgggaggccgaggacggggacggggatggggaggagagcgcggagaggacacgtccacggcggcggcggcggcggcagccgggggagcggagcggcgggaggcggggcgagcagaggtcgaggcggaggtggggtggaggcagcgtgcgagaggccatgcgaggagtggagagcacaggaggtggtggtggtggagagcgagcgggcgggaggaggggggggagaggtgagacttgagaacgagggagagaatggataagaggaggacggcgagaccgcgagagcgaaagcgaagggggcatatgctctcgggcggaatctcgggtacccctgcgtgcgcgcgggcgtcgcggaagacgcgcgcccggcgcgccggttgtcacttgtcaggtgatctttttgctgttttctggtggggccgtgggctgcttcttgaaacttcgttgctcgtagcccatttagggcctgtttgg

SEQ ID NO: 5710 - DNA, 1501 bp, Oryza sativa
ttaaatttatgattttagatgatcgatatctattttcatttttttattaaagctgcattatttctttgaaaaaaatcgttcattgtacttgggacggtgctgggcagcggtgggcggtggcacggtggctatgaaccgcgttttgtgaggcttcggtcgcgatccgcaccacgtgtcgtgcctggttggttggctgcaggctgcacacagcagcattgttccgttttctcgcgcgaccaaagggctgggacctggacgtgagaagataaattggagcgagtggttacgtgcacggctccgtccccaaaatgtaatgaattttgtccgtataattaattatatgattaagaaattctttatgttgaaatggatgtagtgagtatattaccagttcaggtgtaggtagttttctggaaaaaaaatggcaacaccacagctcatcatccgtataatttgcattgagatccgaggtttaatctagattgagtgcatatgggtgattgagtactccgttttattatattataaatcgttttatttttttttctaagttaaacttacataaatataatcaagttattttttaaaaaatatagtaatatttttatcgcaaaacaaatatagggtcattttcaaccctaccaaattttggtaaaattaccaaaaaaagtggcaacatttagtttgctgccaaattttaataactatataaaaaattctgccttgacaacttgccaaaattttggcaaaatttggttagggtttttttcatcaaagtgaataggccataatatgaaagtatactgtgaaactaatttgattcactgttagggagtacttcccaatgaagtgagtttatgaggtgattattccttccgtttttttaaagaaaagaaagattattcctttgcgaatgcagatttgagactaaggtggtgtttgatatctcctgaagaacgaagatgaaaataaagattaagtgtttaacgtaaaacgagatgataataatacgtgattaattaaattttaattattataaacttaaaaaatagattaatcttatattttagaataactttcatataaaaagttttcacacgaaacacatcgtttagcagtttaaaaagaggtccttttataccgttttcgttgcagaaaagaacatgtctaacagctgatttgtataatctcggctgggctgtcatgtcagcctgtcaccgaattccaccgtttatccgagggaagccgaagccctccctcgtgtccgacgacgacgcagggcaaagaccgacgacatccactcccacactccgtcggccacctgccctactcctccctcctcttcctctccttctccctaccctatgattgctctcctcctccccgagctctccccctagccgcccaggcagccgcactccgggagccagcaagcccagccccgtggtccggcgcgggggggagatggcggcggccgagttcttgtcgccggaggcggcgg

SEQ ID NO: 5711 - DNA, 1501 bp, Oryza sativa
ttgtccgagtaagactcttcccatccgtagacttcgtgaaggatttccttagtgtacgcgggaagtatccatatgcgcgtgggtatgccataccgatatgtaacgtatatcgaagggtaaagggtatgcctaacccgtaaccctgacagattgtctctatatcattatctacattagacatatagccgattgctcaacacactattgacatcggctggtatcgacattggctggattactccatcagcttgacagccgatcggctcattgatatgctatttgtatattttatcacttgctgtaggatcaaactgactggtatgcctgcatctcatcaacctttgggtctgcactagaactaagcagatctcctaggtcattgtgttcgtcgacttagttcgcgccaacacagttcctgtaccattgggcgagtgcagatttttcgtcaacaatcgtagatattgaaccttctaaggttgagtttggtacaactgttgggttgggcttagctagtcactggtatggaacccaaggtattcattacacatgattaataaagtagctcatccattataaaacatagtaatctaacaccggatgagatccatatatacaatactacatatactatccgatattatatgatactacatccgtttcaggttataagactttctagcattgcccacattcatataaatgttaacgaatctagatagacaggataatcctagaaagttttataatatgaaatggatgaagtatattttaggacggaactaacataaactattataaaattaaaaataattttatttgatattatatatatatagtatttttttatagaatatatgtttagtagtttggaaaatatgctcatgataaatgagggattagcctaactcaaccttattttagaacgcagcccagtgtgttactgaaagagctacaattgatcttgaattctcataattggttctagggctaattttgggtggtttctccgtcacatttgttgcgcaatttattttgaaatgactgtaaaatcacaagtacagatctatctaaaatcacttttaaaaattaaatttcaaatttcaaaatcagctttgacttttaagaaaaaaactgacccttggaaattcgtaaacactaaacagtgaaaaaaatctctcaaaggccaaacgccaagtccctactcccatagtcccatggccgcgccgcaggccaaatttggcggcgcctgcaggtcaaaattttgagctggccgcctctcagaccacgaaaattcccactatcccgccaaatcaccgatccgcgcctcacgccacgtcaacgatccgctcctccccccgcgatccagatcctcaccgtccattccctcccccatccaacggcagccgcctccccactccatcctctcgtccccttttaaaaccccctcccctttcttccccaaatcccactccaatcaccaccacctcttctccaattccac

SEQ ID NO: 5712 - DNA, 614 bp, Oryza sativa
agagccgcccgcgccgagccgagccctcctttccgccccttcgctgccgctccccgcgcgtcgttcgcgcgcgcgcccgcgtggtcctcgcccgcgtcgcgtttgcgccgcccggccccgctgccctgccgcgcctgcagccgctcggccccgcagccagcgcgcgtgctcgagccgcgcctctccatccgccgcgccctcccgttgcaagccgcgcgcgcgtgccgagtggccgaccgtctggtcgccgccgccgcgtcaccctctgccgcgccagcccgcgcctgtcacccgtgtcgtcgcgccgctccaaaccgccccgccgtcatcgccgtcgtcatcgcctcggccccgccactccgcgcgcaagccgccaagggacggaggccgagccctcctccctctgccgcgacgcccccgctcccctcccccttttcccaaagaagaaaggggcgagcccccctttctctccctcctttttccccttttcctcccgccggcgtcatcctccctccctcctgtcaccgttttggccgctagccagagcgccagctcgcgccttgaccgccaaagtcggtttccaaaccgacattgccgccccctataaacccagg

SEQ ID NO: 5713 - DNA, 1501 bp, Oryza sativa
agagcagcaggaagacttgatgactcatatgcacaaactagagtttcatccaaatcaagcactacctggagtcgagcaatcccaattatatgattgtaagttacacaggtggatgataagtttattaaaaggggattagggaaatcagtcgatgtagaggataagttcattagaggggattatggaaatcagtcgagtaatcccaaatatacgattagggaaaagataggttcattatgtccttgttcggttaatccctcctcgaggccttgttcgtttaaggattaattccacactcccttaatcccctctaatcccttttctcctcaagaggatcgaattaataccgatattaaccgaacaagacctaaagggaatcgatatgaacacaacaaagatagatagaaactaggtctaatacgctgtcaatggcgactcaatatcagtataattaacctgctatgtgtgaaatgaccacaaattagcaatagtagtttgtacgatcactcaacagtcaacagcaagaaagtgaacacaatacacacagctcgctccaaagatgcaggaatgaactaacacacatctcggtccgtaccgtgagccgcctgagcggcggcggcggccccgtcgacgacgcgtcggcgggagcctcggaggggagccgcacgaaggcgaccgacggcgacggcgacggcgacggctggggcggcgcggcggagaggagagggtggcggagcccgaggaaggagaggaggtgcgcccaggaggaaggcgtgccgcggacgatctggagcaggatctggaggaggaacccgagccaccccaccaccgcccgccacgccgcctcccccggatgctgctgctgccgcaccggccccacccccgccgccgccgccgcctccggcgacaagaactcggccgccgccatctcccccccgcgccggaccacggggctgggcttgctggctcccggagtgcggctgcctgggcggctagggggagagctcggggaggaggagagcaatcatagggtagggagaaggagaggaagaggagggaggagtagggcaggtggccgacggagtgtgggagtggatgtcgtcggtctttgccctgcgtcgtcgtcggacacgagggagggcttcggcttccctcggataaacggtggaattcggtgacaggctgacatgacagcccagccgagattatacaaatcagctgttagacatgttcttttctgcaacgaaaacggtataaaaggacctctttttaaactgctaaacgatgtgtttcgtgtgaaaactttttatatgaaagttattctaaaatataagattaatctattttttaagtttataataattaaaatttaattaatcacgtattattatcatctcgttttacgttaaacacttaatctttattttcatcttcgttcttcaggagatatcaaacaccaccttagtctcaaatctgcattcgcaaaggaataatctttctt

SEQ ID NO: 5714 - DNA, 1501 bp, Oryza sativa
gtatacacgtcttccatgtaatggaaaaaaattatctgatggtgtgtgctattctaacagctgtggttactgtggctatgcattgaacctgagctcctcaacacggaacacagcgaacattggatccaagtatggtaagcagatcaggaaaggtgtaatctcattctttgcgatcgacgagagtcggttcacacaaactgatgaggtgagctgcatgccatacttccattcaaggcgctcctggggtttgttcagaaagaggacaaggttgatctgccgcaaatgtggtggccgtatcggtaatgcttatgaggatgaggattccacattgtatgatggttcagatgatttgcacatgagctccgagggctacagcatgtcgagtggaaagaaatatgttatcaagattaatgcactgcagccttcaaccgatgactctggtgttcccttcaccctgtgatgctgttctgaacttctgcagtatgcacttttcgattcttgccttgcgctatactggactgtcaatcaagtaactgcagaaccaagagattacgtgctagtgtgtaactgtatattttgataggaatgctgaattttgcctacctgtatttataaaatggaagagtttgttgtctatttacatatacattcagagttcagtgggtgtgcaactgtgcatcatggacctggatttggcaatccatatttgggcaaatgtttagttagaaatcaggtttctgatgatgttcagtggtgtgtacttgtgtcttgtactgaaatattgtagtgtcttttgattttttgtgtatctaaagaatgatgtaaatcttcagctattctaaacggcagtttttttttgtttgtgttttgaagctatgccaattaatttctgccactaatgttgatatgatttgaagtgaattcctgtgactctgagcaatgctatgccattttcagaaattgcaattgtgagtaatgtgcaagagccaactgccaagtgcagaaactcattgttaaaattttcctgcggagaaatctattgaatctaaagctcagatgaattttcctgaaactatccagatttcaggctaattcagttgcaagaattaactgaaactaaagcacagatgaatttgctgagggaatacaaatgcaactgcagtaacagaaataactaaagcacagatgaatttggctactgcagtaacagaaatataaagtccaaaatattaaacgaattggatctatcgtcaaattaaagcaactcagacaccgcttgatattctgcaaatccgctgttcttagtattggtcagcgatggtcaaatcaatatatagcacatttcaagatgtatcagcccaatatgcaatgtagatttcaaccagaaacctatatcgaactcagcctaagttcaccaaatcgcactaaccaaaacaaaatttcatcccaaaacggacaaacacaaattgcacatcaacaagaggacagatccacaacattg

SEQ ID NO: 5715 - DNA, 1501 bp, Oryza sativa
tagaaaaactaaacagcgaactgaacaaggtggattccacggctttccatcaaactttttttcttgaccgcaagacttgtgggcacggccagacgacatgggagagatggcggagggaggcaagatcgatcagccgccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatcagcccggagatgcgcttcacgccgcccctccttgccagcctccggatcgccggcttggtgatcccctggatgttgtcgcggagcaccttccggtgacgcttggcgccgcccttgccgagccccttgcctcccttgccgcgccccgacatggccgccgacgacgacgattccggtggctcgacgcacgagagagagagaaaagcgagtggaattggagaagaggtggtggtgattggagtgggatttggggaagaaaggggagggggttttaaaaggggacgagaggatggagtggggaggcggctgccgttggatgggggagggaatggacggtgaggatctggatcgcggggggaggagcggatcgttgacgtggcgtgaggcgcggatcggtgatttggcgggatagtgggaattttcgtggtctgagaggcggccagctcaaaattttgacctgcaggcgccgccaaatttggcctgcggcgcggccatgggactatgggagtagggacttggcgtttggcctttgagagatttttttcactgtttagtgtttacgaatttccaagggtcagtttttttcttaaaagtcaaagctgattttgaaatttgaaatttaatttttaaaagtgattttagatagatctgtacttgtgattttacagtcatttcaaaataaattgcgcaacaaatgtgacggagaaaccacccaaaattagccctagaaccaattatgagaattcaagatcaattgtagctctttcagtaacacactgggctgcgttctaaaataaggttgagttaggctaatccctcatttatcatgagcatattttccaaactactaaacatatattctataaaaaaatactatatatatataatatcaaataaaattatttttaattttataatagtttatgttagttccgtcctaaaatatacttcatccatttcatattataaaactttctaggattatcctgtctatctagattcgttaacatttatatgaatgtgggcaatgctagaaagtcttataacctgaaacggatgtagtatcatataatatcggatagtatatgtagtattgtatatatggatctcatccggtgttagattactatgttttataatggatgagctactttattaatcatgtgtaatgaataccttgggttccataccagtgactagctaagcccaacc

SEQ ID NO: 5716 - DNA, 1501 bp, Oryza sativa
cggccttgagcgcgtcggtggcgacgcggatgaactggtagtcgacgaagagcaccttgggctcggcgtgcctgacgatggcggcgacgttggccgcgtcgaggcgggtgttgatggcgttcagcaccgctccggccatcggcacggcgaagtgcatctcgtacagcgccggcgtgttgggcgcgatgacggacacctacgtaaccacatgatacaaaaattagcacgtgacatgcatggagagtgacacatatactacatcttattttcaactctcccaaaatagtttagattcttacctagattgtaaaaatttgtagttattctagaagccaaaatatgaaaaaaactacagtaactctttagattctcactagctagtcgttctcacccgctgcttctcagaacctctgaactcgcccgattacgactataataatagggtatagagttgcttacgacgtcgttctttgagacggcgagggactggagcgcggcggcgaggcggaggcagcggtggtgcgtctggcgccacgtgaagctggtggcgccgtacacgacggaggtgcggtcggcgtagacggaggcggctctgtggaggaaggtgatggggctcaaagggacgtagttagcgtctctctttggcaggctatccatggtcttgattgattgctagctccttaattcgatcgtaattagttggtatatatatgatatgtgataagagatcgagcagctagctagcagcagtagtgcaagcaaagcagctaatggcgatcgaatgagaggagtgtgcgtgtgtgcaagtgcaaggggggtcctgtttttataatgtttgggggtggagagatggcgtaattgacgggttagtggcgcgcgtaaattaaaaatttgtaactggagtgctgttcatgtaagattaaaaaagaagagaatatatgcatagttgtattattgagaggcaacgtgtaagcagtactacctccatattttaatgtatgacatcgttaactttttgtttaacgtttgaccattcgtcttatttaaaaaatttatgtaattattatttattttattatgacttgattcgttattaaatattctttaagcatgacataaatatttttatatttataaaaaaatttgaataaaacgaatggttaaacattggtcgaaaagtcaacagtgtcatacattaaaatacgaaatacggagggagtatgaagtagctagttaatggagagactcgatccttcttgagggtatatgccacaattttgaggagtatatattttctaaaacaaaggcagaagcttcgtcccattccattgataaagaagacgtacacatccatccaggaaaggattcgtaaaccttctatcacaaacatggagtatattttattcaaacttttgatcattaattaatacttgtgtaggtctccctggcataacttaattgtgtattttttttaaaaaaaaggtcaaatgagcgagagatc

SEQ ID NO: 5717 - DNA, 1501 bp, Oryza sativa
gaatctttttcttcttaaataaaggagtggaaatggaatagtgaaaggaatagtgtctctgttaagctttccttcatttatgttcctttcttactcgatgctgttgcctaatatatattcccttatttttatattaaaatgtgcatccaggccacacggttcaaattcttttttttagaacttcaattctaaattggtagtattaattggtgtccactagtaattttaagacacacgcgctcagtgggtccatatatatgctccgggaattttaattagccgtgtgtgaagaacatgcatgtgcatatgatgtctgaatgttgttgtgaaccttgtgtaaggtgtgaggattagtcctcttgactttgtttgtttgggctgtgtacatttaagttggatgtagaggttaggtttttaatccattttctaaaaaaatgtgcatatgatgcatgcgagtgtattttctgtaatatatttgtatattattgaatttggaaaaatgagatgacttgaacttcataacaatatatagatgagtgcgttgaaaatagacgcgcatgtaggtttcattagattctcacgtttgtaggcggatgaaaggtccactattcttctgttacttttgggtatgcggtggctaatcaccgagctactccctccgttctttttttactacttgccatataaaatactggcacagtgcatatatttaataattgaatttcctaatattatcttcgtaaaaattactgtattaaagatataactagataaacatatttttcattataactctgtcaatatcatttatcatattttaaatcttaatatgcatatattagtgggttaatgtatagaagtttgactacacattttctatttatgaaacgatgtagtgatgaatgcttttgtgataatgcaacgttcatgaaatatgtcagaaagaataaaatagcataagaaagtaaatagcaacaagactgaacgtgcatgagcatttgcctttttctttcagcatgtgaacttcaatttagtcaggattatcatggcaaaagaaatatcacttcaccctgccaagaaatagataaattatttgttcgccgcaaaattaatatgcgaaacagctaacggtcctagcgcataagttcggagcatatattcttcttctttccttatggcactcattagcaaggtagccaagaaagctctatataaaccatgtgcatcaccttacactgcctttaacctcctttctttccctaggacctacccctcccctaccctcttgagctttctcaaataaaaaaaaaggaacacctgaatttttttggtgattcaaagagaaaaagacaaagatttgatgggtaacatgcttttatcccctgttaatttcttgtgaccattatttttttctgccttggtttttggatttcatacagaaagtgtgttggtctgtgctaatcttttcctccctctgcgacagcatcttcgagctctacca

SEQ ID NO: 5718 - DNA, 1501 bp, Oryza sativa
agtaacaggcgactgtgcctcggcggccggaggcggaggcgccgggtaccagggctcggtggaggcggcaaagcaagcacctccttccggggcggctccacgaccccatccatgggggatccgggggcggaggccctgccgcgggagcggtcccatgacggggagcggctggcggcggccgcggcggagcgcggggagggggaggaggcgacggggaggaggagttcggaggccgcggcgtcgggggagaagtccacggcggcggcgcggtcgtcgagggtgaagagcggcggcggcggcggcgtcgtggcggcggtgggccccgccgccgaggaggcgaagcgggaggccgcgcggtgggacgggatcggggaggcgaggtcccggaagaacggggactgccgcgcgccgcctccgcggcgcgaggtggaggcgggggagcgcgaggaggaggcggccatgggcggggcggggcggcgcggcgcgggggttgagggtttggacttcgagctggcgagtctctcttcccctttcccacctgcaaccgaccgagctggagaggaggaggagcgggggtgttcgttgcggggagcggagcggatgcctctgactcgagtctggttgctttattgggccacttcgtatgcttgcgtgtctggcaacttgcgaggtccagcccgaattctggcctaattatttcgctcatgattatgattattggggaaatatctcgtgaaaacgagttaagggagttaagggttaaaagctcatgaaaattatacctaaaatttttataaagttataaaaatatgttattataatatatatatatatgaaatatgttctcatcaaatttcaagtccaaactcaactttattcaaaagagacaaagatagcaaatttcaagtgaatagtgccatgttactatgcgttcgaaatttatcttttttactctaataaagttaagtctgaacttgagaggtcagaatgtatttcatatctacatatatttctaataatttttttcatgaattatatttgattttcacgagttccccacacttacctcgttttaacccgatatgtcatctatgattatagaacaaaatttaaattttataacttaattttaaatttaactttttttgtttttctcatcgtagtttattttacaacatttgcttttgaattactaaagagacatatatataaaagttttactaacatatgatttttatttattaataagcaatttgggattaaaaatatgaataagcaaaacaatggattaaacatatgaataagcgaaacaacggggctcttcaccaacggacatgaaaagcactgaccgacagacttgttcaaagggcgagaaatttcatcgaactttgttggaactactcctacaatacaatatttccatatttgcaagaatctaattttgttggaactagtgcacaaagttccagctctgcaagaaagagattcaattcccagtaga

SEQ ID NO: 5719 - DNA, 1243 bp, Oryza sativa
tggattttactttgggacaatgaacaagtatctgtagtttcgaagtagtaggttatcaccttcctcaaagtaacggatcatatgtaccgtatgtccagaggaagcacaaaatgcgtagaggtgacttgtcttgtcaaacatccttggtgtgaagcctcttgctgtgaaagttctgtattcccaagttcccaactagtccatatctactgggaattgaatctctttcttgcagagctggaactttgtgcactagttccaacaaaattagattcttgcaaatatggaaatattgtattgtaggagtagttccaacaaagttcgatgaaatttctcgccctttgaacaagtctgtcggtcagtgcttttcatgtccgttggtgaagagccccgttgtttcgcttattcatatgtttaatccattgttttgcttattcatatttttaatcccaaattgcttattaataaataaaaatcatatgttagtaaaacttttatatatatgtctctttagtaattcaaaagcaaatgttgtaaaataaactacgatgagaaaaacaaaaaaagttaaatttaaaattaagttataaaatttaaattttgttctataatcatagatgacatatcgggttaaaacgaggtaagtgtggggaactcgtgaaaatcaaatataattcatgaaaaaaattattagaaatatatgtagatatgaaatacattctgacctctcaagttcagacttaactttattagagtaaaaaagataaatttcgaacgcatagtaacatggcactattcacttgaaatttgctatctttgtctcttttgaataaagttgagtttggacttgaaatttgatgagaacatatttcatatatatatatattataataacatatttttataactttataaaaattttaggtataattttcatgagcttttaacccttaactcccttaactcgttttcacgagatatttccccaataatcataatcatgagcgaaataattaggccagaattcgggctggacctcgcaagttgccagacacgcaagcatacgaagtggcccaataaagcaaccagactcgagtcagaggcatccgctccgctccccgcaacgaacacccccgctcctcctcctctccagctcggtcggttgcaggtgggaaaggggaagagagactcgccagctcgaagtccaaaccctcaacccccgcgccgcgccgccccgccccgccca

SEQ ID NO: 5720 - DNA, 656 bp, Oryza sativa
gccagattcttgtaagggggtacatttgtcacatcctgattttgtcctaggatttatggttatttaatacattattaatagaattttatattaaatgttctttgatttacaagtgaagttaaatgtgggaaataggatttcctaaatataaagcatggatggatttaatttttattaaattctccatggttaattatactctctggaattttctcggatttttcggagctcaattattaattttaatcatacaaagaacagttcagtaattatttgatcaataatgatctaattataattgttgtttataatccttaaattataaattgttgtttaaaaggaattattagaaatgattttaaaagcttcaaagagaagatctaattttaatttgctaaatctcaatataaaaatgagctagataaaattttattaaatactttgcttgttcctctattttctagaattttctgggaattatttgagcaagggaagtatttttaataattgaaacaacatttcacaaattgttttatttaaaaaagttcaaaaaacccctccctaagccgttgggccgaattcggcccaatactctctctctctctcccgcgcggcccaagccggcccagctcagccgccgcccctcctcctccagc

SEQ ID NO: 5721 - DNA, 1501 bp, Oryza sativa
tattttcccctctctctcttgcgttcaaacgggcggatttgcccccgcaaatctcaccggcgccattgatggtggccgacctcccgcgccggtttccttcccctccggccgctctttcccccttccaactctatttaaaccctccccgcacctcctccgtccgtttccgcctctcgccgcccttcctcctcgccggaatcgagctcgcgctgtcgctctctctctcctccgtcggcgacgacctccggccggctttcttcgctcgccgggaccgtctcccgcctcggcgccgcctccttcggcttcgccgcatcctcgccgacctcgtccacctctccgttttggtcgccgaccgattgagcgctgctgtccccgtcgacctgagccgcgccaccgcctccctccgctccggccgcctcctccgtcgccgccgtcaccccggggtgagccgtggaccgtcgcctcctttcccccttccctcccctctctcggccgccgctccgccgcgtctatggccgccgccggtgaccatcggggcgcgggcgcgccgcctcccgccgaccgtgccggcgtggccgccctcgggcgcgccgagtggctgccacgtggagcccggccgtcagccgcccgcgccctcaggtgcggctgacgtgtggggcccacggcgccggccggtgtgagcccgggtgcgcccggtccaccgtggaccgtgaggctgccgcgtgggccccactcccgtggacccggtccgcgcgcccctccccctcggctgacgcaataaaccctttttaaattaaaaatttaaatgaagaaattcgcaaatatccatttaaagagcatataaacttcaaatggccataacttggccatttgaactcggaattggaccattcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattggatcccattttataaaattattttgatttaaattattgcattatcgctttacttaaattcccgcgttatcactgttttatctagccatgcctatttacctttgttatgaccttattattattgttattgatattattaccttgttcaccctagattaaacaaaaccccaactagtggacactctactcatggtaccactagtatgaatttaggtagatgcttcgctggttaattaggcaacattaggtggttttacaactctagactttgagaatattctcatcacctggacactatgaaatggatggattattgtggaattggattcacacctccccctctattcaaaatcctcaaaatggttttaggctgggttcggggtgcatggttttaatagtagcaa

SEQ ID NO: 5722 - DNA, 1501 bp, Oryza sativa
cagaaattctattcctatatggattctagactactcttccaatcttcattttttcttaactctaaatttaagttatttataaattgtatttcaatatgaactctaaactcttctttcaatattttttatttttttatttttgaatttcaattatcgctaaactgtatttctatattgactctagacttcttttttcaatatttcttttttttaattttagttatttctaaattgtattcctatatggatgctagactttttttcccaagtgttccttatttgttaatttcgaatttcagttatttataaattgtattcatatatggactatgactcttctcccaatcttactttttttattgaattttagttaattctaaattgtatttctatatggactctaacttataattttagttttcctattttttaattccaaattttaattaactctaaattgtatgcttgtatggactctagtctactctttcaatattcgttatttttaattccgaatttaagctatttttaagttgtattcctatctaaactctacttttgaatttcctttgttcataaattctattcctatatagattctagactactcttccaatattaatttttcttaactctaaattttagttatttataaattgtatttctatatgaactctaaactcttctttcaatatttcttattttttttgattttgaatttcaattgttggtaaactgtattctgtagacttcttttttcaatatttcttttttttaattttagttatttctaaattttattcctatatggacgctagacttttttttcccagtattctttatttgttaatttcgaatttcagttatttataaattgtattcatatatggactatgactcttctcccattaatcttactttttttattttgaattttcgttaattctaaattgtatttctatatggactctaacttctaattttagttttcctttttttttaattccgaattttaattaattctaaattttatgcttttatggactctagtctactctttcaatattccttatttttaattccgaatttcagctgtttttaaattgtattcctatatggactctaccttttctttttctccgattaatgtggaaatttataggccgtaagagcaaacgtggtggcttctttttctattatactttccatctaggctcttttttcatatattagaatttttatttctctctaattcatgtggaaatttttagtctatgagagtggtggctcctttttttatttctatttctttattaagataatagattgagtttgccttcttgttttgatatcgtttcggctctatggtattttagagcatcagttagttgctattttccttgaaatatctcacaatttttttcatcgctaaaagtcggatcccttttgatttctttttggctggtagagagtttcgtcactgttttgtactcaatctttt

SEQ ID NO: 5723 - DNA, 1055 bp, Oryza sativa
gtaggcgaccgcttgcgatggtcagggggcatataagcccccagcccaaccgttgccatgaatttccggcgtttctctctcctaaacatccacaaattagggaggaaggttttcgacctcaaatctttgattgtgttccatataaaagatgtagagcttgttctcctccttcatttgcttccatttttgtcagttttcattggtggatacgaagaaacttgcacttttataaatggaatagtgtaggcacatttttgttttttatttttttagcaaataaataatgcaatcttttacttgtttaaaaaagtatttagtacctacattgaaaagttgggtttgcctgtattaaatttattttcatttggatgaaaggacgattatttttattttttagaaatggacaatattatattaatgcttaaaattgttgtgcggttgtttaaaaagtccgtaaaattttaaattactaggtgattagttccctccaatttaaatacattcgtgtttgaatcggtcatggatgtattaatgacaagctttattgtaggtcatggatcggacatggatgcacaacacgaaaagagctcatccaacattcttgaaggaagcagccaaatttgttgagctcgtaaaggcacatgctgtgagggagaatttgaggagcattttttgcccatgcaaagtttgtaagaacgaaattttgctgtaagatcccaatgaagtattgtcgcacatcgtagaacgaggatttaagaagggctacgagatatggacttttcatgcggaagtcggtggtcgtaacgaagagttagatgatttctgttatgatgatgcagaaaattttataatcgaagacatgtcacagggaaacatcccggaatacggtggctcaggtatagagaatgaaggtattgattttgatctggaagatatgttacggcacgttgaaccagaggtcctaactggtacaagacgagggttggacagttgggaagcgttgaaaaaaacagcgaaggagcttctgtacgacgaagccaaaggatgcgacaagg

SEQ ID NO: 5724 - DNA, 1501 bp, Oryza sativa
ggaggtagtggcaaaagttttgatggttacatagacataacaaaatgactcttttgtttgggaggtacataaaaaaggtatgttatctgttaatttgatgtacaaggccatcatatatcgtgatgttgtaccaagaaaagaggtgatatagaagttaatgttgccattgaaaatcaaaaaaaaatttatagtacctaaggaaagaggtcattccaacaaaggacaatttggctaggagaggatgggaggatagcactaagtgttacttttgtaattcaaatgaaacaattcaacatcttttctttgattgccctttggctagatttgtttggaatgctatttttatagcttttggaatccacctgcctactaatgttgctaatcttttgggtaattggttttatggagttcttcctaggcttagagctcaaatacttgttggtgttgcggctttatgttgggcggtttggttatgtagaaatgatgtggtctttaatagcttcaaagctaacttatttttgcaggtaattttcaggtagacattctgggcgcaggaatggtccttgcttcttaaagagggagatgtaggatcataaagggcattttccaccccaaaagctagccattgaggtgagagctcccccacttatatcttaggtccttttcccttccacaactaatgtgggactattcaacaatctctcccttcacacattagtgtccctcagcccttcatcgccccttcactgtatacgggccccgcccacggtccatcaggtatacgggccccgcaggcacccacgatccatcaggccttgacacactgtgtccatcgggccagagatgttaaattagccatactctaataccaattgtaggatcgtaaagggtctttcctaccccaaaagctaaccattgaggtaagggattcccccacttatattttaggtcctttgctctttcataaccaatgtgtgactattcaacaggagatggtcaacttgtgaaagacgcgtgtaggaagctggaattgacaatgttagatttctttgctaaatatgggtggaatcaaagaggaagattggaagtttaagacttttctttgtttggatgttgctttttatgctttttgttgcattgtgcaagatgttatgtggtattgttgttagttgagtctaagtacttgtgtgaaaattttggttgtctttctccttatgtaaggggatgagtctaagaactattgtaagtttggttggttgtatacatccgtctctagatgtagaggccggttattccattatctttaaaaaaaagtagtgatgaaagatttgtttgttcagttcagataaaaacactaaagtaattctaaattatgttatgaattcaaaatcagtcatatcacaaataggcatgcccaaggtcaccagattcaaggcctcaccagttcggttggagaatttagattatctaccacctaattcgcgtgcctcaacttttttac

SEQ ID NO: 5725 - DNA, 1373 bp, Oryza sativa
tagcttcaaagctaacttatttttgcaggtaattttcaggtagacattctgggcgcaggaatggtccttgcttcttaaagagggagatgtaggatcataaagggcattttccaccccaaaagctagccattgaggtgagagctcccccacttatatcttaggtccttttcccttccacaactaatgtgggactattcaacaatctctcccttcacacattagtgtccctcagcccttcatcgccccttcactgtatacgggccccgcccacggtccatcaggtatacgggccccgcaggcacccacgatccatcaggccttgacacactgtgtccatcgggccagagatgttaaattagccatactctaataccaattgtaggatcgtaaagggtctttcctaccccaaaagctaaccattgaggtaagggattcccccacttatattttaggtcctttgctctttcataaccaatgtgtgactattcaacaggagatggtcaacttgtgaaagacgcgtgtaggaagctggaattgacaatgttagatttctttgctaaatatgggtggaatcaaagaggaagattggaagtttaagacttttctttgtttggatgttgctttttatgctttttgttgcattgtgcaagatgttatgtggtattgttgttagttgagtctaagtacttgtgtgaaaattttggttgtctttctccttatgtaaggggatgagtctaagaactattgtaagtttggttggttgtatacatccgtctctagatgtagaggccggttattccattatctttaaaaaaaagtagtgatgaaagatttgtttgttcagttcagataaaaacactaaagtaattctaaattatgttatgaattcaaaatcagtcatatcacaaataggcatgcccaaggtcaccagattcaaggcctcaccagttcggttggagaatttagattatctaccacctaattcgcgtgcctcaacttttttaccacccaattcgcatgccctctataatatgtcattagaactgctaattgctctatttgataccactttctcagtttttcattatttctcatttcttaatcccatttgattttttctcaaactttatggactgttttgtccctgggcccactgtcaaatgaaaggaagagaaatcctcttctctggatcgatcgatctctcgctgtagcgctagcccgagcgcgacgagctcctccgccggcgagcacctccgtcgccgggcgccaccaccccgccgccgagcgtcgcccccacgccgacgagcgccgccaccccacctccgagcacctctgtcgccgggcgcccccaccccgccgccgagcgtcgcccc

SEQ ID NO: 5726 - DNA, 1243 bp, Oryza sativa
aattgagtctggtcgaaatttatctatttcgtttttaactaattgactgtgtaatcagagcagtttgcaatggtttgacagccccacggtcaatggatacagttggcatctcaactaatgaatttaaatgcaatagtttgacagccctacggtcaatgatacagttggcatctcaactaacgaatttaagaaacgttgaatgaaactattaaaaaaaatcaagaaacataagctgtgcacatctacctatcaaaccatacagggaagcaccattcgtgtcgttagagttgtgagtgtacgactccattattacggtttaaatcctaattaatgttcagagactatggttgtgcataccattagttggtgtagaaattgcaagttatactttgtaaaaaaaaaacatcaaaccatatgcacagcttccgagtcttaactcctttgcctcaacctcaaagcaatagcagatttgattctagtgcattctatttttttttcttggagaggtagtgtagtgcatttgtttattgttttgtacatcaaaacatgtcctttttgaaacaagagttaaacttttaaaacttgaacattagtatcttctgaaacatttaagattagactagatacgcgctgcaaatctcctaatcctgctccatatccgctaatcacgctccaaatccccaatctcgctttccaaaaaccacgctttctttctcctctgaaatgtatctctatatatacacgaatcgagttggtgtgcaactgtacatactcgagcaggcagagcaaccaggccatcagatatctccacggtatgcaagattattcagacatgttatctcagtcttgctttatctttctcattagtatttggaatatagtgttatccagtttttgtgatatatatatatatatatatatatatatatatatatatatatatatatatatatatatatatatatatatatatatatatatatatatatatatatatatatatatatatatatattgtgccaagatcattggcatattggattgtgcggctgtctcggttggatgactatgctctctttctaaaataagagttgaaacttatcggatgcgtgtttatattcttgatgagggaatgaacaggggtgataacatttaggtcttaatcaaactattcagtaaaatatttattaaaattatggcagtcattgttcttgctacttctgaaattgtcttcgcatagaaa

SEQ ID NO: 5727 - DNA, 1501 bp, Oryza sativa
cgatataaaagcacaaacttcaattatacattattcaaaccacagaggtcacaacacaatgggaatataaactataagtcttattctcacaaacagtttaactagtaaacttaaccataggaacagcctgagcatagagtgacctagaaaccgtaaccataggtccttcaaacaaatcatagaaatcaccaacatctacagcatatcatcgtgatctaaacccatttatgagtacagaaggtactcagcaagcatgcttgtaataacaaatataatgcattattttggaatgaccatcttaataaccatttgattaaacatcattattaaacgtttaatataaacatcattagtaactaacttaaacaaatctagttacctttagtgatattattaaccattttatctgataatcatttcaaccatattaattaatagccaactagtttaacttgcacccttactctagagtcacccacagacacatctccattaaccgggaacatgtcatattcgaatacaatacgtatttgcagcgtctacccagctttacccgcatgataccctagctggccgggctaaaaagtaagaggcgcaatactattccaagcttttctccattccacatagtaggttaaaggatgtaaatattggtatttggcctagggtgatcctagcgcggagtgtgtcctgacatacctcaacatccacttaccattgcaagactcaggtatcccatcaccagagaaagcgccgagaacattgttgctgcccattttgtcactgccggataaggctccactctctcgcgcgtgcatggaggaaccggcacttgccgcgtcgccgccaaagagggtgctcccctatctcacgactcttcgaatgttgtgatggcattagatggtgtgtttctggcaaccgaaggatgtggttgtgttcagtcaccaaatcatatatatagctcataatttccttcaactctgtttaatgttattcccatatgaacattgcagccagttcttgtctctactagaggatttttggttagataatctcttttatgttttcctcgataaccagcacttgagcaaacaaaccatctacttgggcccatctgctgcacttttgttattatactgcttcctaacatcaaagccaatcttaccaccatagctaacccaaaatttccaagcctcgtctacacagctaaacttcattccagtcctaggcatccaacatggtgtgctatccattctacaaataaataagaaaaccatctgtgacatatgtttgattggaagatgccccaaaaactgctattgaaaaccaatgaaataataagaatagatgcaagcaacaaaccttcacttctctgcattttggttgatcctactttcctccatctcctgttggctcatatttgtggaagcatctttggcgctaagagaaattgggagataagtagaacacatgatagatagaaatatgcctcaaaatttgt

SEQ ID NO: 5728 - DNA, 1501 bp, Oryza sativa
tgtcaatagaaggcagccgattaggttaaataacgtcgttgacttagattatgtgatatatctaccactctatgaaacatccagcggcttgattgtctagatattgttcttcttttcatacttaatgctgcatcagttgagtttgatctattaagtcgtgcttagaaccataatatctagcctgccttctggttgccgattagattagtatcggagtttcagccgatcttacctgatttaactattttttatcctatatgcttgattgataggttaaatctgtcctttatattaagatcttgttgcatttaagtatattaagcttctgtttggtatattctgtttgctttaatatcttaatatagagtggtatcggagtactagccgatacatgctagatctatctgatcggctatgctatgaatatatataatctcactattaatatatatttcgatctaagtgatttatactgtctcggcaaggtgatcgatctatcccaatcacttgatttaagtatatatcgatgtaaggattatatgtcattaatatctacagccgatcgagtagatttagttctgatttgcttactaatacttgccaatcaatgcacatatgacatcggtctaaaataaatgatatgtcatcggcacctagccgatcggctatcatttatagatttaaccacggtttctttgtctttgtttcttgttgattacaggatcaaatcaactagcacgctcatacatccgaaggcgagttttggacctgcactggagttaagcagatctcccaggcctcgtgttttctgtcaacagaaaggtgcactactttgaattgtgttatgcagagagtattgtcacaatctctattcgggtacttgttaagtatcgcgacgcatggttgacatgatgttgaggttgtgtcttgtgggtacagtggtacacctctggccagagtaaaactattcgaatagccgtgcccgtggttattggcgggtctaacaatgtctttcgtgattagtctcatatctctcaccataataaattatgatgataataatttgtttagctcctggtttggaatggtatattcctggtttggagatagaactgtgcagccgggattggttgttcagaatggttgggcctatgcaacgggtatattgtatagcgttggattaatattgtttaattaaatactttactgttttattaatttctgaagtatttattaaatgccatttatgcaaatgagactatattatgccatcctttgttatcccttgcatttgcatatttgctgcatggcttgttgagtatgtcatatactcaccttgcaatcattcatcagaggaggagttctacagtgatgctgaaggtgtggaggattaggcgtagccttggtcaagctgcttgtgggttggagtcgcctgcgttgtttctcttattttccgctgcttagatatttaatgtttgagaggaactatctacctctgtaa

SEQ ID NO: 5729 - DNA, 1501 bp, Oryza sativa
cccaacgatcgccattgttctgagccgttgtgagatgcctccttgcgtatccattagccatttgatgatcttatcctttggtccatcgattccaacaagtctctccgcctccgtgtagagagcggacaatcgaggatcaactgatctagttctagaaccggaggcatctctgtgcagatgtgcttcagagctcatgctggagatgttcatcgtgtcgtaccttctgtaccgatcgctctcgtccatgacacgagccttcagctcttgtatccgcccgctgatccgatgcgacaactgtagccccttgattctccatgccatcttcttgatgaccccggctttcccggtgagggagccgaggtgatgcacgaagaggtcgatgcaatcctcgatgtcgtaggccatctcccgcaccctgtccctctactcctttgtctgggcatcgatttcctccatgtctgcgagcctctcaagcatcgagttcatgctgcgaagctcgctctcgaggaacctgatctccccccttaaccctttgagagatttgtgttcgcttccgagcaggtcattgagcttgaagagaagagagttcagtgcccccgtcagagcgcttaccatggctccctccatatcgctgctgagctgagatattctgcaggtaggcacaatgttagagttgtcctagcaagtgttactatatgattactagaagagactatgcaagtctctcttcttgagatgcacaccatttgcaagtctctcttttgcaaacacgttattgctaacgtttctttagttgttgttgactttggacaagtacatatttggtacccaaaaacttagcttaatacgcctctagattggtgcatgattaacttaacaattttcttttttctgttacacgcatacagtacaagataaaattaacagatatactttagggaaagtggaggatctcctttagagtggactcaaggaataactagtgcaagatgttaaatgttaggagttgttttttctttccattattagaaaaaaaatgttgtcttcttgtacctctgcctgcctgagtacttagcatttactgaagccctaaatggtcagagaaagagagagaaccatggctttaaaaggtcacaaaaggcatgcatactactacacattattaagatgctaccagttgcaagcatagttaaaataaccggaccagcagtcaaatcagtagtgctttcattggttcattggtctgaccggtgggtcaaagctcaaccgcggaacaatgttttaatatatgtacttatatttaccacaactaacaatcagtagctcatggggtcctactgagagatcacccgcactcccctccccctatgccgattccttcctcttctccccctttctcctccccatcttttcttcctattacagtacaccataatttttttttaaaaaaacaaaagttagaaaaaattatggatagaaataggatgaatagctaatttag

SEQ ID NO: 5730 - DNA, 1501 bp, Oryza sativa
tacaaactgatgattacacggcttatgtagcctcgcgtacatgcacatatagctacttcctccgtttcacaatataagtcattctagcattttccacatttatatttagattcattaatatcaatatgaatatgagaaatgctagaatgacttacattatgaaacggagggagtagctaacagcccgaccgggtcgcccgcacgaccatgagccactcactcacacgatctatgcgtctcacgcgcaagaatcgctcctccgagctgactaaaccacgccacaaacatgctccactaatcttgcatgcagctaactaattcgccactaatcctcttattccctagacttgttcagttgctagttatgctgcaacacatgcatcttccaatcactagcactaactaactctacatgcaaagcttggactaaccattgtttacatgacacacatatgcatctatctagtggatcaacataaacatatcacgtgcctatctacatgcaactcatgcaagactaaaaacaatatgcaagtttggattagtgctaacatcgcttttgtcaacgacaagaatgctgcaaaaccagattcagctagcatagtaaagccgacatagacaacatccaactcttgaataacagatatcctggcttgtaggagcgctgccagattagggctgagttacttgttgttagagttagatgtgtttctcttaaaaatgatagcatacttttttttccagatttagaataacactttagcaatcttctctctctttctttcagctttttaccattcttcaaaatgtactaagagtcaccaaacattataatttgtgagacaccaaaatttggtaccttcgatattaaggccctgtttagaagattagcaccgggctaattttgagagctaatgtttagtcttgaattggtaggctaaacattagcctagaatgatatatttggatccatgagttaattgagggctaaaaggtgaagagagaggagagagatggggggagatagggctgcttttcgatggtccccataaaaaattagccccattatcatcccttagaggggctaatgtttcgaggggagctaatcactactacgaaaatcatctttcgtgacggccatttttggtttttcctggcggaaattgcagccgccacaaagcaaaggccagagaaaatatcaatcttcgctagcggttatcggccgccagcgataatcgattttcactggtagctgtgttatactggccgccagcgataatcggtttgagaaaaaaaaaccatatgcagctggcctccagccgccagcaaaaactccatgctgctacctgcattcccaaatccacatccccaaatctcaaatccataacaattcaaatccacatcagatccaacatcaagagaacactacatcaatttctcacttcattctcaacaaacaaacatcaatacatgcatatatgaaacatcagtacaaacaaaa

SEQ ID NO: 5731 - DNA, 1501 bp, Oryza sativa
  unsure (1)..(1501): unsure at all n locations
cagaaaacaaacagagtacgccattaagcacccgcttttaagagacttattcaagatatccgttcgtccatgcatgcaggttaattaataagcaatataaaattttatgttgataagtgaatctatgctgaaatttttattgtaaaaatattagttatatttaaatttgttcggactcaaaaatctttccgaaaataagtaaatgtgcaaactgaaccgtgagcgtctgaagtgttgggcgtactatacctttggtcggaacgtgacggagagtggcggaacacaactagtagggcggcggcgggccgggggtgtaggacggcggcggcttgtggtacggcggcgttggcgtcggtgtgtaggtcggcggcgtcggagttggcttgggggtgtagggagaaggagtcggcttgggctgcggcttgtacggcgtcggcgtgggagtcggcttgggctgtggcttgtaggttggcggcgggttcggcttgggcgtgggagtgtagggagtgggagtgggagtcggcttcggttgtggcttgtacgtgggtggagtgtagggagtgggagtcggcttaggctgcggcttgtacgtgggtggcggggtcggcttgggctgcggcttgtatgttgncggtgtgggagtgggagtgtaaggcgcaggcgtcggcttgggctgtggcttgtaggtgggaggcgtcggcttgggtggagtgggggtcggcgtgtacgtcgggggagtaggggtgtgagccggcggcgtcggcttgggcgtgtatggcggtggcgtaggcttgggtgtcggggtgtacgtgggtggggtgggcgtcggcttgggcggcgtgtaggccggtggcttgtgctccttgggtggcttctccggcttgggctcgtggtggtgcggcggcttgtgctccttgggcggcttctccggcttcggcgccggtttcaccggcgtcggcgtcggcgtgtacccgccgccgtagccaccggcgtccgccctggcctccaggacgacgctgatggccaccagggccatcaggagagcggccttgccacccattctcactcactctctctcacactccctctacttcactcccctgtgtaagctgcccagcgagcttgcaggtcagtgtgtgtggaatggctctacccatggcaccgcattatatacacggtggaggcttggatggtagcccggggaagcgggcatgtgacacggcatggtggtggcggtgaggggattggcgtgcatgtgggggagggggagggggtttcgccgctggtcacattgtgttcgctgctggtccagtcggggcgccgtggtggtctgaaacgtttgacgtacgtgtaggtcaggatcactgtacatagcttagtactctctagctgtttaccagggatggcccccggtggagcaggtcgtatttaggtggtgtttacatccagggacttaactttagtccctgtctttagacactaatttagagtattaaatata

SEQ ID NO: 5732 - DNA, 1501 bp, Oryza sativa
gtatctaaaataagtgcagagtaaatcgtatgtatcctttcccgcccagctaatacaccgttttggtgatttgaccttggagtcacatgacgaactgtaagcgagcttaataggtgcactttaattttcagctattccaatagtgctacaattcacatagatcacacaattaacgccaagatacccacaccatggacccatcacatctataatagcgaagtgaaataaccttgtcgatcaccacatgtgaaaatgccaagcacactgctgcgaggaaatcgacatactcgttgggtttcatgcattatattctgagtgattataaaaacgtgctggcagcccagtaacagtagtagccgagagcaccatttttgttttctcctcgatcaatgaacgtctttcatcaccgacacaaaacacacagccgccatcgatcctcacgtgcctctaccacacagattgccagattggtgcttgattgttaagtattattattactgcgtgataacgtgcgtaccacaaggttaattaggctaagagcaaagataataatagcgctcacttcctactattaatgtatcttaaagccaacatatataatggattagctataaggctagctataactttcttcttctctctatctctcacctatgcatttaatgtatttaattagaagcttgtgttaagctaacttttacattagagccaacatccttgatttttttttatcgctattcttcacgtaagctcactattatacttgctctaatagagtagtactgctaaggctaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccacctaaatacgacctgctccaccgggggccatccctggtaaacagctagagagtactaagctatgtacagtgatcctgacctacacgtacgtcaaacgtttcagaccaccacggcgccccgactggaccagcagcgaacacaatgtgaccagcggcgaaaccccctccccctcccccacatgcacgccaatcccctcaccgccaccaccatgccgtgtcacatgcccgcttccccgggctaccatccaagcctccaccgtgtatataatgcggtgccatgggtagagccattccacacacactgacctgcaagctcgctgggcagcttacacaggggagtgaagtagagggagtgtgagagagagtgagtgagaa

SEQ ID NO: 5733 - DNA, 611 bp, Oryza sativa
tattaaaaaacggaggaagtatttgtttttttttgcacggagagagtatttcaaagagtccaagggatgcaaatgattttgtaccgtagcagtacaatctctgcttcaaggtcttgaataaacaagcggtaccacgctgtatcgcaattgaatgctactcatctgcattgcatccacgtacgtggagatgagcaaaaaataaataaataaatatagtaaaccgctccatccatggatggcaccacccacaacaagctagcccattaatttcccctgtttttctgtttggtccacaagtagatagggcacactcttgatctggacattcggtagtactaccgtttaattgcctgaattgaattttgcttaattgcctgaattcaattttgcaaatggttggatgtagtagctgtgttattgggcttcttttactctagctatgagcagtagtgtacatctctatgcaaggcattattttatatttcctgaaaaagatttatgcatattacataagtagtatctggacctatatatacatattgcagaggtccctgcaaggagtaattaatcaaggctgttttactcctatcacaattattaaagaatcatca

SEQ ID NO: 5734 - DNA, 1501 bp, Oryza sativa
  unsure (1)..(1501): unsure at all n locations
gttcatttcgcacaaatcggaatgaacaagttctagaggtgccaaattcctcgcctcagatgacttgtgaggcttgcgaggttgtttcgattggatgcaagtatggcacttggaacctttgaccaaagtaaattttggaattaaactcatgttagctaagcgcgtcatacaaccgaaattcacatgacagagtcacgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacccaatagagccgctaacaagattcttctttattgaagggacatgctgcacgttcttcagctgcacggtctttcccgaagtaaacttcagatcgaccgtaccaacaccatgaacagccgcaagcgaccccgtttccatcaacaaggaggaacctctcccgacctgataagaagaaaacagagaaatgtcagcacatacatgaatattagcaccagtgtccacccaccaatcaggtaagtgaagaacagagagaactgtaggtaatattttaccgtaccccgatgttcctccgccctcgctaatgaccatgttggcagactttctgtctttgcgctcaggacagtccttggcccaatgccctgacttgccacacacaaagcagtctccctttgcctttcccttgcctttcttcttaaagttggttgcagccttgggtttgacatcaggtttgactttcttggtgttgtgggatgcatgagggttcttcttctgtaccatattggcactagaacctncctcaacctttttgccccgaacgtncttttgcctcgccttcttctcaacacccaaagagccaatgagatcagaaacactgaactcttgtctctgtgctttagagaagtggcaaagtccgaccaagaagttggcagtttggcaataatgccacccgccacaaacttgtccggcaactcacagttgttggtctcaagtttcttagccagcatctgaatctcatgaggttggtctactacagaacggtcatcgacatcttgtagtcatagaactggtccatgacatacagctcactgccggcgtcagaaactccgaacttggcctcaagtgcatcccacatgtccttcccggaaggcatgtgcatgtacacgtccactatattgtcagcgagtacactgatcaatgctccacggaacaggcaatccaaagcctcgaacttagcctcttcctcaggagaaagaggtggttcacttcgtttgccccgtgaaacatagaagtactgcatcgctgtcaaccacaatagtgcacatgctttccatctcttatagntaagaccatcaaaagcatgtggtttcagtgcagcagcaaagccaactaccgaaaatgacctat

SEQ ID NO: 5735 - DNA, 1501 bp, Oryza sativa
atgtttgacttgtcgctatgctaaaaatgcttatattttgggacagagggagtaaatattagctaaaaagctttaaaatggattaatatgattttttaagacaattttcctataaattttttttgtaaaaaatgtactccctccattctaaattgatctatatatttcatatgtacaccaagaccaagaaaagctaataactctctcatactatatttactctagcaacaaactcgatgcatgccccatccctactatttcctagccaatagcaaatcaagatattgcatgtgggttataaatacttgtgtgcatggatgcatgcatcaatatccatttactccaatacacaaataacgaatagacttaatgaatgaacactaatatgtagatcatttaggaataacctaaaaaaaactatatgtagataaatttggaatggagggagtaccatttagcaatttgggaaacatgtgcatacaaaaagggaggtgaagttggaaaaagtgagaaaaactgggcacctatcaaaagactcgagactgttcttacacggccaaggtgtggcaactggacatgcctaagggcaagggcaatagaaaagacgactgcttactcttaatctttatacacgccatttagaggcaacttaatagataataaatataatagttgtctcttcatatttactgcaacactcatattaatcatggtttaattatttctccctcacttcttcccagcttttctctttcctccaagccgatcaaggaaagatcattcatgctaatttcttgttccgtccatggtgttgtcgataggaaggcgctaagccagccggggcggattcagaataagattttttttgggggggggggggggcttctttgttcagtccccctactcttcattttctccctattttttccctttcatctccccttctatcaatggtgatccagtggggtagggggactcgagtccccccagcaaccacgctggatccgcccctgcaagtcggcgataggagcattggtgcctgtgcatgaccttcgacagattaatcgacgacgtttctcattcatggtactctctctccgccacatagatataaaatccaaattagccggtaatttcacgttattgtacttgccctaaggcaagtgcttctctcactctcagttagccttagaaaagacagcaaaacatgccggcctggacatggaaacaacgttagccacatgacggtcgcacactaactgtcatcttggagacctggactaacaggtaaaggttatattgatgattgaacgcaacatattgaggaaatactaacaaatataaaaatttaatgatgtacaggccagccttttcccttttctttttaattaaaacctactgtttttcctatgtaattaacctacatatattaccttgagaaccacccacccaagtggttatgtgtagtggcaaaccaatacagagatggcatccacactac

SEQ ID NO: 5736 - DNA, 1501 bp, Oryza sativa
gtggatgccatctctgtattggtttgccactacacataaccacttgggtgggtggttctcaaggtaatatatgtaggttaattacataggaaaaacagtaggttttaattaaaaagaaaagggaaaaggctggcctgtacatcattaaatttttatatttgttagtatttcctcaatatgttgcgttcaatcatcaatataacctttacctgttagtccaggtctccaagatgacagttagtgtgcgaccgtcatgtggctaacgttgtttccatgtccaggccggcatgttttgctgtcttttctaaggctaactgagagtgagagaagcacttgccttagggcaagtacaataacgtgaaattaccggctaatttggattttatatctatgtggcggagagagagtaccatgaatgagaaacgtcgtcgattaatctgtcgaaggtcatgcacaggcaccaatgctcctatcgccgacttgcaggggcggatccagcgtggttgctggggggactcgagtccccctaccccactggatcaccattgatagaaggggagatgaaagggaaaaaatagggagaaaatgaagagtagggggactgaacaaagaagcccccccccccccccaaaaaaaatcttattctgaatccgccccggctggcttagcgccttcctatcgacaacaccatggacggaacaagaaattagcatgaatgatctttccttgatcggcttggaggaaagagaaaagctgggaagaagtgagggagaaataattaaaccatgattaatatgagtgttgcagtaaatatgaagagacaactattatatttattatctattaagttgcctctaaatggcgtgtataaagattaagagtaagcagtcgtcttttctattgcccttgcccttaggcatgtccagttgccacaccttggccgtgtaagaacagtctcgagtcttttgataggtgcccagtttttctcactttttccaacttcacctccctttttgtatgcacatgtttcccaaattgctaaatggtactccctccattccaaatttatctacatatagttttttttaggttattcctaaatgatctacatattagtgttcattcattaagtctattcgttatttgtgtattggagtaaatggatattgatgcatgcatccatgcacacaagtatttataacccacatgcaatatcttgatttgctattggctaggaaatagtagggatggggcatgcatcgagtttgttgctagagtaaatatagtatgagagagttattagcttttcttggtcttggtgtacatatgaaatatatagatcaatttagaatggagggagtacattttttacaaaaaaaatttataggaaaattgtcttaaaaaatcatattaatccattttaaagctttttagctaatatttactccctctgtcccaaaatataagcatttttagcatagcgacaagtcaaacattttta

SEQ ID NO: 5737 - DNA, 472 bp, Oryza sativa
agtaccttttgccctgttcgaatgtcatgaatgaataaatattttgggcagcacacttcgcaagctaaacgttatgattttataaaacaaattctatatatacacggttagtagaatatgtttttaaaaaacaacttttcaactttgtaatatagttaattgacagtttcaggttataagatattttgactttagtcaaagttaaactgcttcaagttgtattacattaccaattaatttttattaaattaataattaaatatattttataataactttatcttgggtcgaaaaaattattattttttttataaacttggttagtttaattttaaccaaagccaaaacattttataacactggtggagaaaccatctttcgtcggtcggccgaattccacaatagtccccgatacaaacaaaaccggggctaaagatgatctttagtcctagttaaaaagggtaacgggcat

SEQ ID NO: 5738 - DNA, 1501 bp, Oryza sativa
ttttgtctttgctcattgcttttcaagctctccctctcaatatttaaaatttaggcaattttctcttcgaagagtacacaaagcacatatttgatttcaattaggggtgcaagtgggtttacctgcaaacccgcttatagacaaaaatagtgcgtaaccccccggtttaactagcgggttaactatgaatttaactataaataggtttatagatcgatccatttgtatatttagatgcagcaagttaggccacgatgcgaaaacccataaattattatttatttaaactcacggatcgatccgcttgtatccctaatttcaattcataatgagatttgtgagaggatgagtaccaacattcaacaacaatggcatcatcatccttggaagcctacctcgtacggctgtccggcgccgacgccccggacggacaagtacaccacccacccggacacgaagcaccaccgcaccacctgccccgccaccgccaccgccgccttacttcgccggcggaagccgtccaccgtgcacatcaccaccccgttgaaggtctccgcgccggcgtccacgtgcctctcgacgcgccgcgcgcgcgtcccgaaccggccgtccatgatccgcctcgccatctcctcccgccgcaccgcccagtccgcgccctgccgcccgaggtggtagctcacgtggacgggcggcggcggcggcggcgtcgtgcgcggtgcgtccctcgccgggctgtcccactcggcgaccacgtagaggacgtgctccggcagcgccgccaccgatgccggctcgtcgccgtatccggcggccatccactccggctgctcgtaccgggacggctggctgcagtagtgcgcgtcccacgctgggaggtggtcgccgccgccgtcgtcctgcgtcatggcctgcaagcggtggaagctcccgaaggcggcggcggaggcgaagcggaagtgcggcggcagcgcgtccatggaggacagagcgagcgccatgacgtcagcgctctcagagaggtcgagctccacgaacagctccagcttctcgccggtgccgccgccgtccgcgtacaggaacacgacgtgcgcgcgcgggcggcgccacggtgatgtgaggtccgggaacgcgaacgcgtgcgccgtggcgcccggcgacgccggcggcttgacggagaagctcaccgctctccgcgcgagcagcgacgccgcgaccggctggaacggcacaaaccgcttggcgcggccgccgctctcgacgagcttcacgaagtcgcagacgccgtccgccagccgctcgaaccgccgcacggtgccgccgctcagccgctgctcgtctccgccgccgaaggcgaagagcttcttgccggcggcccgagcaacgcgcctcggaaaccaaaggcggcgcgcatcatcatcgtcgacacacaggcgccgccgccgccgccgcctgtactcccgcaggacgcactcgccctcgtcggcggcgcgcttgagct

SEQ ID NO: 5739 - DNA, 264 bp, Oryza sativa
aatgttatatttcacatctttggcgattataatgatcttggaatatattttgtgcatagagtttacatctgctcagatttagaacttcctgtacatgtggataaaacatgcaagctagagaaaaatgttcttgctaaccaaattgtctcgagtttgccttgtttgattggaagaaacaggttgttgtaaatggactacgcaaagagcaccatatggaaaaaccgaggacggttttccatgatgaaggggaggatgatgtgacca

SEQ ID NO: 5740 - DNA, 1501 bp, Oryza sativa; identical to SEQ ID NO: 5509

SEQ ID NO: 5741 - DNA, 1501 bp, Oryza sativa
cttcttgcagaggccatgcgcagcagctgtcagctagtggctgctccacggggaggttgattcatgcggtgtgttgctacgtctttggattagggaactttttttttatgcaagaggtggttttgattgatccagagttcgcttcattttgtttagtttcgggaaagtaaatgttttcattgatgatccaggagctacggatttttatccagaatgtgtcagtagaattgctgcgtatcaaacctcagctagttgtttctactcagatctggacgcatcccaagtcccaataaaatggaaatggcttgcagctgcactgtattaattaggattttgacaagttcgatcgtggttgcaggtggatggcatataaactactacagtgaatggtgatatgttagacttgatccgtgtccctagcctataaatatcagatttggtagtacctgatactaataaggattgatgagacccggtataagtaggtatcagatcaatctggtactcggtaccaatacgtatcaggtcatgtatcatgtaccaacaataatcaggcttattaccgatacgggaatgctaggggacgggataccgtcccccaacaggatagctcctctccacacgcgattcttatccatacattcacttgccgctgtcgccgtcccccgccgctgccgcgcccgtcccccgtcgcctcctccgccgcggccaccgccgccgccgcggcgcccgtcccccactgccgccgtcgctgtcccccgccgccaccgccgcggcgtccgtcccccgtcgcagccgctgtcgccgccgccgcgcccatcccccaccgccgacacgcccgtcccccgctaccgccgccgtcgccgcgcccgtcctctgctgccgccatcgccgtcctcatctacaagggacggctgctaggggcgaccgcgcgtgtcggggtgctcctcccccaacgggatgcccaactatatctagtaggaatcacctgatacctggtaggtatcatctaatacctcgcaagtatcacgtgatacatggtagaaatcgtctgatacctcgcgagtatcacgtgatacatggtagaaattgtctgatacctcgcgagtatcacgtgatacgtggtagaaatcgtctgatacatgacaggtatcgcatgatacctcgtgagtatcacgcgatacgtggttgaaatcatctgatacctaacaggtttcacatgataccttgcgagtatcacgcgatacgtggtagaaaattgcatgatacctgataagtatcacatgatacttgcaggtatcacctgaaacgtgtgtagaatcatctgatacctgataggtattacacctgatacctactcgggatcatctcgttcgaaaacgagataccgttatatagcagcccccttaccgatacgtatcagacccgataccaataagtatcaagattggtaggtatcatgtctgatacatattagatctgatactgacaagtttcaggc

SEQ ID NO: 5742 - DNA, 996 bp, Oryza sativa
cggcgaactacaaagacttcgccatgacgagttcggcattaaggaggcccaccaggctgcccccgacctttaaggccccttcaccatagaccaggcccagcctatcggcccattaaaggcccatatatgcaaatgacactgtgtacccatgtaaatatcccttttataagggcaaccatgtaaaatcccctgtaaacctaaaccctaggaggtgtaagcctgtgctaaggctataaatagacccctagggccatgtaatgggggatcccaagaaattttatcaatcaatacacttattgcttttccaacactgttgagcaaccacgtccttcgacgtgacgcagttgtccatttgacagcactccctctgtcccaatatatagctaagacgagcccatcctacttgctatatgttgagacggagggaatagtttttatgatattatttttatagtatggtagcataaatatatataaaactatacttctacgaaagtacatattgtcacaatatattttcattggatatgcaacaacctatagttggcaagtttatttatctttctttatcttttttttttctggggtgtctaaaatggccatttctgttattaattcgatcaaatgggcatctcatgattaggctattgtgaaactggcccacctagatttaaagttacttagtacaggtgcatgctcacattttttttcgattaatatcagaaaataaaaattgctcttatgctacaaagtcgaagagtgtactcacaattgccacaaggctgattgatgttgcaaatttgcaccttagttcttttttttttgaatgaacatcacctgagagtatggtgttttgtattgatatagcagaaaaaaaatcacaagactatagccctacgatgttataatcgggcaaaagaaaaaaaaaataggaccaccacgcaccgacggcattacgcacacctaaatttaattagaaccgcccgcctgccacta

SEQ ID NO: 5743 - DNA, 1501 bp, Oryza sativa
gagtaaaactattcgaatagccgtgcccgcggttatgggcgggttgagcaatgtttttcgtgattagtcccacacctctcaccataactatggatgttatactgggtaataatttgcttagctcctggtttggagttagatctgttcagccgggtatggttgttcagaatggttgggcctgtacagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgttgtgtggcttgctgagtatgtcatatgctcaccttgcaataatcaatcaacctcagttgaagaaaaaggatcccgaaggagaagacgtttggcttataccccagttgagctgcctgtgggagtggagccggagcttcgctagattttattttccgctgcagttttcttcttgttgaggactaagtgcctcataagtaagtatttatcgtttttagttaatttgatgaatctgtatattaaattgtcagtttgtgtacctcggctgattcctggacgaggattttatgcacaaataagttcggaaattactagtgaatttccgggcgtgacaggaggagctctggatctggatctgccgccggccctcctcacctcgccgagctgccgctgctggacctcctcgccttgccaagccactgcgccgcatgacctcctcctcgccgaaccgcaccaaccccgctgtcggccctcctccttgccgagccgccaccaccgctcctccttgccaagccgctgccgaccctcctcgccttgctgagccgccgctggacccggcctcctcctcctcgccaagtcgctaccgactctcctcgccttgccgagctgccgcagccggcggacctccttgccttgctgatccgccgccgccgctagacctccaacttctcgcctatcccgcctgtggagattatgggtaccatatacctgcatagcatggatatcctactggttgcgggggatagactatgtagatagattatgttaggaaaggactcgggtattatgctaacttgtatatcaaggaaatatcccgtagtcctggttagttacaattgtaatatatctgttagcctaggctgtaaggcatatgggtagtacattgtaatctcggcacctccccctatataaggaggggttcgggtgctcctaggggcatagacttatcccccagatcgtcagatcaataatacactcggcgaaatatttccccggataggagtagagtattacttctcatcgagaagtcctgaacctgtataaacctttgtctcctgacccatccacttttctagcttgattgccacccccttttagtattgctgaaatcttatttcaacagttggtgtgtcaagtaggtgttgcgtcaagtgtttggccgactagtgcga

SEQ ID NO: 5744 - DNA, 1501 bp, Oryza sativa
ttgtgagcacatggttttgagagtcgtgctcatgacaattaaggaccggttcgcgagctactattgtgaaacattaaccgtgccaaccacaagccagcgtgggcaacggctttacctttttgtatagcatgattcattgcggagcaccagactgagaagtggcggagataagcccacgggggtcgctggggagtccatgccttgttttataagggggtgattatgatccaggaatggtgcactgtcacaccctgattttcgtttcaggatttataaattatttaataaattattaatagaatttatattaaatgttctttaatttacaagtgaagtaaaatgtgggaaataaaatttcctaaatataaagcatggatggatttaatttttattaaattctccatggttaattatactctctagaattttctcggatttttcggagctcaattcctaaatgatacaaagaacagttcagtaattatttaatcattaaatgatctaattataattgttaagagcttttcttgtttaaaaatccttaaattataaattgttgtttaaaaggaattattagaaataattttaaaagcttaaaagagaagatctaattttaatttgctaaatctcaatataaaattgggttagataaaattttattaaatactttgcttgttcctctattttctagaattttctgggaattgtttcagcaagggaagtatttttaaataaatgaaacatcatttcacgaattattttaattgaaaaagttccaaaatccctccctaaagttgttgggccgtttccggcccaactcttctctctcccgcccgcggccgagccggcccagccgactcagccggcccagccaagccgccagccctccccctcctgtggagaccgacaggtgggccccacctgtcgggagctccttcaacctccagccggccatggagccgagcccgagccgccctaccgcgccgctttgccgcttcaaatccgcctcaatccggccccgattcttccggatttttgaggggtttttatcctctcgtcttcctctatctttcccctcaaaaatcggagcaaatcgttgtgtatcttgcccgaatcgaactcgtttttgagtttatctccaaaaccgagttatggattgcccggatcgatttcttgcgggaggagtccgatctcttcaatccaaggctataaataggaccctctagtcctcctctttcgtttgccccctttcccgagctctctagtgcgccgtagagtcgtcgccgcgtcgttttagccgccgccgtcgccggccaaccaccagccgcgccgcgccgtcgccctagcccgtcgccgccgcttgccgcgtcgccttcgccgttgccgccgcttgccatcgccgcccgtaggtgcgccaaggggtggagaagcccggccgcctgtcccccttcgccgccggccaccggagagctgtcgccgccgttcaaccgagccgccgccg

SEQ ID NO: 5745 - DNA, 1501 bp, Oryza sativa
ggctcgggttcccctttaggccttgttcggttgggttgttcccggccgggatcggggcccaatccccatggatcaccccggcgaggaaaaaatcccggcccatgcgaaattgtgcgttcggttaagccctaccgtgaattttagcccagcccaccacggggtttccctcttctctaggcccgggaaaaaatcatctactcctggagcgtggaaaatttcctcgagtggaggcggcggcgcaacgaagacgtgacggagggggcagcgcgcggcgcgacccggaggcgacggcgacggcgacggcgacgacacggctctctcctccggccgccaccttgtctccagtgagcacgctgcctttccccttcttccctcctcttgcaaagctagggttagggttttcttctcttctccctttcctgtcgtcgccgccatctctcttctcgccgtgtagctttctggtgagtgagcgcttagcgattcgtcgtcctcctcctcgtatcctgctcgatctggtgagttcttgatttgggcgtggagctttttttcttggttgggtggggatgagttcttgatttgccgccgccaccgcaccgcccaactctggttcttgatttgagttcttgattcacggtggctttgaggcagcagatggtgagagcgagagctgtacggtggctatggaaacatgcttgccttgattagttttgcttagtgtgactgatgctgtgatgcttgcctgagcatgtcttgtaaaattgactatacaagtttttacagtgaagtactcagttcttggtgcttccggagtcccaacttgtggttgttggttatatttctgtttggaaattacaagggttgggtgtcctgattttgaggattgtagagctatggaggtactctgtaattagtttaacatttctgaattgtaaactaattctatcgtcattgtttcacaaacaaactagcaacaaattgctgcagtatatacagtaatgtatacttaaactgatttattttaaactaacaacagtagcttttagtctcattagactaacagatttgttttcctcaacatgatacttgtataaaacatgtttatcatagctattcaagcactaatatgtctagtgttaaatgagctgattgggtgattaattctgtacccatgttataatgtatttgatgatgagatccttctatttgattgaaaaacagcagctcctactttgatgctagctagcactagttctgggttttatgtaactctagttctagttctgaatttgagttgtcagtgatgtgtataagttgtgcttgttttgtagattgcacgtgcacccattagagttggagaagaccaacctcctccttcaattattgttgcactgtgcactctttaagaaaaaaagatccttattgttcttttcatttttcccatcaatttttaaatatgcttcataacttggacttcttaagattaattcccatagtttagcga

SEQ ID NO: 5746 - DNA, 1501 bp, Oryza sativa
cactcaatctaagtgtgttccattagctagattatgtatcgttaacatctacagccgatcgagtagacccaacaatcttcaagttttatctgcctctgccgatctgacgcatcggcatggcctcggatgatacgtcatcggcaatcgtgccgatcggctatcgttgatgaatttaactctttgtcttttctctatcttgttggttgcaggatcaaaccagctggcacgctcagaacccgaaggcaatctctttggacctacactagagttaagcagatttctcaggccagtgcgtgtttttcacgtcaacagatgccaaagcatgttgccttcgttcctcagcctctcttgctagtcgcttccattcttgctgctcacgcagcaatctggcttgcccttgctcttgccgttcccactccaacctgagtcgctcggcttcttaacatgctcgttcctcattagcttcacgcacgagccgctgttcttccgtctcattgtctgccataaaaacgttgaaaaagagaggagtatagtcgtcttcatagttgtcgtcgaattcttcatcaaggtcatcgtaatcgtcgaaattgtcgaagtcatattcatcatcgaagtcaccatagtcgatagtctcagtcggagcgtaggaatcgatgcttggagtgttgaggtattcttcgatttcttctgtagaacacgattcgagtcgttgaaggattatgccgacttccttggagctagatccgactgtggtcgaagccgagtcagatctaggcctacggggagaaggcgctcttgaaccaaaaacagtagctagatcatctggtagccgcatcatgattgatggataaactgtgctgtcttgatctaatcttgaagatgaaaacgtcgaggtcccatctgagtggtttgaagccaagtcagatgagaaaaccctggagtagatctcggcctagtccgggagaccgaatggggcgagccgctatctcctcccgactggttcgaatccgaatcgagaagagagatcttgctgaagctgtcggtggtgaagtcgaggctaccgaactggtacgcctgcccgggagggaaggcgaagtcgtcgatgcccgaaacgaatcgcatcgcactagtcggccaaacacttgacgcaacacctacttgacacaccaactgttgaaataagatttcagcaatactaaaagggggtggcaatcaagctagaaaagtggatgggtcaggagacaaaggtttatacaggttcaggacttctcgatgagaagtaatactctactcctatccggggaaatatttcgccgagtgtattattgatctgacgatctgggggataagtctatgcccctaggagcacccgaacccctccttatatagggggaggtgccgagattacaatgtactacccatatgccttacagcctaggctaacagatatattacaattgtaactaaccaggactacgggatatttccttgatatacaagt

SEQ ID NO: 5747 - DNA, 317 bp, Oryza sativa
cgcccggaggccgcggtctgaccatctggtgcagcggtggtggcgttcgaggtggagatggcggtcgtaggccttgaggcagggcgcaaagggagcaatggcagtgctaagggagctggcagcggtgggtcgtcttcctcgttgtcgatctgcacccttgcccttcctggagctcctccccttctatgtggggagtttctatgttggattgaggcggcagccggttagcgagggaagctcagatcgccatcacgacgctgtctagttccgggttctctttcggccaaaactagcaaggaggccggcagatggtggga

SEQ ID NO: 5748 - DNA, 1501 bp, Oryza sativa
attggagctaataataggctatactattaaacttgctgttagcttctctaatgcagaggatccgaatcctagattcgactgtgttcaagcctttctgtatcgtacggtactccctcgtgtgttctgctgagtgttctgacacgcacacgtgtaaccaaccgattttttttgccttgttgggctatttctctctctcctctctccgtctcctactgctgcagctactgcccctgcccgccgccgccgccgccgccggactcctcccctccgccgcttcgcctccttgccggcgagcaggccggaccgaccgtgcgcgcgggcggcgtggacggggcggggctcctctcctccccgagtccccgccctcccctgtgagtgagccctactctactctcgcggagggcggcgggcgaggaggggctagctgcacctggcctcttccaccgacctgcgtctcgtgtcgaatcgaatccaaggtattcctcgtcctctcctctcgtagcgcttcctcatcctccgagctagatccgtccttacccttactttggggattgctttgtttcagctgtaagttaaatggtatgatggtgctagctagtatattctgatgacctcgatttgagtattgatttagggtggaggttttaaatcaacaatgttttgggttaaggaatatatatggatggctattctaaccacattgtactgattttgccctcactaatttccattttccttatacacaccattgtataataacctacttcaaacttgtgtctgtcaccggcaactatgctttgtacgcaaacttgtagccatggttcctgaattgaatgacggtaggcatgaaaagatggacggattgtgacatcattattttttttagtagcttgatataggcttatgttgttatttgttactccatccgtttcacaatgtaagactttctagcattgcccacatttatatagatgttaatgaatctatacatataataatgtctagattaattagtatctatatgaatgtgggcaatgctagaaagtcttatattgtgaaacggaggaagtagttcgttgcaaggaaatgtcaatgctcaatgacaagagctgaaattattcgtgtacaattgtgcaggtcacttttttcttatcaataaaagctggagcagaagtcagtatccacagtgaatgatatataccgttgtctttgtttctatagactatagcaaacttcagatattggctattgcaaagtatagccggggaaaccatcacacctttgccaaaactaccgctgctaatcaaaatactaggatctaaggtaatggagtgatcttgaacagctatcgggttttttgtgcatcttgtcaccattgttgctaatgttgttccatctttggcattgagtataggttgtttcctggtgacaataattaaaaaaaaataatgcgccttttgcttcttttttaagttgaagttgcattgcccatccttcctca

SEQ ID NO: 5749 - DNA, 1501 bp, Oryza sativa
atgtctgtgtttgcatttgcacgattagattatttgatctataacttagtatattgataaaaattactaaaatggagtactacttgatagaatgtttgtattggagtaaactttagcaaaagaaagatcagaattgaacattacgcaattcaatgatggaacaatcacaagcaacgccccctaactctgaattctaagcttttactaccgatgctacaatgtttaaatcgtggagtagtaatatcttttattttttccgtgatggctacaggattgaatttactctctggaaaatacacatgaaattccctcacttccaagttccaacttgtcctcagcaagctaccgcttgagctttcattgacttctatagctgcaagttattgccagtggaggagttgaaagatatggtggcgattggtccggatccgactaccgagttgccgtttcaggaatattcacatctacggtgcaggctagcactagcagattcctttctggatctgattttcgggacatttgtggtagttttgatggctcctttttcagattccgttaccgataacactcgagatttggcagaaacaaaaggcaaggacagggagctggcacgtcactgaccgccgtcccctatacggactgacgagcttctgtacgtacctcgaatccaataaaaacgggaattgattttgttcaccgagactttcagaggcgtaattcgattcaaagcgcccaatttacactccacgaagtcttaaagtctagcgccggaagcaatgtctctcatcactaaaaacaactgatcttaccagacaattcatatgcaaactccccccccccaccccctgagttagtcaaaaaaaaaaacaactgatctgaaattctgaatagtttgagccacagcgacaggaatgcatgacacagtcttgtaatttttgttcgtatttcctaacatggcgtggactattagtacgtcggtatggaccatgcatagtgtacgcaaataccgtatagtacttttcaatagtagtacaccacgcgaatcagccggcaaaagccctgtccgacccgggcgggggcgtatctatgtacgagccccatgaacaacagctcgatccatccacgcgcgcgtgacggctcggcggctgtcaccaacccggtcgccgggcggtctcgctcgatctgggttgggatacataccgcatacgggttgcagaacgcagatagtactaccagcacagcgcatcgcgatagataaaggcaagcaaacaagggatggtccaaaccgagctcgggccgcgctgccatctcgcctaaataaaaccgcgctacccatcgaccgatcctactcgcacgcgcacacacccaatcaaatgctcctcctccgccgcctcctctcgctgagctgagctgagctgtgaaatagtgccaccgagtgagcgctgagctgagctcgaagcaagagaggaagaggaggaggagggaagagggggggcgaaga

SEQ ID NO: 5750 - DNA, 1501 bp, Oryza sativa
taaaattttacactaaaaattttaatacctcaatatgcgcagtaacccatttttggtggtgcgcatggcagtaggttagagagtttatgtgttcaacttcaaacttggtaggtcatattaggcacaagagaattcaaatggcacgtttttatggaggccctctgccatcgatacaatctattagattaaatgcctgagaccttatttggatagctcgagatttaaaataaaactagtgaaaatctggagaaactaggttttcctagtttctagcatatatttcaaacctatgtaactataattttttagattgtaagtgagattctaaaagaaaatgtagctgctaaaaactcctacaataaggttgaatttgacatggtaatacacacttaccttgtttttctatgactgaaattgaaactttgcaccacccttgaaaggaatataaacaggtagaaaagtgatgaaagaaaaaaaattgaagataggggggcagggatactcagagcacgtatctttgtctctatctctactattataaaaattaaagatgtttttgccggtattttggtacgtcatccatgtataagtcggtttttaagatcatttacttttggtaatatagaaggaatcatatgagaaatatgtttaaaaaaactcgcatgctaacatatccaagcgaactctcacagtgaatttcatcttaactaaaccatataacaataatgagattaaaataaattttcacccgttgcaatgcacgggcatttttctagtcagtaaaaagtgaaactttaaatgattcaagaataagccacatcatttcattaataatggccatcggatttataaggagacagaatagctaaaatcattatggaccatcggatgaaggatcgatgatgggaagggcctcatcgtttggcttttttttaataagccaaaacggcttattagataataaaaatgaatttgtaggtaaacttttatatatgtgttctcgatgacttaaaagccaatgctaaaaagaaactacgttgaaaatatctcaaaatcaatgtcaaaattaaatttaaaaatttaaattttagttttttctttgactgaataggccatccgataggagccaaaataaggttcgagagctatcacgagtgttcaagtgtcttcggctgaaaatctcatctgagcttttttattctcttgtcaattttacacatgcacccctataagatcatttattctagggtcctctaaataaacaatattttttcaaatatgcttttgctctgatccatttacttacttagaaactcttaggaattttgtattttaaaaagtgaccaatgatgcaggtggtggggttgatgacatacgcaaagtggtgggtttatttactgaacgcgtacagtaaacttgaattcaatacaacatacgcataacaaatttgatatgatgacatggcgatggtaaaatttctataaataaatttgcttcaact

SEQ ID NO: 5751 - DNA, 157 bp, Oryza sativa
aggagagagaagatattataaaccatatgtggcatggtatgatgtgataatcttagtttcatctacactagacattacctaacagacatgattggttggttgtatgctccaagcactcatttcgttgggttttctcttagcacacatataaccacga

SEQ ID NO: 5752 - DNA, 1501 bp, Oryza sativa
ctttccagatcaactgaagaagacttcttgctgatcttcctgaactgtttttgtgccttcttgataaggcagatataagactggatcttcacttgcacagctgcattatctcctctcttcataatcagctgcatgtcttgaatgctttgcttaaggttggaaaagctctcctgcatggcattgcagaaatcgagcaagatgagagagcgctcaagctcttgctccactgctttcctctgcagtggctggcaaattgcaacatggctgcttggcaggcacatgatctcattgatgcagctgtagatattcccgatcctcttcaagccattactcattgtctcaatggtcgaagacgatgaagaaacaattgccttcaggttctggagctgcccttcgatatcgatttcgttggagcgagggctcgatggcacacttgcagatctcaggtggaatgccatgtcttcagaggaagctgtaatactttttttttcctcctctctctgaagttggaagaggagaaggtatgctacaatggtgtcgacacggttagctttatctctatatataacggaagaagaagaagaagaagcagaggcaatggcatctctactctgtagacagcattggaatctcaattacatttaagtaatgtgctgctgcaacggatgccacccatctcctcgacaagctgatgaattttatgtttggtaatcaagtgtgtgtaacagtgcaagtggcatgtctagctcatcttgtgtctatcatgtgctggctattggcagcaaactcattgcacgagcatgttgtttaaatttagatccagatccagatcatgggattgatgagcttgccactaaagagaacaagagctgttcctttgctcggccacgcaacaggtgactatacctccatgatgtgttcttatctggtacgttcttcgtgcagcatcacatcggtggcctgccttctgcactcacagcattcagcatctgctgcaatctcaagatgattccacgtgctgtccaaatttctgatgcattaggcctaactgagtcacattgtcatgttccagttattggcagcaggaatcagcatggcagcttattctattactgagccttgtcatacgtgtatgctccagcacccatttaatggagattgctaatcaactagtattggtgccatgtgtgctattgcatctgattgctgagcaatttatcaacaactatttagttatatggggagcaaaggatcttgtgcctgttcctgtctcatgtgaatactggtgacatgaccatcccatggctttacgaaggcaaggtgggaactgtgtacttattactaattgcatatattatgacagccaaaaatggtatgtgtcttctgactaatttattatttttttgcttgaacatgcttcaggtgaagcgctccaaatgtccggtgattgtttgagagcagtatgcgtcaagtgaagggggaaattagaggcaaaagagtg

SEQ ID NO: 5753 - DNA, 1501 bp, Oryza sativa
aacccaacctcggaacggccatagtttaatgataggattcaacacagcggtagacgctaattgaacattgccgatccattgacaagcttcactccctctataacatttgaaacaatcatcaattattttcggccaatgaaaccccactctcctagcaaccaatttatcttacgggccgattaatgaatttcacaaatcccttcatgtactactctcctagcaactttagttgatcattatctaagtaatactccatctattttttggcgatataatatttgagcacttaccgccgaatcttccgatcaaccttaagtgtaggatctttcaaaactctaatcaaaggaattctccaagctatttctaactcatgggcacaaatgtccgaattcacaattaattcagccttttaatcaattgtaacgtgccccccagccttctgtctgggatcggtcagaccggccacgcaatgccggtcagaccaccctgtctgtccggtcaaaccgaccatgcagagccggttagaccgcatgtcaccaccggtcagatcggccatgcaatgccggtcagacaacccctggtctgtgattttgccaatttcatccaaagacttaaaaatcaagcaccgacttcactaatatcaaaaatactcctttcttcatattataaccagatgcttggtgtatcaaactattgaaccaaaactctttctctctagacatatgaaaaaaatataatacccaactaacatgtctagatgaatactaattcaagtggcttttgaaacaataaccatcatggcatcaaaacacttagccaattgaagtattatcaataatgaatcaccaaagtcatatgcctcacacacatgaattccaataaactacaaatgtaagtaatcgacttgagcatgtatgcaaaatattaacaatgccaatgtttctaaagaaaacaactctagaataaatcatcacattgaccattgacattagccgaattactaataaggaaaactttcatggtgcaataaatatgaaatctatatcttatatggtgatccataaaaacacatacgatttggctttaaataaatatcaaagagtcatgagccaaatcatacttgaaacaaattatatgccaacctaccaattctactacttagaactggcatttgcatgtatgtataatatcaatttgataagcaaaaacacacatgtgctagatagcaagcaatgttctaacatgacataggcatataatataacgatgaacaccataaacccataccttgccttagcatccaacgaacggcggctcgaagatgtgatgttgtatccattgccgttcttcttttcttggttccctcatgagcatattaatgtcttgccccccaagcaaaatcggctttcttgattgcacgatttcgaaggcaagatgaataccgcactaacacccatagcatcatgtgaaggagacttatctttaatgaccgatgattctt

SEQ ID NO: 5754 - DNA, 1501 bp, Oryza sativa
gggtttcattttgcaaaagcagcatttagcaaacatttgagaatttaataaaacagttaagtaataattaaacaatattaatccaacgctatacaacataccctgttgtataggcccaaccattctgaacaaccatcccagctgcacagttctatctccaaactaggaatataccattccaaaccaggagctaatcaaattattaccagttatagcatcttttattatgatgagaggtgtgagactaatcacgaaagacattgttagacccgcccataaccgcgggcacggctattcgaatagttttactctgatcagaggtgtaccaatgtacccacaagacacagccccacatcatgtcaccatgtgcctcaataccaccacggtacctcggaaaggagctgtgacaataccccttgcacaacacaatccactacagcgcacctttcctggatcataatcacccccttataaacaaggcatggactccccagcgacccccgtgggcttatctccgtcacttctcagtctggtgctccgcaatgaaccatgctatacaaaaggtaaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaaataatagtaaatcttaagttatcccaatagtgtgctaatgtttctaagcagggctaagcaattatatctaatacatctagttgaaccaatatatatatagcccaactagtcaagttataacaacccaaggtatcaaggaataaagtaatcaagaacaaaaagggctataacaaacaataggttaattccacccaatgacattcgaaaataaatgcaatagttgaatagaaacgatagctttaaacgggatcaacatgctcaaagggttgtttgggatctgtgtgacttgccttgctgaccttggaactcttcaaactcttctcctgcgaaaacggactctccggaaacgacggaatctaagcagaaaagagcaaaatcaccaaaacagcacaaaaacaagcatgaacagtacatgtggatatttttaacatgtagatctcaaatttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcggctagggtttcgcggtggaccgggcgcacggcgacggttcacgggaacggacggccgagatcgatcttatccaaaacggacggccgagatcgaccgatccacggccggaccacgagagacgacgacga

SEQ ID NO: 5755 - DNA, 1501 bp, Oryza sativa
ccaaccggtgcaccgctcctaagccatgcgcacccgaaacccgtgcgccgcacctcgcgtgcgcccatcccaccgtgggccgtgccaccgacaagcgggccccacccgggaccccgcgcggtggaatcggtccaccgggccgtctctctctcccccgcgccccctctgttgggccgcctcctcgcgcccgcgcccggcccaatggctcggccgcgccgtgcttatcccttgggccgtacccgagcctcccaaagaagtctaaattacatccctccacccttttctttttcagggatttaataaatcctttttttttccttcctttgtcccataaatcaattccttattcccaaaattccacaaaccatttcctttggtcccgcgtgacagtgactatcaataatatttttgagaatattatttctataaattccataaaccatttctcctattccagaaactccaattaaacttccaaaattcatatcacccaattcgcaactctgattgactccgttcaacttccaatattcccataaaattgagatctatttaatggcactactaattagtctaaatagggtctttcttttggtcttttgtttaggttttcagttgtttgcgtatagttgcggttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcgtgccaaaccgacggacctacccagtaatcgcactaatttccgtaggttgtactaccctgtttccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcgacggttggagccaaaccgggttcctggtaatgcaagaacgagaagcttgctgaattaccgatcgaggtggttggagtttgatttgtgaacgcctaaaatggcctatgattatgtgaggatttgatccttctatgtggcatgaggtatccctgggtcggcttgggaaaggctttgtcgcgaacctctgacaccggccagtgtctggagtaagttcgtgtcttgtgggtaaagtgtacccctctgcagaggttaactaactgttcgaacag

SEQ ID NO: 5756 - DNA, 933 bp, Oryza sativa
aaaaaatatataaaaggtttttttatagacaatatggctcaccaaaaaaaccttcaaaatgattattttcttgttttagttcaattcaattcttccatgaacaaaagaaagaggaatccaaattactcatgaagcatcaaggttaactaagctctggggagctttggtgctttaattttttttcccaagagaaaaactactgtcaaacatttgacatgctcaaaagtttcaaggatgggattaaacttgtgttagtggaaattactaaacacatgtaattggaaggtgaaaaacaagaaactgttcaattattgaagatttgtgaaacttgtccgattttttttaataaaacgaatgaccgaacatatgtcaaaaatgttaactgtcttatataaaaaaatatagtttatataaaaaaatgaagacagtataaaggagtataacacagataatgtttcggatgaaatcggttatattaaaacctactgggaattggcgagctgagagcgattcggagcggcgtgttcgtacgcagaggcatccacgtcgcccgcgagcgctgggaggcgggcggaatccgcgccctctcgtgcgtccgcgccgtgcagctcccagccgttcgattcgtcgcagcgacggctaagatcgatcatcgtcaagagtgtggtggcaatttttcaaaaaaaaaaccctccgttgcattgttaatgtgtttagaacccagaaatacggtgcgacgttgtggtcttttacgtataagccctccataaccaagaaaatcttacatgaagaagagagaaatctaaaaataggaccgcgctctgaaaaacgagcatcaaagggcttttttgaaaaacaatatatacctataccccttcccccaaaaccctagaatcattgctttccttcccctctccgccccattgacgcccc

SEQ ID NO: 5757 - DNA, 1265 bp, Oryza sativa
cccccccccccgcgcgcacccccatatatatagagagagagagagagattactgtgctttaataaggcaaaacagagaacaaatttccaaaggggaggggagaaaaaaatacaacaaaggggaatttacaagggggttaaaataaactgtgtatccatgattgccaaattggtttatctgcttcttttactctatgcaaatgcaaagtaaattcatacttgaagtgtgatttccatttaccaaaatgcacttacacatcgttaaagatgagatcatttcttatgctctataaagaaagggtgggagaagctactttttgctgtagatatcatattcatgaagttcaaacttatgttccagtttatgacaacgaagtgccagcactgttgagcacaggggcaagtgaaaaagggatgcaaagaatcatctgtggttaatgtgttgcatgtaacacatctgattcccccttgggtgttgaagtgttctcttggtagcagatcctttgtgtttaacctatccattaataataaccaaacaaaactttcaatttgagtgtgcatctgcttttccagataagggtgatgggaacttctggttgaatatgagcgaagaacagatcataaactctttttgattgatattgatttgaattccaatgatatgtccactgatccaagagattaccgaaattcaattcatgtaaagtattgctcaggtgctgccattgttgaactgcttgagtagtttttttttttttttggggggggggggggttgaaaagcttactccagattaaccagttctttgaaaccctcgaaagaaatatcttcattctttgcaagtgagaacagaatgatcaattcttcttgcaagattctgccattccagttgtcttttcagaatagagctgtctccaatggccaatagcaacagatgtaatggctctgaaaattggtatattagcctaaacacatccttccaccagaaaaaaccctttcctatgtgtgcatggggtggcatgttggagtgtgaataatatttgttccagattaggtctaccctgggcaactccattttgttgaaatattttgtagttccagatttatgacttctagtccccttttttttctttggttgacaaactagatcccaagctgctaatgaatgcaccttagcattagggtcatttgatttcttccaaagataatgccttctagttcgatcaatatgctgaattaccttttttgataatttgagagtgcaca

SEQ ID NO: 5758 - DNA, 1501 bp, Oryza sativa
attttttaaaacatgaaacaaataatctgttttattaatctggtgaataagctaaaactacaacacggtgtgccgggaaattgacagagaaatatggtcaatatgctgatgcctgcaggctgcagtgagcacgaccactggaattttctttggtcctagatgatgtgagcgatggtgttgtgcggcacaagggtacgtgctaatcaaaagtactccaagtaaacacagcacaattggacggcatcacaatctcattctcgagtgatgcttcgccaaatttcagtacgtgcttcgtgtaataatgtcccatctcacgcgtgctaaatcaaatcacgccatgtattaccagtggcatgggtggttatagtcaattattgtctaacttttaactttgtataaatatcccccaactctctctctctcttgatatcacagccatttggttccttaattgttgtgtcctatagggtctatttgagaaacttaacatcctgagaaacacaaacagctggttggtagtcagtagttgtttctctggaaaaattaagcttcccagcttctaatgttgtgggttcttagcgcgcgcgtacgcgtcagcagtttagctggcgcgcacgccagctgggcctagctgggcccgtccctgcgccgtttttttcttttttcgcactttttttctcctccatcgtgtttttcttttttcttttttccgtttctccgattttttttcaatctttcacacacctctttataaatgtagagttgaaagtttttaattttgacttgaaatttttcaaattttttgttgaaagttttcaaattttggcgcgcacgccagctgggcccgtccctgcgcctttttttttcttttttcgcacttttttttctccttcatcgtgtttttcttttttctgtttctttccgattttttttcaatctttcacacacctctttataaatgtagagttgaaagtttttaattttgacttgaaagttttcaaattttttgttgaaagttttcatatttgagttgaaagttttcaaattttgagttgaaagttttcaaatctaggttgaaagttttaaatatgggttgaaagttttaaatttgagttgaaagtttttaaaatttgacttcaaaaaattcaaattttgagttgaaagttttaaaattttgtgctgaaagttttcaaatttgagttgaaaattttcaaattttgagctaaaagttttcaaatttgaattgaaagttttcaaatctgggttgaaagtttttaaatctaggttgaaagttttcaaatctggattgaaaactttttaaaatgacttaaaaattttaaattttaatttgaaagttttaaatatgagttaaaaagtttttaaatttgtgtagaaagttttcaaactttaaccgaaataataattacgatctaattactcggaaaaaatcagcacgctaatcctcgcactaatcgtattttactccgtaacgggcccgtca

SEQ ID NO: 5759 - DNA, 1501 bp, Oryza sativa
tagctggtttcgccttcttgcctgcgccatgtgctgccggtgttacctacctcggtgtgagcaagcaacgactgatggaaccaaagggggggggcagagaagaaaaagcaaaagatagatagaaagagcatgttgaatagtgagcctgggacaatgacatgttgactaggggcaaaattgccatttttgtattttagtgactaaggtcgaaagaaggtttgaaattaatgaacctcagtgatgggattttaaagtatgattacgtcgatggcaaataagggacgcagaatttcattcgatagtgtataagagatgagccatttatcaggaattaaggaaaaatgatagcatttgatggaaaatgaagaatgttctcgtttatttatttaccagaggcatagctggtgcaagccacaagacctgtaatatccaaaaatcttgaagttgtgcaagtgtttgtcaagtaatcttccaccatacagagattttcagtttcaagtttgggtctgttctatataagaaagttaatataagatgaattgttacaataaaatgaagggaaaaaataaaattattgtccacagaaagtttgccattattggttatcttactattgattgagtctcccttccaaattttcagtcttggtatgtcaccatttttgttcttttcaaactttgcgctgacttgatgcctgaactgagggtttagtgatgctagcactaattttcctgtgaactagatttccccccttggttataaatttatatacttctacatatactggcaggatttgaaatactggtaaaatggtaatcattagtatgcgtagtctttatgatttcgtttccattgttcatatcttgtgtgcctatccttcatcttaaatttgagtctagtattgtgtaaggttttaagtcaggggcatctgaactgacactcaatctcgtttgaaatttacaaacatgttcttgtgggctttatggccatgcatgttcattgtcaacttcctgttatttgttgaattgtaggtgtcacaatatgaaatatttactgttgtgctgttttcatgttcaagctggtagcatagctgtaagagttgttctttttaaaatctgcagtgcataggacatcgcatgctttatacaggaatagatactaggctacactgtttgcaactttgcaaccaacactgttattagtgcctatgtgatgcaagattttcgtcagtagtttgtattataaaggatgtggtttgtttctttgggggtgtggaatgcttgtcaatgaagctgtccctcagtcctctttccttaagcttgtataggttgaaacttgtgctgtcttttcaataatcgtgttaatgccttccgctcacttttaatgattttgagattttgataatatttgtttctccatgtgtgatcatctaagtatatacttgttcttaggtgcaaatctcaaaacgttattgaggatatatgaagtagtggatgttgaa

SEQ ID NO: 5760 - DNA, 1501 bp, Oryza sativa
tggtcgttgccaactaaaatctaaatttatgtaagttttgacatgcatgcacatccttctcccttgcccatcgatcatgcttcaaccatcagaataccacaattttaatttatgtttgcatttcgttgctaaataagtagtgatatctattgttattttgtagaatctgggtacaagggaggcgcaattcattttcccttgcgcggtaagggacaaatattgacaatgtcttacatccgtgcaatgctgcaggttacatgtttattttctttgataatagaattcattctgatatttactttaaaagaaactacaaccaattgttatggatactgttgtactactacgattttattagtttgtcatagtagtttaaatgaacagctatacacatcagttactacagttgctagcaagtatttaacctaaattttattttgagaattttcacattttgtatcctttgactaaactttaaaaagtttatacttcgtaaaacattagacaaatgcatagcatatcacaccattgagctatttatcatgtaacatgattccctttcaacatgattattcattccaaaagttttctccaattgctcttatattccaagcatctcgtgttttatgctttttaatgcaactttttttccaaatgtttggcatctggtgtgtcatcgtaatctttatttacttgtcgtaaatctcaatgaagattctttttctctttttttttgatcttgatataaaattgttcaacatggcaaacgtgacaaacggtggtaaatagtattataaaggtatttagagacaagctaaagtttttttttctgggttggaaagacaagctaaagttatgtgcacaattgcgtaggagtactgccatatagtattgcatattattgcttggaaaatccttgcaaaaaggagaaaaaaaaccatttgtttcttcagatgatcaaatcacatatggacatttttcgtgctacaaaatacaatattaccatattacacgacgtctagagtattttttttaaagatcgtgtaattttattacagttatatcaaacacaagggaattaaaaaaacaaagacaattttaacaatataaagtattttttggagtaaaagtaatttcatttgatcataaatatcgattagggcaaaatttgatagagcttttagaatcccaaacatcaaaaaaaatttaaatgtagagttaaaatatatatacgtagatttattctgatacaaaatcgataataaatcataaaagtttgactaaatcttatcttaataatattttttgaaaggagggagtactcctaattgataacccaaaatacatcggtgaaaaaaagagaaggaattaaatgagtttttttatacgggtagaattaaatgactttttgcctcaaaaaatgaattaaatgagatttaatttagacccaaatggacatggcgaagacctctccccacagctataaatgccccaagtcctc

SEQ ID NO: 5761 - DNA, 1501 bp, Oryza sativa
ctctggatgatattttgggttgaggatagatttgtctgtcagagctttcccgtatgcgacgccaagtggtagaattagctagtaagcaagttctttctttccattacgtggatgagtgcctgcaaaactgacctaataaggattttagatcaattacacaacaatctatagctaagggttgtttttttggattgcatttctacctcatgaagaagaggctgactcaggctgagcagtctgcggccttggtctcctgcttgctgggggtccatctcttcgcctttcataccgtctgctttcatatttggatgtcctccgctcttttggttggtaggttgggtaagtgcatggaattatctctccgtttatgtatttatcacctgaattgtgaaaggattgagattttttatttaagaagcaacaactaattgattatgcaaataaccagctgcagacaataatgttgaactaacccccgtagtctttgttcttgacatcgatgtaggaatcaggaagcacccacagaacgccgggtaaacctacaggtaatagaacaatagtttgaaccagggcaatccaaaaatgtttagacttggttaaatactgaggcaaccagtatattagcaaatacccttgaacttctctgatgtttcctcgtcgacagtgcactggaaaccagtgtaggtggttgtgctgaaggcatacatgttcttcttggcttcctccatgctgtgattgcaaacatatgctcagtatcaagaaaatgaactaaaggcagaaaattacaaaactgtaggcctggtttatagtatagcaatgctgatttcagacatagcaccgatgataacttcaccaacgtgcagtgaccagcaaagaatacctaaacaaataatcaaccattccttgtgtttacgcaagaaattttaatccttgtgaatcgtcaagcataaactgtgcaacatatagacatgtctaccaatctactacacacttgtttcttcaacaaattatcatgcaaaatttgcaaccacctatagaatgtaaagcttttttacattttaccaaaaacgtgcgctccaattaaaatttcgactatcataatttacaatcgaaacaaaatttattatgtttgagtgaagcatgaaacaaacatttctctcgagattactctaccgacttagtcagtcagtcagtcagtccttgcaaattggcaaccaaactaggtgagtcaaagagaggtggagatcttgacaatgaggatgagaaattttacataattatacctgccaaggacggtggcgagggtgttgaggtaggtgtcgatcatctgctcccgcgtcggggcggggtccttggggaactccatcacgatcagccagtggttgtagtcgcacccggggagcagtatcgtctccctctgctcgctccccgtccccgcccccgccgccgcggccaccaccggctgcctcgccttcccgcttcctcgcacagccagcgtcgg

SEQ ID NO: 5762 - DNA, 1501 bp, Oryza sativa
tatgtttgctgaggttttgtttgtgattaggtggtggtccttcagatcgtgcatgatatcaacccttcattggaggcaagtgcatgacgaactaagtgtgtgattgatggattgtttgttctatctatttatttccgatatatttctatgtgacatgtgaccgcttatattcatattgttgttcaagccatttagattttcatgtttatcctatgtttacaacattattcttgtttcaatattccggattctggttctgggtaaataattcaagttccctgcttgccatgaatgtgcaatatgatttcaatttggttctttgattccggtttcaattattcaagtaccatgcgtagtcatgggagtgcaatttggttctttattcatgttcgtgtgggtaagcactgatcacgcttactcggtttgccggcaaatgttaggatgtattcactattgttcgggatggaaactactatttcaattcatgcctgcttgggatgggaactactatcttctttgacttggtgtttgaaattgtgtttcctatcagagaaagaaagccttctgttcatgctttattgccaatgatgtgtatatgtgttttctagttccatattgtacttgctgagtatttttatactcactcttgtgttttatttggttttaggtacatattgagaccgacatgcatgggcgggaagtagcactcttatatacatatttatctgcacactatcaaactatattgcctaggtccataatgatacttaaactatatcatggtttggtcttgtaataatcttttagatttttaatagtttcttccccatggattataaggatggatcgtattatgggaatgatattgttattagtttaacttataattgcctgtcatggatgtccgtatttacaagggagactctgccgaaatttctaataattttgggagttagtggtttgagtgtatgtttggtatggcactctaggtacgtggttacttggggtgttacaatcatcgggtaggaatgacctatttcctttgttatagccttttgttattgattacctatacttggtcacttggttaataattggattagctagaacattatatggttttggctaaaatgattaggatgcttagccatgcatagagacactagctcatatgaatgggataataaatgattcactattacttaatgatggtttagtggtagctcatgatggttaatcatgataggttgattaattaagatgccaactaatacatgataatggtgggttgtgagcacatggttttgatggtcgtgctcatgacaattaaggtccggttcacgattttcggttgtgaaacattaatcgtgccaaccacaagccatcgtgggcaatggctttaccttttatatagtgtggttcattgtggggcaccagacagagaagtggcggagataagcccacgggggtcgctggggagtccatgccttgttttataagg

SEQ ID NO: 5763 - DNA, 922 bp, Oryza sativa
cgggcagttgtagccccaaataaacccattgaaatcgtgaggtggcctcaccacctggaatggcatggctttcatagtcatcatcacaaaagatattatttgaagccatgcgagtgttcctcttcaatccatccaaatagaaccccccccccaatctcctccccgctaagcaaacccccctaatccttccttaaccccacccttcttgcttgcttcgctgctgctgcttcgcttggttggttggttatatttagtagtccgcgagaagagtggagttgtgactaggtgtgtgcttaccactgggaggaggaggaggaggaggagttgtggactataacgagcgggaatcgagattccttcgtgttggtgttgttgttgttggtggtggtggtggtgcgttggttgattggtcggcggcgggagggatccggttcttgcggattctttaccgttcttggtgaatccgtggagaaggcggcgggccaagattgctcggaggtgctcggccgtggcggagcggtggtccgtctatggaacttgccgccgcggcgccatgccccgccctggaactgaggctaccaccaccaccacttctggctgtgaagcggattgtggtgtccctgctatgaaggcgacgttgatgatgatgagttgtcggagtcggagtcggagcgggcgtgctcactggatgctgctgctcttctgcctcctcctcgccttcccttcacatggtactgaaattttttttcccatctttccatccaattcaactcaattctcttgccaattctctttcttgaccagttattgagcctttcatgctttcgattgcgatgcctagaaaaaaaaataattccttgatttggtattaatgatatgaaatttgattgttggtatttgttgtgacaaggtcctagagccg

SEQ ID NO: 5764 - DNA, 201 bp, Oryza sativa
aggctcaccgctagaacgagcgctgccttcgccgccattgctgcaattgatcaagcaaaagctagtgaagaagatgagagtactaggtagctagtagatcagctcgaggttcttgctttgtgtgtgcttggagtgtgcatggcgagtggtatttatagtggccatggaggaggaggagatgatgagaagaagatgtgtaga

SEQ ID NO: 5765 - DNA, 426 bp, Oryza sativa
actatagggcgaattcgagctcggtacccaaaaaacttatatactgatcaatatataaacccaaacagaagttacggaccttagctagatgatctgaaaccataattgtacgagctctaattgtacagtacccatgtattacactagtattaattgatccgggaaaatctagcaatatattgtgatgaaaagaatatattgcaactaggacacacggagaatataaatcacaatcccaatacagttcatccaatcaatcatccatactcacggtcgatcgattcttgattcgccgattgggtaccacacgcatgatcatctaggcccccattcacgtactcatccatctacacatcttcttctcatcatctcctcctcctccatggccactataaataccactcgccatgcacactccaagcacac

SEQ ID NO: 5766 - DNA, 486 bp, Oryza sativa
atccctgaaagttggtttttataggacgagaggagtacatattttttaagaaaattattttataaattatttataatcaaatattttaaaattcgatcttaattttgtccgaaacaacgagtattataagagcttatttggtagagctccaactcctaaatttagcttcaagagttagatctgaagtagagttatatgaagctgcttaaacccaactttgcatgtctagttcattttggagatagctctacacagctcagctgaaattgtttggtgaagctagagctgtgccaaacagggcctccgtctggagagaaagtagcaacgcatccatgcaaaccactcttgctataggctcgatcggctataaatacaagacgccatgacaccccaagcaaaccaacccaaagcaacacaagccatagcagcagagccgagtagctgagctcactgttcgatcgatcactagctcgctagctgcatcca

SEQ ID NO: 5767 - DNA, 1501 bp, Oryza sativa
  unsure (1)..(1501): unsure at all n locations
cagagatgcaatggggacaccagatttcgcttgtgcgtgccagaccagcgcacgcggtacacactactgtccgcggtgatggtcagtggtcacgacgtcttctcctcgttctcctaacttttaatcgacaggtcattgataatgggattagggagttcaattagttactcccggacaaacataaaccaattacagtaccccctatgttcttaaaaaaatgatattataggatgtataatattttgaaaagtcaaactttgtagattttgattgacaattagtcagaactgtaagcatatttattaatttagggggtgtttagatcaggggtgtaaagtttcgcgcgtgtcacatcgggtattatataaggcatcgcatggagtgttcgggtactaataaaaaaataattactgaatccgttaataaactgcgagatgaatttattaagcctaattaatctatcattagtaagagtttactgtagcaccacattatcaaatattgtagcaattaggtttaaaagattcgtctcgtaaattagtctcaatctatgcaattagttattttttagcctatatttaatactttataaaagtgtttaaacgttccatgtgacagggtgtaaagtttttttgatgggatctaaacagggcattagcaacggattcatctttcaaatatctttcgtaaaacgatggttatataaatattatctttaacatcttttatttatccaccaaccaatcaaactttcttgttaataatgaataatttgttttcctcatgctaatttgaatttaaatgattagactctataagttattttagggccaaggtactgtactatctctattacaagatgttacaatctgaggataagatttgatcctcctaaaacaatgaagggaggaagtacttttatttgccaacctaacagttagcaaaaaaaaaagtaatgcaaaccttatataatgaaaactcgaaaactaccgttggatcaaaaatttaaatttttgatattcgtccacgtcatcatgagtaaaattattacttataagtaaatctgtgagtaaatattttacttacaataacacggacaaattttatacatcttttttattttttttatttagcggtagttttcagactttttacatgaatagtttccatcacatattctttttccccgttaaccctagcagatgaccgccttccgtacaacattaactccaccgccgcctcctttctttcctctcctttcctacccttgagatctccgccgcgtccccaccaccaaaaaaaattcacttataaaaccaaacaaaaaacccgtcaaaatcaccagaaaaaaaaaaatcccccgcatcacccgccccgccaagccgtgcgccaccaccgaccgccccccgcgtccaccggcgccacctccacctgctcgctgcgcgcccagccactcgcccacccccgcccatgccgccgccgncgccgtccagcctcacgg

SEQ ID NO: 5768 - DNA, 970 bp, Oryza sativa
tgcaccccggcacttggtttaatattgtggtaaaacacatccagatttcctatgtctagaaaagtgtctgggtccattacatgatacacacataacgtgatatcgttagagcttttattattgagggatgcaaatatgcaattgatgggggctgggctttcatgcaaagctgcttggcttggaattttggtcaggcatcattgtactaaatgaattagaacttgcagacaacatttgagctctagcgtggatcatcctgattgtgtctaaatgtacattgcctgctgtaaaaggtgtgcaactatgcaccatagttttgatcatattctaatgggaagtatttgagcttgttaaacattattatttccttgttggccattagtgagtgaagttatgcaattgtaaacagatacataaattgtaaccaaattataagtggatttatttacttgccatgattgtttatcctgatgtgtttcacatctagttgtagttggcattttcaaacggcagggtttaaggggttatttaggcatttacaaactttccatttctcctatgtatattttcgacattctcagttatagttggactaattcaagtgtcagttctacgattaattcctaaattattttcggccttttccaaatttatataaagtactgttgtaaaagcttagttcatctatgataatcacagtttatattccatcatgcaacacccccccccccccctcatttataatcagcaccatggaaatgtaggttatttctgattattttttatacttagtaaatctatggtgattagaaagcatgtacataatcaccatgtacttacggtagtgcctgaactgtttgggtttctggttagtgtaacatatattttggatttttggttggtattatattaatcgaatgtaagcaaattgaactttaaccttttgttacctttatttattgcctttagg

SEQ ID NO: 5769 - DNA, 258 bp, Oryza sativa
  unsure (1)..(258): unsure at all n locations
atgacgccgcttgtagtcnnnnnnnnnnnnnnnnnnnnnnnnnnnnnnnnnnnnnnnnnnnnnnnnnnnnnntctgctagaaacttgtggtatttatatatttttaagctcagatggaatggatagtgtttgtacaattacacatcagtaggtagcatttaatctcgattacatcaaaaaaatgacatggtttgatgcccaaccaactgcattggccattaatggctgggcctaaaatgcaaagctactgtgacaaga

SEQ ID NO: 5770 - DNA, 1501 bp, Oryza sativa
actgttcatagggcagcttttcttctctctaccggcaggccggcttaatttgccggcatgtaacgatcatggagaaattgcgggtagttgcgggcatgcatgtgggatgatatgcaaattaaggacaaatggagtcaaaagcggcaatgcgtgtgctctttgtgcatgcattatcctgcttgtttttcttcatgcacatctgtcacaatcgtttagttttgggttaactcagtgtcagctagcgaataatgccaggcgctaaagatgaacgtaacggcaatgtacagctaggtagtagctcttccgtcaataatgagatgaaaaggagatcagtggggattagtttgcatgtagtactggtagtaaagcaagctgccggtatctgattgaatgtaatgtcaagtctgaaactggttcaggttagtttggaaccagatgcactctggtctactgcaagggaacctcccctaaactgtcatttatactcacgaaagggatcgcgatttttcaagtagtcgagtgtacagtagtataatattgttgaggttctaatcttcattctgtgtaaaattgccaaaccatatagataaatcaaagattggaattgctttgtagcttcaaacaagctcaatatgttttgcagcaaatataagaaaacaaatttttgcaggatgaaggtgtgaaagcacaaacatcatgggtgtacgggtcctctgtttacaaacagtactccactacctgagaaaaaggtcgaaagcaaaaaaggctgaagcacgaacaaagatccaaaaaacccatatctgaactatgggcgcaccaacagcatgaaacgggcacgagaagaggatgatgagacatcaatcagttgtttatcccggggagaagaagagaacgcatgcagtaacaattacttggatccacaatataatttcgtgtcatggcacattggcatggagcatgaacctttttttctcacggcacgcacatgccgacatttcaaaacacaagaagcagcaccttctgttctcgttctcttctgagcctgatcggatgtggtttagctgagctaagcctccatgtcagtcaggcagtgaggcagaggcagctagctgagctgaggccagcctatctatctaccggccccaactatcatctgccaacttttaatacgcgctgccgtagcaagaagaagaagaagatgaggaagaggaggacggacgctgcatgtcaccgtgccaggccatgtgccgcggcccaacatggcacgttctcccctccagttcacttctctctctgctcacacacactagcctagccagtgtactagtgttgtagtgtacccacctcgcttataaatacccggttccgcactacggccacacaaaccaacacccccactcatctcacttcactctctttctcttctcttcacttcaccaccgccacctctctcatcggatccctgcagaggaggagagggcagtggcggcgaaaggcgaca

SEQ ID NO: 5771 - DNA, 1501 bp, Oryza sativa
tcgagattgcctcttgccgatgcattaatctagggtttagtgccgtgtgtgccacaggcacagcagaagtctatgatgcaacttattgagaggacgtgcagcttcggtaactaatttgttggtgtgtgaatcatcttatgtggtttgggatgtttttgctctatggaatgggcataatggttggtgtctcggggatccagatcctctgttacaaggttggcattgcgtagttgggcatgaatcaagtggagtagcttttgagaatcatcgccaatgggtattattgttagctcatatgtacttctgtttctcctgtacaccagccaagttgtttgtttttctactttggtatagatatagaagaagctatttctgtttgtttcatccacattgtgatccagttcgttattttttgtctgtgcaaagtgcaaaccatgtccatgttttgacgtggattacccttttgtgtgtttctaatgtctgcagacgataatcaaatggcctggcgtgaatcgctggaagtaaccaatgaagtaagtgcagttcctttttcttgaatcttaaacgcattgattgctttctggctcgtactgtaaacttacaggtgtactgcatatagagcttatttgtcatataatgagataatccaagaaatgctgcagcagcaaggagaatgtagatcgtgttaaatattagtgatttacaaaatgacctgctgtatcagtatcagtacttcagtagtatagtagaaaatgtaacatcacacctaagtttaaactgcttttcagttaagagcacagttaaggaacatgatgctcttatatatttccgctgtctcaccagccatttgaggagagtccatttcccacttccctcatctgctcattggtttagtgaactaatcctttcaagtccatatactgttgtggctaaatgatgatgaacatatttctcttttgagcttagtgtatttgttgagaactgccagaagcttttgttcaaattgtcggaactttagtttgcaagggcaatactacatttactcctcccttagtctgtttctgttagcatgtttacaacataaattattatctgttggcagcttttgatatctttctctttgatccaaaaatgcagacacataggcattctatagaatggaacaccaattctacagccctggataataaagccagcctgctccaggaaggtgattgtagaaatcaaaacgatggcagcggtctcgctgaaattgagaatatcatcaaacagaaacatttttctaggcaggttcttttacacctctaaagctttgttctgattttatttaaaatttataacatagtttgctgaactgcttgaaaatcgtttgcaaagtaagatgacaatttgttatcttgtgtttgacctaaatcttattggctggaagcacttaatttttttgcttttgataattgaaatttgaaatatagttaaatgtgcatcatgttgctcttacagg

SEQ ID NO: 5772 - DNA, 376 bp, Oryza sativa
atggccccacgctactatcaagctcggcaatgaggttgcccttttatggttacaaagaaggaaaaaaaaaagtggaacaaagcctcggaggccggaagcatctagactcgcggggccatttgaccaaccgaaactcgacggcccacccaccaaccaccaccaccaccaccacacccgctcctcctgctccaccgcactctgcagtccgcacccgcgcgaggcttccgctccgctcccctccgatccgtggcctcctcatcgcccctattaaacgggaacccagcccggcgtccccttctcggcttcctcctccaccatccatccatccgcgcgcggtgcgtagtagcgagaagagaagggggggagggcaaagcga

SEQ ID NO: 5773 - DNA, 1119 bp, Oryza sativa
cccataattagcgcccacaataaacgcagttgtgggtttcagtgtccaactttgaccatccgtccatccgtcttatttgaaatatttttatgattagtatttttattgttattaaatgataacatatgaatagtactttatgcgtgacttaacttttaaaattttttcataaattttttaaataagacggacggttaaacgttggtacggaaacttatggctgcacttataatgggacggaggaagtagtaatttatgcttgtcattaattttgttgtttaagcccatgttgtagtgatttagcaaaatctgacagttttgcattttactaataatatattcctccatctcggtcccaaaataaacgggcttctggcatttaaattttcatctaaaatataaaatcttctataagtttaataggtgcaaccgtataaggctgttaatccaaaaagagatattgaaaggattaaccaagcaaagcctttccaccaatcagcatggattagctcaatagcggctggtaattatgccaatcaggagtggtcctgcttgtttaatgtgggccatttcagacttttgtcttccagctttgattggttttaaatttgctagatacttttatattttagaacgaaagaaacaatgtacaacaaatatttaaaatatggttcttcagaatgtaaagttggatccgatcttttagatgggtcatttattcttctatttattgtttcttgtaaaaatataggatattaatgatgacacgtccttttcgccaattttatatttgtctttttgacttataatgcaatatattctatttatccaagaattcaaaatactccatcaatttttaatagatgatattgtcgacttttaaatgtggtgtttgcgcatttgtcttgttaagaaaactatgcaagcatcatttattatcattaaagatttttttaagtataatttatatattttcaatagaacaaatgattgaacgtaatatctaaaagttaatagcgtcatctattaaaaataaagagtagtgtttttttatttagttcttgtttttttttcattttcctccgctttttacatgctgtatttatgttcgctcctagc

SEQ ID NO: 5774 - DNA, 1181 bp, Oryza sativa
tccgcgaagggagcgtcgtgggtggcagtggtgatggtagagctggagaggggaaggtcgtggaagatgagaagcagagtcgacgctcgctggcgaagacgccgcggacggcggcgcggcagcacggatccagcggcggatcttggcctcgaggacttcccactcgagccgctgcacgtcgccgatgctgagcttctcaacgccgaggcggcggagcgcggagtcgacggccggcttgcggacggaggcgtacacctggacgcactcgcggccgtagccggcgacggccatgcgggagcgatggcgtggaggtcggagatggcgtccgcggggaggagatcgatttctcggatgctgcgcagcgagcggtagctgctgcggcggccgacggaggacgcacggagtcgtcttcgtccgcagccgccgcttcctcggcgacgtccgcggagttggtccggtcgctgcacatggagagcgaggtgaggtcggcgagcgcctcgatctccaggtcgagggcgcgcgacgacagcacgtggcggaactcgtcctccagccgcgccatcgcgacctggacggcgttggacgccgcccctccgccgccgctagccgacgaggtgcggcgcgggctcccgaccgtggccggggacggcggcgccagccgccgtaggtcatccacagcccggaggaaccgctccgcctccacccggtcaccgccgccatcgaacagcatctgctcgtccccgcccccgcccccgtaggacgccgacgccgtggagtcccacctcatcaccaccctctccgccgcctccagctccgccgccgcagcggtggatccatccatcatgcttcaccccccaactcccaacacacccacgccgcagcacaacacctccacactcccgccggtacggcgcggggaggagagccttaagccggcggcggcggcgaggcgaggaggcgagagggcgctgtgcagtggccgcttcgagcggccgctcgttttatcgaattcgctttttgtctcgggtattttccccttgttgctttgctcctttgggcttcctcgcaccactaattatccaattagtgcgcggattagtagcaaagctgtggaagcggagactttttatcacctcccaacaaaataaaatacactctaaataaaataaataaataaataa

SEQ ID NO: 5775 - DNA, 1501 bp, Oryza sativa
gctgatgtggttcagcgacgccagcggcagcccgctgcccctgctgcccttcgccgccgccaccgccgccgtgttcaccatcgccgccgacgatctcccgctagctctcacgtacactctaatctctcgattgattccaagctccggcgaattgaagagatcaccgagcaaatcgagctagcaattaattaggaaaactgagctcgattgctagctagctaaattaacacggcacggatgaactgagctgttgatgattgtgatgatgagcgatgatcgagaagggatcggatatggaggaatcgggcgggtcggaggggattaaatagggctcacgagatcggtgccacttgacacgtgggatccacgtcaccatcctgctccgcaaccatggcagtctaagctgtactagctaagctagtggatggctaagctccaaattaaacagtactccactccgtattgtctacgaggatccaatacattaattaatggattaatagtgccgccaaagatgaattaatggattccatgatcacggcagagctaagagctaactcatctgtccaattgaaattagttccctctcctttagaacagagaatttttaacaaattatataggaattaaattttgttcctgtaaaaagattgatataaaagagaattctaaggtctcctttgaaatgaagaaagagccatcgatcaatggatacgatggaagttgattaattggagcatagctgcaggaaggtagctagctgcttccagacgttacgagacggatcaccggaagagaaggctgtcacggctagctagctagctcatcatccctgtacaatttgtctattgctggatcacacatattgacaacactgtcggtgtaggtttgttcctctctcgccgccgcaaggtccagattttggatttctctctaccgctttcttcgagctaaattccactttctttattttaaaatataagccacaaccatcgttaatacaaagatcaagatcacctagatgcgtgcaaataacgtggtgttgaagttgaacgatagaggatttaaaacaaagcgaattacaggaagatatgttagttaaatgcatgcaaaagacatgaagagaaaaagagataagtccattttatacccccgaactcttgcacatttgcctaaaatacacatctagctaaactttaaagccgggtattttgcatcccctagcttttagttccgtgcagttacccccctccccctccccctcccctcttaccggtttgtagtccggttttaaccaacatggtgctaatgtggcagtctactcagcactataaatataaaaagcttatgggttccttatgtcacactctcctcctccttctccttcccctttttcacaatccaacgatcctctgatttcatggagacaagattgatgagtgactcgccattgctaagctcgtggaggaggagcaaggtggccggcaatggtgaagctagc

SEQ ID NO: 5776 - DNA, 195 bp, Oryza sativa
atggtggtggtggtggtggtggtggtggtcaccggaacattccgtcgccaccgagtcggggcggagttgaggtcgatgcagcaccctgctgctccagcgatgtaaggcgagatgaggcgacggcaactgagcggctgagatccgccaagtcacttttggatgcgaggagggacatgccatgaagtacgtcggcca

SEQ ID NO: 5777 - DNA, 549 bp, Oryza sativa
cgttgtgtttgcacatggtcatactaccaaaaatgttaagaaaaaaaacaatcagaaccatgagttaacgttgaggtcaatttcaggggcggagccagcttgaagccacacctagggcttagttctattaccttgtccatttgcataatcacagaggaggtttaactttaggtccttcggtggtttttgacccggttttgtcctaggtggcggctgagtcctaggtgtggcttcaagctgactattggcaagagtcgcaacatatttttgcttcaattttttccagacaacattgtcgtttggcttctttaattttttttccagacaacattatcgtttggctgctttacctttacgcataaatcataaaccttgttctgttgtccatctacaatgccaaaggttgatacacaatcaggcctactacattcacacacatatacatggacagagatgcatacaagatataaaaatacaaacaaataagcataatacatcagatctgaacgaacccatcaccaaacaacaacaaacaagctcagatctggg

SEQ ID NO: 5778 - DNA, 1501 bp, Oryza sativa
ctcctcgaccggaggctctcggcacgcggcgcgcaggcgcggcgatcggcggcggcggcggggactaggccagcgaagccacgcgctctccgcaccctcgtgagtctctctccgtttccccccctgatctcagatcgaaaatttcatcactcgcgcgcagcggctcacgctcccgtccctctccgcgcagagggatctcggcgtcggccatggcgccgtaaaaggtgctcttgccttgacgagttcgttggctggattgctgctcggattcctctatttcaagcaagatagagatgactcaggtatgtatagtatggcgttattcttgaaagtgccgttagattagattcctcgccgttttaaatttccggctatagctgccgctatatatattatatatgtatatagagacatacgaagccattgtttctcttattggcggtataagcgaaacggcttatttgtaaacgaaaaataatttatcaataaaacttttatatacgtattcttagcgatctaaaagcaaaggctgaaaaataaacttcgatgaaaaaaatctcaaaatcagctccaaatttaatattgaaaattcaaattttgcctgataagcataagtgaaaagatgatgcccatagttgtttgagaagagtctagctatttactctcatttacaatttagccgctattaactgtgttgtcgaaacgacaaccgcatacgtcgaaagacgtggttacttaacagtggttggaaagaaacgaagtatattgatttcttgaattttctcccctgtattacatggccctagggggctatttatagccccgttacagattctcacttctagggtctaggttgtactgaggaatttacatagttgcccttatgaaagggacgtttacagggttacataacgtaaaggggggctcatgggcccttgatgggccatcgggcgatcgccggccctatggcctctatgcttggtgggccgagaaggctactttggccctcgcgggggcgaactggacctggcgaagctgtccttctctgggctggatgccggggcgaaccggtcctggcgaagttgtccttcttcggcatggcgaagtcgtccttcttcggcgtgcactcgtgcgacccttcgcctcgcatcatccttggctcgtggttttcgccatgggtttcggcagattcggtcgaagggactcatgccatccgccaacaagcccctcgcgggcaagggtgagagcggagcttcggccgagaccgtgcaaaccatgtggtatggtatgtggcgccccctttcgatcgatgctcctgccgaaacccgtactgttcctgcaaataaaatatcattactttttccgggccgaagtgaacagtattgggctttcccttaatgggctttttactgtgctggtcggatgatgggattttaccgttacgcctaccctcgcgccacgtggctctttgtgattggagggtatgcgaaacgtcgactcg

SEQ ID NO: 5779 - DNA, 1501 bp, Oryza sativa
ttttcgaccgcggtctccgtctcttcttcctccccctctccctcttcgccgtcaagttcttcgccatccttgtcgtcagcgtcagaatctgatgaaacaggagccctacgcttcctaggggcaagcttaacctgaccgcgcggccgcttccgcgaaggccctgcttcgtcaccagccttatggggattcgcccgaggaggcaattcgccgttaaaaacccggttcgcccgaccagttgcctgccgtgtaagcatttggctgtactcaacgaccgatacgtcgccgatcatcttacgggcttcggcttcggcttggtcaagggttagcactgcaaaggaaaggaaaggagtcaggttaaaaggtcaagcagagagagctaaagcgcgaaagtatatggcgaaaacagcagacttactgttcattccctcagggaggaccagcttaggcaagccatcaacctcttcgctcaggttaaccgcaacctgccatgactgggagaggggaaagatgcgaagcatgcagaactcctccaccaggtcgcggcagctgaggcgggaacagactttccttagcagggcgaaccgggcctccatagcgccatccacggcgatcctgggttttcgattcggcgcaataaccctgcgccgacaccgaagagctttcgctgaatcagagccggcctcgaaggggatggtgtggtaaaaccacctcgccatccaatggcggtcccacttcgacatggcagcattcgctggccaaaggtcggaccgttcggggcgaacattgaagttcacgctcccgatcaccgtcttcttcgtcccagccggagtaatcaccgtcttggagttcacggtggcgaagaatatggcgccgaagagagcagcgctaggttcgaacccagaagtccgacaagcccaatcgaaaattgagatccgaaccagcgtcgatgggctcaattgggggagctctacctggaagaggcgaaggatctccggcaatagcacgttgcacggaaaccgtagccctgcctcaaaaaagacggcgaaaaccaccgtccgattgtccacaggcttcggcaccacagctttccccggggcgaaagcctgccccgcaatcaacgccccagagctgactagtttcgccagctcgtcgtcatccacaagggaggcccccaaaaaggtggtgttatcgtcgtcgacccggccagggtccggtccgaccgcctgaacggggtttggtttgcgaggggccatggcgaaaggcgtgtgggccgtggcgaaccaatagggtaggcgaaacacctacggattcaagaaacgctgtggaaggagataacgaaggaggagagcgcacgcagtaaaagtggcaaagtgtgacggtgaaagggaaaggggtgagaatatatagcccaccgagtcgacgtttcgcataccctccaatcacaaagagccacgtggcgcgagggtaggcgtaacggtaaaatcccatcatccgaccagca

SEQ ID NO: 5780 - DNA, 1501 bp, Oryza sativa
tgagcgaactcgagacaggacgctgcctccggtgggcggcgaggccggctcccgtcccgtgcggctgtgggggaagaacgggcgaggggagcgaggggtgaggggaggacgatgtcatgctcccggatcttgcctctcttctagtctgccttgccatcgccgtcatcgatggccaccgtcggtgtccttcctccatcgagctatcttttcccgtgagcgactgtcctcttcaccacccgtcgccggccgccatgcttctcagtcacaactgaacaaagagatataggtgaagaggcattgacatgtgaggctcacactgactcaacattattaattcgggtcaaatttttacgtcggacaaaaccacatgtcatacttctgtcggacctacattacacggttttaacagttaatgacccgttgtatctgatatttcggtctaaggatataaaaatcaatttcgctggcaagttgagggacctaaaatgaagggcgtgttcactttgatgctatttttaaccttactaaattttggtaaagttacaaaaagtggctatatttagtttgctatcaaattttggtaactatataagaaaccctgccaaaattttagtaactatgccatagccaaaatttggtaaggtttttttggcatcaaaataacggaattgctacatatctggcgacagattttctgttaaaaatcagtcgatttgttgaccgtatgatttactttgagatacgtgtatgtgccattgagtgaaaaaaaaaatgtcgctagaacagggaatcgaacccatgatgtcgggatgctacgacatgcatcgtaccaactgagcaagcagcaaacgactactttctttctatgcgtaactttttttaaaactttcactgcagttacactacacccactcacaacatagttataccacgattaaaacgtaagtgcactacaattacaatgtaattttaagtatatgcgggtgtaatttttgttttacatgtacggaattttttactcatcgttgttttgttgcactatagttaacttaattgtttgaggtgtgatttgatatttttgggactatatataccgttatatttttcataaaataaatttacattgcaagtacccaaagttacatatgtaattttagtgtatttacactgtaagtttcaaaattacatatgtaatttcggtgtatttacactgtaagttttaaaattatatatgtaagttgatgtaaatagatgtaagttgcttgtttttccttttctttaagcatcattgacgtgattaccgtccggtgactgacgtacgtggatatgttttcatttgaaccgcacgtcgtggtggcttgaaaatccgactgattttctactaaaaatctgtcgaatgattttcagacagtccctcaaaataaacatgctcgaacttattccatctacagccgaactgacgtgcaacctggtagctcgcaaagcccaatagtcaccatga

SEQ ID NO: 5781 - DNA, 1501 bp, Oryza sativa
  unsure (1)..(1501): unsure at all n locations
agaaatttcctagaggctgatttcccttaattatatattactccgtagtacacattgacagaactaggagaaaagctttagcaccggatacataaacggacctagctgaaaactgtagtactgtattctcatgatgtaacactctgaaatttcaggttttgtattcggtgtatttcgattggtcgtgagatggtgaggaatcgatgatataattcgaactattttactggagaaattacctaagctactctttgttgagtggtgacctcgagtttattcttaaaaaaggcgcacagattattggagaaaataccttaagcaactttatgttattgagttaattggattcatgccattacaattttattgatttgaataaaatgtcattactattaacgaaatcggggtggataccattacattattttgaaattatagctatgtcacttcgttctgtcaatacctccgtcagatccaacgggccatgagcattggctgactggtcatcttctccccccacccacatcctcctcgcatgttctagggtcaggcagcggcggcaacaatggggtgttggtggtggcttgtggtaagcaggacagcgacgagcaagatggacaagatggtgcacaagattcctcatttccttgttgcagtcagtcttggccctcaaatcacgcttgccttgtggaggtggtgcacaacgtggctcaagctcactggtcatggagctgagggcgtcacactgcgatttgcgcatctggcgatggtggttctctgagcctgtgtcctcggggaggtcgagtgggattttgtagatcagactcgctcgcatctgtgctagactttctttagaaattttgaggtcttttttatagtgcttgtttgcttaggcacatattgagccgaaagttggatattagaaagagttttgactctttgctaagatttgcttggttgcttcgcatgcatgcgatctctgacaagccatctgtagatgtcaagattgccaccaatgtattgccctacagccatccgccctcaagctcaaccccctatagcttcgtgcagtctcatccaactccttgcgtccacaagaagattcgagaacaaggaggaagaagatgtgttgatagaagtcatgacggagtgacatgtttctaatttttgaaaagtacaatggaatccacctggttcatgaatactaatgataatttttaaatccgatacatttataatgacatggattcaattaaccctatgttattaccttgacggcttgaccgctcgactctatactttgtcaaaaattagaaggaaagtagggactgaaatgaaaaaggtcccgacgaacccctaccgtccgatccggctcccatctatatattccactcgctcccccacctcacagctctcatccaagtctagggtttcatcctcctcctcctcctccgccgccgnctncctcctcccccacctccactctccactccaatggcga

SEQ ID NO: 5782 - DNA, 300 bp, Oryza sativa
gttggcgggttgggggtatttatagaccaaacacacctcaaacagggttagattaaaaaagcccgtcaaaggtatgaccagttgcccgtcactggtatcccctcacctgtgacgggccagaaaaaaaagccgcccaccacctgtgacgttttataatgcctcggcccgtcacaggtgagaggataccagtgacgggttggaagcaaaactcgtcactgactcacctgtgacgagttttcctttcggcccgtcacaggtgaggggatacctatgacgggccgcggccggatgcctcaccga

SEQ ID NO: 5783 - DNA, 1501 bp, Oryza sativa
ccgaacaaagaaaaaacacgctagtgatgcatagcaaaaacctttttttttggggggggggggggtatagtgtgttttagtcaacaaaatcattcatcaaatagtgccaatattcgtgtcaaacaagttaggattttttgcagctgtaccttgaagaatgggtgattgtgtgaatcaacagaagatcacattaagcagccaagcaaagttctctttgcttggaggatgtgtgaagctcagatgtggcacccgagagaaccacaaattaatggaagaaaaccacagattaatggaagtgaatcaaagaggattttgggggcgggggcgtgggggggggggggggcgcaaacactttgtaatatcttcgttttcatacctggcgtcacatctgttttatcacatccggacatccctcagaactcctagccctgttgtttagttccaaagttttttttcaaacttacaactttccatcacatcaaggttgtgtttagatccaaatttctaactttttccatcacatcaacctgtcatacacacaatttttcagtcacatcgtaccaatttcaacccaaactttcaactttggaaggaactaaacacagcctacaagtttggttccaaattttttcttcaaacttccaacttttccattacatcaaagcacacacaaacttccaactttgacatgcatgctcactggagacatcgattagcagaaaacatcaacaggtggatctataaaggagacatccatgcataactaaaggtgacatgcccaatggagatatagattacttggaaaacaaacatacataggtctgatccatgcataattaaaggggcagctcaaggcaaggtgggtatgaaaagatggagggagagctacgcagttgtgctgtcaacagcttctaagcatggaagctctgccttggttctcttgtatgcgtttctagcagagttttgtccaagtttgaagcttgcgtaggtgatgatggataaacggattattctacccctgaaattcaataaagcatgaccaagactcaaatttaagttctactcctgaaactcaataaatcatcatcaagaccaagagttaaatttaaggtagcagcaagaaagtcgtagaaacagacggaagggaatcggtattgcaccagaaaagcaagcgaggactaggagcaagatcatctcccccaatgctttgcacccccgattccgcagcatccctttcctgctgcatcatcgccgaagcagatcccttcttcatgtggccgctgttctttgcgatcttcttatgcaaatcaaaatcaggcataaataagtaagcaagttagattttccttttgaaaactcaaacttttattaataaagacagagttcaagggaatgaatcacagtacatcgccgaacagatgttctgtggcactgaaccatccttaaccacaaatatgctaactgataataggaaccagacttcctaaggaaaccaagcagc

SEQ ID NO: 5784 - DNA, 1501 bp, Oryza sativa
tctggcctgctctgctctgttctgtctcctccctcctgggggataagcccttggcttgttcctgctcagctgtcttggccgatgtaaaacaaatcatgtatttgctcttttcttctgatgtgtatgccctctgatggcctctgtaattattgaccaagtgtatggagagctgagatcattagttattgattggttgaattgaacgtgcttaggttgcactaactgtaatcgtttacttatggcaataaattgtttacttgatccatttacttgtgctaaaagtgtactctgcatgagtggattagtttactttggttctcttcttcttggactgtacacgtcaagttactgtcagtctgtgacaaacttcttgctgaatgtcaggtgtatgttaaacatgcgttttagttgagattactattgattggttgaattgcatgtaatctgtactaatggcaataaattagttatttgcttcatttatttgtgccaaacgtgtagtctgcataagttggattgagttcagactcttaagtctgaatttcagacatgttcagaattgagttggttgaaatttcagagaagttcagaattgagttggttcaatttcaaagaagttcaataacttagttacttgatctattgtttatgccaaagtaataataccatggaagaaaaccatgcactgaaaacattgatctgcgaggtgttctgtgtcaggtggaatgactgaccaaaattctatggtatgtgggaagcgtgatccatcctattacaacgtgtcgccaaagatgcaatctcctggtcctcatcttaatagtttgtatgattgtcaattttttcattgtcgacgtaaataatatccaaccttttgcgaatcttattaactatagagcggatttcagccttaagctcaaggagagcacaaccgaggactactggatgttgaaataagggtacagtgcactagtcattgagttctaataagtttttgatctattaaacattcccttaaaaacggcatatattgatgactcgagagagcaactaaattaaagagactttttacaatgcttgggaggtatgttaggtaccatttgttatctccatagccaagtgcgcttgtacacctcatattataacaagattggatattgggatggtgctctatatgtgttttggggtcaaccagttgccgctattgtctacaaggctagatcactctactgttgatttgctacttagcacagcaaacttgctccccgacgtttaactgggcatcagcttcagacagagacgcagttgcttctctttgtctgaatgaatagtactagtgtttccgactgacattttttacattggtgaaatgtttgatccattgcgctggaaaatgacttatattcgctaaaaagaaccagtgaaatagaacaaattatctcaaatctgaactttctgaaaattcagacttgagatctgaactcaatccaactcatctcggcgt

SEQ ID NO: 5785 - DNA, 1501 bp, Oryza sativa
actagtttcccatgtagtattattaattctaaatttagtaccacctacaacataccagcgaacatgatataaatacacggactccacaaacaaagtacggttgttactagttgcgattgccacttcaattcactatagtttagattcaccaaaccccccctaaaaaagtttggaaacaaaagtctcataacaacgaaacctaatttggtttctgctcttaatgcaagttctcaacaaacgacaaactatgccaaactctcagctaccagctgacacctgcaacattgttccaattgttttgtggacacatgatacttcaactttgttgtttcaattgtgtgtggagcgaaaaattaaaaatatgtggtcccaatatgggatttttttttaatttttaaatttgtaaagtaagcccgccagtaacttatgttcagatccaaagcttttaacaatcccatgatcaattaaaaatgcttcgaatgaaattttctcaccaccgtgatgtttcagtcaaatctgaaaagggttatttataaatcgtcatttggaccaatacctccataattcaacttacatacactgaaagcattttggaataaattttttacctccaaagatgtttcaacaattacaaaagaggaatataaaccctgatttgtacccatacctccataattcaacttaatcacaatgtcaatcaatgtcctgtggcaaagtgccatttcagaccaaacctgaaaaacctttcaaaacttacaaacacaaatttgaacaaacacattcatgattcatcccctccacctcctcctacacccaaaagctggtccatccagctgcatcctatgcatggattcatgtgcagagcatttccatttttttccctctctctcttcacaaaaggcacaccctaaaaaaatttataaatatttttttcctctaacactaggttaatctaatctccatactttatttattcctctccacatccactaccactacaagagagagaagaaagaggagaggaaaaaaaaatcctctctttttcttcttcttcttcttctccccccttcctctgcatcgaagctgctccctgcagtcgcaggatcccgaatccgagctcctccccgccattgccgcgggggcgcggcttcttgatctgtggaattcgatcggggggcgcggggggcgcggaaaggtgggatttttgcggcgagatttgggacccatctttggcccgtttcttgtggatttcgttcgagttcttgtggttttggatcgggttggtggtggtggtggagctggaaaaaggtggttaccttggccaccaaattcccaaccctttttctgttcagattcttggcgttttcttgcgcaaattttagctagggttggtgtggattcccgctcgtacccccattagctcgtgattcgtatccaggttcgtgtaaaaatctgggagtggtggagatttgggaggttttctccttcctgtgctctatga

SEQ ID NO: 5786 - DNA, 1501 bp, Oryza sativa
tgtagtgtacttaactatgaaactgcggtgaaagttttaaaaacgttaggtatagcagcaaagtaatcagtcgcttcttgcacagttggtacgatgcacgtcatgttatcctgacatcatgtggtcgattccatgctctagcggcatttttttttcactcgaaggcacgcgcacaaatctcaaagtaaatcatacggtgaagaaatcgacagatttttaaccaaaaatctgtcgacagatatacagcaattccggaagaaaaaacagtcaacagacaaaaaacgacggcaacataaaaagatataaaaaaaaagaagagaaggaaatattttgagtccaaacaattccaaacccacacaccccacccttcattttcttccccctttcatatcctctttttccctttttccaccctccacagccgcctccttctatcgcccctctgcttcttctgccggagccgccgccgcgccctcctcctcgcctcctcgcgcgcgccgccgccgccgagcgagcgagcccggagggtgcgtggacggcctcctcttcctccgtcctagccttctccgctccctcgcgcgcgggcgcggcgcggcgcggcacggcacggccggcgagcaaagttcggagaggcggcgaggtcggccggcccagccagccagccagcctcgttccgccacctcgggttttttaaggtattccttctccgctactcagtgtccctcttccacctcgtagctagtatcccctcctccttcccaccgcccccgcttcgtagcagtagcatccctcctggtctcctcctaagcggcacctcgtgcggcgtagattggagattcatccggattgggattggtttcgtctcctctgattaatcttattttcctgtgtggtgctgtagtatagcagcttgtttccagtgaaaaaaaagaaaagaaaataaactcttcttttttctaggtttatctcaaccccatgcccccatgttaggtctgcccatgccttgaagggttctttggactttattacagtttgccattgctaattgcttacctagattctttgtttcttccttgcttgatgtatgcttcaaagtaactttagattttgccttttgtaatacatagcgatttctggagagggcgggtaggttcactgaatctgccccatgtttatggtcaagtagtgaaaatgtttaattggtccataaagttgtgattccattgtgctagaattgtggtagtggagatggtagggcacttgatgtattcttcttcgtttccaacttttgggattggtggctgagaatgcggttcttgttgtggctgtcaatgcagtgcagtcgcccgccttcactgtgtgctgtagattgaggcaaaaacattttccaggagatggcagcgacgatggtggcgatgtcggccaagagcaagaacagcgtgctgacattggagaagaagcagggctggtctgtcccacaacttccggagctccggttccc

SEQ ID NO: 5787 - DNA, 1501 bp, Oryza sativa
tcaagcggaattaggaaaacagaaaaacagacttcaagtggaatttggaaaacaattttaaaaaatttgattataaattaaaataaaactcctgcaaagaaaaagctggaacgggatacacacgccatacacctgacaagacctctcctacttcgagcaagttagcagcatgtgtacaacttctcctatttctcaacccgttcatgagaaaagagatatgcacgaaacaagtatgggctccttcgattgctagcccatgaatcaattacagcctcgacaagctttcacaatcatcttaatcaaagaaatcctgcttataccaccaatccgtgttggagccatcctctttggtttggactatatcatatgtgaatggttacaactagttggtgttgttactggttgcgcctccaataggctcgcggatgtgggcgactttatggtgcaaggtggattgtatccaatccggtcgggggcaacttcgttagcatggctggcaccttcttgcgaaggtagccgcactagtcgatgttagggataacctcgtcgacatgcaatgttgcagtaaaggagtcgttttacgagcgcatgtggttcttgtccttcaccactagtcccaatgtgcaacaggatgcttgccaacaagctcaatgctgcacggcattaaccaacatgcagtgtcttggttggcttcatacttgtcttgtgctgatatcggtagacatgcttcttcaccgtggttcgatgataagggaacttgtttccgtcgtccaagaatggtagcaaaagaccggggcatgctttttacaaaatggatgcatcgaggcatcgatgaactagcgatgctcagtcatatgtatcttgcttggtacctcaatatcaatcagattcggtactttttatgcatatagtataagacttgatatttatcgtgttgtttcggaatggtatcccgtacaacagcgtaaaagcgaaagaaaaattaaagtaccagtataagaattgctataaatcaaattctatatcacaatataagaatttcttttactaatttatcatgtttcacaacacttaaattttaagtgaaaccaggtcaatttgatgcttcaaaagggaatctgatccgttcaaaatcttaaaactaacaactgaagtgacttaaaagatacggagtactaaatattttgatctaattttaatactactaaataaacaaattaaaagaccttcatatttatatcttcaaactgagagtttagatggagaggtagaagtagactctgcagaaaggggaaaaaaacagaaaccttccagaccggagtggagcctctctgtcccgtggcggccatgtcagccggaagcgaaagagcccacgccgccttcgcgagcccctcgccggtgtcgggggccttcttctccgcctccggctcaatcctctccggctcaatcctctccggctcaatcctctcctcctcctccgccgctgtcaccaccaccacca

SEQ ID NO: 5788 - DNA, 489 bp, Oryza sativa
gagtaactcggcgacatgttgcaagtatcaatctatatattccggtgaattacttatttataaacacgatcactatagtggtgatcatcatttcatgtgttcttatatttcatgggagattcgattcaaatgaattagatttaatcttactatttctttagctaattgtgacatcaagctatcaatcatggttcgaatatttaatacctaatttgtaatttgtaatagaaattaatatttgacttaactatcttgtgcataattatttgtaggattaaatatattctcgtaaatcatatctattgcttaaatgtagttcttttctttaccttcttggtgatcatttatggtttggcaagcaataggaatcataacaaccagcatgatgcaaaagttttaaaaagttcgaaattttagtgatttttattgttgggaatttttaggatgttacaggtgattccttggaagattggtttcaaggaggacatc

SEQ ID NO: 5789 - DNA, 1501 bp, Oryza sativa
ccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcaacattacaagacgttcatactgttgccatacaacacagagttagtttaattttactgtcttcctacataccaaatttcattcccgtacgaacttgctaagtgtttcatatgtaatgcatcccacgcacattgcagattccactaggtgcttttattcatcgacctggaggcctgcaccgtcaacgtatatgactcaatggataaaaaagagtctacatttgacaaggttttcgaacttatagacaggtaccgtcataagttcctttgttaattaagaaaatcttgttatgttaattgctactatgaattatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtaagtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatatctatatacatatgcatttgcataacatatatatgtataaatacatatatattatgcatgtatatacatataatataatataatatatatatatatatacatatatatatgtatgcatatatatgtattgaaacatatacatgcatggtttatatatatatatatatatatatataaaccatgcagcaacagggccatgcaaaaaaaaaaaaaggtcagctcgatctttagtcccggttggtgttaccaaccgg

SEQ ID NO: 5790 - DNA, 1501 bp, Oryza sativa
ggtagatgtgtaacatcctaaaaattcccaacaataaaaatcactaaaatttcgaactttttaaaacttttgcatcatgctggttgttatgattcctattgcttgccaaaccataaatgatcaccaagaaggtaaagaaaagaactacatttaagcaatagatatgatttacgagaatatatttaatcctacaaataattatgcacaagatagttaagtcaaatattaatttctattacaaattacaaattaggtattaaatattcgaaccatgattgatagcttgatgtcacaattagctaaagaaatagtaagattaaatctaattcatttgaatcgaatctcccatgaaatataagaacacatgaaatgatgatcaccactatagtgatcgtgtttataaataagtaattcaccggaatatatagattgatacttgcaacatgtcgccgagttactcatgacatgaaaatcactcatataaaataatggtcatataaataaattaatccttatatataaacaagaatatgtgagtgtttaaaattagattaatgttgtaccgagtcttaatatactatttatagaataaatagattcaacctatccgtgtaaaatatattgctataagttcattcaatgtgctattgtaataataagggccacactaggatattttagaaccctcaaagcctccaaaattatctaggctaattttagaattagacctcatttaaataatacaatagaaatatatatataagaataaaatatgggtaatattaaaatttggtaaactttcatctaaattaaaacatatattgggcaaaccttatttatgtaaaaattaggatttatagaatgaaatttatacaagggataaactaaaatcgggttaaatagaaaatggcactgttcattgcactctaggtgctcgatgtggtccctggctctatttccccctcctcagcctcctcagccgcgcgcgcctggctgcctcgcgccccgcgccacgccgctcgcgtcgcgtcgccgctgccgcgccgtcgccgtcggccgtcccgtcaccgctcgtccgtctcatcgtcgcctcgcgccccgcgcccacgcgccgctcgtccgtcactccgccgcctcgcgccccgcaccgcgtcgtcatcgcctcgccgtcgccgtcgcgccgaaccccgtgccgtgccgcgccgagctccgcgccgcgccgtcgcgtcgccgctgtcaccacctgctgccgcgtgcgcgttccatcgccgcctcgagccgtgccgctgccgcgccgcgcgccgtcccgtcgcctcgcgccgcgcgcccgctgcctcgcgccccgcgccgctgccacgtgccgcgccgccttgcgccccgagccgcgccgcgccgtcgtcatctccacccgcgcgccgcgcgccgtcacatcgccgccgtcgcctcaccccccctccaccgcccttcccttctcttccctctcccccttatcctctctttc

SEQ ID NO: 5791 - DNA, 1501 bp, Oryza sativa
atacatgttcactttactttcttacattacctttcattttcagagacaagatgatccaaataagaagcagccacatagagcaatggtttacttagcaactcacaaaaaaaaggataaagataaaaatcaacacgtggtatgccatatacacataatccttccataaatatctaatatgtatgttatctaccttgtacagtgggcatatattttttcacttgcaggtcacattggagaacctcatcgatgaacaaccagagttggcacaaaatgaccaaggaagagttgcatgggaaggtgatgcgctaaataaagtattgggcaaagaaaaacctggccaagtgcacggaatgggattacttcctgttcctaagcaggtttatggtcgtacatcacatcatctcaagaacataaacatcactacagtgaatgactcatcatcgaatgaagagacacatgttagaggggaagtgggggaattaaaaaaattagtcaaaacactgggtcagcgtattgaggagttggaaaacaaaggaacaagcaatgggaatagtgaaccaactatggtaaacgttataaatacctttgtccttaacattgaatttttagctacttctgatttcatttttgtagatgcttgtaaaataaaaaatttatgtgattcacactaaaatcttaccccttcctgatttcattgttgtaggcaacatctcagagaacttttgatgatggtattgaagagggagtagtacggactaatagaaaggtaatgtcaaagtaatgcattctatgtttctcaccatattttgtgcaacaatatttaaatatgtgcacatacagagggttcgatgcagtagacctgatcaagacgactcaatgagtaatcaaagaaatatatcaatggtattttgtcgtttctaattgataaattttatttgaacactcaatacacatactggcatctatagtaaatttttattgtccattccactatagaacaaaagaagatgtgaggaacagcaaaatatgcaccatgacaatattctggatctttgtggcaaaaaggttaggatttgttgttttcattcatatggtgcaatgcaatttatatatggttttacatggattatatatcatggaaccagcaccaggaggctgataacaacataggatcaccatgtcaagatgattcatcatcacagccacaccttgctcatgatcttcggtgggaggtagttcttgaatgcctattaaaattgtacttgtttctcaatgtgttttatccatctcactacgatattagagtgaaatataaacacgttgttgggagaactcctagttaggcaatgctacatctgtgaatgcatcatttgtgtgaaacataaacaaaatctttccaaggagtactgctatatttttatagacattaatcaactgaaaattaagtagtagcttctagtgctcaagtttagctttggacccttcatctatgccatttagt

SEQ ID NO: 5792 - DNA, 390 bp, Oryza sativa
gtcaagagatccaccaacgaagaataatcgtgcgagacgtgtgatgcagcgatatttttttctcaccgcgctccaagtcctacctctttttttttactcacctctcccacctacctctctcccagattgttctcttcaccacctctccctcaacctctcaagctcgaggcacgactactaataggcggcaaacagtggcggagctaagtttggaggagaggggggcctcagccttcttcttcctcctccagcccactctctccccccattttcttcttcctctccctcttttccccctctcctccctcaaatttccatggagtccagctgggtagcgggggctcgagccctccccccttcccccgcccccatactggctccgccgctagc

SEQ ID NO: 5793 - DNA, 1412 bp, Oryza sativa
tcccccaacactgatttgtttagggcatagcaagattatgcggttgcgcatgctttatttaatccttattgaacaagtgtacctcaatagcaccaggatattttatttttgaagtcaatcaggagaaagtggtatgaatgattttctatacgagttagtgggtttgtttcagccgcaccatgcatcaatgcagcatgatcagttatttgactcttaatttggatcttatcttgataaaggtaagggataacgcaaatgttttaagaaattaatgatggatgtgaactgatggtaaagtaacaaagggaggggtgatgcatatagaagatcgaacaaaattcaggagcatcaggagtgacatagtgaagtatttagggacaccatggaattttagaaatatttgtcattgaacacaagactacaaatcaaacacaatatatgaaagattttgagaacacgagtctcgatgacattactgcaacaactttcttttttcatggccatatggctaggattaaccaggagtattggcccatgtgactggaaatagattagaagtatggtgcatggatattgcataaatcatggttatttcttaaagggaggggtggtggcgtatgagacatgagagagaaacaaacagataactccttttatttaaagtagcaatacatgagtctaaatacaaatattagcctcgataacactacccttcaaatcacaatggtatttatattacttttcaaaagggaaatgctacgtaacggtatcgcgttcggacgggatgcattagatatcttacatgtatcattccgtccaaacaggataccgttttatattattctcctttcaaaatttcaatcgcaaccaaatacccgtgaagtcaaaataaattgcacccaaaataccaaatccactccaaatattccaaacccctcgctatactccacgaccaaaataccagaaagaagagagacttggcgtcctccaaaaaaaagggaaaaaagaagggagatttgccgtcccaatcctgagttggccacaggccaaccccaacccaacgcgaccggcagcagcagcaggcggagacgcatggtcatcatcaccatcgactcatcgtcatccatccccgcacccaacaccaaagcgcacacgagagacagatttccttgggcgtttttcctttcccttctcttcctctctttctcccccacacgcatccatcaccaaccgaacggccacatttaatcccaccaccaccgcctcctcctcctcctcgcgcggccgcacccgatcccaatccacgcctcgcctcgccgcgatccacgccgccggtggtggcggtggaaggaaggaaggaaggatgctggagacgaagccgccgtcgccggggacggcgggggcggcggggg

SEQ ID NO: 5794 - DNA, 947 bp, Oryza sativa
  unsure (1)..(947): unsure at all n locations
ggtatcatccaattttaattggattggacagaattcagtggtgtggaaaataacaaacatatgccaccgtaatggatttcattgaggttttgtttacaatcccatagtcatgatagttgcctcgaacatctttcagtgaggttcctctcaaatatattatttgtcatgacgaaattatacagatcttacgcatacatcgtatttaaagagacaaacaaacacacatacacttaaaaacaaataaacaatcaaacacaaaaatattgaaatgtaacaaaaacgaaaacgagcacacagaaaataaaatcaagacatattgctttatcagtatctttagatttcgttacctttttcacaggccaaaagttgaagttgtatagagagaagtgtctaatttcaattttaatacctgtttttatatcattttccaaacttcttcattatcaaactattccagatagttcgttatggatgacatatcangagcatatacacaggggcatagtttcgggggggggggggtggggtgaataacgacaaattgtgattggtggagggaccctttaaataaagatgatccgcccctttttgacacctcactctcattcgatgagcttgtttttntgcatttcaagtaaccccccccccctagtctataccttccctatacgctactggacatgagggcacatatcggcacaatttttctaatgggggaggttaagggggctgcctcctctagtttgaagagcctgcgtgcaagtaaactctgccctctgtcacttttctaatgcactattatgaagctgttaatatctgctacatgtacacgtttttcatttgaggccttatactcgtactctattgcttcgacaggtcgactcataaatgaagcacttttcgggattcataaacgaacgggtgacttctggtcttattcaaacaga

SEQ ID NO: 5795 - DNA, 276 bp, Oryza sativa
tctctctctctctctctctctctctctctctctctctctctttaattaaaatctctgtctctatttctatccctatcccgttctccatctctacttttcaatctttctctacatttctctttatttctctccgtcactgccaatttgtttctttctctctatttttataactctatcattcccccttctcccccgcccccctctctctctctctctctctctttctctttctctctctctctctctctccctccctccctccctccctccctcaga

SEQ ID NO: 5796 - DNA, 1501 bp, Oryza sativa
tactccagagtttactattaagaatctataacccacactgtggatagcataaccaagaaacacacaatcaacagtttttggtccaagtttccgctttttgactataggtacatttaccttggccaaacagccccatgttcgtaggtatgagagatttaatttcttcctttcccattcctcgaatggtgttacttccttgtgcttcattggaattttattcaggacatgacacgcagtcagaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttacgaggctgtttcgattgaacacaagtatggcacttggaacctttgaccaaagtgaattttggaattaaactcatgttagctaagcgcatcatacaaccgaaattcacatgacagagtcgcgaatgccacacattagactcatcattctcgctaatatggttcacagcgttatgattattacacatgtcattcaaagaaaagcggaacaagcctccgctgtcataaccttttccaacaaaagtctcatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacaactgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcctttcttcttaaaattggttgcagccttgggtttgacatcaggcttgactttcttgttgttgtgggatgcatgagggttcttcttctgtaccatattggcactagaacctccc

SEQ ID NO: 5797 - DNA, 1501 bp, Oryza sativa; identical to SEQ ID NO: 4516

SEQ ID NO: 5798 - DNA, 1501 bp, Oryza sativa
cacaaaacaacatattatcaaaatacatacaatgctacatttaataaaactaatctggtattatagatgttgctaatatttctataaacttggttaaacccaaaaaagttaaaacaatttataatatgaaatggagggagtactccttacaaaacaaaagaaaaatctatgaattatatagagatactactaggagcgcagcatgctcctagtattccgagcgccaagcatgcatcagcccaagcccacctcaccccacgtcccatcatcttgctcccaccattatcagagtaaacgatttactttgataaaaacaacttccctgctccccaccccaccgcacgtcctgccatcctgcttccaccattatcggagtaaacaatttacttcgataaaaacaacttctctgctcccgatgtggtaaagattacgaaaaccctttgactcgggcgcccgatgggaacaagaatattgggcgcccgcgccccacgcctcgctccacccgctgcccagccctcgcacccccaccttccatattatgcattcccctcctctctctcaaccgtttctctccacccgctcctcacgctcactactacaaaattgatttttcatggcgtcaacttatttttttctctggcggccatacgtgaaaaccaccagtggaattataacaagggttgggggctaatggccagcagcgaaaatggatcgtccttggtggccaggttaagagggccgccagcaaaaatagaggtatttttgcaagtggtgctcttaagatgcagccagtaaaaaaaaactattttttactggcggggtgttgggagcctcgcttgcaaaaatcgtgggagggaataaacatcacgtgctccctctttttttcctcgacccctcagatccaacccttctctctttctttctttctttctttctttctttatctctctctctctagctagtagcagcgaaggggtgcagcggcggcggtcaatgatggcggcgctcggcggcagcggcagcacgacttggccatgcttggcggaggcaaggagagccacgtagtggaggtcggcagcagcggaggggaggcggcggtgtgcttccgtccaggacgcgaccacgacgacgagacggtcgcactgtagggatcagagcagttgcggtggcctggctctcccctccccctcctagatttggttggaggggagggggtggctcggtccggatctggcgacggcaggtcgtgacggtgcagatctggcagcagcgagtcacgggggcatggatccgacggcgacgagtcacgggggcatggatccggcgacagcgggtcacggtggcgcgaatccgatggcggcaggtgacgatggtggggatctggcagcaacgacttcctcccggctatggcttccccttggcatatatcctcctccatagtggcaatggagacgggtggcgatagtgtaggggatagattcgactgcggctgatgtgatca

SEQ ID NO: 5799 - DNA, 1501 bp, Oryza sativa; identical to SEQ ID NO: 4519

SEQ ID NO: 5800 - DNA, 218 bp, Oryza sativa
cccagcagaagaactcacgactcgtctggagtgactccgccgctacctcatcggcccctcccctattttcatctcctcgcgtcctcattggagacaaggagggatgaagatgtcccccatctggttgcatataaatgcatccgccctacccaaacagaaggaactcacaactcgactgttaggagtgactccgccgccacctcgtcccctcccctcca

SEQ ID NO: 5801 - DNA, 1501 bp, Oryza sativa
ctctcttttctttctttctttctcgcacagatacaaaggtgcacccggccccgcccctcccgcgagagcacttcggttttaatcgccgggagaaaaaaaataaatgggaggggcggtttggggaagaagaagttgaagaaggagaggaggacgctgaaaagaccaagcaacaagaagggagtccctctttctctttgggagtggagagagagagagagagagaggcatcggccatggcgaggtttctcctgggtgcggccgccattgcgctgctcgccggcgtgtcgtctctgctgctgatggtgccatttgcaggtcagtgctactgcttcgctttactactcctacctgtctaacggatcggttttttgttacaggagtttagagaataaatatgccatattttctcctttttttttattcttctcggagggtaaaaaaactctgatatttctgggcttgggaggcttggaccttggagtcacctgcttgcttaatgcgtgttgttttgcagtcaaaggttgatgcttctttttgggaaaaaaaattatagcgtttttgtgaatgttttcagtccaagattccttcgaaatggcgccattttgttttgagctcacacatttcacccttcctcaagttggccttgctgcgatgctcgcatggtttctcctctcgaaagacaaaaaaaaaattaaaaggaaaaaaattgctgtcttgattcataagaaggaatgtttcctgaatcttgagtcaggaataagaatcctagtaatagataattatatctgcggttggaatcacgtgaaatcgtggctgcggtgtactactcaagttttatttcgtggacacgggtggtggaacacacaaaagggctgcggtttataccgttccattgtgactagtagtacacctctcgttttaaagaatctagttagaacattagccttttttgggcatgtggccatgcaggtattgtgtttgtttgttaactgtccaaacaatgttgtcctaccatggcctttgtgctctgattctgggctctgttactctgtgtcaactctgtttcatagagttccatattattagtccaagtccaggagttggtacttcgtggcaagaaaaaatcagagcaaatgttgctatagcagtttaccaatttcgtatttattgatctgtttatgtaattattatgttgtatgaagttagaactctgctccccacaaatgtagcatttttcctattcagtccaggaaacaaaggtagaactttcatgagtgctggaagtagttaggcaaaagaacaattatgatggctgtggaacatgtgaattgggcagttccagagttcttccccgtggtttcgtattatgtatgtagagttgaatgcatgcttttggtctagcatcatgtaagcgccgaattcgacccaatcgcggtagtttgtcaatccagttatgtaaactgttattcgaagtagcacttcaggtttgcaaattgcaggg

SEQ ID NO: 5802 - DNA, 1501 bp, Oryza sativa
agcctcgggaagggagggtggcgcggcggtggaggggggaggtgggtggcggcgctgttccggcgtgggtcggtggagaggtcgtcgctgcagcgggtgttcggcgacgccacgctgcgtgacaccgtcgcgccgctgcttcgccttccgcctccgcgacgtctgcgccgcgacgtgcgccggcggggccaccgccacagccgtccgctccgtcgacgggcgcacggccatcgccgcggcgtcggccggggtggcggccatgggcaaccccaccgccgccgccatcacccaagtcctccacaacaagtaggagttccccctcgccgccggcgtcgacgacctcctcgtcgtctccatcggctccggctcctcctccagcgccgccccttccgccaccccgtcctccaggggcctgttgctggggtggtcggcgaggccgacacggaggtcgcggccgcgcaagaggtggccgtggaggttgcgggtcatcccgtcgtggcgtcgtcccggcggatggcgaggcagggagaagcggggcacaccgtcgatccggcggcggaggaggaggaggacgccggacaccgcgccgcggctggatccggccgtggaggaggaggagccgaggaggacgccgacgaccaccatgcccgccggccgccgcgcgctcgcaaagagaagtaaaaaaagttgagaaaaaagaaagggaaagacagagatgacgtggcacgccgacacatgggtcctatgcagggtcccacgctcactcagccgccacgtagaccaaaaccggggtcaaaaccaccgaaggacctcgggtgaccggttttgtatagttaagggaccccgcgtatctggttttgtggtttgagaacgttttttattccgatgacaagttgagagacctttggtgcactttttccttttctttttctacacgcacactttttaaactattatggtgtatttttttagattttttttatagaaaagtcgctttaaaaattatattaattcatttatcaagtttttctaaactaacacttaattaatcacatattaataagtaacaccattttccgtgcggggaggtcccacctcataaacccagccttaaatctagaggtgcccgacacattttaatttcttactgtaacatcagtgtaatacagcaaacagcattcaagtacaggccttaacttttctttccaccaccggtttttagttaagcaaaaaagtatgtattgtgctatttcctaaaagatactacaacgtacactgttttttttaaatacacttaatttccttttcctcattgaggaaacatagagacaacgagcagcttaatctgagttatcgccagagttcagccaatccaaatatgctctgatgaacattgctagttctgccatgcaaaagaacaatcagagcaaaagaatgcaacttaaactcacatataatagagtgcacaccaagcatcgctaacatattcggccaatatttg

SEQ ID NO: 5803 - DNA, 666 bp, Oryza sativa
cgccggagtagtggaggaggtggaggaggacagagagagagaggcgggattcaaatcgaatcccggccatctcgcgggcgcgggggtgagcgggagtggggcgtgggcgcgggagggcggggcgtgcgggaagtgggcgacgtggcccggggcgcggagtggggcgccgaaagcgggggaggccggccgcgatgggtggtggtttcggcggcggttggcgcgggcgtgggcggccagaggttagggaaagggctgacaggtgggccccacctgtcagcgcccgagagggagaaggaggccgggtgaacttcgggagtaggagggaggagcgggccggcgcgggaggaaatgggccgggcccaagaaaaagaaaaaaggagggaaaagaaaaataaaaagaagaaaggatttttccagggatttaatattgcactttgctcattttaattgattaaaattattttcaaggctctgagaattccactaaaaatcgtgttagcatattttgacatgtagaatccaagaaaaattccacatgtcgattccgattattatttgcatttattaattagggattcatctctaggttaaattaaacaattacttcggacgatttattttatgaatttagagcaagggaggggaacttcagggcgtgacagaact

SEQ ID NO: 5804 - DNA, 1006 bp, Oryza sativa
atatatatatatatatatatagatcgatccacatcgaccgacagatttgtcgttaattaactgaagaataaatatgacaactgccacaagatttttgtgtgctcctaattagcacttagctagctagactttacccgtggctccagcaaacgatcgctgatatatatgctcacatgcatgcaatgcgagatactgccacttgaccatgaaaagagtataagatattagaaagactttggagctgcactaccgtaccagctgcacactggtagctagttaggctaatacatacgaaaaaaaatataatctcgatgctttgattaaggaatcttgagctgaacgatcgaagaaggacgcgcacatgatcgttgttaatagttaatttaagtgtgtgcgtgtcagttgcatttgtctatatatgatgcgtatgatatcgctggttattttgttgatcgactctgccagagctatcgttgcaaggaacgtgaattgaaaaatataccatcacaaaggtcgtcaaatagtatagtgcacttcatcgttgtcacggaattttgttcagaagtgcatcgatgactaaatttgggagattttggagtccattttgtattttagaacagctagctatcaggctgcaatgtgccataggccataaggtgccttaccggtgtgggggctgcactagtacaaaacacgtcatatgaaccagtctcatatgagaggttttccatgttttgacattatcaaattaaaaccaatatcaatagtcatacacgtattggttatgacaaaaaactgatacttacatgtgagtcatttgtgttgggcgtataaaaaccagtatttatatatgagacatcagtgttatttaattagtttaagaaaaacgccaccgatgaatcaagctgagatgacataagacacaagttgacttataagcgaccagtttatcttccaccaaatcctcttctcttctccacccggtaaaggtgcatcctcccccagc

SEQ ID NO: 5805 - DNA, 339 bp, Oryza sativa
agagagctccacccagctcctctcccagttttagtggaggtgaaactgtttggctaagctccagctccaggaggggtggagctggagctggagctgtgccaaacatgccctaagtgttcgattataattaactccacttgatcgtgagcttgatctgatcaagtgataattaccttcttttttttctcatggattatgcgcatgaataatgatgaacagattgagatttaaaaccgagaaccatgggaggcgggcatgacatgcacggcggcggccagaacggcggcgtgaaggggctggtctccaagctcgtcggcggcggtggccatggcggcggac

SEQ ID NO: 5806 - DNA, 1501 bp, Oryza sativa
tcgcagcagtcaggacactggttggctggctggtgatgatggcgctaggtcacggcggcgcaagtgtggggaggaagaagtcgatcggcgctggtgcgggagggagaagacgtgcgcaagtaccgaactgggccccaccttgcttatgtggcaaactaacaaatgatagggaattgatttttgggcttctcttggaggagggggtcattgttgggcccaatttttattttggtattcctaattcagattttttgggaatcaaatattgggtgattgttgggcatgctctaagtgatttgtttggttgggagacatggaaaatttagtgggatagggatggtgaattgaggaaggaactccctccttttcaatacctgggtaggggcaggtaattgggagggaattcctcctttactttttctaagcaaatctgagccatctgtttttattaatgacttaatctccaactaaactccctatcaatttccattacctctaccaaacaagatattgagattaaaaatcaaattcccatcttaatctcattatcaattccctcgtgtaaactcccaatctccttccctcgagttaccaaacaagccgttagatcactaagaatacgtatataaaagttttattcacaaattttttccatttacaaatatgccgatgggtcctggtgatttacttaacaaatgtttgattagatcttcagttttatatacaaattcgttttgtctaaacagataaaattgacttattaatcttgggaaggccgttactcactctagactttactcctccttatctttttttttcttgaacgaacatttcatttcttatatttttgcatagtttttttaaggtagttatagacaaaagtgataatgattgggcttctaaataatgggtaagacttgtctccaacaagtgacccataagggcacctaaatctaaaatgggtttccgatagtattatttcagcctccaacagagtacctatacagaagacctattttacgtgctataagaggcataacctaaatctgagtatcctctctcctgaagacctatttgcagtaagggttctcttttaggccttattgttggagaagaccaaaaataggtattgaactcttttactgtagcgctatgcaaacgtgaaatgagtcttgtattttgggtttcattgttggagatagcctaaccaccacgcgccggaagccaaacccagttctccccgttcccgcctacattttcgccacgtcagcgatccgcaccgaaatgcatcgcagccgtttacggaaacagcatcgaacgtcacacgttcgtccacgttatcgatccgtggggaaaccactccaccaatcagcgcccacctcaagttcgctataaagtcgtcgcccccgtccccattctcttccccacatcgcagtcttgcaaacacacgcagcaaaatccacaccgcttcccctccccgagaagaagagagcagcatcca

SEQ ID NO: 5807 - DNA, 1501 bp, Oryza sativa
tctgtgctactttgtaatttctctctcctaatgttaaattttggcagatctcctaccgtcgttctcctcaaaaaaataatataattataccatggaaagaaaaaaaactgaaggacacgttagagatcgactcaaatatcaggggagtgcaagggattttctcttgttattagaataattttagtggcgcatggcataaacgaatgtgaaggcaattatcttggttgcagcatcgagctaagagatcaacacgagcagctgaagcgacaacgactacatggtcgcgaactcaagagcagcagtgagggaagccaaggcattggcacttggcagaacaaagctgggtcgaggaggatattgatatcggggttgagtagattaaattagacttgaaaaatagggaattgccaatgagttgatatatttgtcaacaaacatagtttaatatattgtaggccaaagacaagctatgtcaaaatcaactttctgctaatgtttaactgagtttttaatttcattttgaaaagtgattcacatttgatgatgtctcaagtgcctttagcatcaagctttccattctatttcatttgtactccacctgttccaagattctatttgtcacaaaatattcatatttaaactttgaccatttgttttttctttaaaattaaatacttataatatatcatattattagggcgtgttgaagcctaacctaagcattaatatttgttcatcatagtctaatcacttaaaaatagccatgatcgaagttaaaacaacgcttgtcaaacaaataaaaaagtatttggaagcggatatagttattgcctagcccggtctagaacctcacagaaaatcacacctagtatatcttggaaagccaaataaagtggctaaatgaattaatcgatttttcacccaagaattttatcagaaccttattgacttgaattttacaacaataaagagttcagcatgacgcctttgcataatagcataatagtaccacataaaaaccatggtagaatctattatagaattgcgcatttatcgtgaaacattttgaaatcaatatttggtcaaaatttcttatgtatacattaaaacttaaaaaaatccagtactctaaaaaaaattgtaattctcgatacacaaaaatcgtcgcgtccctatgacccatgggcccttccacaatttcgctcacgcgcgagaaaatcccgccccgcgctcgtctcttcgcgcccagatatttcaccacgtcagcaatccgcgccgaaacgcatcccacccgttcaccgcaaacagcggcgaacgacacgaatccttccacgtcatcgatccgcgccgcatgctttccaccaatcagggcgcacatcccctcttctataaaaccaatcggccccgtctcctcctcttcccaaccgcaaatcttgcgatccacacacagcaaaagaaccaccaccgtttccccttcccgagaagaagagagcagcatcca

SEQ ID NO: 5808 - DNA, 1501 bp, Oryza sativa
ctgtatacacattgtaatgtccctacggtaagggtaactatgcaaattcacatgtactaaccaaatcctaaagggtacaagcctgtactaggattataaatagtctcctagagccatgtaatggggagatcccaaaaatttttatcaattaatacattgctttactattccaaccactcaccgagtttaccacgtctttcgacgtgaagcagttgtcattcgagaacaatgatcaatgacatggtatccccaaatacattagtggatatactccctccatttcaaaatgtatgacaccgttgattttttcacatagtgtttaaccatctatcttattaaaaaactatatatattatttattttgttgttacttgttttaccatcaaagaaactataaccttaacttatacttttatgtatttatattagtttttttaataagataacgtagatacgtgttagaaaagatagattgaattaacatatgagataatctagtgcgaggaaactataagaatatatagttagtgaagaattgaagctattctggtgtacttgtgaatgtctccaatattgatatcttagtacccacggttatgcaaacacatattttttaaatagaatctagtcctattccagttgaatttaccctttgtcgacgggggatacccgtagaccggatgatgagggtattgggatacgttggtatgaggatctacacgattcaacatcaagcaaacaaaaaacaaggattatactggttcatgcccctcgcaagataatagtcctattacagtttatatgagattgatatggaaaaacacatagtacaatagagaacaaatgattatgagattaccgatgaaatccttgttgagattagctcgacgagatctatcggtgaataggcttcaagtcctccgagattatggtggtggtgtcttgtgcttatgactcaaaaccttggaccccttaagggtatgtatttacaccgtgaatcccctggaactcgaagacctaggaccttgcacgatatagtatattcctaatcctttccgagtagatctttgttatgtacttgcccgcgaggattatttccataatctcttatcgatttccttattgcatatggagctttaccatacacacgaaggtgcggtgtatccataaaattacataagtagtaggatagagggtataccttacccatatagggcgcattgaaatctattgtatatatcatccaaaaacacactacttagatttgctataattaaaggaataactattaaactctctatcgtctatgtgcaaaacaaattttgtcatgaataatacctcacacaacaaaatattgaatacatgataatctcatatagataattctaaattatgttttcctttcatgctgatgccaaaatggacttttcataactattaaatggccaattaaagaaaagaatatggaaagagaccaaaaatcaaaatccataattatacc

SEQ ID NO: 5809 - DNA, 1501 bp, Oryza sativa
tggtcacagccttggtgccctcggagacggcgtgcttggcaagctcgccggggaggacgaggcggacggaggtctggatctcgcgggaggtgatggtgggcttcttgttgtagcgggcgagcttggcggcctcggcggcgagcttctcgaagatgtcgttgatgaaggagttcatgatggacatggccttggaggagatgccgatgtcggggtggacctgcttgagcaccttgaagatgtagatcttgtaggtctcgacgctcttcttcgccttcttcctcccagcgcggtccttcttcccctcgccggagcccttctcgcccttgccggcggggagccgcttctccgccttgggcttcttcccggccggggccttctcggccttctccgccgcgggctcctcctccgcgggcttcttcgcggccggcttcttctccgccttgggcgccatggatgctgctctcttcttctcgggaaggggaaacggtggtggttcttttgctgtgtgtggatcgcaagatttgcggttgggaagaggaggagacggggccgattggttttatagaagaggggatgtgcgccctgattggtggaaagcatgcggcgcggatcgatgacgtggaaggattcgtgtcgttcgccgctgtttgcggtgaacgggtgggatgcgtttcggcgcggattgctgacgtggtgaaatatctgggcgcgaagagacgagcgcggggcgggattttctcgcgcgtgagcgaaattgtggaagggcccatgggtcatagggacgcgacgatttttgtgtatcgagaattacaattttttttagagtactggatttttttaagttttaatgtatacataagaaattttgaccaaatattgatttcaaaatgtttcacgataaatgcgcaattctataatagattctaccatggtttttatgtggtactattatgctattatgcaaaggcgtcatgctgaactctttattgttgtaaaattcaagtcaataaggttctgataaaattcttgggtgaaaaatcgattaattcatttagccactttatttggctttccaagatatactaggtgtgattttctgtgaggttctagaccgggctaggcaataactatatccgcttccaaatacttttttatttgtttgacaagcgttgttttaacttcgatcatggctatttttaagtgattagactatgatgaacaaatattaatgcttaggttaggcttcaacacgccctaataatatgatatattataagtatttaattttaaagaaaaaacaaatggtcaaagtttaaatatgaatattttgtgacaaatagaatcttggaacaggtggagtacaaatgaaatagaatggaaagcttgatgctaaaggcacttgagacatcatcaaatgtgaatcacttttcaaaatgaaattaaaaactcagttaaacattagcagaaagttgattttgacatagcttgtctttggcctaca

SEQ ID NO: 5810 - DNA, 161 bp, Oryza sativa
taatttaacaatgtggtgttacagtaaacatttgctaatgatggattaattagtcttaataaattcatctcgcaatttatagacagaatttgtaatttgttttgttattagactacgtttaataatttaaatgtgtatgtgtccatatatatgatgtgata

SEQ ID NO: 5811 - DNA, 543 bp, Oryza sativa
gccgtgtactcctcgccgttctcctccgcagccgacttactccaccgcctctctccgcctataaatggccagcaagctcgccatccctctccacaactaagctcctcgagctctctcttctctctccaccatggccggctaccacaaagtcaccggccgatctcctcctccatagcaactcttccaattccctctcaccaccagcctcgcctcgccgaggagagcccatttcaccattttcccctcctttcccccctccgaaacaagccaccaccaccacctctttttgtcgccagagctgagctcctctaccgactgttccggccacatcccacactctctctgccggccaccacccttcctgggtgccccaccctcaggaacacgtttggccgccggcgtcgcaaccacccagccaccggagcaccggcgccccccttctcttctccctttgctctacctgggaagaacgaaccagagaagaaagaagacgagaggaaggatgaaaaataaaattaaaaggattgattttccctgacaagt

SEQ ID NO: 5812 - DNA, 1017 bp, Oryza sativa
tatctgatcggctacgctataaatatatatagtcctgttattgatatatatttcgatctaagtgatttatactgtctcagcatggtgtccgatctatgccaatcactcgatttaagtttccatcgatttagggagtttttttcgtaattttctttacccaatcgagagaattaagggttaattacctattcatggacggcgaacgaaacacaaatgacattgggttcaagaataatgatatgtcatcggcattctaccgatcggctatcatttataaatttaaccgcggtttctttgcttctatttcttgttgattacaggatcaaatcaactggcacgctaacacatccgaaggcgagctttggacctgcactggagttaagcagatctcccagccacgtgttttctatcaacaaatacccaagttatcatcaatggcataaggtaaacaagatatggctgagtggtaggacccatcccacatgatattgtaaaacaatgcaacatttaatagaaatgcgggacacttgtaaattgggtacaatatgatcaatctaatgcatgacttgccttgctctcgcactgatgagaccacagcaacgtcttcgagaaaccgcggatcgacggaacgaccgaaatctacgcaacaaacaaagcacacaagcaaaacatgctataagtctactgaaacagaaacaaaaccatttttaatggattctatgcatttttatgaatttactaagacttgaatggatttaaacggagctcggatgaattagatatgatttttagaagattatttgtgtttttactattaaagaaaagccttattgatttattgtgcaataaagcatcctagggctgacatcatccaaggggtggggcggcgccgacaggcgggacccaagggtcggaggcacaagggagagggagggggtactagcaggcgggccccaccggccgcggctccaaaaagggggaggggcgacgtctgccgggctcggctcggctccaagc

SEQ ID NO: 5813 - DNA, 1501 bp, Oryza sativa
ttagctagctgaactaatgcaatacttatctcctgttataatgcttatctaatgtctagaatcaatcctgatatgctacatactaaacaggacaaatcagaaatcaagaccggtgtttaaaatctgtgcactagactccctctactgaaaaacatggttgagggtagaataataaaattgctacacagaaaaactaaatttcatatgggtatatagttggtaccttgattgtggttatttgatctcataatctcctgtgttgatgttgtacagcataaaggaacatatattaatcattggttccattagttatgtaacataatagattagttagtaataaaagtattttggatatattggaaaaaaagtataaacattattcttttagtcacacacatccagtaaggcaaatatgccatggcatgtcaaatatcaagtatcaccagcagcgaacagggcacataatcatgttttctacaacatggcagcctttgtattacttactatatctatttgcacgcatagaatggatgaactaaatcattcagttatatatagagaaacagagatgatcactaagtggacatttcataggtctatctggaatagatgatactttgcaaattgaacacataccacttcagtattgaatcatgggtaaaaaggattgtgcttgcaaaaaatattgctatttgacatggtactaactactgaccgtggtaattgttattgtagacaatggcgatgcaatggatcaagttctgcaactttatggaggtcacatccataatgcctttccttttgatatcaactctgatgccttcgaggaacacctacaaatgcaagcaggtactattattacatcatgccaactacctagaataattcagcaatgccattggctgcattagttgcatcaatagttaaggattataaattggatatttcagcacatagtaaatcacaacgaatgatgggattaaggattataaatatgctaatatgttgtatttacatagatttttcatgttaattggctcacagccatagcaatctcaaagaaagcacatacagtaaattgtgccaatgtttctctgccttctaaatgatatgtatggttaaatcatattataaagtaaaccacatggtgagcctaacaagttgtgcaagaactttattatcaacatgagcacttaatatggagatcacatttccagttttgcctactacgattgttcagtacacatcaaattatataatgcatggtcatgtataaaaagtatatgcatgttgtatcagccataattttgcaagcatgttcatccatgacgataaaaaatccaccatctaaattagtgcagacaactcacctggaaattattgttgtagacatgcaggagtacggtttgtatgccggtgatgtggacattgtttttaaacacgaggagttggatgattcagatcaggaagatgaacagccatacaaaaatctgaccaatat

SEQ ID NO: 5814 - DNA, 1501 bp, Oryza sativa
cacagatggtataattaagctgctgcttccatctaccctagttcctaaatcggtttggttttaatgcaatgcacattgatcttacaatcttacattgtgaatctatgatttccatcaggcacctagaacattacttcaccacatctctttgaacattagtacccactgattttcttgtcagaaacttatgactgtaaaggcttaaacacaagggtttgcagaataaacatatattctacagttataaagtttgatgttgtgcatatctagactaggtaatcacatgagggcttttatatagtacttcagtgaaatgcatggacctgttctgaaaatctgaaggtatcctttgttcagttcctgcacaagatccttactatcctgcaagcctgcaagttgtgtgtccctgcaaaatgagcagtcagtcagcaagcaagagtttcaggctgcaatctcaataatgagtatgttaacagtctgtagaactaaagtactaacttcagttgccatctgtctgatttcagacttgcagtttttcagttgggtctgacgcttcagggttgaaaaataagaagtccaagtcctgtagttccattgtttgcccaagctgcagtaatatgttgatctagttcaggcttcaattgaattatagactgaatcaccatcaatgtgttagagtatatggtagttagagtcatattaggatagtattgatttgtgtgtatgtaatccttccttatctcctccccatgtactcctatatataccgcccccttaaggctcaatacaacgtgtcctatattacgcggtatacctcttcttatatactatctaacatggtatcagagcggacgacctagagccgccgctcaccgcttccgctgccgtctcccccgggagacgatctcgctcccggggcgggcaccgatttttttttctctatcgacatcgtgcttgtcgtaagagagatcaatctcttcggccaaggccgttcgtcattgtcgtcgtcaagcagcacagcactacagtagccgccggtcttgggtcgcggccagcacctcgtcctccgcgctccgccacggcgcgccgccggcgtggccgacggatccccgcatgcatggctggcgtcgccgtcgttggacgcagcagggtacggggggacccgtccggccgtccccatcgtctcctcttccgcctggaccgccgcctgtgcccaccaggccggcacgaccgccgcgaccgcgtgggtcggcgccttggatctccgcttccgccgccggccgacttcctccaggacgcccgcggccggccgtcttcctccacgatgccaacaccgttcccatccgctcgtctacgtcaagtcgatctcttgctaccttgcctattgttcttttgactgtctcctttgctgtgatcttgccgtggttagcaagtgaggagagagacaacatgggagcgacaagatgggtgcacaggctggttgacctggtcaaggcctgca

SEQ ID NO: 5815 - DNA, 1501 bp, Oryza sativa
tgcatggtggatgatggctgagaacatgcaggctatactatggttggcatgcatcggctagtttgcttaagcatggcactgtgcatgtgtacatgcaaaggccttcaactcgtgcagcaaaaagacacagcaacaaaaagaaaatgaacgagtattacctgcatcgactgctccatcggtggtttgatcgccgccgccgtcgtcgccaccgccgccactgccgccgccatcgtcgtcgctgccgtcgcagccaccgtcgttgccactgccgcggccattgccatcttcaccatctgtgcgttgaaacaaaattataaagtcacacatgcacaagaaaaaaaagaagacaaagcaagagaagaaactcctatgaacaccttcattgtcataatcccaaacgaagtcatagttcaaatcagatatatctccatcgaaatcctcaacttcgtcccaattgatgatgggtagatttagatcaaaactggccattacgtacgttgaaccatgggagggaagaagagagatggaagaaatgtgtggtgcattgtccatatttatagaagaaaattttgctggcaaatagtggcgtcaagtgaaaattttcgattcattttttattgctgatggcgccatccaaatttttgatcaagcatgcatgcatggggctttccaaatttttgaatcaaaacaatccatacatggcgttatgccaggcgagcaaagcgcgctagcaaaaatgcatctgcatgcatgctggctattcgcgcggaaagtacaggtcgagcgcacgctgcatggtggttaatgctagcgtatctaccacgcaactacctaaacgtcgctcttcgaacggagagaattaatcagcgtaactgatatttaaacggttttattggtctttacaactacaacagccacgccacggagggagtatattcctgccaacacgtgtggccgcgcgtgacgtgtccgctgggatgctcggagtgacgcgtgggtggagtccgaacgaaaaaatttgaaagcagagattttgtttttgaggataataaagtaaggataaagataaggataaggataatagataagcagtgtttcgagagttttaattcgattttaaactctcaacctaatgaaatttgatccgcaaatcattcggtcgacctgaaaaactgaaccgttgattgaaatttgagtattgtcgtgtttgtcgagtcggagaacagagtgcattttaacgagtcccactcccaatcggataggtcgtcctgtccgagctaaaatatgccaaattttatctcccccagattggatgaagtttaggctcccgtctccgattcaaactccgttcccgcctcggatatgaacgcggcaagtcgactccccgctcccgccatttataccgcgctcccggcggcctcccttctccacacgcatctcaatcttgatcacgccattgccacatcgagagcagagagatcgcatcttccgtgccaagaac

SEQ ID NO: 5816 - DNA, 1501 bp, Oryza sativa
aagatgcgatctctctgctctcgatgtggcaatggcgtgatcaagattgagatgcgtgtggagaagggaggccgccgggagcgcggtataaatggcgggagcggggagtcgacttgccgcgttcatatccgaggcgggaacggagtttgaatcggagacgggagcctaaacttcatccaatctgggggagataaaatttggcatattttagctcggacaggacgacctatccgattgggagtgggactcgttaaaatgcactctgttctccgactcgacaaacacgacaatactcaaatttcaatcaacggttcagtttttcaggtcgaccgaatgatttgcggatcaaatttcattaggttgagagtttaaaatcgaattaaaactctcgaaacactgcttatctattatccttatccttatctttatccttactttattatcctcaaaaacaaaatctctgctttcaaattttttcgttcggactccacccacgcgtcactccgagcatcccagcggacacgtcacgcgcggccacacgtgttggcaggaatatactccctccgtggcgtggctgttgtagttgtaaagaccaataaaaccgtttaaatatcagttacgctgattaattctctccgttcgaagagcgacgtttaggtagttgcgtggtagatacgctagcattaaccaccatgcagcgtgcgctcgacctgtactttccgcgcgaatagccagcatgcatgcagatgcatttttgctagcgcgctttgctcgcctggcataacgccatgtatggattgttttgattcaaaaatttggaaagccccatgcatgcatgcttgatcaaaaatttggatggcgccatcagcaataaaaaatgaatcgaaaattttcacttgacgccactatttgccagcaaaattttcttctataaatatggacaatgcaccacacatttcttccatctctcttcttccctcccatggttcaacgtacgtaatggccagttttgatctaaatctacccatcatcaattgggacgaagttgaggatttcgatggagatatatctgatttgaactatgacttcgtttgggattatgacaatgaaggtgttcataggagtttcttctcttgctttgtcttcttttttttcttgtgcatgtgtgactttataattttgtttcaacgcacagatggtgaagatggcaatggccgcggcagtggcaacgacggtggctgcgacggcagcgacgacgatggcggcggcagtggcggcggtggcgacgacggcggcggcgatcaaaccaccgatggagcagtcgatgcaggtaatactcgttcattttctttttgttgctgtgtctttttgctgcacgagttgaaggcctttgcatgtacacatgcacagtgccatgcttaagcaaactagccgatgcatgccaaccatagtatagcctgcatgttctcagccatcatccaccatgcatgtgtaggtatca

SEQ ID NO: 5817 - DNA, 1501 bp, Oryza sativa
aactgcaaagcctgacaagtacatatctgtgagatgccttttttaaaaaactttaacagtgataagtttcaccttatctcctgaaaaagaaaacagagagaaaggtaaaatatggatgggatgtatgaaaacaatgtttattatttgcaatgcgcgtaagggcatcaattcacttgtttttttacatcattaaaacgacattatggaagttactttctgaatcatagcctatcttaggatatagtaggcaacacgcaacgaaatcagagtctctacactctctacaaaagagggaaactgtaaagatcttaatcattttcagttacaaattaaatggtgtttcaatagcttgaaactcaataaagtttccttttggagagaggatagaaactaccccagctagcacatgcttgcatcgaacaataaaacaactttaagaccatatattcaagagcaaacggtccatcgatcatatataacttctactcctatctatatatatcgcaaatacgacaaatataccaattgagctagctagctataggatgatcaaccaatcaaataagcaacctgcattctcttcattcactcactcactcatactcatacatatatatgtgccccctcaataattaaaagctagatctacgtacacatacgctgataaaggtcgattgagacatcaccccaaatcttcccctaactttgctaattattcactggccttttcctttctatttctgctacagttttaatgaggagaaaaatagatgagctaccagttctttgcttttcctgagctatatatatttgggtggcttgtgcatcggctggcactcacccttgcacactcattctctagagaagggagagagaagagtgtagtagtagctagctaggagaaagagagagatagagagagaaacaatggacaggagagcagtagtgtatgatgctgaagcagttgatgatcatgagagacaaggtatgtgtacatgatgatcaatagctagtttactttgcacctaattgattgatgtaatattcagaagtgcccaattaattgtcaaaagtttattcaaataactactgtctgaacccatgctcatctctctatgttttttcctcgaaggcttttagaaggtctttgcatttgattgtgagacatgcatgtgtgggggttgtcatgcatgcatgccttttgctttgcacaacataacagaatgttaagaggggagctaggggacaaccttttctgttagcagagtgacatgcataaatgatgcaggatgtttgaaagctgcagttcaaaacatggtccatgcatatgcgaagcacacaggaccaatacatactcacatcattcatctacctttttagcttctaactaaaaaccacccagtcttaattactgtcaaattaaatcgatctgcccctacttgtcgtcatctcaatcacaaggaaattttgacagtaattgcaagtgtgtttacttgagctc

SEQ ID NO: 5818 - DNA, 304 bp, Oryza sativa
taatacaaatgataagttggggttccaaagaacaagcagacagacggtctagccgacacgcacgctacaagcaagtagcaatggctaaattttaatctatcaaaacccgcgataccctgaaggggtaccaagctatttatagagataggaggaccctaggtcgtcctccacctgattggggcgcaccccacatgggccccacttaggccggggtcccagacgaagttacaagcccataggcccattacaggtgtcgcagcaccttgtttcttcagttgctgccgactgagatgaaatttggcaa

SEQ ID NO: 5819 - DNA, 801 bp, Oryza sativa
gtaaacttttgacttaataaactttgggtctataaactttaggtgtataaactttagatgtatataaatactatatatagaaaatatttgaattcaaattcaaatttgaatcgggtatgtaaacttttgacttataaactttggatctataaactttaggtgtataaactttagatgtatagaaatactatatatagaaaatatttgaatttaaatacaaatttgaatcgggtatataaacttttgacttataaactttaggtctataaactttaggtgtataaactttaaatgtatataaatattatatatagaaaatatttgaattcaaattcaaatttaaatcggatatataaacttttgacttgtatacttttggtctctaaactttaaatgtgtaaacttgagatgcataaatttattaaaataggaaagtaatatggtgctaaaaaagaaaaccaggtggagggaggggaggggggcacccgatccctatcccatgggctgggcgattgatcgcccattagaggtttcgggaggggagagtgtatagggggatggggatcgatcgatcgcctattagcttattagctgtccccccaatacattgcctacgccgtgccaagtgccaaacagggaaaggagacaatatttttatttttcaattattatattaattataataataatccccgcaaaaaaaaatcataaagacttgtctcttcgtatcgaatatcgattcctacccggactctttatttacctttccccaattctcacaaactgaatgccaccaaaatc

SEQ ID NO: 5820 - DNA, 207 bp, Oryza sativa
accccccaaccccccgccccctcctctcctccacctcctgacttgggtattacgtttccttgtatattacggaacggtctaaagtcctggtttgataatattgtaaaatagatttaggaaaccgataccgtattggttaagatttctatcttgtaatcctgccctccatcctatataaggtgggcaggaggccctctagggggcatg

SEQ ID NO: 5821 - DNA, 1501 bp, Oryza sativa
acgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaatgtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatcttttctttactcccggttgttctcaacaaccgggactaaagatatctttagtcccggttgttgaacaaccgggagtaaagatccaggggtatatatattcccggtgcgccctcgtcttcttcaccaacacttaaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgcatctcccttcatgcatctcgatctctccgatctcgatcccggccacgtggctgagccatctttagtcccggttggtgttaccaaccgg

SEQ ID NO: 5822 - DNA, 1501 bp, Oryza sativa
gacatggaacgaaatctttttcgccgggggaaacgggacgaaatcgttatgtgcacaccgaacactggtggagaaaccctttgtagtcccggttcgtaacccccctttagtcccggtttccaaaccgggagtaccaatccgggactaaagatcgctatctttagtctcgggtgaaataaccgggagtaaagatcgatctttagtcccggttggtaacaccaaccgggactaaagatggctcagccacgtggccgggatcgagatcggagagatcgagatgcatgaagggagatgcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttcaacaaccgggactaaagatatctttagtcccggttgttgagaacaaccgggagtaaagaaaagatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaacattttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 5823 - DNA, 306 bp, Oryza sativa
cgatgactgagccggttttgaaaccctaggccagtatatgctccgaagatcgtctctttgacagaaccgatgagaattgagaaaacgccaaagctgtgccggagataacaatagtataaatcttgaagtggcgttgccactttgtttcattaatctctgcaggttaaacaagacaaaaacaacaaattaattaggcaaccgtctcgcgggtttagcccggccccctactaccagcttattatatctcgcctccacgtcctcgtcgctcacaacgcgacacactcccaagcacacacacagagcgcg

SEQ ID NO: 5824 - DNA, 1501 bp, Oryza sativa
cgattttctcactcaaatttacagtatattttcttgtaagttacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatatatcggattttaatccaaagattaaaaatctgtgtgatacgatcataaaaatctttcgaaagatgtataggtactccctactgcttttgcaatgtggtgggcccccgtagggttggggaaagctgaatgtttcataccccctttaccctcccgaattgttcccaaccacacatctcgccagcgcgttcgacgtcacctttccgtctcgccccccctccccctccccccaccatctagtcgctgttttttctcgcccgcggcgatctcgtcgacgccggcgacgaaggagtcgatgccacactccgttttgtccacaccgcactctgattggacaccggcggcggcggacgttttgtccacggcggcgatggcgtatacgccgcacactgattgtacaccggcggcggcagatggaattgggtggagatcctcatcgccatcatgagtgtggagatcctccacggcaagacggtccagagcttcgtggaggatgagggcgccttcaactcctccatcgacggccgctttgcagcgcttgacactaacagcgagtccgcgacgtcctgctctcctacgtcgagatggccaacgagctgatgagccttcgtatgctggacaagcacttcggcgacgacgaggccgtcatgagcgccgacgagctcgtgaagctgtaccgcggcctgtttgcgtggttcgaccgtgatggcagtggcgccgttgaactggaggagtttcgggctgagatgaaggaagtgttgctcgctgttgctagtgggcttggattcttgctagtgcagatggtggtcgaggatggtcggagtgtggcgaaacacctaggcgggcgtttgtagagattcaaacaattggaaagacaaagggaaaggttccaggctcttcctgcaaactaattgatttttcgaaaaacaaatgtttgcactgtctttttttttttttgctactttttgtcctctgtgagtgataatgtgatatggtgtgattgaaggtaggaagggtgatctgcttctgctcatgatccgctaagagcctcagatagagagagagagagagagagagagagttcttccatagagagaagagagaaagaggaaagaacaaagagagtagatctgagatgttcttttatctatttgtattcggattattgttttgctagaactagatgaacaaaaaagattttgtttaagttcgaatcaattttcgtcatcccaaaaattggctcgcttggtcttaattataatcaataattttgaaacaaaatctcagtaat

SEQ ID NO: 5825 - DNA, 1501 bp, Oryza sativa
atgtagcctttggttatggggcatgtttagcagaagctgtttcttctgttgtaattagcttttaatttggggtagctagaactcaatatcttccaatcagagttaagtagatcagtaatatctgcttttgtttctaattttaaactcaatagttgtgatgcagctgtagaatgtagcatttgcactgattgggagagcatttgtagataagtggtcttttttagttccgactatagtttggagtagctatgggttatttatcttttgattgggagtaggctgtcactcacggttgatgttttggcaaattccgtagaagggattatttgtcggttttagtgtgtatttttgttcatgtgggacaaagttgtttagatttggcaaagatctcgatggtcttttaggtttatactctcttttgtagtttggtggtgatggcattgataattttctgtcatgggtccttttggcagggtatttcttcggcaaatgtcgcatgcacaatcataacacagttacggttttgtagtttggtggtgatggcattgataattttctgtcatgagtccttttggcagggtatttcttcggcaaatgtcgcatgcacaatcataacacagttacggttggactaagggattgcaaaggagattgctagtgccggattagatctaggattgggttgggctagtgaaagtttctagactagttgagcactctttctcctcctgttatttaggtagcctctgttttatgcaagctttaattgtgtttttcttttatttagtactctgttaatatcggcaagcctgacattgctgcagctcatgttaaagtccaacatcattcttattttaatttacttcttccttttctaaaccttaatgttggacactatagtactggtgctattgtttacattgctttcctttagaaacaacgaagaatctagagcctagcttgcactcttaagtagctatgtcaaacatttccaccaatgtgtcatcattcttttgttcttagctatgttctgcatacttatttactttatctgtaaaagggtctgcctggatgctgagatcctgtattgctagaacccaaattcttgagatgggtaggaagtggacaacaagaggacggagtgggcagggtcacagcacaaaaggaatccagcgaagaatgattttcaggtcacttcacctgattgaaatgttcctttcctgcagtatcatgcgatgtggactctgctctaattgttcacttgttcagttctcctggccttctgtgggccagccatctcactagcggaccgaagcatccaagcatcccttgagaaccctgttcgttctgtatattacttatcttgtgctggttgtttttgcagatattttctacaaaaggtcaattatagctttcaaaaagtaggttctgttaccccagaagattgttatcgagtccaatagtttccaaaggttcaaactatatgcatttacccatgaca

SEQ ID NO: 5826 - DNA, 1501 bp, Oryza sativa
ttgggcgcagggggcggtgtgctcgcgggcggctcgccggggcctacagctgctgctcaggggaggggagtgtggcgctgcggccgtgcggcgtgccgcctcgagcccgcgacggcgaggtagggcagcggcagcgctgcggcggcaccctgcgcggctggcggccgggctagcggctgcgccgagtgacgagtcgggggcgtgacgactgacgagtcgggggcgtggcgtagggttggccttgcccttgatggcctgatgggctgcgaactggtgggccgtgggctgcgctgccgcgggatatgtcggtttaatcggttgttcggttcggtttctctataaaaccgccgccgcgggatatgtcggtttaatcggttgttcggttcggtttctctataaaaccgaagctgaagccgtacaccgaatagcacaaaaacagaaaccgaactgacaaccgaaaaccgaaaaaaccaacaattcggtttggttcggtgcggttcggtttgcggtttgcggctaaaaaatgcccaggctgacctcaagctaccttagatccaaacgtcttcttactgtttcttttttttttttaccatacaacaattttgcaaactctaaatattcttccctctaaatattcttcccccaccatttcctttatccttgaccgctatctgtttgaaataaaatataaatatcaaaaaatgatgcaccatcaaaatactttgcatggtaaatataacaatacttatcaaaacatcattaaaaattcttactgctcaactagaaaatctcattggattaaaaaaaaagctaacgaataaagcatcagccattttgaatatatatatctttcgtttcaaatacgaactaaataattcctataaaaaacctgataatatttgtatgctatagaggatcgatgaatagtactaatgggatataaaatatccagcgtgccacgcgccattttctaatcataatgttagaacaagctcgaaattgttacaactcacatgcaaattaaatgccatcgactagtgaactttggtttagtgatcgtgctagtctgcaaattaagctgcatttttgttaatatctcgatggaaggatggcagccacgacgacagcaacgccgaacatgaggatggcgagaccggtgaagttgacgacgaacgcttcgctcggatagccgtggaaggggaagatgaagcgtgctaggccggtctcggcggtgcagatggccatgaggaagatgacgatgcccaacaaaatgtgccatggcgcgtagtcagccctcatcgtcatcaccgcccccgggaatacaaagtagacaaaacccaccagccactgcaaataattttagtcaccggatttagtgaaatacaaccgcctcaccatttcgcttaatacttattataagcggaaacagcttatcaacggtcaaaaaaattgtgaatttagtttaaaaaaattgtgaataaatcttttatatacgtgttat

SEQ ID NO: 5827 - DNA, 1501 bp, Oryza sativa
accggcagcgcggtgagccggaagctggcgctgctcttcaccggcatgactatgcctctctactcttcttccccgacccgccgcccgccggctgacacccacgtcgagctcgccgccggcaccaccaccaatcaccaccagcaaccacggagagatggcaatggcatacaaatgatacaatgctgcagtacacgggttataagggctttgttctggtgatgcaaccaaggagtgctcaagtaaataagaaccgggtcaatgcaatcgtaaatttatttgatagttttcaatcctgctaagctagctattggaggagatgaattagggtgcgacaaagccaaggaaaggatgataaaaccggaggaaaggtctaagttttggactgtttcggatttgtccggacggcagaggaaacagcttagattgaaatcatcccagctgggacagatttagctggagttactacaaattgcccattcatcagggatgctggagtaaaaaacaagggacgttattatgattttatattcgtatcaacctgcgcgtcgccggcttgcttcaagcacatactaatagcttgtccgttcctgctggtccatatgttgtgttgttgtgttgtcggtccccctcgcaagcttgaaaagtacaccacaccgggaaggcaaatcaatccatcagctcaaatgcggccgtccgtctggactactttgcttgtcattgcaagaatttctgcttgtttgcgccgagcaggttcttctcatctccagccaaactgaaactgaaattggtccacaaccacctcaagccccacttctcttcttgtagtatgtacgtccaagacctgatgattataatccatgcttctggtgagaacagaaaatggataatgtaccaaaaccggttgcatttttttttgtttcaacattcaagtatatacagtataccaaaaggatataaacgcagccaagaatatgtatgaacataccaacatagccgtcctatcttgtcctatgtcctggcatcgaccttggtaaccactgcattcaccaatagacagttagacaccacaggccctgcacataccacatcatcatgtacaggggaagggacagcaacaaacaacaccggcaagcaaaacctaagagcccaggaaaaatgctaaggtgagggctagtacaaaaaatgctgacctgggatctcagatgacaaccatagaaaccagcatccaggctgcttgcaaaatggaagagagaaccagcatcctcccaaacagcaggaattcagatatagaccaagcctgtaacagaatcacgaccgttcatcacagtttcacagcaactacacaagtaacaaacaaaaccagtactatatggctgacatacagcagacagaaacatcatgggcttaactctgcttcactggaaaggatcaaaactataacacagaccatcacacaagcactattaataccaagagaacacaaaatcacgaaaaacaaata

SEQ ID NO: 5828 - DNA, 1501 bp, Oryza sativa
tgccttactaccttctttgccattataaaagtgggtaacataggaggtagtaactaatactatactagacaatagtactactacccggtaataagcataaaaaaatactaaaaatctctcgtctatcttttttgctcaactattgttttacaagtacgtcatatattactattgtcggtgacatgggaccgggagtatcatgacttagagacttgaggcagacacgatcacccacgtgacctaaccccctcgggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacgttgcacctgcttccggcggaatggaggtaggtatgggccgtcccatcagaagggtcactcgggcagcagccgttgcaaatctccgcccatttatgaagagatgacagggtgatccccgaggtcagacgaacgaggacgcgtgtccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagagagggggctggaaggggggaggatctggagagtagatcccacgagaggaaaaaagggagaagagggtttctagagtaagagctctctggctctccatctctttgtagcttcttcatacacagatccaccataacacaggagtagggtattacgcttctcagcggcccgaacctgtatacatcgcccgtgtcttgtgctttttccattctcgcgaactttccacagactaggagtttagaatctcacccagggcccccggccgaaccggcaaaggggggcctgcgcggtctcccggtgaggagccccacgctccgtcatctggcgcgccaggtaggggactctgcgtgtgtttttctaagctctcgcattctttcgtgtgcgccaagcttttcctgttcagcccaa

SEQ ID NO: 5829 - DNA, 1501 bp, Oryza sativa
catgttgtttatgccagccaatggtccaaatctctcatgtctgaaagtaatcaagtgcaaaatattatgtagcatcaaattctcatatatttcacgcatagacttagagagaaacgagttcaccttatattctgatctgcaagtaaagaacaatgtacttttgataggtatatctgcatcagcgtcaagctgatggtagtaggggcatgtctaggtgtccttgagatgtttcttgtttctctccttcttgatgttttcccacttcggcaacctcaatgacgacacgccgccgccactagatgtcctcgtgtcgtactactctagtggcggcgcttgaatggtgttggcctccttgctctgtggatgtagttggagctgggactgtggcatcattggtattatgtggtgctgaagctgaatcggtggtggtgtttgctgatgatgctgcggtggtggtacagcgaaagacaacggcatggactgtagctgcagaggtggtacagtgatggacaagctgttgaccctcgatatgaaggagatgacgacggcggcggcacaggagatggcaaattggcaatagcacgctactgggtaaggcacaggggcattttggtcactccgcgtaaaatatcgggcccactaaaacttcgtcatcacggatacactattttaatcggcgcggtgtccgctggcaaattactacttttatagagtgttttccccaaaaacgtgagttcgtgcggtgtttcacggctaaaaccacgaagttggcccaggtggggttggccgagggcccagctctgataccaaatgatacaatggcctaactctgctctgataccaaatgatacatctggcccaggcccaggtggggttggctgagggcccagctttgataccaaatgatacatccgccccaggtggggttggccgaggcccaataaattatggggttggctccaataaattaaggttgccccaacagttgccgagacccaatatattaaggttgccccaacagttcttaggcacacccactcggggaaaggccaatctccctaaaagattagtccaataggggaggggtggctctcccttttaaagtggcttcctcctcccaagctaagcaaggtgagattattcagaggttcacacggtcgccgcccgactacaactagacaacttggccccttattgcgtctttgccagcgggtaatagtggatgatgccctcatcaacaatttcaaacaccacaattcaaattcatctatctaccctataattcaccaactgggtcttacatccttcatacttcatctatcctataattcaccaactacctcttacatccttcacacttcattcatcaaatccaacggctcatattcctctaccccgatcgaacgatcgagatcagctctacctctcttccgggtgcgatcgctcatcacggcctctgtttccgcgctcccctgccaaacccccccacacatcacgccct

SEQ ID NO: 5830 - DNA, 1501 bp, Oryza sativa
atgcagcgcactcatctagcttgagcatacatgttccatttataattacaggtcactattaaccaaatcatgcatactaaccttcagtttccagtgctattagttacctagcaagcataatatatcgtatgaggtgcacaatatttgggttttttttgtaacatagaagaccaaataacagtccatacattattttgctgtctacaattaggatttgcaaagtccagcatgcatactgcattttgctatgaatcaaactaaaccaaaacataactaatacagccaaatataaaacaatgagaaactgacttgacattttttataggggagggggcttggacagtctaatatgaaacaatgagaaactaacttaaccttcttattataggttagggggcttggaggatggaggcatgggcagtgcggacggaggtggagggacggatgcgggagtgcgggtgggggtaggggcacgggcggaggggtaggatttgcaggcggcggtggcgcgtccgtcggctcgcaggattggataattaaatcatcgcagcatatttatttaacatactatggcagtaagctcggaacaaagaaacattgatcataagagtttgatgctttatcactataattggtggaaaccttctggattgcaagcaaatttagagcctcaactgacctgcttaatttgatcaatgcagcagggcctaatcttaaagctcccgaagacattagcataaggcaagtttgcatggctccaactcctggcctcctgagaaaccaaacagggccttagaaattttctccttagccacatcaaatcattcaagcaagttacgtccaaataaaaagaaataacagaaccgggcatagaattatgcatcatatattagtaactaaaagtcatcagaacattgcaatatttaaaatgccagagaaaacacatttttactggattcaaccgatagagttttttcaaggatatgaagccatggtttcattgtctagagctccaaaattgaacaatatctcagcttaaaggaaaaatgaaataattaatggcaatgaaatacacgttgacatattcatagaatgattttcattgataaaaaaaccaaagtcgtaagcttgtaacttcatggcttttttaggaacaattaaagttcttatgcaaaaaaaaaatcaaggtgcatcttgatttgattatgcaatacctttagcaagagggcttcatcaaccaaattgtgcaatgtctcatgacctgcacaggaaaaatataacgaagagagtgtcaatttgtctaaaatttgtaaagacgtaaatcatacctcgtggaattttcaggattagcttgatctgaaactgcatctcttcctacatttccaataatcccaatcaacctatccatttggaatatccattttgaacaatctaatccgaacaataagactcaaatctgcacccaaatggacgccatagcaaaagaaaatcacaaaaaatg

SEQ ID NO: 5831 - DNA, 1501 bp, Oryza sativa
atatattgtacattagttgtgcgactaataaattcagttgagttgctgatttattgtttcacaaatgaatttagtttcactctattttcttcttaacaaatcttttttctgttaattgcatatacatgttcaaatcccttgtcatggagatataaagctttagtgaacagtcaaggcagagattttgcatctttagtgtattgtagatcagttgataactatggatcattcatacatgattctggtcgctcaataatttgtgtattgtaaacatgtttataattcctgcaaatttctcctacatgattccttattcatgcaaattctgttcttctccctctaattggcctcaattcactgatgtgagaaaacaaaacatgatggtattcagtatcgaagctaaggtatttttctttccttttttgcagtcataaaactggattgcagacagctacctcggttctaaattcatccagggcatcgcttcatataagttactgcaaggaattctgcactacaactttctacacataggagcaagatggtaaggcacaaaatgcatagtaacaaataaaggataatgactatcgctcttgggctataaaaacttttatgttaaagcatctcatatgattaaggaaactgtatagctataaaagttatcacaactgaaaaaaggcattagtgtcccagatattctcggcttgtggaatacaaagttagaagaaatatttctcaaacattattgcagtgtctttttttttccttgaagaaatactaacgactactagattacttagaagcagcaatcaaagatgaaaactaacgcgccagttggcaaaaccaggttaaatcaggttatatgtaagctcaagtgatcttgcagttatgttgagaaaaattattagatctatgtgtgaactcactaatgtttttagggtgatgcttgatagtcgctgaattaccaattttaaagttcaattcagatcaaatattaattatttgaaaaaattggttatatagcatcgaaagtttccgtttttggttttatagcaccgaaagttaccggtcactttaatagtatccaaagttcaccttgttcccatttttagcactttcgtcaatttttccgtccgtcttgatcgttattgatccagccacacacatgatataacatttctacccctcattgatatgcattatacttgtacttgtgaggggtaaaaacgtcatatcgtgtgtgtggctggatcaagacggacggaaaatgatcgagaattgacggaagtgttaaaaatgggaacatggtgaactttgggtgctattaaagtgaaccggtaactttcggtgctataaaaccaaaaacgtgaactttcgatgctatataaccaattttgcctaattatttatagaatcgggtttgtctgaaacgatataaaacaatatgttttcttgaacttaataggctcacttttacatattctgcctatttgtgacgaca

SEQ ID NO: 5832 - DNA, 1501 bp, Oryza sativa
ctaatcgaacaatgtcacatatcaaatcttgtaattttgggatcaaaacaaaggcagacatagctgttggccatgaaccacaaatacaacaacaacagaatggccgctgccgccgacgacatcggcggtggcaagatgtaggtgcagtacgagacgccccatttccaacggccgtagctgcagaaccagaacgttgtcgtcggccagccaaatgtgggcggcgggcgacggtgctccgatagcactggcaggccctccgcagcctgcagcaacaagtgggacatctttctcggtctgcttccagtgatgacgacaaagacgacgacatatatacacctagaaatatgaggaagcatgggcatttcggtcactgcacgtaaaatatcggtcacttagcgtctcgtcagcacgtatacattattttaatcgacgcggtgtctactggtaaattaccatgtttatggagtgtttcccccaaaaatgagttcgtgcgatgttctacggctaaaaccacaaagtcgtgatgtcctatagcaaaatttgtcttcaaaataaggactattgctggagatgaagtaggtctgagatagtgtgcggtctcacgtccatttccttttgttttccaaaaaaaaatccttccgtgagtgtaagggcgcgtcgtcaggcttactgggcatgtttggattgatgcccaaaatacgcctataagagacaaattcatgggcaaagccaaatttatggcataagtagtgttttaatagaggttaaaaatgtccatttgaattgaagccaaaatatacctataagagataaatttatgggcaaaaccaaatttgtagcataagtagtgttttaatagaggtgtttggtttgctaccctaccacaattttggtagggtaacgtttggcaagaaaacaagttggcgatcagtcgcgcgcccccctccccgcgtgactggacacatgtcgcgcgtggagagggggcggcgacgctccgcgcgggtgaggaagagcgagttttccgttttttttttgttttttttcgtttttccgtttctgttcggttgtttttcctttttttccggttcggttggtttatctttttttttctggtttctcttctgtttttttcccggtttttttaaattttatgaatacaaaatttgtattcgtatgtataccaagtttgtatttgtacgtatacaaagtttatatacgcgtatgcaaagtttgtatacgtgcatataaattttgtatacgttgtgtattttttattttttaatacatatgtatataaagtttgtatttatagtatacaaagtttgtatatgtcctatgtaaacttcgtatacgttatatatatatatatatatatatatatatatatatataaactttgtatatgtgtataaatttatatacattaaaaatatatttatatatatacgtatgtacatactatatatacacacgtatatatacacacgtggtgtatatataa

SEQ ID NO: 5833 - DNA, 1501 bp, Oryza sativa
tggaggcggaaatcactgccattacatttttagagtctaaagttctgaagtaggtaattcttccttttacccctaaagttatgaagtaggtaatttgacatcacatgctactggagctagtttatggtacacaaaaaatatacaaagatttgatggaccataataacctgtaaacctgaatagtctacaccctacagattacaaattgtaaaaaaaaagttgaatataatcctgaaaattaaatgtcctgccatagtgccatcaaatatttcattcatcacagctgaaatgtgagcatcatccctttcacattaatcactatcgactatacttattttctctgtcctgtctaattttgttgaaaataaatatcccagaacaattcgattagtggaacagaactctctagctattgtattttacaataactgatccaacacgaacaattcgatttggactcattttatatgaaaatccaaccttttttctctaactgaagaaatatttttttaaaagctcatagcacgaaaaccgaaccctcaataatggttactgttactttagctttttctgttgcaatacacatccacacctaccatattgttgccctaaaccagctaatttttttacaaaataaatacctatgatccaacctgtaaaatgaagtaccatatgttatcatcagttgcacagttgcaataacataaaaaacccaggaactctctttgccaacagaaaccccgtaagcttgagtgaacgtatccaccggcaggaggtaggaactctacaatgtacaataaaagttaacttttttaccttaagaaatatgccaagatgaattggtcgcttctgctcctgccagatgacggcgatggatctagaaaaccaatgtggtaaagttagtgtgcaattcattcatcattaaaatcaaaatgagtatactgaatactcagaaagacccaaaaatggtatcaccaaattaagagagaggaacagggatgcccttctctggatggtcgtcagtgacaggtggaggtcgccgtaatgatattcagagattaattctgaagttaaataatcatggaatacgtaatatcctaaatagaaaggtaagtagccgtgtattaaaaagctaaatactcataacaggctccaagtttgccttcataacagggtccaaggagctcattgtgttgttttctaaaagttgcaacttagcagtatcatttggagaatttcataatgaactgcaattgcatgaaaaacaacacatcgctaagtaatccccaaacaaagttatgattagtgacatccctacactcagctatttatatctgaaattgtgagcgtgtcggatttcaataacatattatgaggaaaaccatcaatacgttccaaaaaaaaaaccttcaaggagcaaagttgtaaaacaaatattatgagcaatatatattttcttcataaggccaatcaacactgattcatcttaatattttatccc

SEQ ID NO: 5834 - DNA, 1501 bp, Oryza sativa
gctaagccttgacttggactgcagcgggaataccacttcacaggcatcctcgacggcacggacgaagcctactcctcggaaaagccaccatctaacacgtactcaaactctggggtttggggaaaatagagcaagactgagtactacccactgtactcagcaagtcataccggaataggtgtatgatgcaggatataaccaaaggatagctagagcggttcatttgcataaagcgagcatttaaagacagtagttgaaagtagaaaaatagttgtaataattaatcaatattaaccatccactgtccaacgctacaccatgttgcaacaggcccaaccacccacctgaactaatcaattccattagactaagctagggtgagactaatcacggtgaatctggttgaccgcccataaccgcgggcacggctattcgaatagttttactttgatcagaggtgtacaactgtacccacaagacagccccacgacacgtttccgtgcgccgacatgccaccacgacataccggatagaggccgtgataggacccttcgcataaccccctctaaccaagcacaccacacctcaggtttcacccccactcctcgcaaggcagcgggcagtcccctctcgtgcctaggtgaatccggaagccgcataggccgtcgcaaggcccatccaaactccatcacgcccacccttgcctggatgtgtcagctagaggaaagctacactacaagcccagccgttgcccacgctggcttgtggtaagtacgataagttcttccagggcatcccgcgaaccggtccttaagtgccatgggcgcgaccatcaaaaccatgcacccacagcccaccatatgatatattttaattgaccaacaccaagatggtggcactaatccaacatcaacactagaacctgaagtctatgcattaatgcgattctcccattgtgtgctagttaaactaagcatggctaagcaatccctagtccaatatctagtcatgttatatcccaagctaacaaaggagcaaggtacaaatagcatagctaaaacagtaggtaaccatcccatggtatcattgtaaatcaatgcagtatttaaaggaaaacaatagagcctttgcaatataggatcaacatgttcaagtgacaagcatgacttgccttgctctgctgctggaggaacctcggcgactatttcaaaatacaccggagcgtcgggagagccggaatctaagcgacatacaaagcaaacaatataaataggccataagactactgaaacagagaacaaaaccatttttaatggattctttgcatttttcttgatttactgagacttgaatgggcttaaacggagctcggatgaattttctatgaatttaagaagattcactgtgtttttactataaacagaaaaaccctaaatgatttattgcgcaataattaaaaccctggagagagagggggcggcgctgacatgcgggccccaca

SEQ ID NO: 5835 - DNA, 1501 bp, Oryza sativa; identical to SEQ ID NO: 2592

SEQ ID NO: 5836 - DNA, 1501 bp, Oryza sativa
ccattgcatatctttggtaagctagccacatatttaatacgagtcaagtataaaccaaatttggtactcgaataattatacaagtatagtaaaggaccaaaactatataaagaaaaatatttcattaatggataaaatcttacaagagagggaagagatagtagaaccatacccgaattctccagaagacttgaagaactaaggaagactattctaattctgactctactagcactagagcaaaatatgtaaactaaaaagcttcttcacttgattccttgttggtgtgtgttggaatgaaggagatgaggtccttttatagcttgagaatgacggttggaggtgccaaaacaggtacaaccgtcattggaaggtcagtagtaaccgtcgttggcttgggcctaggccagcggagccaagcctgggtcggccgacgcctggcaggcctccctgggccagtccttccttctgaacgtctcctgatggatcctgggcccagtggtatggtggttggtcccatttgcaagtgtttcaataggtttgtgggcccatctatccatatgtctaccgcatgtcgacctctgattggtgattttccatcatttcttcttaatttatgaagtgatctcctgtatacaagtactttgtcaagtactagtggaaataggttatttctaaatgaatatgcatgcaagcatttctagttctccattatttccaacagtattgatggtcgaaattcgtctataatgaccgtcaacaggtaataggaccatgaggttgtagtcgtggagacgtggatgtatcgatggtgttgatgtcctcatcatgagagctcatggagctggagtcgccaccgggccgtcacacgagatccgccaccggggatgccgctcgagatccaccaccggtcggcagcgtagagatccaccactggggccgcctctcgaagcgaggaggaggatgactgtcacatcctgattttcgttttaggatttataaattatttaataaattattattagaatttatattaaatgttcattaatttacaagagaagttaaatgtgggaaataaaatttcctaaatataaagcatggacggatttattttttattaaattctccatggttaattatactctctggaattttctcggatttttcggagctcaattcctaattttaaccatacaaagaacatttcagtaattatccacatattaaattaatcattaaatggtctgattataattttgttaagtactttgagtgtccaagtattttcaggatttttcttgaaactatttgagcattggaagtatttttaacaattcaaagatcatttcagtgattattttaattggaaaaagtttttaaatcctctcctaagccgttgggctgatttcagcccaacatctctctccctcgcgcgcgtgctgtgcagcccaagtcggcccatccgagctcctcctctttctttctttgctttgttttcagc

SEQ ID NO: 5837 - DNA, 353 bp, Oryza sativa
tgcccgtcacagatgacactctttttgacgggcttttattaaggcccgatagagattacttgtatgcctgtcacggttgattattttagggccgttacatatatttgtcgcacagtataaataccccccaccacctagtgtaaatgtatctcactgttcactattttggtgggaggctgtagggggcgattttttgtctttttccaaggaaaacagaaaattcccaaaagtgatcaaaatggatcaatcaagtgagtaatattaatcattaattgagcaatttcatcacgtcttactttagcattactgatcttataagatgtgcatgtaatttgttttttttattttgtagc

SEQ ID NO: 5838 - DNA, 503 bp, Oryza sativa
  unsure (1)..(503): unsure at all n locations
tctttccctccctcctggntttctattaaaattataaannngntnntaccccgccccaccccccccctccttnnnnnnnncnaccccgtactnnggnngaaggttgtaaaattnttagaaannttagcccctcacttagcaggttaannttnagntttctccaaaattcccccaccccccggggggncccccccccccccccccccgcttnnnccctcctccttcccccctttcaaaatgtacgggcatttttgctagtaagtaaaaaaaaaagaacagcaanaatgtccgagcggttaggtaggaccagcgagcacgagtcagtcctgtgtccgaacagaagccgcagtactgtgtccgaacagctccatctcccttttaaagtcgcgagaaccaatgccaaagtcctcgccaaccgtctccgttcactgccctcgattgcaatccacgttcgtcgtgagtgacgatgggaagcgccggtgcggcgccggtggcnacgncgg

SEQ ID NO: 5839 - DNA, 1501 bp, Oryza sativa
ttgccgccgcccgctgtgtgctcgccgcccgtgctccgtagcgcccgctcgtcgccggcctcgctcggcgcagctccgcccaatccgacgctagcaacggattcccgtagccgcgtagatgctctcgccgccgggaatcggcctctcgtgacctcgtcgccgtttcccccttctccctccgccggttgccgccgccgcaatccgccgccatcgagcatcccccggcaaatccgagccgttggctcgactcccctcgtcccgtgcaacttcccggtgtgctcgctttcgcctgtatcgccgtgattcgctccgccgctcgccaccgccgtccgccgtccgttccggctgacgtcttcttcaacctcccgccggcccgcgtggctaccacgttggcgccacctcggccacgaccggatcggctgacccggccagccgctccctccgtttcccctccctcgcgcgcgtggtccaccgcgagccgtgaggctgcacgtgggcccgccgcaccgtgtcctccgcgaaccacgcgcatgcgccgcgcctccctccccaaaccctagcacgccccgcgtacacctcgctcatggtgagccgagtcgccgacaagcgggtcccacccgggaccacgcgggatggacccggcccaccggctctctctctcccctccctgcccgcgcgcgccttgggccgccttcttgggccggccggcccattaagctcggccgagccgtccctttctctcgggccgcgccctagccgcccgaggaaagtttaatttccctccctccttcttttcttttcttttcttttccaaaaaggatttaaataaatccttttcctttagaccaaaaatccaataatcttagaaattcaatatcttcccaaccgtaagtccgtttgactccgttcaacttccaaaattcctcaaatctcgagatccatttaatggcacgcttagaggtcaataataggactttatttttgccgtttgttgagttgttccgtttcgcgtgtagtttcggagcccgaagacccgcaatgcgaggattccgaggatcaagctcaagatctcgagcgaggcaagccacctttgaacatcttgaacctatatttgaacttaattatgttgcttgaaaaatattatgcattgataggattgcactaaatctgcttgtcccgtctgcaaggcagattggcggacctacctaacttgttacatctgacccttccattgtaattgttatatcatgttcccttgtaaccacctagttgcgcctcggtaattgtgcactcggcacgagtatcgacggtcgccttcaaacttaaaatcagagaaacatcttgggtaaaacttgggttttacaaaacacttggaaaacctgacacctgggtcggtgcttgcgaacctaaatgaatttccaaaatcgcggaccggggaacgtaccgggtgtatggtttcccgctcttgcacttaaggaccgtttccttggaatttcatctg

SEQ ID NO: 5840 - DNA, 960 bp, Oryza sativa
tggttgttttccattgatttttttcctctctggactgctttgtagtttgtaccactaactggctcgtgaagctttaaaaagaaggaaagaaaagaaatgggaattgggaggtgtctaattggtgggggcgtgcaaccgtaagatagagatatcaagcgcaattaattgcaccatcaccacttgctaattggatttcttttcatacactagaccacttgctaattaattgatcaacatcatggcccactgcaacgttcttcttgcaatctggagtcttaagatccgagaatccatgctgaaaaaaatattttattagtgtgacgactgacatgtttgaaactattagaatttgatttataaaattgatataattagatttttcgttacaaaatctgttcatacaaatataatctttgtatgatcttgatgcaaagttattaaatggattagcccaagtcgtattctggaaaccacaagaaaatacaaaaatgtgaggtttaaaataacagaggcagtattattgtacaacacaaattaaagatgtgatggtaactaaaagaaatgagtctagctggtcagctttatctttgtgaaaaagtcagctttatttttctttgaatatagttaacatactgcaaggttaggtggtgatatattaattattgatctctgcctttgatgtaggcatatgcctgcctcctgtggatcagatcgggcttggacataacaattaattagaaacagcaaactgacatcttgataatgtgctggcttgagcaatcaagccacaatcctagaccaacatactatgcacgtagtaggagtatacattatattccacttttccacaagatagggtccagtccagtatatatatagggcatggagagatggaccatttgcaggaggcagaggtcgagctgagagtgatcgatctttgttagctagagtgttgagcaa

SEQ ID NO: 5841 - DNA, 155 bp, Oryza sativa
taattaagcttaaaagattcgtctcgtaatttacatgtaaactgtgtgattgtttttttatttatatttaatgctctataaatatgtttaaatatctggtgcgacgaaatttttagaagtttgaatgtaatgtctaaatctggaggctgtaatga

SEQ ID NO: 5842 - DNA, 363 bp, Oryza sativa
ccctcggggagacagagggaggggtggccacgtcaccctcgggcccgacccccccaagggggtcaggccacgtgggtgaccgcggctacccaagcctctagtcacgatacccccggccccatgtcaccgagagtagtactaggtaatatcacatcctgtactaggtagctatattttgggacgggagaagttaacgatatttatagaacctattggaatataaattttcaaaaaaattaatatattccgtgtatttactgaaatttacagtagtaaagaaaagaataacgaatttaaaaaggaaaaaaatcagtttacctcctttactagttaccgattgaaatttcgatgatttcgctcaga

SEQ ID NO: 5843 - DNA, 1501 bp, Oryza sativa
gcaggttcggggaggtccggcagcggacgctacagcggaagctcatcaagatgctgctcgaccccaacccgggaacccgcatcaccgtcctcggccttctcgagacaccgtggatccggaagacggcgcccgtcccgcgccccagcgccgaccccgtgccgacgccggtggacacgcatggcaatgccggcgacgacaaggatgaaccacaggttcgcgacgcgggaggcggcaagcggcgtggtcgcgcggctggaggcgcttgctacgggcggcgccacgcccacgcgcgtgacgaggagcggtgcgcgcggggtgcggctcgccgtggcggccgacgtcttcagcgtggcgccatcgttgctcgtggtggacgtcaagaaggatggcggcgacgccatggagtaccggttggtctgtagcgaggagctccggccggtggtcaaggacatcgtctggtcgccgccggcgacctgacgacacggcgggacgtcgccgccgccattattgcgcgtcatcgaattgtatctgttgctatgggcgttcttaatgctgatcacaaaagcccacctcatgggatggcatgcatctggagtttagtaccaccttgcttattctaggagagggggacctccttaaaagggaggatgccctcctagccacttgaagcatgtgtggtggagagaagagggggaacacacacgcgcgctcgctcgcctcgcctggcaggcggcgtgcgtgcacgacgtacgcgtcgaatggtccgcaaaattggatcctcaccattgcgcagatgcagcctccttttgcagttttgttttgctgctggaaaattcggatttgttttgttttggaaacattccgaaaaatccggtacgtgaaaacggtgtggagtccggataagttacgcgcgacttatccggttcggttacgcggagtggagatcgtgcgggcgccttgatcaagcgtcctatctctatataaaccgaggcgccgccttcacgcaaaacacacgaaatcaatctagggtttgcctcctcctctgtgctgcgctgtcgctcgtagactactccatcccgctcgccggcgtgcacctgcgatcgggagagcaggtctccggaacctctgccttcgacgtcctgcaccgggagaagacggcaataaggtttttgggaagcgctccacgcgactgctccctgttcgtccgcgacggctcgccttcctcttcgctcgcgtgctgcgcgccttcgtcgacgctcgcaaccgcgagtagttcctgccgagcaaacggtctttccaccacctcggtacgtgttcgacatgttgcgcatatttgatctgttcatattttactgcttagtttacatgtgtagatctaatgatgcgtttatgctagtatacatctgtaatgtcatgatttatttattgaatatattaaatcattatatgtctatattctcaacaatccaaaaaccttattataggcgctgtgattttacta

SEQ ID NO: 5844 - DNA, 1501 bp, Oryza sativa
ctgattaactgaaaaaacagtaggtaaattaccatacccgcttccatctccagtgttgccaatggtcacattagcagacttagaggtctgccctgcaagtgccttcatcctcttgcgttgtggacacttcctggccagatggtcaggttgatcacacacaaagcaagtcctctcatcctgattagaattgttgttgttgttcttcttcttgaagttggtggtctgctgagctttgtatttccccttgctcttgttttgggccttgtgcacaacattggctgtggactgcccaccatcgcccttagacgcggcatctttttcctgagctttctcctcaatatcaagagacgctatccacccctcaacggagtattcctgtctcttgtgtttgagtgcagtaccgaaacctctccaagatggaggtagtttcgcaataatgcacccggccagaaatttgtcgggtaagacacacttaaggagttcgagttccttagccatggtttgtatctcatgagcctgttcgactacagaacggttgtcagccatcttgtagttatgaaactactccatgatatacagatcattgctagcatcaatagcaccgaatttagtattcagtgcatcccacaactccttagcgtcggtcatatgcatatacacctcgaccagatgatcgccaagcacgctaagaatgcatcccacaaagagagtagtggcctcatcgaattctttctggtgattagcattaagaacgcccataggcttgccagtactcacaaagaagcatttcatagttgtcagccacagagtgaccctgatctgccatctcttaaagtacacaccggtaaatttatccggcctcagtgcatcggcaaaaccagccatagtaaaatcacagcgcctataataaggtttttggattgttgagaatatagacatataatgatttaatatattcaataaataaatcatgacattacagatgtatactagcataaacgcatcattagatctacacatgtaaactaagcagtaaaatatgaacagatcaaatatgcgcaacatgtcgaacacgtaccgaggtggtggaaagaccgtttgctcggcaggaactactcgcggttgcgagcgtcgacgaaggcgcgcagcacgcgagcgaagaggaaggcgagccgtcgcggacgaacagggagcagtcgcgtggagcgcttcccaaaaaccttattgccgtcttctcccggtgcaggacgtcgaaggcagaggttccggagacctgctctcccgatcgcaggtgcacgccggcgagcgggatggagtagtctacgagcgacagcgcagcacagaggaggaggcaaaccctagattgatttcgtgtgttttgcgtgaaggcggcgcctcggtttatatagagataggacgcttgatcaaggcgcccgcacgatctccactccgcgtaaccgaaccggataagtcgcgcgtaacttatccggactccacaccg

SEQ ID NO: 5845 - DNA, 1501 bp, Oryza sativa
cgagtactttacatgacaacagtgcaggatgaagagcctgcccgaaaatcctcttgagtggtctataattaccttaggtggacatatggatggaccagaccaactacttcgtttccttctcgatgaattttatctatatcaagcagcatcctccatgtccatttgtccagtagccatgcatgaacattacagtttagatataccaaaactgcatgtagctagctaggcctgggaggcagagggaactactgagccataacatcatgtgtacatgagcagagttgcaccttgtcatgcagagaaacaacactaacatggttgagtagattatcggattgcagaatgacaagccaactatgagatcaaggcctgggttgaacgacctgattagtccgtgcgtcttcttaacacaagcgtttgatcaaaggacctggcctgataaaggatcagcagagcacctcatattaagataaaatagatcatttgagtagaattaatagaaaggggaaacatgaggcgctctgctgatcctttatatgtcattttttttgttctgcacatgtgtagttacctattgtacttagtactcaagaaccttataattctctgttctgaattcctagctaggcttctcaagctgactagatgcagttaataaccggtatcataacagagatggtatacgatcgaaattgagtacattaaaatgcaaaaaaaaaataaaataatgaacgacatatatgtttatttcccttctcctttgctcaaacatgatgccaatgacaagttatttcccttctcctttgctcaaatatgatgccaatgacaagttctcaccgtgtatatatataatgcatcgtcccaacggccaaacaagtaagtaaaatcaattcaactatggcagcaacattaattatctctcattcgtacattctacctagctagcagatacgtatatatagatcaatttcgctagtatgcacgcctacatgtctcatcaaactatagcaggagtatcgatcgttgatcgatctaggactgggaggtgctaggaaatacaagctaacagcatcaaaagtatcacaaatgggtgacgactgatttagaagacatccaagaaacagtaacaccttgtagtgtcttgaatcatggtagagatcgaaggcgttgctgacagacttgttggagtaatatcgaaatgaaatggctcctatactgtatgatgctaccagtgattttacaacatttctgtggtcctttcactactggagaagtgatctttgccgggtaggggaaaaaccacaattgtcccggttcaccaaaaaaccgagactaaaaacaatttttagtcccggtttataggttcaacgggaagatttcatcctggttcgccagttgtcagggtgtgttaggcccccggtgatctttagtcctggtttgtgttactaaccgggactaaagatcatggcgatttttaagcccggttggtaacacaaaccgg

SEQ ID NO: 5846 - DNA, 1501 bp, Oryza sativa
tcgagggcttagaacctcacctagtgcccccggccgaaccggcaaaggggggcccgcgcggtctcccggtgaggagccccacgctccgtcagttcatcttattaaaaacttttgtgaaatgtgtcaaactatatgtatatataaaagtatatttaacaataaatcaaatgatagaaaaagaattaataattacttaattttttgaacaagatgaatggttaaacatttttaaaaaagtcaacggcgtcaaacattttggaatggggggagtaggaaacattaaaagtatcttccgcaacctaaaagatacaacaacacccttatctcctctctctgtacctagctgttgcgtagcctcgcgtagtggctatcaaatctgtcttagaacgcaccaattttggctcgtcaatgcaagggccacctttgcctacccatgatgatctattggaggtcactaggccctctccctatatctgggatttgtgcctcttccagctcctcacgtagcctagatatctacacctccgccatcggctagatctggttggtaaatcggttagatttgtgtctctttgcttggtattggtcactccatcggcagcattaattgcatgatgaacatgcttggaattggtcgctccgtcatctacattgtcaaggctagaagggaacacaataggcggagaaaagagggagggagggagtgtggacgtctgattttcttttcacttaatattagatactcgatggaaagcgttatgaaaagtacatattaataagagaaaagataaagtttacatgtaaatcgtgctcagaatgaattatagtggtagcaatggattaacatagttttgtaaaaaaaaaaggaattgcatttgtggaaaataacaagtgctttatatataaagagaaaaaaagatccaaacaaagtttttaaaatctgctttcatcctccgaagcaagcacttaatagtttaccttgcgcgctgattttatagtaaggtttgaaaaagtttccgtttaccctaggaagatatagttaggtccattgaattcggtggtgatcgagttaactaatttctttgtcctccctgagactcgccgtgcgcttgttgtggtctcctgctagcagctaataagcaccatggacctgtctctgatgacttaggcactgtctataaatacaccatcaccatccccacactcctcgctcgcctgcctctctgttcttaattagctagttacctccaaatcaatccaatctcaattcatatatatgcgatcgatcgatcgaacaagcaagtaatcgtcagtagtcctagctagagagacataaatatctagctcaattggctaattacgtgcccaactcaactgcaattcagttcatccgatccagcacagaaattagctataagtaagggccggcgccgccggcaagaagaagtaaagaatatgggggccggcgaggtggtgcaggggctgaagccggtggcggcga

SEQ ID NO: 5847 - DNA, 984 bp, Oryza sativa
catacatattgatgtttagattcattaacatcaatataaatataggaaatgctagaataacttacattatgaaacggaaggagcagtaaaaaacaatgcaattttggtttcattccatatatatgtgtgtgcaacgtacatgctggggtcggattcgttcagtttaatcctcaagtactccaaaaatcatcatttttgttaaattttttttgaaaggagtcatttttgttaaattaaacaaagccttatgttctatgtagggcatgcaacttaatgtaaataaattgacaataacatgcatgcacggtattaaagtataaatagcagggtgtgttaattatactgtgatatttgttagtgccccccaacacacaaaaaaaatatattctgtggaatagtatgacgatgcacagagatctccctatatatgcaatagtgataaattagaatatactaatatttgtatttctaaaatgtaatagtatatatccaacaatactaataatgctcattaattgttcccctggtaaaaaaaaaacgtatgtacctcctgaaaatagtctagcctaaaactgtaatcaaacttgtcaaaaaatagcacactatatgcataacattaaattgatatgcaataattaaatagctgttaattaatttgtatttaatttagtagctatatatatacaccgtaatatgtaaatgaaacttgaaatgccaataggtacaggtgcactactgcacattaattgtataaatacaacacatgtctatattgagagctgatatttttttacatgaacaaaggaattttctgtgcttacgtatatgtacatcagtatcagtatgcaagcataactcttaatatatagccaacaccactctgattcttaaatccatatgtacaggtacagcagtaaactaactagttagatcatcgagtaatctgatatatatgtgatatatatagaccacaaaaatcatgca

SEQ ID NO: 5848 - DNA, 1190 bp, Oryza sativa
cggcggggccaccatctccgtcgtcgccggtctctcactcttcactcgcgtggaggggtgagacggtgggggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgacggcgccgccgtgtcgccatgccgccgccggcgctgtgctagggtttcggcgacggcgacgccgctccgtgcaaccgcaagagaaagaagagaagaggagctaggttttcggcgccggcggccgggggcggttttgtttgcccgatccgcccgcgcgaccgtccgatcgaaaccctagcgatcggacggccgacggcggccggaccgaaatcggcccatgtgggagcgcacggcaagccactttcccggcccaggcccaggttgcggcctggcgaaaggggagggggcgcccgcccgcgcgcaaggcggccgtgggccgactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtatttttcatgcaaattacaatagaattttgaattgttttacatgttttatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcagatggctact

SEQ ID NO: 5849 - DNA, 1501 bp, Oryza sativa
tctggtctggtcgagctgcctacctaaccgaggcgcgtgcgtcgcgtgtgcggtgcaacgtacaccgttcgggactccccttttctaacctgtactcaattgtttttccatacgcacgttttttaatctgccaaacggtatttttttaataaatatatatagaaaaaatattttcaaaatttatattgatcaattttaagtgatttatagttaatattcaattaatcacatgttaatggatcattttgttttacgcgcgtgataggcaggtctcatccgaagacacccctgaaaagggaaatattgacaggtgttagctaaacggttttctttaccaatgcaaccctctctcgtcatggacagcaaaaaccatacatgcccttctacctttgacaattctttagatcacttgagagattatcgtgggattgatgtcgactatcttcttggttgtagtgacaagttaaatttttaatagaacatatagtatatttttaagaaaaatatatatttaaaggtgtagagcaaataatataaggtgataattagaaaggcagtaaaaacaaggcatgtagaactgaaaatgagggggggagggtggggagggtaaaagaaacgtaccaacacacatttatagttgattccttttatataagaataaataggtggtgaatttccatccaaagaatcctccatagttttcatcgggttttggattatacgttaagattatgcccatcattcacacactcatcaacctaagacatccatcatatgatgatcatggcatcccgcatccagagccgaatgtcatcattatcccttcactaaaaaaaaccccctattttttacaagccaacgtccatacatgttgctccgagaacaaaagagaaggaaaaaaagacaccaatgcattttatcttgtgaacattgttcatcttgttccctcaaaaaggaaatcgattaacccaacgaagaactccaaatcaaaccccttttgcctacgtgtgtacagctacgcagcatccgcatgcgacatgacagaagagatcacacaacaacacaagcaaagacaaaataattaaaaaaaagtgccagaacacaacacagcagagagagagatcaaaaggaaagcaaaaaaaaaaaaaaaactggagctgtctgtctgtcaccagcgtcgacgcagttaatcccccaccattagctccttaatcacccacactaattacctgtttaattaattaactctccagccggcgcagtccacggggctctatatatacagccggcgcgcacagcgacaagggagaggaggaacaaacaactcatcgtctcgactcgattctcaccgaggcagcgaaaaaaaaagaggggagagaaaaaaaaaacaccagcgaggcaacgagggggtgggtggtggtggcggcggcggcgatggagagcgagatggcggacgcggcgccggcaccggcggtggcggcggcggcgacggcggagccgc

SEQ ID NO: 5850 - DNA, 1501 bp, Oryza sativa
ccacgtgtacacttatgaatcaaaattagtacgtcatcaatcacgcgttcactcacaattcaaactatcacataatatgctctatttatgcgcacctacttgctgaccaaccgcttaatacaaacaaatgatatgcgacaagtgtattgtcaacggcacttaaagacagacataaccgtcgcatccacacaacatttacagcacatttctccactgaaaaccttcatgacagcagcatacaaaatcaagtcaaccaactaagcaagctgttagatagtaacactaagctcagttcaatttttttcacgcctattactccatagaagcagttacaaccatttttgcttggcgcaaactgagcagacgctaagcattacaaacaactagcagaatcaagtaccctcacagctaaatcgtgctactccaaccccaaattgcttaccgagcaacaattcgagaatctacggttacgccacagtagaaacacctcaaatcgtggctagcggagctactgctacacgactcctactccccccgcattcctcaagcacacgcccaaaacttttcccccccaaatctagcagctcgagtccccgagctccagcgccccaagctctaaacccgcccagcgcagcccaaacccgtcgatcgagctcccaccactcgagatctaccccaaacccacgctcgcggcagcagcagcagcagcagctaaaattcgagcccgaaatcgccaccgcgcgggtggggggaggggatcgggatcgggggggtggattacctctccttgcgctcctggatgttcttcatctgcgagcggtagtggttctcgatgaacttcttcgccgcggcgacgcgctccatggtgagggtggaccccaccgccgcctccccgccttcctccccttcctccgccaccgccgccagcggctccgccgtcgccgccgccgccaccgccggtgccggcgccgcgtccgccatctcgctctccatcgccgccgccgccaccaccacccaccccctcgttgcctcgctggtgttttttttttctctcccctctttttttttcgctgcctcggtgagaatcgagtcgagacgatgagttgtttgttcctcctctcccttgtcgctgtgcgcgccggctgtatatatagagccccgtggactgcgccggctggagagttaattaattaaacaggtaattagtgtgggtgattaaggagctaatggtgggggattaactgcgtcgacgctggtgacagacagacagctccagttttttttttttttttgctttccttttgatctctctctctgctgtgttgtgttctggcacttttttttaattattttgtctttgcttgtgttgttgtgtgatctcttctgtcatgtcgcatgcggatgctgcgtagctgtacacacgtaggcaaaaggggtttgatttggagttcttcgttgggttaatcgatttcctttttgagggaacaagatgaacaatgtt

SEQ ID NO: 5851 - DNA, 483 bp, Oryza sativa
gggttacagcatgcaacaataaagtagggacacgatatatgtgagcgatatatacttgcaccccaccggactaattaattaataaaacattattcttaaacatatagagatatggtagcttagcattagatacgcccacgaaagcgagtaaacaaatggaaagaaaccacgggtcgaacgaacgaaaaaagttcctccaacacgaagcatcacgtacatacatatatattcttcaattcgcatatataagaagcatttctgcttgactcaatcacaacgcgaattgaatcgttacatatatcgatcttgctggtggtagtggtcgctgcactatctatctatatatatctgcagcctttagcaagcagaggcagccaaggtggtgctggttgctgtctcatggagtacttccacctagctagctcattttgtgatctttccgggtggagaagaattaatccatcatttcagtgctggtgggca

SEQ ID NO: 5852 - DNA, 1433 bp, Oryza sativa
attgggttcttatatggaaacttctttcgatattacttatttttaattctgaatttcagctatttttaaattgtatttctacttggactctcctttccttttcttattttggattttattttatttttatttcgaattttagttaatctcgtattgggttcttatatggaaacttctttcaatattgcttatttttaattccgaatttcagctatttttaaattgtatttttacttggactttcctttccttgtcttattttggattttattttatttttattttgaattttgattaatctcgtattgggttcttatatggaaacttttttcaatattgcttatttttaattccgaatttcagctatttttaaattgtacttctatttggactctccttttctttttttttttctttttctccgattaatatggaaatttctagctcccacagcgaacgtggtgcctcctttcaaagctgttttaataatataatagaataatagatagatagatagatagatagatagatagatatgggctcaaccggggatttaaaccggaaaccggcccatttaaacagcacttggagcccaccatgaaaaccttttcaggccgatcatttccacagggatttgggcctaaaaccggccttccaagcgaattttttttatttataatttttttattaaaagttttacaaaaataattttccattttgaaaattgacggaattagtcgcctaccgccctctgggagggcgatttttaaaaatcgccctctcagagggcggcgaaaatgacgtggcagacggccgttcgctctcgggcgacggccgtcaacgaattttgcaggcggcccccttgccgccctccgctagggcgattttgtactgtggggggggccgcctgcaaatgggcggcgagggggcatggaattttgcaggcggctcccttgccgccctccgcgagggcgatttttgcctctccccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacaacacatatgtgtagatccagagcatagaatataatagtatgaattgagacatagacagtagtgttaattgtaagatgtagtttagtttgatccagagaatgtaacgtaattttagaaatttagagaacaatattgtagagaatgtaacttagggcgtagtacagaaatgcgaggttaacgcagttattgttttcatcaggcacaa

SEQ ID NO: 5853 - DNA, 273 bp, Oryza sativa
aataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtactttacgtttcattgttgcgctcttcctcttcattgggcacgggcacatccaaggctacatccgtatctgaaaga

SEQ ID NO: 5854 - DNA, 1472 bp, Oryza sativa
aattccggattaaaattaaaattaattccaaatttgccaaaggaaattaaaggaggagtccaggtgggattttaatttaaaattggtggatttaggatttaaaaataagcatttttaaaagaagaatccttttaagaacccattccgagattaattaaaatttagaataaaaaataaaatattacccaaatttagaaaaattaaagagagttcaaggtgggattccatttaaaataaattccaaatttagaaaaggaaaggagagtccaagtaggaatacaatttaaaaatagctgaaattcgaatttaaaattaaggatttttaaagagaagagtccttttaagaacccattacgaaattaattaaaattcggattaaaattaaattaaaatccaaaattagaaaaggaaaggagagtccacgtaggaatataatttaaaaatacctgaaattcggaattaaaaataaggaatattaaagagaagagtccatataagaacccaatatgagattaattaaaattcgaattaaaataaaataaatccaaagttagcaaaagaaaataaaagaagagttaaagtaggaatacaattgaaaattagataaaattcggaataaaaaataagcaatattgaaagaagaatccatataagaacccaatacaagaataattaaaatttcgaattaaaaaaataaaataatatccaaaattagaaaaattaaaagagaatttaagtaggaatacaattttcaaacaactgaaattgaaaataaaaataaaaacattaaaggaacacaatacggtattaactattttttttaaaaaaaataaattctgaaattagaaaaagaaaaataagatttcaattagaaatacaatttataaataactaaaatttgtgataaaaataaagactattgaaagaaaagaccatctacaacacatgacgagataaattaagtaacagcctagaaaggagtagagtggtggcggttgatacgacatataaaaattattaataaaacaccaaatataatcctaatgacgattaaaaggagggacatcagacaggccgtgaagcaaacaagtaaggcggttgccgggacttctagaaagtataaaaaataaaccccattgataatcatattcgatttttaaaatgttaatgacaataaaaaggagaagcagcgggcggggtgtataagagtatagttgctgagccgccgacgattgacgggacttctagaaaataaaaaatgaattccaacgatagttatgtttgatttttagaatcacaacgacattaaagagtaggcggcggacgggctgtaaaggggcatagtggcatcgtttgatgggacttctaaaaattataaaataataaaactacaagtctaattttttaaggttcggaacttccaaaaagtaaaaaagaaaccatgataatcatgttttattttaaaatctcaa

SEQ ID NO: 5855 - DNA, 926 bp, Oryza sativa
actcagtactatgggatgtaatatgttaatcttattcttttaataaaactagctgggtggcccgcgcaattgcgcggctagcatccaaataaaatcatatattttttaatatgattttacttaaaatttattaaatagctatctcattgtcttaagactttgaaagaccaaaccttatcatcctcgtgtttctaattatatagtttttaaaagtcacatcagttgctaccccttatgtcatcttcttctttatttgtttgctcgatctaccactatttctatttattcttcttggaacctttaaaaattgaattttatagtttttagagattattgtcacattgggtttcgtttttataatttgtagatgtctcgtccaacgttgtcattatactcctctaccgcccgtccactgtttcttctttttattgtcattgaaattttaaaaatcaaagataattatcatttgggtttatttttactttttagaagtcccgccaaaccgtcagcggctttgccattgtactcctttacaggtcacccgcagcctccgttctttattgtcattgagattttaaaataaaacatgattatcatggtttcttttttactttttggaagttccgaaccttaaaaaattagacttgtagttttattattttataatttttagaagtcccatcaaacgatgccactatgcccctttacagcccgtccgccgcctactctttaatgtcgttgtgattctaaaaatcaaacataactatcgttggaattcattttttattttctagaagtcccgtcaatcgtcggcggctcagcaactatactcttatacaccccgcccgctgcttctcctttttattgtcattaacattttaaaaatcgaatatgattatcaatggggtttattttttatactttct

SEQ ID NO: 5856 - DNA, 1501 bp, Oryza sativa
tggtggatgcttttattaattgttctgagtgatcctcgcctccgtcgacagcctcacgaacaagcgtcatggacccctgaatcaaatattctgctagctcgctcttcattccaacagctacagaagatgggctcttgaagatatcaccagtagtgctgtcaactgaggcagttgccaatccacgaagcaggatttctgccatggaatgcactacatctgaatcacacaggttgcactgaaaatttaagccatctttcccaactgtgcattcaaggttctccattgtaataccaagcagtagttcaaatcatcataacagtcttctgaaaaggtccaatgaagcaaaccatttatgtacttagtctagtatatgctcatgcattcttataaagaacatacataaaattttcaaagcaatgaagcctaaaacttatgcaggtaaggttctccaaagatgcgtcactgttcaaacaacacctaaatggcttctagacgtggctcacaattgggctgcacatcgcctagtcagaagcgtttcatatgaatcaactatctagagatcaataatgccactgccagcaatacagtccatgcacaacaaaaccaattccaactactataggcaataggctatagcacaatcaaacccaattactccaatatacaaatatatgaattggtcattggaaaaatctagaactgaatgagatatttggcaatctagcacttcacatcccacacatttgacatgattgctttgcacaacgccaacgaaaatgtggagacactgggatacggagtagcgagtaccaaataacaacacaacaccaacgatgcaaggagccaaaaaacggaagttgaaaactggacgaaacaatccatctcctatgataatagcaatcgaagactcaatcggcgcatcggacgaaacgggaacaccgccgcacacctcgaggatcctagcaactggtaagcgaagcgacgccggaaacgagaggcggacagaaggctacgcgccgtcgagaggatgcggaggaggggagggtggttacctccgggagcaggaacgatacgcccgcccagcccagcctcgagttcgcggccggcgatacggcgccgcgcagcgctggagagtcagagacctcgccggaggagagcgcgtcgcgtcagcgccacggggagggggagagagaagaaggcccacgagaagaggaggaaggaaagaacaggtcatcaatggactcatgggccgcgtggccgtccttctgtagcccatccagcccatctggaccgtgcatcgtcgatccgacggcccgtggagcgaaaatggatacggcacggtgtgtgggggtgtgcttagccgtcttcttcttcttcctccggcaccgccgcccaccaaaccaaccaaccaaccagccccgcctcgagccaagcaaaaccctagcaaaggggaggggcagcgccggcgggggcgacggggcgtgggggcgacggtgcgcca

SEQ ID NO: 5857 - DNA, 1501 bp, Oryza sativa
tcgggcatggccccatgtccatcttctgcaaaaaaacaaaacaacgcaggcgcacatcagccacgcgataaccgaatccgatggatggagtggggatataggagggggctccgccgcgaggggatcgagagtagcacggggaacgcacggtgagctggaacaggtcgtgggggcagaggccggcgaggaagaggcggcagacgtcgcggtcgtagtacttgcggctgacctcccgcacgtcgccgttgcggttggcgcccatgagctggtcgagctgcttccggatcgcgtccatggcgcaccgtcgcccccacgccccgtcgcccccgccggcgctgcccctcccctttgctagggttttgcttggctcgaggcggggctggttggttggttggtttggtgggcggcggtgccggaggaagaagaagaagacggctaagcacacccccacacaccgtgccgtatccattttcgctccacgggccgtcggatcgacgatgcacggtccagatgggctggatgggctacagaaggacggccacgcggcccatgagtccattgatgacctgttctttccttcctcctcttctcgtgggccttcttctctctccccctccccgtggcgctgacgcgacgcgctctcctccggcgaggtctctgactctccagcgctgcgcggcgccgtatcgccggccgcgaactcgaggctgggctgggcgggcgtatcgttcctgctcccggaggtaaccaccctcccctcctccgcatcctctcgacggcgcgtagccttctgtccgcctctcgtttccggcgtcgcttcgcttaccagttgctaggatcctcgaggtgtgcggcggtgttcccgtttcgtccgatgcgccgattgagtcttcgattgctattatcataggagatggattgtttcgtccagttttcaacttccgttttttggctccttgcatcgttggtgttgtgttgttatttggtactcgctactccgtatcccagtgtctccacattttcgttggcgttgtgcaaagcaatcatgtcaaatgtgtgggatgtgaagtgctagattgccaaatatctcattcagttctagatttttccaatgaccaattcatatatttgtatattggagtaattgggtttgattgtgctatagcctattgcctatagtagttggaattggttttgttgtgcatggactgtattgctggcagtggcattattgatctctagatagttgattcatatgaaacgcttctgactaggcgatgtgcagcccaattgtgagccacgtctagaagccatttaggtgttgtttgaacagtgacgcatctttggagaaccttacctgcataagttttaggcttcattgctttgaaaattttatgtatgttctttataagaatgcatgagcatatactagactaagtacataaatggtttgcttcattggaccttttcagaagactgttatgatgatttgaactactgc

SEQ ID NO: 5858 - DNA, 975 bp, Oryza sativa
tcagacccgataactcggcatcagatcttgtatttataggtttcatacttggtacctaggtattcgacccagtacttggatatcagatatgataatctagcatctatatatcacatactagagtttctaagatgtggtataaccaagagcccaacatgacatatctaattagaatacattgtatccatatataatttaggtaattatttgtctggtctaatccatgcatggtataggacacatgcaaatagatgcaacccatcttaaacacatagctaggctactaggctctgccataataagtaccctacatggctagggtacgggactactagtagctattacagggatttgacatgcacagcaagctagtagtactttcggttttatttaatagctaggctagtatcaaaggcaggacaggcatgctgggtattagctagctgtcaggaacaagactatacactgatacacatagcaaacatgcgtgatgataatcctagcagcacgcgacatactcgggagaagccggcacgcggggccgcgtcatgggggataagcggtataccattcaacggtataccgttgtgtagtctttctcttttagtaattagggagtcgagatatcccggtattgtggtttagggatacgaattagattaagcctctagttaagggagtcaaagtgaacttactttacggcagaacactttccggccgagatagcccagtaaggcccatgggccttgtcgtgccggcccagcccggtctatcggttgcaacatgcaaacgttgcgcagcttagccttagcccaacgatgacgacgagatatcagacgtgtacgtgtgtacaaaagcacagcaacaatggcggcgaggtgacgtcactgctcattaaaccaaccaagaccaagtgtatataatgtaagtatgccactgtctcgcgtcgtcactgagctgtggcgttgcgagtga

SEQ ID NO: 5859 - DNA, 1073 bp, Oryza sativa
  unsure (1)..(1073): unsure at all n locations
gatacaaataaaacgtctagattcccattataaaaccgagttctccgtgatttagcactataagattacaaaatatctataatatattaattttgcattctccgcctatattgatctatagtaaaatctaatattttaaatttcataacttccataatctccctctaattccattttatnatttattccctnttcttttcctctcctctttctttcttttcttttcccgtcttcctttctctccctttttcttttctttttttctctcctttttctctctttcttcttttctttttttctctccctcccggcttcttctcccttctctctctcttggctctctggcgacggcgaccgagcaaggggaggaggcggcggcttaccgacgacggcggcggcggtgacgacggcgcgatgacggcgcacggcgcggcggcatgaaggcggcggtgcggcggcgcgagggcggcgcgacgacggcgcacggcgcggtggcacgaaggcggtggtgcagcggcgcgagggcggcggcgcgacggcacgaaggcggtggcacggtggagagggaagaggggagaaagagggagatggagtgggagaaatggagagggggtgtggagtatttataggggagagggggaagaaagagagggggaggggtggccggcctgacgtaacgacggcgtggggctcggggcggcgacgcgacggcggcgcgggctcggggcggcaacgcaactgcggtgacgcgacgggcggcgacgtgatggcggcgcggggctcggggtggcgcgcggggctcggcgcgtagtgatgggatggcgcggcgcggcgcggggctcggcgcgcggcgatgggatggcgacggcaacagcggcgcgggctcgaggcggcgatggaatgcgcgcggcgacgggacgggcggtgacggggcgcgtgggcgagcggggcggcaggatggcggcgcggcgcggcagcggcgaagcgacggcgcgtggcggctcggggcgcgaggcgcgcgcggcaggggacatgggacgggcacgcggcgacggaacggcagcgcgcggcga

SEQ ID NO: 5860 - DNA, 1501 bp, Oryza sativa
tcccaaccataaaattagggatggtttcatcacatcccatctagtcccagaaccaaacacacggtagaatcgcactgaaaaatgctaaaaacagaagacctacatgccaactggtggttcatattaaatgcatgcacaactaaaataaacaggtagaaactgatcttttcaagtgcaacatgcagatgccctacctccatcgtactacctccatccagattgaagttttgtactgtttatatctaacgtttaaccattagtcttatttgaaacattttatgattaaggcctaaggggcggcggcgaggtggcgctctccaggtgcgacgtgcaatggcggcgctggggaaaacggccagcttggcggtgccctgtttggagatgtgagagggaaaagtgatgtttctctaagctctaaaaggtggtggtttggttgatggaagagaggtgcctgacatgtggggccctgcttgccacgtcaatagaaaccgcttttaaaaccaccgaaggagtcaatttacactggtttttaaaaatgggggaggcgttatatctgattctgtgattgagggagaatttaatcacaagcaatagttaagggaggcaaaatggacttattcctacaataagtaatgtataagtggcattttaaaattgttatatcatatttgtatttaggtgaaggagatatgtggagagagaagaaaagcaaattatagatctgtagttaggtacaacatgacatccaagagatcgacactatgtgtgtgtgagaattgagatatgccaggtagtaattgaccatactttttaattcgctataatcatcatctttgcctgcccatgttttggcgaatttggcttctcatacccattaattcctacttaataccacaaagggggcggggattctggagtatcttgttatatttttcagaccatcatatagaagacacgcaccatgctttgtgacatttcttataataatagtcaagttgttgaagtagaataacgccgccacacattaagcatgtgatgtgcaacccacggtagcacccggaaacacgccgccatagggagtgggtagatgccgcctaacgaacacccgggagggaccccatcaaggtgaacgagcgtcggtttattctagactcggcaggctagctaggtgttgacgaccaaatttggtaagatgtgaaccaggttcgacattgggatcgaagcggattcgataaagagatcgattcgaagaacagagcgtgaatcggctgcgaaggcatcggctggagtctacatcggctgagatggatcggacagaggatagccgatacagccgatggaggtgatgcagctgattccgatgaagacggtttcgaagctgtttccagaatcgttcaaagtgcttcatgaggattgccatgatggagataaagctctcggataaggcaattgtatctattagttaggatatttcatgtaatttccttagagatatgtttgg

SEQ ID NO: 5861 - DNA, 1501 bp, Oryza sativa
cagccctgtcacgctcttgttctctccctagaatcctgtgggctcggtctatacactactagctactcgttcaggaaatctcaaagcaactggtgcattcaggttattccggtttaccttaggcattcctcctcccatgaacacaaagcatccttatctaaaaagattaacagtgttgatcgtgcattgttttttcctatcataattgatggtaaatcccatgtttatttagtactcactcagtaaaactaaaatcccaatctttcaccgaggtatgactaaatttttcattatttctagggagcttcttttccttaaaataaatcaaatttataaattttgatcaaaggtagtcaaattagataaacttacatgatattctctacttcccatatttcaaaaatagcgacttagtatgagatggaacacatcctaatattaggtatttggacatgggacctatccaaactcgtaatattagaatttgtcacatctcatagtaggttattgtatttttatgatagagttagtatttttttagaaattagttttcaaaatttccttttattatatatttatagtttaattataattatgacataatatagtttaggaaaaattccaaatactccctaattttgattgaaagtcctcaactttaaaaccggatatttaatcccctcccacctcaccaaaactttataataccattatatataatctcctaatgtggttttgcaatgtggtttttaatctaatatgtatatacgttgaatgagtttgactacgtggcatacacattggatatatgtgttaaaatctccacccaaatctttattttttttcctccttgtttgttctgacttacataatattactatgatatcactatcgagtataaattgagaaccgagtattaatgatatataaatatattatattaattattcaaaatcactcatttatgcttttaaattcacaaaaccaccatccgaaaacaccttaggtcttgttcggtttagagagtattaaagaatattggaggggattgatgaggaataattctacaccacaatacatgtggaataaatccccttcaatctctccctcgcagggattaaccgaacaaggcattagaggacaatataaatgatattgcaaagtttagggggttggatgtataattttaaagttaagaatgctagatgaatttcctaccaaagtttagtggggtatatagactctttaatatagtttatccatcgtaagttcgtaccgacagtgaaggcacatatttggtcggtacaatttaaggaaatagttttttccgccatgtggttggcaagaaatatttgctgacaaaataatatgtactactattgatatggacatttgccacactaaataataaacacactccaataattccacatcttggtctatagaccaggcctaactaactcaaacccgtctctgctccccgctatttacacttcgcaat

SEQ ID NO: 5862 - DNA, 1229 bp, Oryza sativa
aagcaatagttttatcattttgcctataactaattataaaccataacacttaattagtagcgattaaaatataatttataaataacaatttatatatctccttaatgatttaaaagaaaattctagaaaaattaactctaaatttaagttttaaaatataaattctgacatcagcttataagctgaaaaataaagtacggtcgtcacatttttccgatccattgaatcggtagaaggtccttgtacaatctgtaccggttgttcattgcgtgatcggtactttgctgatgaaatctccgcatagaaatggataacagacagatgatccataatttcctcatgacacaagcaggttaacacatgtgtcacaacgggatcagctcgcataagagcaggtacaatagtaggctacaagtcagctataaacatattttaaagagataaaaaaaaagagaagagcagcgggctatagatctgtagtcagctacaatacagactataagacgtaatgtgtatatgatagatgggagtatatattagaccaagtttaatagtatagccaactactagcttcaattcatctatagccaatctaatagctgattcatacaatagttacatactccctccattccataatataaggcacaaccactttttttagatgttacataatataaggcatacatgcatacatgtcattaactatgacaattctccattaaattactacttttttaaatccttcaccctcatattctctaactctattggctacatgcattatatttattaggatgatccaaactacaaggtgataataactatttcttggtctttgggttaagagtggttgtaccttatattttggaatggagggagtactatattattaatagctggtcccacctgtcatagacacactgtgtcttggagtccgtgctacagctggctacaaatctgtagcccgctgctcttctctctcctcatttatctctttaaaatatgtttgcagctggcttatagccttctattgtacctgcttaatactatagtaaacaactattgtatgaattgattattacattggctatagatgatttggaactagtagtgaactatactacttgctctaatttagtaactcaaagaaccagcattacccacaaaattagcacatggagcaagtagtattagcttgtaccactagtacacccctactgcacagg

SEQ ID NO: 5863 - DNA, 1501 bp, Oryza sativa
gaagaaagagggcagtgggctatagatttgtagccagctgtagcatggatttcaagacatagtgtgtgtatgacaggtgggactagatattaatagtgtagtatgtaactattgtatgaatgagctattagattggctatagataaattggagctagtagttggctatactattgaacttgctctaaaatcatgctatataagagtaggacacactacttctattgaaggttacttcttaatccccccgtttcataatataagcatttttagagttggacacggttattaagaaagttggtaggattaaatgtgtgagtatagtattggaggataagtagagataggtggaaaattaaatagtgtagggttataattggttgaaaagagaatattagtggagaagttatattttatgataaattttaaaagctataagttgttatattttaggacggagtaagtaaatattacgaaatctgaggatactttgcgaagataagcccatcccagcccacaaacacaagcgctgttttcctctcctacccttttctttattttattcggcccactccccctcctttttctcgtctcctccgccccagcgcccggcgcctccccttctcttcaccgccggtcgtcggcgctgccgactgcgccccacgcgccacgacgactcagccccaccgcgccgcctccgactccaccccatcgcgccaccgccgactccgcaccaccgcgccgccgactccgccccaccacccgtcgcctccgctcttcgccgcgccagatccggtgggccgcgccgtcgactcctccccacggcgccgccgacgactccgcccctctccctccgcccttcgccgcctctctctccctccgcacggcgagaggtgcgcgcgagccgagccggagggggaggggagggggggagggagcggcggatgccatgggcagcggcgcgtcacggctgctgaccgcgtgcacgtgctcgcggccggcgccggcgtccgtggacgcggagccgtgcctggacgacgctctcggccactccttttgctacgccgccgccgccacggccaccgcccactcctcgtcgttccgccacggcatctccggcgccgcgctctccgccaactcgtcggtgcccgtcccgctctacaacgcgtccgccgccgccggcggcgtggcgccggggtactcctcggcattccacacctcgtcgtccttttcctccgcgccgctgcagctgtccaacctctcctcgggcccgctgttcctctcgggtcccatcgaccgcgccggccagctctccggcccgctcgaccccgccgtgcccttctctggcccgctccccgcaaagcctcccaagcccgcgtcctcctcatcgagggggttctcgaggaggttccggaagccgtccttcggcagcctgcggcggagcgtgtcggagaagaaccgcccgtgcgccgtgccgctccgccgcgacgacggcgtgcagt

SEQ ID NO: 5864 - DNA, 1501 bp, Oryza sativa
gtcttcgacttcctcccatccacgccagagaccttgggagccaccgtcgtcgacgccaccgtctttgacctcctcccatccacgatgggaggcctcgggagccagcaccgtcgctcgtcgacctcctcccatcctcggcgggagggcacaggagcccgctgttgtcatcttcaacctcctcccatctgcattgggggggggggggctcaggatccactgacctcctcccatcgacagcaatttgccgttgcaccggccatgcgcgccgcaccattagcctccctcgttggtgccctcctcaccggcagccacatttgaaaacaagatgagagatgggaaagaaagaagagggaggatgaaggaagaagatggaactgacatgtgggtcctacgtttaggggtattttggtcaatatgatgacaaaaaaagtggtgatgatggcataattttaattttgtgcatattcggatggcacgactacgaatagatgaattacagtgacatttaactaaatcggtatatttgcaatgacatagttccaattaaacctattattaataactagaaaataatcatcatatgaaactactttcaaatacggatataataatatcacacgtatagcactaatcacatatagtgttactttaatttattagttacagattgtaaaagttgattttaggacggagatggaggggagtatatactgatttattttgatcgcaaattacgtcttgccttcagctatgccactgcagctagcccacggtatcggacggatccggtaaggttgccttgcctctcctcagcaccgacctggcggcccatttgttgccattgactagcgttcacccggccctggatccccctctcccatctcccatctcaccacctcggccgccgccgccgccgccgccgccgccatcgccgcagcgatctgtcacaatcaccaccgccaccggcaatgcccaccgcgtcataggtcgaggcgcgccatgcccccgccgaccccgctggcccgcctcctcgcggccatctccgccgccgcctcctcgcccgccgacctccgccgcctctcccaccgcgtcctgtccccctccgcgcctcttccccctctccgctgcctcaacaccctcctcatggccctcgcacgccaccgtatgttcccggacatggagtccctcgcctcccgcatgcccgcccgcaacctccgcacgtacaccaccctcatcaacgcctactgcctcgccggcgacatccccgccgcgaagcagcatctcacctccctcctccacgcgggactcgcgccggactcgtacgcgtacacctctttcgtccttggatattgccgcgcagggatgctgacgcacgcctgccgggtgttcgtgctaatgccgctccggggatgcctgcggacagcgttcacgtacacggcgctgctccatgggctgcttggcgcagggatggttcgtgaggctatggcagtgttcgttggga

SEQ ID NO: 5865 - DNA, 1501 bp, Oryza sativa
gttgagtctagagtggagttgtgtagctgtctaaggccccgtttggtagggctccaaactccaactcctaactctaaactccaactccagtgagagctagctccggttgaagttgaaaactcgttaaaagtgtttggctatactttcagttctagatctgaaaaaaaaaatgaaaaaatgaaaaaaaacgaaaccaatcggccccagccgcgccgccggccgccggccacgcgcgccgcccgtcctcgtcccgcagcccccggccgccgcagcccttcgccgccgccggcctccgcccgcgcgtcgtcgtcacgccccgtcgccgtggccccctaccgccgacgctaccgtagcccgccgccgccggcctccacccgctcgtcatcgtcacgctgcgccgcctgtcgccgcctgtcgtcatcccgccgctgccgcagcccgccaccgccgccggcgcccgctcgggattgggaggggaggagagagaacgggaggaaaggaggattgtaggggtagttgagtggcattttcgtgtagatactctaaaaaattagagggtagtgggtcttttgggatagagtggagctgtggagcagcaaaaacccagctccaccccgtagttcattttttaggagtagctctgccaactccactccaaaaaaaggtggatctggatcgtttggcacaactccggctcctgataagttggagtgggagctagagctatgccaaacggggcctaaacccagctccacaactctagtacattttgtgagagagcttcacccaactccactctcaattttggtggagctgaaactgtttggctgaactccagctctaggaggggtggagttagagctggagctgtgccaaacaggcccaaagtaacagtgccaccgtgaaggaacagcagtgaattgtaaatagtagaaacaaaacagtactaggcagggaaaatgaagtattattagcactagtatgcgtatcaatcaacagtcggcaatgcacagaagcattgatcagtcactcttgcagaagaaaaaacatgagtggtcagtaacagtcgcgttctcttgttacattggccagaaaaatgtgaaacgatgaaacacaggcgtacatgatagaacaatactgcatctgtaggcgacctcttattctttagtatcgtgtcactatccccccgtgcatgtcctatcatcaacggagacttgtcgtgctaaaccaactcgtcccaatgcaactcatcccctcgaagagtctgcagtctccgtctcaagaaccacgacagcctgccatgcatctatcgagcgcgagcagacggccgattcatcctgacgcttacaccgttgccgccatctgcctgccggccacgccatcctcctcctccccgtcgctccggtcgacgtccaccgtgccactcctgtaccggctcgcgcacacgaggtacacggcgaagtccgcgacggccagcacggcgagcaggaagaagaacttg

SEQ ID NO: 5866 - DNA, 1342 bp, Oryza sativa
cccttgcattggttttaatagttatgggtcaagatatctgatatagtagttaagagatacaaattagatcggaccttcaatcatcaaacccaactaatgaaggaaacggtccatttcgcatccctaatttgagtttgcatcactcaactataaaattaggtaagagtatcctctaacttttaaaatcactgcaaatcgagtccctcgactaatttgaaagtggtttttgacctatgtaacctctacttggcacgttggcatagtcttaatctaacatggcacttgtggtaatcacgaaactagaaaaaaatttaaaaaattttaaaaataaggagacccaatgtgagtcgtagttgtgccataatttttctaatgaaagatgtaggactcatatgtttcacatggaaaaaaaatataagagtaaatttcacaaagctataaatactttgattaaattatcataaaactacatatttaaagtgatgtatcacaaaactacagatctaacaataaatttatgacaaacctactggtttaaggctaagtataaaaaagatatagatttgctgatgaaattatcgtaaactacagattttggggtttaaatcctcagcactaatgctatgtttgagttatataagtccaacttctgttattaaattgatatcaaatctatagttttgtgatacttagtcttaaacatgtagttatgtgataaatttagtgctaaatctatagttttgtgatatatcatgttaaacctgcagtactgtgataatttactcaaaataaaaaaaacatctatacaattaccacttacatgtggatacgagtcctattatatattttttccttggctgtaattacatgtaagcattacgtcggataaggactaagttaatctgtcatgtagccgtaggatgaaagcgccgtgtaaactaccgagggacttgatttacattagttttgataatcggtaacgctctatagccggttttgcgctaatggacacgaatgaagctcaatgcatagccaagataattagggtgtgtttgcataggctggtttccaacccggaacagtaacacggaaaactgagcagtcaattagcacgtgattaattaagtatttgttttttttaaaaaatggattaatatgactttttaagcaacttttgtatagaaactttttgcaaaaaatacaccatttaatagtttgaaaagcgtgcgcgcagaaaacgagagagatgggttgggaaaaaggggtgctgaacacacccttaaagtgtactcttcacagaaataataaacttcaactcaaatttggcccagcaatccaaata

SEQ ID NO: 5867 - DNA, 1501 bp, Oryza sativa
ttggtttagcacgacaagtctccgttgatgataggacatgcacggggggatagtgacacgatactaaagaataagaggtcgcctacagatgcagtattgttctatcatgtacgcctgtgtttcatcgtttcacatttttctggccaatgtaacaagagaacgcgactgttactgaccactcatgttttttcttctgcaagagtgactgatcaatgcttctgtgcattgccgactgttgattgatacgcatactagtgctaataatacttcattttccctgcctagtactgttttgtttctactatttacaattcactgctgttccttcacggtggcactgttactttgggcctgtttggcacagctccagctctaactccacccctcctagagctggagttcagccaaacagtttcagctccaccaaaattgagagtggagttgggtgaagctctctcacaaaatgtactagagttgtggagctgggtttaggccccgtttggcatagctctagctcccactccaacttatcaggagccggagttgtgccaaacgatccagatccacctttttttggagtggagttggcagagctactcctaaaaaatgaactacggggtggagctgggtttttgctgctccacagctccactctatcccaaaagacccactaccctctaattttttagagtatctacacgaaaatgccactcaactacccctacaatcctcctttcctcccgttctctctcctcccctcccaatcccgagcgggcgccggcggcggtggcgggctgcggcagcggcgggatgacgacaggcggcgacaggcggcgcagcgtgacgatgacgagcgggtggaggccggcggcggcgggctacggtagcgtcggcggtagggggccacggcgacggggcgtgacgacgacgcgcgggcggaggccggcggcggcgaagggctgcggcggccgggggctgcgggacgaggacgggcggcgcgcgtggccggcggccggcggcgcggctggggccgattggtttcgttttttttcattttttcattttttttttcagatctagaactgaaagtatagccaaacacttttaacgagttttcaacttcaaccggagctagctctcactggagttggagtttagagttaggagttggagtttggagccctaccaaacggggccttagacagctacacaactccactctagactcaactcctggagttatatttaggagttggaactgtacgaaataggccctttgttagcagcaaggcggtgaacagctgaaataaagttaagtggtagaaaaataaggtgtgtgcgcccacttgggtttgtgggggcgtaaatgtggtatgtggattcacatccaacttgtagccgaaaaccatgaaatcgttatttttcagtagcagacgagttatctatttggctgcctagcactcaccatatttggattgctgggccaaatttgagttgaagt

SEQ ID NO: 5868 - DNA, 1501 bp, Oryza sativa
catggaatttagttggcatggtaattatatatttagtggttgtagctaacttaactttgtagtagtataatccagtgaaaaaagttagccacatatccatagtcacattgaacaaagtttttaaattcttttcattatttttgtatggtatatggaagggtaaattggacatttcaccatatattttgcatgagaggatattcacgtggcaatttaagtgggcccaaggactatattagcccacgtgacaaattataaggctcgtttggacaatataaaagattagggaccaaattgatctcggagcaaaacttcaaggagtatatgcacgaccctaaactccatatatcagtattcgtcgccacctttagggtttaggttttgcttagattaatatgtcaagaatagtttcgccgatccttcggtttgtaagtccccaacttgtgagcttaatcattcatctgcaactttggttgcattctttatcgctcttgtttgtgttcttcgatttgcaagcagggattaaccttttcggcgaggtcagccaggtttcgacacagttgataaccagaggagacgtggtgttgcgattgcggggctcaatagcgtgtttgttcagaagccagatcgacttgtgttgcgacttcaccaaatcaactgtttatcagaacctttcagaagatcagaaacccttgtcgacatcatccacatcctcgagctagcccggatagcggcctcaatgaaccacaccccaccaccaccaccaccgcaatccaccaacagctcgccggaatccatggagactgcaagcctcccggccgtcttcgccacgcgttgcgcctccagcatgctctcggtgtgttcctaacttagggccatcaccacggcttcgccaccctgtcctagaactcggggaggaggccgtcgatgaacgtagacttgaggaacaagtcagggacgtccgcgcagctgccgccagggaactgtcgaggacgtccgtgtcgcatgcagcctccattgcgccgccccgtcgctagctacctgggaaagctccgcccgcctccgtcgccggctgcctgagcgcgcgcgcaagaaaaagaagtagtggactggggaggtgttgggctgagggagatggatgacagctaggcctagggaggtttttaaatttttttctgactgaactgccatgttgggagtattagtccggtataaatagttgcgggtgtaaaatatctggtatatgaatttaaaggggtaattctgttgaccgtgatagtttaaggggtaattcgtattttttcttttttttaagcattattaagaacaaacccgcgggtatactagcttcttgcgttataaattcgtatctccttcggttttctttcattaacaccatcaaaatcaaatgtggcatcacacgtggggcccaaattaaaatgggaagacaaaataagttcaactaaaaccacataacctcgagtccgtgcaactactatat

SEQ ID NO: 5869 - DNA, 1501 bp, Oryza sativa
ccagttgttccgtcgaaaccgtgctgagaggctggagtatgatgccgacttctctggtgctaagctggatcggggtagaggccggatcccgcctagatctacggggagaagatgcccttgtggtgaagacagcagccaaatcatcggggagtttcatcaggattggcggataggccccatcgtcttgatcgagtcgtgttggagtagattggatctcgttcgagtggtttgaagccgactcggtggagacgatcttggggtagatcttggccgagtttgggataccgaacggggcggagatctggcttcttcccgactggttcgaatccgagtcgaggagagaaatcttgacgaggtcgttggtgatgaagtcgaggctgccgaaccggaacgcctgcctaggagggaagacgaagtcgtcgatgtcggaaacgaaacccatcgcattagtcggcgaagtacttgacactacccctacttggcgcgccaactgtcaaaacaagatttcgacaatactaaagggggtggctatcaaactggaaaagtggatggtttaagagacaaggaattttatacaggttcaggcctttttaatcaagaagtagtaccctactcatgtccggggattgatctgccgagtatattattgatcgtatgatctgggtgaaaaaacgtgcccctagaggcacctggaccctttcttatatagaagaaggggtccgtattacaaaatacagtccatatccctaacggaataggtagttacaaataaaatacaatcgtaaccgactaggatcttgggtattaccttgacatacaagtttagaatttaacccaagtcattttaaagatattctatctatatatagcactccatacccagtcaaactatacatgccgtgtatgtatggggtatccatgatctccacaattcatttgtcaagtaagtacttcaatagtacaattctgatagtgcgagcatagtcgtgaaatacgacattcacaaaaccgatgataactgctcgaaaaccacaggtatcatcagctttattgctccggctcaagctaaaagttcactaaaatccggtcaagtatataaaaactcaagctaaaacttaaattttgcattaaactgtcatctccgagctgttaacatcaaaaccgacaaatccaaatcctcgaatccttatgggaagcccatttcaactcaccttaaacagtcaatgggcccagccatctatcataaagcccaacaaggcccatgaaagcccatctcaactcagcctagggtttttttccactccgcggcgtctcgctgtctctctctcctctatatataagcctccgccgccgcctcctcacctcttccccttcctagcaccgccgccgccgccgccgccgccgccgcccgccgcgccgcctccgtcgccatgggtaagctacaacattccgttcttctctcctcccgctcgcctgcggatctaaccgtgcgtgtgtggtg

SEQ ID NO: 5870 - DNA, 1501 bp, Oryza sativa
aacctagtatggtcgcatccccaccagtgatgcaaaccatacccctacacacaagcaaacaacacacgatctagaagctaacgaaactactcttctgggacagattgggtttaggtcatctccgggaaaactccacttgatcttcgcggaacgacgactctgggctgaacttcttgctcctgctgcacgaagcttgaggcttgaattgacttccgaacagacatgaagctgacggctggtcctctaggtatgtcaactaaaagaattggagagactgggaggagaattttgaaaaaccgtttgacaaagaaatgccgaagggcgagaggagacaatttgcaaatagggtttttagaaaacttgtccttagggtttgaccatttggctcaacctacagtcgagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaaatacttacagaagaggcacttagtcctcacaccgaaacaaaagcagcagcagcggaaaaaaaaaacgatcctagcggggcttcagctccactccacaggcaaaactcaactggggtctgagccttggtcttccaactccatcttcagctcagaagcactacacttctgaaaagggggaataatagcaagactgagtacaaccaccgtactcagcaagccacaccaacgatgcggacgtgcaaagggatacaaggacggtttgtggctatttgcataaaggcagttgtaaaacattttatttagcaaacagtaaaactgttgagtaattaaagtaacattaaatctccactgatcaacgctacaccacgttgaacaggcccaaccaacccacctggactacagtgcattgggtcgatttattaggtgtgagactaatcacggtgaatctggtcgatcgcccataaccgcgggcacggctattcgaatagttttactctggccagaggtgcacagctgtacccacaagacacaacccaccgacatgtcaccgcgtcatcatgtgctcatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccctggccgacccaactccatcacgcccaccctcgccaccggtgcctaggaaagggtcgagctatacttcagatcaagcagttacccactcccgcttgtggtaagcactgtaagtcttccagggtttcccgtgaaccggtccttaattgccatgggtgcgactcgcaaaaccatgcacccacagcccaccattcagtcgcattttagttggataattacgaccataaaaca

SEQ ID NO: 5871 - DNA, 1501 bp, Oryza sativa
ctatcagcatgagttttagatatcagtagtaggtgtgcacggttttatgaaatcttatacctggtgcttggtgaggcggcggcggatggcgcgggtcttcttggggcggaggtcgagggggaggaggctcttcttcttgtacgcctcacgcagcgccgccctctgcttctgcgagatcaccgtcagcacccgcgcgatcgacgtgcgcaccaccttgctgcaaaaccacagagattcaatcaatcacaagggcacacagaaagaggagagaatgagcgcgagcgcgagcgcgaagcgcgtacatcttggagagcttgttgggggcgccgccggtgaccttggcgacgcggaggagggagagctccgccttgaggtccttgagctgggcctgcagctccgccttgttcttcccccgtagctcgtcgaccttgatccgggctgcaccacacacgcacggttagatccgcaggcgagcgggaggagagaagaacggaatgttgtagcttacccatggcgacggaggcggcgcggcgggcggcggcggcggcggcggcggcggcggtgctaggaaggggaagaggtgaggaggcggcggcggaggcttatatatagaggagagagagacagcgagacgccgcggagtggaaaaaaaccctaggctgagttgagatgggctttcatgggccttgttgggctttatgatagatggctgggcccattgactgtttaaggtgagttgaaatgggcttcccataaggattcgaggatttggatttgtcggttttgatgttaacagctcggagatgacagtttaatgcaaaatttaagttttagcttgagtttttatatacttgaccggattttagtgaacttttagcttgagccggagcaataaagctgatgatacctgtggttttcgagcagttatcatcggttttgtgaatgtcgtatttcacgactatgctcgcactatcagaattgtactattgaagtacttacttgacaaatgaattgtggagatcatggataccccatacatacacggcatgtatagtttgactgggtatggagtgctatatatagatagaatatctttaaaatgacttgggttaaattctaaacttgtatgtcaaggtaatacccaagatcctagtcggttacgattgtattttatttgtaactacctattccgttagggatatggactgtattttgtaatacggaccccttcttctatataagaaagggtccaggtgcctctaggggcacgttttttcacccagatcatacgatcaataatatactcggcagatcaatccccggacatgagtagggtactacttcttgattaaaaaggcctgaacctgtataaaattccttgtctcttaaaccatccacttttccagtttgatagccaccccctttagtattgtcgaaatcttgttttgacagttggcgcgccaagtaggggtagtgtcaagtacttcgccgactaatgcga

SEQ ID NO: 5872 - DNA, 1501 bp, Oryza sativa
tgtagttttgtaattgctttgttactagatctgtaattttacgatactctaccataaatttgtatatgtaattttgtgatgtatcactttaaatctatagttttgcaatagtttggttaaaatatatgaagttttgtgaaatttgctcaaagtaacattttgaatactgtgttaaaatataaaaataattaggatgttgggtgtacgtgatttaaaccttgaccggtataatcaccctgccacttctgtaacattttcttcaccacttgtttgagactgtcgatagacaagaaacactactacaaaacattaaataggtgtcgccactataggtgtcgatagtgttaaaaccggcatataggcattttcctacctccgcgggttgaaatcgcaaaaaaactgacacctttaagcaattataataaaaaccgacacctattatatattgtgtcggttttttaaaaaaatcagcacctataatatgttataggtgtcggttaattaaaaaaccgacacccaaatcgagccgaggtggctggggtggcaacggcgggcggagccgcatctgggatcggcatcggcgggcggagcagtggcggcggtggctcccgcgacggatccggcgacgtggcggcaacggtgattgtttctatgaaattgttgagggatctgtgatttgctttggatctctcggggtgacgggtctcggggtgaaggggaacgactcaatgttcgagccgatgcattgagcccttttttttttttggattcttgggacctaaaccggcatctttgagtattcacatcagtgccgcctcttttgtgccggttcctgtgtggggttcccaactggcattgatgtggtgttatgtagtagtgaaaagatcctcggtttttgcgtgtacattttttaacgattaaatagtatttttttaaatatatatatatatatatatatatatatatatataaaagagttactttaaaaccatattaattattttaaatttaaaataattaacagttaattaatcatgtgctaataaatcatattgttttcagtaccttctctacatttctcttttcctcctcttaaaacacacctacctgtgactcctctcgtttttcaatcattttgaaacttgcgtagtaggatgtactggtagctgcagattggattgagatcgaatgcaatcacaagaccgtaagttaatcactgcatgtgatctcatccattcattttcctaggtgtagattaagtgttatagcggcatagcgccatctcccatagtagatgcctggtgtttttttttttcatgaacagtgcttaaacgatctcaatcgtttcagtagtctcaatgtgactgtgtcagtagtctcaacgtgactgtttaaattgtagtagtcacactaaagactccaccagaacctgatccctgcagatttgcatttgccaatcgattccacatatatactctcgccgggttgataatacttgtcg

SEQ ID NO: 5873 - DNA, 1501 bp, Oryza sativa
acagaagtggcagggtgattataccggtcaaggtttaaatcacgtacacccaacatcctaattatttttatattttaacacagtattcaaaatgttactttgagcaaatttcacaaaacttcatatattttaaccaaactattgcaaaactatagatttaaagtgatacatcacaaaattacatatacaaatttatggtagagtatcgtaaaattacagatctagtaacaaagcaattacaaaactacatgtttattatcaactaaatcacaaaacttaaatgtttataactcaaacataatattaatattagtgctaaggatttaaacatactagtacgaagatagatagatagtacgtataagagtatagtgtacattatgctgcatgtttcatgcaattgaaagaagagatgattgggaaacaccattaatagggtggtaaaattatgagtccacgactccacctactattaggaaacaacttatcaggtttaaatcttggtgtctataaatattatgcacgtgcgagtgcgttttcaatggaaatttagtgaagtcaaaaatttatcgctggtcttcgtctcgttaagagcattgtgtgtgtctgattgcggtgtgcgtgtgtcatccgtgcaatgaaaaaataacaaggaaagagagaagattgggaaaattgacaagtttcaaagttcaaactggcataccgtctacccatgtcccgcctaccgtcttcctccccgtcctcgttgcctccgcccgcccaagcacccatcggccatcgcagccttcaaaacaaacccgcgacggacgacgcccccgcccatggccccacacatctcccaccaaaccacccaccccaacgccacctacaatctagctcctcgctccgatcgaccatccatggggaccatcaccgccgccaaagcagccgcggcggcggccgtcttccagtctccgtgctcccctgcgcctgcggccagcttccccgcccgcagcgtccggccggatcgccgccgcgccgtctcgctctcagtctcaggtaatgaccgttttgatttaacgccttattattattgatgatgaaagcagagaccatatgacccacttgtcgtcgtggcatcaacatgatgggataatggcaaactgtgactcactcaagcagtgctatgactatgtctatgttggcaattctctgaaaatgtaggtgtgttcgtgataattctattaagtttttgtgttgtggaaaacgcaccgattatacggccgttaatacgttgacagtgattagtccgtcacgtttttgcaaaacggtcttcactaatcgtttcacaacgaaaaaaatctcgtcattgccgattaatcttcccgtttgtgtctaatcggccgcataattggcctgatcaaaaggctgaaccaacccacaacgactaccctatcccatttgttgttttctctagtaggagtataaagctagctataccagtacgtgaattcctcta

SEQ ID NO: 5874 - DNA, 1501 bp, Oryza sativa
gggggccaggaggaggcggcggcggcgctgaggttgaagagggcgcggatcctggggatgctgtccccggtctggaagatgacgtcggtggagccgagctcgaggacgccggtggcgagggggaggcagaccatggtgcggaggccgaaggtgtaggcctgcctggcgcggtcacagggggcggaggacaagccggggcgatccagtgggctggcggcgaacagggcctggccggggaggccgacgccgctggggaaggactgggtcatggagacgaggaagaaccactcggtgtcggtgacctcctcctcgacggcctcgtcgggggcggcgcctgcgccggcgatgagggagttgagctcgcggaggacgcgcttgcggtgctcctgctcggcggcggcggcgggggtggaggagcgctgcttgcgcttgtcgtcgtcgcagcccttgtagtagccgtcgccccacccaaggagggaggcgccggtggagacgtcgatggaggactgccagaagatggcgtacgtccacgtctcccgagacccctcgatgatcgactgcagccgctgctgcagcgtgtcctggttgaacgccgccgccgccggagctgctgcaggcggcggcaggacctgctgctgctgctgttggtggtggtggtgaggcggcggcggcggcggcggcggggtggaggccgccccccacgggaaggccgggaggtcggcggaggccatgaacgcctccatcatcgacgcgttgtcgtccgtccaaaggttcatcgatttgatctcgatttcttcttcttctagatttgatttgatttggaagaggactcctacaagagaagaagagaataggaggagaggaaaggtggggatgggtatggggtggaatggatttttggtggtgaggagaggagataacaaaacccacatgggtcccatggctaatcactcaaatcaaatcatatttagtgtccaggggtattttcggtattatcactcctcctatgtctacactcctaattagcgatcattcgcgcgtccgccagccgcaccatcaccgcttcactcatcttcctttttttagccataccatgttaaatcgcccgcaattcctatttttcgctatcaacgtgtggtatgcatgtttccacacaaatcatgcatatgcgcatcattccgtgattagcctccacgatttgtatactgcaaataataaagtacagtatatactaattttcttttcagcctccctgaaataacgagtatttatacataataaagtttataaatagaaagtttgcatgcattttgtatatcgtgaatttatatatagacctttatttaaaaaaacagaaggttttttaaataaattttttttataattatcttaaaaaaatttataaaagattttgacatctttaggatgaatttatctagtataatttatagtaaaaatagttataaaataatgataatctaaaaatatatattaaaaaata

SEQ ID NO: 5875 - DNA, 498 bp, Oryza sativa
taattactctgctttaatagaaatatcattttgagtaattaagatttgcttagtgagaattacttcttggttagttcctaattagcatacgggatcattgttcactatagtccatttatttatagtgattgctttagtgtttgatcggcactagagtagttattaattgcatagacgcgatgtctgggtaattaatcttcagtggttgctgcgtatcccacagtacgtttgaggtgggtgtagaggtggtgacaaccctcaagagcacttaagtcctccttgtccgggtacgtagtagagcgacatctaggaacagcgggttaccagtgcctgaagtattgcattaggattaaagttaagctttccttagacactgtttctcattaggaaatcctctctgccctctgcccacattagctttgtgcccttggatgaacctaacgaggagataatcacacacgttcccttgattcgatacccttggaatactccataagg

SEQ ID NO: 5876 - DNA, 568 bp, Oryza sativa
ttatccgcaaatgtgacaaattcagttaccccctctctatactcggtagacgaatgatgcgcatagtacatccatctacgatccatctgaaatcaacaacatacgaagaaaaatatatgatgatcgatatactgagaaggaatggagaataatgtgttttttaccttgaattttagaaaaaaaaatcaccccccttgccctcccaaccgatttgtgaacagtgaaccgatcgggatggaaagcagttggcggtttggggggtatttatagacccaacacacctcaaacgggttagattaaaaaagcccgtcaaaggtgttggtcatacctttgatgggcttcaattgagttgcccgtcaaaggtattgacctacctgtgacggttatctgtgaccaattcataggcccgtcactggtatgccgtcacagatgtagggttctggcatagtgggcggtgaggaggactggattgtggcgttcgacctcgagccccgacctcgtcggtggcccgccggtgacgacgacgaccagagacgcgcgcctctacgtcaccctggccgcacttagg

SEQ ID NO: 5877 - DNA, 1501 bp, Oryza sativa
ctgccacatggtgcgcccgtgggcaacgcgcgcgtggaccgagtccaccgtgcgccgacctcctttgagccactgacaggtggggcccgcttgtcggcgccacctattcccctcggtgacatcataaaccattttaattgcgcaataaatcggtaataattctataaattcatataaatggctcaaaacttctaaaattcatatctaattcatacgaactccaaattgggccattcaacttgcaaaattcatctaaaattgagctctacatgtttgtttactttttatgtactgttttcttggtttttattaggttttttttcttgttttgcatgccagcgtgtagaatccgtcgtttcggaagatcgcgatcgcgaggaaaagagttcagaagattgttgtgaagaagcaaggaaagtaacacattcctcttgagcatgttgatcccaatttataaatgttttactgtttgcaaataaatatgcatcgttttgctaattacatgggatcagggtttacctatctgcttgcttgtccttcgtcaaccttgggtgataaatcgactagcttgtgttactttgatgacctagctagaactatatgcttagccatgcttaattaccactagctcagttgatgggataattacagtattagacattttggtatcagaacgagctgcgtgctcgagacacccggccatgttttattggccgtaattatccaactaaaatgcgactgaatggtgggctgtgggtgcatggttttgctggtcgcacccatagcaattaaggaccggttcacgggatgcactggaagacatacaatgcttgccacaagcgggaatgggtaactgcctgacttgaagtatagctcttctctggctgacgcatctaagcaatggtgggcgtgatggagcgggatgggccctgcgacggcctttgtcgcttccagattcacctaggcacgagaggggactgctcgctgcctgctgggggcggggtgaaacctaaggtatggtgtgcttggtcagagagggtaatatgaagggtcttgtcacaatcacttgacatggtgacgcctccggccgggcacggtgacatgctgatggattgtgtcttgtaggtacagttgtgcacctctggccagagaaactattcgaatagccgtgcccgcggttatgggcgatcgaccagaatcaccgtgattagtctcacacttaataaatcgactcaatgcactgtagttcatatgggttggttgggcctgttcaacgtgatgtagcattgatcagtggagatttaatgttaccttaattaaccaactgttttactgttttactcaataaaatgttttacaaccgcctttatgcaaatagccacaagccgttcttaaatccacttgcacgtctgcatcattggtgtggtttgctgagtacggtggttgtactcagccttgctattattcccccttttcagaagtgtagtgcttctgagttgaa

SEQ ID NO: 5878 - DNA, 1501 bp, Oryza sativa
actatatgcttagccatgcttaattaccactagctcagttgatgggataattacagtattagacattttggtatcagaacgagctgcgtgctcgagacacccggccatgttttattggccgtaattatccaactaaaatgcgactgaatggtgggctgtgggtgcatggttttgctggtcgcacccatagcaattaaggaccggttcacgggatgcactggaagacatacaatgcttgccacaagcgggaatgggtaactgcctgacttgaagtatagctcttctctggctgacgcatctaagcaatggtgggcgtgatggagcgggatgggccctgcgacggcctttgtcgcttccagattcacctaggcacgagaggggactgctcgctgcctgctgggggcggggtgaaacctaaggtatggtgtgcttggtcagagagggtaatatgaagggtcttgtcacaatcacttgacatggtgacgcctccggccgggcacggtgacatgctgatggattgtgtcttgtaggtacagttgtgcacctctggccagagaaactattcgaatagccgtgcccgcggttatgggcgatcgaccagaatcaccgtgattagtctcacacttaataaatcgactcaatgcactgtagttcatatgggttggttgggcctgttcaacgtgatgtagcattgatcagtggagatttaatgttaccttaattaaccaactgttttactgttttactcaataaaatgttttacaaccgcctttatgcaaatagccacaagccgttcttaaatccacttgcacgtctgcatcattggtgtggtttgctgagtacggtggttgtactcagccttgctattattcccccttttcagaagtgtagtgcttctgagttgaagacagagttagatgaccaaggctcagaccccagttgagttttgcctgtggagtggagctgaagccccactaggatcgtctttttccactgctgctgctttcatttcggtgtaaggattaagtgcctcttctgtaagtatttatgtttagaactgtatattacttaccgttttgtgtaccctggctaattcttggacaggaaaacacaaaatagtctggaaatttgggctaaattttagagtgtgacagggctcacggccgccaccgccgccagcacccatcgccggcgtcctctccatccgccgcttcgagagacttggacttgtcttcactgccgccggagggagtgcgcggctaaaccagagatcccgtcgggccacacgccatctggcctagggccctaggctggcctctacccgttggctactcggctcctgcctcactcgctctctctgcagtctgcctatctgtttctctttcctgtcatcttgcacgtggttagcaaacagaagagagagaagagagaagagagagagagaagatgggtgtagactgtagagggctcgttgaccggcatgcatggagatggagggttc

SEQ ID NO: 5879 - DNA, 407 bp, Oryza sativa
tcgatgattggcttactaacgagaattcactttgaacagaatgagttgtggtagtgactagagagaatagtcaattttgtccctctaagtttcacttaagggctattttgacagttggttataagactttctagcattatccatatttatataaatgttaatgaatctaggcacatatatatctagattcattaacatttatatgaatatggacaatgatagaaagtcttataatatgaaatggagtaagtaacgctttattttgtacagttcagtgcttaaagcttgcattttgggtcaacgtggtaattggatgaacctaatatgctacaatacgaacataactcaagaaaagtttagccttgtgtatcgtgtgtcttgccggcgagcatctttccacatacaga

SEQ ID NO: 5880 - DNA, 1308 bp, Oryza sativa
cgaattccgcggaaacccgaggtttcggcgtggctcgaaagtagaagccgtttggaatttcgatgggtttcatccaaattcaaatttgaattgataaaataggaaaaaatcaaataaaatcctataaatagtatgatatcatagagcctaatgggatataatttttccaaaaaaaggtgtatcccatgtatttcctgaactttacaataggaaagaaaagaataacggtttaaaaaaaaagaaaatttggttatcaatggtaggttatcaaatttaaaggaaatggcatttttacgaattttttcaattatcacgtgtttttcctacattttattgactaaaacaaatttggttttttcattggtttatcgacaaaacatgttcggttttcgccacaaaccgaacggtttttagtttgtctctttctctagttgcctattgaaatttcgatgatttcgctcggaatttcgtcaaaaccgaccggtttttacaaacatatcggtaaactcggaatttgtattcaaattttggtttatgaaatttatttggaatctactggctttccaccggatttcacgaaaaccgtcattccgccggcgcccggaacggaatgccatctcagaatcgtaaaccctatatctcattactcgttatgtacgtgctagactgctagtgcaatgagattcttcagttgatgggattcgccaatcgctaattgtttccacgatctgttcataatgaacctagaacggcttatttaacatatagcgccaatcgctcataattgaaggcaacacatgagcagagaacatagaaatataagaaacaattaaaagtttaaaaccaccatgcagtgtatggttgaattactttatttctttggcaataatgggttcagatggattaccctttcccctatgaatcctcacgcaaaacatgaacactaaaatgttagttctttacttcccgaaaccagcaattctattttttaaaaaaaaaatataggttgccaatcccaaaaagaaacctgctacctccgtttcataatatagcacatattatctagagggagtaattgttttcaaatactcaacgcccaaaccactaactgtcgaaatatcgttaaatagttaagtgaagctgttgatgacaccatatccttctctatctccctataagcaaatctgtccattcaattagtttggatggtactttactagccaaaggtagaggatccatgtccccccaaacccccaaaacaaagcactaagcccttcaaagaaaccaccgtctcactcgagctgaaaa

SEQ ID NO: 5881 - DNA, 971 bp, Oryza sativa
taatgcttgccttcgggcgaccaggcggggggaggaaaaatcggtcgctccccccgcccccgtccccgcgcgcgcgttgatgacgctgacccgaccacaatacctacccccacctgcaacaaatcaatcacatattttggaaaccctctattaaggaaatttggtttatttttttgttccacaaaaaatgtttcacctagtgtactcacgatgtttcactatgtatagatcaaatgttgtagtgaactgaaatattccattgcaacaaaaaaacccacatattttggaaaccccctattaagagaatttgttttattttttgttccaccaaaaaatatttcacctagtgtacttataatgtttcactatgtatagatcaaatgttgcagtgaactgaaacaatctttcgctatttgctgaaacattgttattatataaggtgaaacaacacccgatttaaacgagtgaaacattttcgatatacttagtgaaacaattctgatatacctggtggaacatcgtgcaacatttaaaaataattcaataataagataaaaaaatttcatcggaatatattcatgtgtggtcttgttttgaagatttaattacaacgaatttaatggtgcaatcggatcatgatttggataaataatttaagagaaaaatcagtttaaagtagtttctgcacgtaaatcgctgacgtcagcgcccgatttttctccaaatgatcgggcgcccgagccgtagaggttttcagattatggaagttgaacggagtcaatcggagttacggttggaaagatatggattttcgaagttggaagagtttataaaccgaaggggagctgctttcagagagggctctgggttgcataggggatgtgttgtggactttagtggatgaggtggctaatgatgggctctgtagaagggtattatgtagacttatgtaggttaatcaatctctcggg

SEQ ID NO: 5882 - DNA, 1501 bp, Oryza sativa
aaccaacaacgcctgcacccatgctccaaatccacaagactcaccaccaaaaaccaacaaacacagtgaggaaggctcacaccgaaaaacaacaccaagttcacagaggggaactcactttgtctcccatgcagatagccacaacaccaggaagcctatataaacaccaccacagccatgcacccctccatttcctcctccccctccctgatcgtcgagctctgtcgccaccaccactccattccctcacgcatttgctgcctcctctccatttgccccgccgtggctagcctaggctgagcttcgattgggcaaagggacgggttggccgccgcgcgcattgatcacctgagaacgactaacccctaacatttaacccgctaaccctttcattttcagtttcgctaacctctgactctttctttttgtttcgctaacccctaactcactaacccgccaactcctttactttcgttccgctaacttctaactcgctaacaaactaacctccaacccttatcttgcactaacccgctgacatttatcccctaacactgtgtgttcgcttgttgccgacgatcgaacacgtggtgtgtgcgaggacgaacagcaagcctaggatgatccgtgagccgaccgtcgacgcccgtcgacattgcacggtgtgccgctactcggctaccgcaatgtgagcaactcctccttcccctccttgctctccctcccatcgtcacccttagttttgttgatcgcctcctccttgcgtggccgacacctagccggaccgcgcaccatccctctcccacgcgcctggccgcgccgccgcgtagcctagcctggctaccggctaccgccgcaccgtcgcctgcgccgacacgcccggccgctgccccgccgacgtcttggcctcacccaggacgccgccgagtggccgcgccatatgcgcggcatcgccgtatcacggccacctcgaaccgccatggccaccaccctcgcaccaacaaactgaacaccgtcatcgcgccctccatccccaacccaacctattaactgaacgccgccacccccggtcccaacctccatccccgccagcaagcccctcccctctgcctgccgccggcgtccccattccccatggccgtcgtgccgcccctagcgccgacgagccgacgccccaggccgcctccccctccattaccgccgccaaacacatccaccccgttgccgcaccacccatccccctctcttttttgcgcatgaggagaagccgagggaggaaagtaggaaacagagcgagagaaagagataagacgagagattgagaaggatcgggagaaggagaaagaaaaagaaataaaaggtaggacccaccctttggacttccgttcgtgagccatctctcctccatgaagtctacaacacctccctgactcctccaggacaagcccaaacaccaaggcctctgttgaagtctatgttatcccctagccgagccgagaga

SEQ ID NO: 5883 - DNA, 384 bp, Oryza sativa
cttaacccacacacgtggcgccaataccacagggggtgggggagccccagccctcggggcctaaaggggagcagcccgacccctcgggaatacagagggaggggaggccacgtcaccctggggcccgccccccccccccccgagggggtcaggccacatgggtgaccgcggctgcccaagcctctagtcacgatactctcggtcccatgtcaccgacagtagcccccggcgtcatgccagggcgatcgcccccctcgagggaagcgctcgggcgtgacgccactccttaggcctggtgacaggtggggccggtctctacaggcgggcaggaacccagcggtcgcaaatcgcgcgcatcagcaagggaaaaccgaccgacaataa

SEQ ID NO: 5884 - DNA, 1501 bp, Oryza sativa
aatccaaatatttgtacatatatatatatatatatatatatatatgaagtattaaatgtggacttctaaaaaattccgtcacatcaaatatttggatacatgtatggagcaataaatgtgaagaaaaaaccaattgcacagtttacatgtaaattgtgagacaaatcttttaagcctaatagcgccatgatttaacaatgtggtgctacagtttatattttctaatgacggattaattaggcttaatagattcgtctagcagtttataggcgaaatctataatttattttgctattagtctacgtttaatatttcaaatgtgtgtctatatgcataaaaaattttgacaaggaactaaacacaacctaagaagaaacaacttataattaagggctaattgcaaatttaccactactttcaattgttattacaaaactgccactagagctatcattcgagtggcatcatcgtgctatacgtacgaccccatcgtccgactcctgtccaacctgcctcatcagccaatcactgcattccatataaattccatataagtctgcttctttacgtgtgggtcagttcgagcagcagctgagtgttggtcggacacaagtcgtatgtatagcaatttcccttacagtagtgaaaaaaaccgatggtaaatttgtaaatacccaattaattaatatatataccccgttaatcctctcgcctttccttttcgatttgtgtaccaaagcgacagcgggtacagggtacaggtggtggtgggccgcagactacgagagcgtgccagcgatgcgtgctttgtcggacacgtctggcctggtcccacctatcacgcgtaccaagcgacccaaccgacgatgcggctccggcgcgtaaggccccgcgatccgcctcgcgaacattcgcgacctcatcgcctcgcgaacgcgttgccatgctttagcgtttttctgtttcggaatgcatgtcaagaatttttttcatttctaaatttttattttttaatatttacagaaatattataccatccaaaatatttacagaaatgaccgctagggtgataaggtgtgcgcattttgcacttgggtcctttgccgccctctaataaggctgaagggggtaaatgcaattttcgcgttaccaaagatacattttcctagtttttttttcatcttgtccgtccctcacgttaccctgccactttctcgggagttctataaatattttcgccggtacaatattgtttgtagatattaaaaaaaaattaaaaatgaaaaaaattatgcatgtcaatacacgtaccgaatgtggtgggctagaaatacggcccaacgctacgatttcattttttccatacacgtacaaatgcacgttgttgaggagtgaccctctctagcgggtgatcgagacatccccttttgtgagttcggccggaggaaaggacgcgctgaacgagaccgtgtatccgcctggagttcttcgagaccgtgcg

SEQ ID NO: 5885 - DNA, 396 bp, Oryza sativa
ccgcaatggtgtgagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcat

SEQ ID NO: 5886 - DNA, 215 bp, Oryza sativa
gtagggattattactaattatttccactagtgttggtgaaatatgagtatgcaggtattttaaggagaaaacacaccagtcatataagaaaacatacatccggccaattagacacaagtacacggattgaaggacccacaagtcaagtgaaaccatcatggaatgggtcataactgtcgtaactgccatcaggacccaccactcaatctcctagc

SEQ ID NO: 5887 - DNA, 1063 bp, Oryza sativa
gcgcggtggggttggttggccacatacaggagcagcacacgcaccgcccccgaaatgcatccaaaacatcgaccaatcccaacaaatccgcaacgctcacgcgtgacgcggtggtctcgtcgtcgcccgcgccgctgcgctcgggatactgccgctgcccgctgcctgccattccgatacggcgcgccgggacccccgatgctatatcctcctcctgctctgccctgccgtgcgctgtgctatctgcctagagtatctcttccgcgccctgtctgctgctgcgcacagttcttttcatccttttccaaggcgcgcgcgcggtcacacagagccagccactcggcgaggccgtagccccggaccgagataacggaaatcaatcaaccgctccctcgctcacgggtggcaagagcgcagaggggagagcactgtaaagctgccctgctgctggctgcacacgtaattccatcgcttgaggtgaccaccaacacgagggaaatctgaggttaccacatcggggtcggggctagtctaaccgggctcgaggtggcaggcttgaatggctgacagtgggccatgcttaggtcatgtctttggtccgtacgtaaggcccgaagcccaatatcagcaccccagtggatgctccatcctactccctccgtcccacaaaacctgccgtttcaccgcccctggattgtcccagaaaaaatgtcgtcgagagagaagtggtgggcccctccgtatacgtggaggtgaaccagaaaaaagaagtgcgtttttatttgttgcgctagtactactccgatcttatcctctctctagtcgcccccatccatcgctctccgtcgtcctcaaccagcgccgatccccaatctccatcgcccccaaccatcgccgatccccaatctttccctacctgattcggttcctccgtcacccccaaccctgatcctcactctctcccacctcaatccggttcctatgttgcactcaacttcaatccccaatccctaacctcctcacctcgcctctcccctcaacagtcggcgtgggcgcgtggcaa

SEQ ID NO: 5888 - DNA, 481 bp, Oryza sativa
accctaatccataggttctcgattggagtttgagatgatattgtcaatgccaaagaagaagagaggtcgtcgaatttggagaagaatcaccgtgggaattatgaagcatatctgatggcttaaaatctagcctatttaggatatattttttgtcgacagaaggttaacaattctattttgttcaccttaaaatctagcctatttagaatgtattttttgtcgacagaaggttgccaattcaatttggttaccctaaggggtttttcaattaatctcgaataatggtggtagttaatttaagcctgattgaataatgtaactggtaaaaaagaatggcttaagtacttgccggttaagtttttgaccaggccaaccaatggttggtcaataaaacaaaacgacgttccaactcccccccgatccacctgccccactgcagggtgcaggtcacacccaaacgcctcacgccccgccgccatgc

SEQ ID NO: 5889 - DNA, 1032 bp, Oryza sativa
cttagtaagttgtggctaacaatttgatcacctcaccttaggcaaggtgtggcaacttttgttggcaagtaatggtaaagtgtggctgggaaccaaacagccccagtcatgggcccgttaagttttgtcccccccctttcggagcttttacttaaaaaacctagtagtaagcacaagtttatatatgaacacactcacgcacacacaatctctataaaacagttttttaaactagactgttatattttgagattgataaaatcatcacaatcatatcactgtcgacggtcacgtctactattgaaggaatagttagacgtaaatcatggtacaatgtaattttcattttatactagtcagtataactatatcagtccatctccactgttataatttgatccactgtgatatagtgatttaatgacttaccttttcttttattaatgttagagagtccacagtgaaacgtctaccaacaatcatgataagatcgtacttctgtcctatattacgctattcctccacctaatttctcatattaatcaatcacaatcattatttatttaatttatttatctatttttttcatctcaaatgctatctctgtttcatattataagtatttttaactttttttagtcaaattactttaaatttgacctagtttctacaaaaatatagtgatattttgcacacaaaacaagcatattattagaatatattcaatattggttttcaataaaaataatttgatgttataaatattgctaattttttctataaatttgatcaagctttaaaaaagtttgactagaaaaacagccaaaacgatttataatataaaatagagagagtaatcacaactatttctcatctcaatcttaatctctcgagaaaaataaaagtaacataggcggtagatcatattaaaatatctaccaatcaagtactatatactaatatagtactccctctgtctgggttacggataaggtataccctctacccttggatatacatcatgtatcaata

SEQ ID NO: 5890 - DNA, 495 bp, Oryza sativa
ttgcaggcggcccccttgccgccctgggggagggcgatttttgcctcccccctataaaccccagcccctcccctgtgaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacagtattgtagagaatgtaacttagggcgtagtacagaaatgcgaggttaacgcagttattgttttcatcaggcacaa

SEQ ID NO: 5891 - DNA, 1501 bp, Oryza sativa
ctcatcaactccgacatgtcaaggatgacaccggcaagcctcttggggaagatcaacaccaatgacatgtacaagttgaagaagaaggagatggaggaagcctcaccttctaaaaagggcattgccctccaagccgaagttgaagactagggcaagggcaaggtgaataagccaatgaggacttggaggaagagattgcccttcttgctagatagttcaatgatctcttgggaaggagaaaggagagaggaagaggctccaactccaataggagaagaaatagaagacccaacaagactctctccaacttgaggtgttttgagtgtggtgagaagggacactttgcttcaacactttgcttccaatgcccttccaaggatgatgatggagacaagtcatccaagaagaagagtggaggctacaagctcatgaagaagctcaagaaggaaggcaagaagattgaggctttcatcggggaatgggactcaaatgaggagagcttcgcatcatccgggtccgaggaagaaggtggtgatgatgcaagctccaagaagaagaagatggtcgttgttgccatcaaggaggctccatcactcttcggtccactttgtctcatggcaaaggactcatctaaggtaacatcttttaatgatagtgagagtgatgatgattgtgataatgtttcctatgatgagcttgtgagtatgtttgaggagctccatgcttataatgagaaggagattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatgaagctctcattgatgttggcatatcttgtgatttgcttgatgatagtgctacttgccatattgctcatgttgcatcatctagcatttctacctcttgtgatgatcttgtggatatgtctagctctagctctaactcttgtgtttctatttgtgatgcctcacttgttgttaaaaacaatgagcttaaggagcaagtggctaagctcaataagagcttggagaggtgcttcaagggtaagaacactcttgacaagattttgagtgagcaacggtgcatccttaacaaggagggacttggattcattccaaagaagggtaagaaaccttctcaccgtgccactcgttttgtcaagagtaatggtaagtattgctccaagtgtcgtgaggttgggcatttggtgaatgattgccccggtggtaagcctcctaagacatgcatgtttgattctcattatatgcttaggaaggctcatgatggtagcattgttgatagatatgtgggttcccctatactcggtggtaaaaagaatgccatttgggtgcccaaagctttggtctgtaacctccaatgacccaaacaagtttgggtacctaaaagagcttgatcttcttttgt

SEQ ID NO: 5892 - DNA, 1501 bp, Oryza sativa
acctgcggccggtgacgctgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctggcgcgccagatgacggagctcgtggctcctcaccgggagaccgcgcaggcccccctttgccagttcggccgggggcttagggtgaaatctcaagctctcactctctctgtatgtggtcagattactcgtcggcaagacacacgagacacgacgatgtatacaggttcgggccgccgcgaagcgtaataccctactcctgtgttttggtggatctgtgtatgaacgagctacaaagtgtccgctgacttctcccccgttctcagctttcaatccgggaaaaaaatcccccctctaaatgggcaaggtcctccttttatatctcaaggggataccacatgcacctttctctttccaaactggactgttctttttctctttaatgggcggagatcggtacggtttccatccgaatgacacttcgatgggacagcccacacctacctccactcccggcggagacgggcgcaacgtgggatcgtggctgcccgttgctgacgcgaccagtgtcagactggtcattcttgtccaccatgtgtcagtttaacaagatgcatgtttgcccttcttcgtgtaacaccttgcctgtaatggttaggataaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgaccccccctcgggggaaatcaggaggagggcggacacctcaccctcgggcccgacgtccccgaaggtgccaggccacgcgggcgattgcgtctacctcaagcctctggtcatgatactcccggtcccatatcaccgacaggaacattgagcaaagaacacagacttacggagcaaagcaactacactattgattcaaaccatggtgtttatgcagctgcataggattgccaggtcctaattggctgattctgccactaactagaaatactatacttatattagaactcacgttagatagatagagt

SEQ ID NO: 5893 - DNA, 1501 bp, Oryza sativa
agtttgtgtgtgtaagaaaattcgatacgacagaaaagtttaaaatttgaagaaaaaaaagttagaatctaaacaaggccaataagaagatggtactcggatctaaatgggggagttcacaactatgggggtgtttaggagagaggggctaaaccccctatatatgctctactctatctatctaacgtgagttctaatataagtatagtatttctagttagtggcagaatcagccaattaggacctggcaatcctatgcagctgcataaacaccatggtttgaatcaatagtgtagttgctttgctccgtaagtctgtgttctttgctcaatgttcctgtcggtgatatgggaccgggagtatcatgaccagaggcttgaggtagacgcaatcgcccgcgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggttagatttataccaggctttatcctaaccattacaggcaaggtgttacacgaagaagggcaaacatgcatcttgttaaactgacacatggtggacaagaatgaccagtctgacactggtcgcgtcagcaacgggcagccacgatcccacgttgcgcccgtctccgccgggagtggaggtaggtgtgggctgtcccatcgaagtgtcattcggatggaaaccgtaccgatctccgcccattaaagagaaaaagaacagtccagtttggaaagagaaaggtgcatgtggtatccccttgagatataaaaggaggaccttgcccatttagaggggggatttttttcccggattgaaagctgagaacgggggagaagtcagcggacactttgtagctcgttcatacacagatccaccaaaacacaggagtagggtattacgcttcgcggcggcccgaacctgtatacatcgtcgtgtctcgtgtgtcttgccgacgagtaatctgaccacatacagagagagtgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaa

SEQ ID NO: 5894 - DNA, 1501 bp, Oryza sativa
tgaaaagacatatccgtcatccggtgaaaaaaaagtgagaaaaaattaaaaaaatagaaaataaaacttctattgtaaaaaaaacgtccgactccgactcctccggtggaaaaaaaaaagagagacgacgggaaaaaaatcaagaaaaaacaaagaaaggagaaaaaacaacttctacccaaaaaaaaaaacgactgactcctccggtggaaaaaaaacagaaaaaaataagagaaaaaaaaacttctacgtaaaaaaaacgtccgactccataaaaaaagtccgactatctgcggagaaaaaaaggcaagaaaaaataaaaaaagagaaaaaaaacttctaccgtataaaaaaaaataaaaacgtccaattccttaaaaaagtacgattccctcaaaaaaaggactttttgtccgtaatcttctcttctacttctactatttttttaaaaaaaatctctactattataaaaaatttaagatatttttgccggtacgtcatccgtgtatgagtcggtttataaatttgttcgcttttgaaaaaatatatatcctttgagttggttttaagttcgtccgcttttggaaatataggagtcgtataagaaaattcgcatgctaactttagacgaacagactcctaaccacagcttatgattttctagaaatatatagatccaagcaaattctcacagtgatgaatcatcataactaagccatataacaataataagactaaaatagttgtcacccgttgtagcgcatgggcttttctcttgaaaataaaaaataaaaatattaaaagaacacaatacgatattaattaaaattgaaaaaaaaattctgaaattacaaaacgaaaaataagatttcaatttggaatacaatttataaataactaaaatttatgataaaaataaagactattgaacgaaaagaccatttaaaacatatgacgagataaattaagtaacatgcctataatggagtagagtggtggcggttgatacgacatataaaaactgttaataaaacacaaaatagaatcctaataacgattaaaaggagagacgataggaaggccgtgaagcaaatgaacaagacgattgccgggacttctaaaaagtaaaaaaaaatccaatgataattatattcgatttttaaaatctcaatgacaataaaaaggaaaagcagcgggcggggtgtataggagtatagttgcagagccgccgacggttgacgggacttctaggaaataaaaaaatgaattccaacgatagttatgttcgatttttagaaccacaatgacaataaaaagtaggcggcgtacgggccgtagagaagcatagtggcatcgtttgacaagacttctaaaaattataaaaaataaaacccaacaagacaatcaactctaaaaactacaaggttcaatttttaaaggttcggaatttctaaaaagtaaaagaaaataatgataatcatgttcgattttaaaatctcaa

SEQ ID NO: 5895 - DNA, 1501 bp, Oryza sativa
agctaggcgaaaaactctaaacgtttctctacaaggacaattgtttctaataaccacattccaaccttatctccaattccaaatttccaatcgctagtaacgaccgactatatatactgagtaacactagtaagactatttttagagagagaacgattcaatgattcatacatatagccaagtgaaaaagattggtatagatagggctaattaatcctgcccccgccgttttctctcggtttgttaatcttaaccgtggatgtcaacatcacacattgtgtaccaatcgccatctcaccacctttccttttgcactataaataaatccgaacggcctctgcttctcgaagcccggcctgtagcctcgcctcgcctccctccgccgccccggttacgcaaccaaataccgacggcgccgcccgccgacgagccttctcccttcgcgccgccccctcgcagcatcctcgtgccctcctccggcatcttcctgcgccgcgttagcatcgtctgtcggcgccgtcggaggttctgctcggagctcgcttccgatggacggcgcggcgacgggcacggagcgcctctgccctctaggatgaggggccggagacgtcgccggcggaggcttgtgcaagtacgagcacttaatattctcccctactctattccttttccatttgagaaaattagaagaagaagaaaaaaaaaactcggttactttatttctttgtgagaaatgtgggattcgataagatatggccttgctcgtgctgttctaatgcgctgtaactgtgggtgacggcggtgcgtttggtatttgttgataatgtattgcttcgtcgctgcacattctgcgagcctctgcttggaaaagcaaaccagcaatatttcggtgtaccatcactaactggagtagctgcggcttgttctgttcggttcagcatgatcttatttcagagtttattcggtggattgatatgaaaacgattttttgtacggattaaaccgcacggaaaataccgctgaactggaaattttttttgaagaaacggtggcccgtggaaatattttatatgatctgttccttataacatttgggtaggagactaggaggaacataatgtgctccaactgtgccacggcatgcaaaccatttacagatagcacagaagattgatgaactaacattatggtaattgagttctgctgcaatagtaactgacatagcttgagcgctttcgaaataaaatggtttaggatatcatgtacttacatatcatgtgttagtatgtctgcaataggcaatggtaacttcctgttcctgtggttaaacattaaccgagcttttcttgaaataatatactgatgtaattagcttatgatcccatgttcgttttattttccatttatttatttataggtaaatgatctttgcaactgtcctataaatataacttttttttattcaggtcatctatgctagcacacttgatgactgatgtca

SEQ ID NO: 5896 - DNA, 1501 bp, Oryza sativa
gattccaaacctgtaagataggacacatctgtcaagcaatatctatctatctatctatctattatattattaaaacaactttgaaatgacgcaccatgttcgttgtgggggttagaaattcccacattaatcggagaaaaagaaaaagaaaagaaaaaggagagtccaagtagaagtacaatttaaaaatagctgaaattcaaaattaaaaataagcaatattgaaagaagtttctatataagaacccaatacgagattaatcaaaattcgaaataaaaatataaaaatccaaaatcagaaaaggaaaggagagtccaagtaaaaaaaacaatttaaaaatagctgaaattcggaattaaaaataaggaatattaaaataagtttccatataagaacccaatacgagattaatcaaaaatcgaaataaaaataaaataaaatccaaaattaaaaaagaaaatgagagtccaagtaggaatacaatttaaaaatatctgaaattcggaattaaaaataagaaatattaaaataagagtctatataataactcaatacaagattaattaaaattcggaataaaaataattcccacattaattggagaaaaataaaaaaagaaaaaggagagtccaagtagaagtataatttaaaaataactgaaattcgaaattaaaaataagcaatattgaaagaagaatccaatacgagattaattaaaaattagaataaaaataaaataatatctaaaactagaaaaaataaaagagagttcaaataggaatacaattttgaaacaactgaaattgaaaataaaaaataaaaacattaaaataacacaatacgatattaactaaaattttttaaaaaaattctgaaattagaaaatgaaaaataagatatcaattaggaatacaatttataaataactaaaatttgtgataaaaataaagattattgaaagaaaagaccatctaaaacacatgacaaaataaattaagtaacatgcctataaagaagtagagtggtggcggttgatatgagatataaaaattgttaataaaacaccaaatagaatcctaatgacgattaaaaggagagacgtcaggcaggccgtgaagcaaatgagtaagacgattccgggacttctagaaagtaaaaaaaaatcaattgataatcatattcaatttttaaaatttcaatgataataaaaaggagaagcagcaggcggggcgtataagagtatagttgcagagccgccgacggttgacaggacttctagaaaataaaaaatgaattccaacgacagttatgtttgatttttagaatcacaacaataaagagttggcggcggacgggctgtagaggggcattgtagcatcgtttgatgggacttctaaaaattataaaaaataaaactacaagtccaatttttaaaggttttgaacttctaaaaagtaaaaaaaaaaccaatgataatcatgttcgattttaaaatctcaa

SEQ ID NO: 5897 - DNA, 1501 bp, Oryza sativa
ggaggccccttgccgcccagccctccctcctcattcctcccatcacctccactctaaaaaagaagggggaggagaagagaagaagaggcgaagctctgtcggttcgagactccgatttcatgtaatattcatagatgcattatatttttgactattgagttaactactgtgtattttttaaaactttgtttgaataaatgcattatattttctagggttttagttgtattaatctagaactgcgtattgctagatatcggtaactgcgtagatctactagttttaaatatacactttaccattacattagcatacataacaagatattacgtttgtcagtgatatgggaccgggagtatcgtgacctgaggcttgaggcagacacaatcgcccacgtggcctggcaccttcggggacgtcgggcccgagggtgaggtgtccgctctcctcctgatttccccgaggggggtcgggttactcctgccccggccccgagggccgaggcaccccgaccctttgaggaggtttgcgccacatatatgggataggtgaacacggcagtgctcacctaaccacatttattgcagtctggtcaagcgtgtcacgctgcatgcagcgcagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggttagatttataccaggcttcatcccaaccattacaggcaagatgctacatgaagaagggcaaacatgcatgtttgcccagctgacacgtggtggacaaggatgactgatttgtgaccggtcagacactggtcgcgtcatcaacagacagccataatcccacgtcgcacctgtttccggcggaagtgggggtaggtatgggccgtcccgtcagaagggcactcggacagcaaccgtaccgatctccgtccatttatgaagagaagaaaagtccagtttggaaagggagaggtgcatgtggtatccccttgagatataaaaggaggaccttgcccacttagaaaggggaaaaaaaacggatcttggacttttggagcggggaagggctggttcatactttgtaacttgttcatacacagatccaccaaaaacacaggagtagggtattacgcttccgggcggcctgaacctgtatacatcgcccgtgtctcgcgttccttcctggctcgcgatctttccacataccgagagagcttgggatttcaccctaagcccccggccgaaccggcaaaggggggccagagcggtctcccggtgaggagccacgagctccgtcatctggcgcgccaggtagggggctcagcgtgtgttttctgagctctcgcactcttccgtgtgcgccaagtttttcttgttcagcctaa

SEQ ID NO: 5898 - DNA, 793 bp, Oryza sativa
gcctctctgggtgactccctaggtcacccgagcgtgcgagagagaggggccccgccgccactgtccttgtggccgtgcgccagtagccactcgggcggcagcgaggcggaggagggaggtgagggagaaggggcagccgggtcgtcacctcccgtgccgcccctagggaggacgacgcgagaggatactgttatgttcccgaaccagaggaagtctcatccgaatttcatgaatcctacgtctacatcctcatctgcatgactaacgaacgggtccttggagtttgatttttagtccaatatgcaagatttggggtttaattttccatcgaatacaggtaatcaattccttttttatgagtctgtctattatacatttgatgaaaaaaaacacccatcaaaatctaacaacttttgaacaattgcttcgtatactcaaaccctaattccttccacttttttccttagcaggacacgcctaaactatcacctactgcatgtttctcgtcatcgctgtctcctccattgccaccagcccagcacgccaccactcaactggccaaaagacctcaaccgtgccagcaagaccccacaatcagcctcctaaacccacgtaggataaggaggccgactagagggggggtgaataggcggttttaaaacttaatgacacttaaacaaaactaacctaagttgctaggcaaggtgaggtgcaaggttaactaagcaactaagttaagttttgcaaacctaagtgatatgggctcaaatatgtctctatgaatataaatagc

SEQ ID NO: 5899 - DNA, 1501 bp, Oryza sativa
gtgctttagctttagtggcaggcctggaagaggaacatgagagaggacaagagaggcactatgccaaattgtcacttaataggatttaaatcctggttccaacaagtgttacacgtatatgtctgattaacaggaatttattaagacgaggaatttgtcactagacttcatctcttccattatcatgtgttataagaggtatactcacaggtatttgtgcacagcttccatgtaattaaaaaaaaggcactatatagtggcaaattcagagtaagggctcgtaactagcgcgattcaatgtcaatctccaacctcacaattacagtgctcatggtagtaagtttttgttatttacactgagatacacctaagagaggttttccattattgtacaacagtaacaacagctggatggcttgctatcaatttgagttttcactgatacgctagcattctgcagagaacaaaaaatatgtcaatagagcatgtgccaccggcccaccggccaccgccccacatgaaagtattgagttatgaatcgctagcataacagctggggctttcacttatgtgctgggatttctacagagatcaacaatgccaacagagccatgtgaaaactgtgagagttttaaactataaattgctaacagcaacgtccacaaatttccaccataaagcaggaccggttttatgccttccagacaggttcattgtttcgttgaagacgccatgctggagagcgaagaatgttttgtttaagaagctagagtagtggggagtgctttggagggttttctacctgtttatttttggttgcaaagtatgttgttgcaaggcacatgatctgtcttagactgtttcaccttttattttattttcctattttgactgggtacattttagtaggtgcagatcgagtttacctcacttcaaaaataatattctattctgtcaagagagattctgctggtgtcttccacggatgaaaagctgatgttaaaaaaaaaaggagttcctttaaacaggtaaacatgttcagatattcaggcaactttttgcgagtttgccaattatgcatgacttcaaatttgcccaccgtgtgtaagggtatgtactattagagaaaaacaagtacggttttttaatgattaaaaaccaatacttgacagtcttgcaataatgtggacggcaaatagaagaccctgaaaacatgggaatgcaataagaaaaatacttatatattttttctatttatttaatgtatagtgctcgtgtaagttttataacttttcttttgaagtgcttgagcctaaaatctaccaggcctagcaaatatatgtgaaggaaacatgaccacgatagtataactgacatgaaaccaaacagaagttcttaatctcacatcaaattcgtttgatcaaaataaagaagaaacttatatattggaggaacacaaaaggcactggagttgaattctatcttacatggccaacttatg

SEQ ID NO: 5900 - DNA, 806 bp, Oryza sativa
caggttttagtgggcaagtaattaattaaccaatcacgattgaccatcgtgaactatcattaagccatcattaaataatagtgaatcttaagttatcccaatagtgtgctaatgtttctaagcatggctaagcaatcatatctaatatctagttgaaccaatatatatatagcccaactagtcaagttgtaataacccaaggtatcaaggaataaagtgatcaagaacaaaaaaggctataacaaacaataggttaattccacccaatgacattcgaaaataaatgcaatagttgaatagaaacagtagctttaaacgggatcaacatgctcaaagggttgtttaggatctgtgtgacttgccttgctggccttggaactattcaaattcttctcctgcgaaaacggactctccggaaacgtcggaatctaaacaggaaagagcaaaatcaccaaaacagcacataaacaagcatgaacagtacatgtggatatttttaacatgtagatctcaattttagaaaaatttagagacttgaaccaactaaatccgagctaaaatgaattagttatgaatttttgaagattaaatcggattaaaacacttatatggattttaattgaattatgacgcaataatgaattatttttgaaaaggaaaaggggtttattgcgtcagcggctagggtttgcgggggaccgggcccccggcaacggttcacgggaacgaacggccgaaatcgatccatccaaaacggacggccgaaatcgatcgggtctacggcggctcacggcagacggccccca

SEQ ID NO: 5901 - DNA, 491 bp, Oryza sativa
aggcggcccccttgccgccctgggggagggcgatttttgcctcccccctataaaccccagcccctcccctgtgaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacagtattgtagagaatgtaacttagggcgtagtacagaaatgcgaggttaacgcagttattgttttcatcaggcacaa

SEQ ID NO: 5902 - DNA, 1501 bp, Oryza sativa
gtgtttgaaaggagggaaaatagaaggtggagaaatacctaaaacgatatgagtcatcaacacatgattaattaagtattaactattttaaattttaaaaataaatcaatatgattttttaaaacaactttgctatagaatttttctttctaaaaacgtaccatttagtagtttgtgaagcctgcgcgcgaaaaagaggtactgtctctctcaattaccctggaacgagagagcctcgtcgcccatgcaccactatcaactattttgaaaagtttaatattacagtcaaccgttagctctaaaattgatatatcatctgctgtcaacctaatagcatatttgtataatagttttatataaatataaattgcaccattagtacttggctcacatatgtaacgtgtttttcatttctcttctccatggatgtttatagctatttataatatgttattggacttattattagttgatggctttcttctctctcatgctttctctctcctccacttagcttttttaacgtattaaatttagaaatcaaaacaatatgaatatatttatgtttatgtatcttcaaaatcaatgttaaataaaactattagcactgttaggcggttttctcttggaaatatcttttttatgtgatatcttattattattactttatttttagtaggctggctgcatatatttaatataaatattaaattaaactaaaaaagaaaatctcgtagtattttgatactaagatgcgattcatgatcatacttagacttatgatcatactcccgccgggccaaaaggagcgacaaaatatgattgattaagtatttactaatttttttaaaaaaatgaaaatgtaatttttaatgtaactttcgtataaaatatttatataaaaaaaatattgtttagccgtttgaaaagcgtgcgagcgaaaaacaatggacacagcctaaaaaacaatgggctggtttggtttgtggcctaaataggacttactaaattttgtcagtgtcaaattttggtatgactaattttgataaggcaaagttgtgcttggattgaagccaaaataggctaagttcactattaaaatggcctattttcttaggcatgaaaaacttagcttcaaaccaaatagatattaaacactatattaaaattatcaaatattgataagtctaatttaggtctcaaaccaaaccagcctaaagatcctgataatgaccaatctggaccgtgcgtgttctggaaaggaaaaagaacattttccgctgttccgcctaatgagtctacgcgcaggcggcaggttagttccaagagaaaatgtcgatcaataacgcggattctagagtaacgcggattccagactattcctccgtggtctactttatccagcgttggaaacccgctcctacacacacacacacccactaccgctctccgcaattcagccagactgcagttgcagcaacagcaaggatggctggtggag

SEQ ID NO: 5903 - DNA, 1501 bp, Oryza sativa
  unsure (1)..(1501): unsure at all n locations
aaaaaataatttatgggggaaaaaatttaaaaaatagacccccccccccaattttggaaaaaatcttattggcaaaacggagaggcagggtgtgtaaaaaaaaaagtttttttcaataaaccctttcccgcaagggcccgaaatcaaaaaaaccaatttgggccggccattttgcaagcggccccttaccgcccttggtatggcagaaagcctgattgttaaaaaaagcttgttaccagccccagacttaattccttccccttcaattccgttaaaaaaaaaaaaaaaggggaaggaaaaagaagaaggggacaagccctgccggattcagacgccgatttcaggtaatattcatagatcctatatgtgactattgaggtgaaatagtgtgtattttttaaaactttgtttgaataaatacttaatatttttagggttttagttgtacnaatataaaagtgnnnatnnnnacagcngcccctgcacccacgttggatccgcccctgcatccaagcacgggcagagccaccgctcggcttgcacgggcagccgtccgggctcgccgtcaaatacaccattgaacttttattgttttgaaaggattaaagttgaaaatattatagcaaatactagatatatttaaatttgtctgagcttaaaaaatttcctagctccgccactgcatccaggcatactgatctggtgacatagacaaaagaagatggcacctggcctggtgggctgatgggcaaatgtgttggaggacacagggagacacgaacctttggttagatttttaggatatgtgatactccctccatcccattttaagtgtaaccataagtaagttttcgcgtccaactttgatcgtccgttttatttgaaaaaattatataattagtatttttgttgttatgagatgataaaatatgaatagtactttacttgtgacttatgcttttattttgttttttttaaaaaaataaataagacggaaggtcaaagttggatacgaaaaactatgactgcacttaaaatggtacggagggagtagttataatctgtctgactggcttctgaattttgatgggaatttgtttcagatatgcttacgtgcacatacctccactgtaccgtatatatagtcaattaccacttcgtctctgcatatgtacgtaaaacatgcatgtgatatgactaaaccaataaccgtatagtatatggtttctgcagctagaaatcaaaacgatatcgagagggccagggcccagagcatcatttaactagcaactagataatcaattgcgagctaagtttacatagcatgcaaattaagcaaacgtcttgtactcttgtgtggagtgcttgctggagtgtggataaataggtcttcacagggaagagccgggaaaagtcttacacaagcccctgcatcctctctctctctctctctcgctccgtcctccccattacacacacatggatgctaaccacgacaagg

SEQ ID NO: 5904 - DNA, 970 bp, Oryza sativa
cgaaccttgttcgggaggaccaaaccctactaggagtttccagggaacaacgaatagcaccagaagctcctcatgaagaaggcgggtaaagcatggcccagtgtcacatcataaagtacttccggttgggaggtgcaccggctttgttacccaaaaacattgctggcgctcacaaataaacgcccatcctcttcctttgcaacgagtccggggcaggttcattcgttgaccgagttccacccctcccccaaggcggcctgtaggtcctcgtgaaccacgttaggcgcggaagcccgcgcgttgatccttttacggccgcccgcccacagctcctcccccggccgcccgggcgccgttccttccccagcagcggcgttgtccgtcgccagtagccgacaccctccccctctcccgtcgccagtcgcagagaacggagagagaaagagatgaggattggagagatgagagaaagagagagagaaggatgatgcggcaatgctaacatgtggggcccacgtgggtcccacgctgactcagccgacatgtaggataaaaccagggtcaaaaccaccggaggatctaaagtgaacggttttgttagttgagagatgtccggtatctggttttgcagttgggggacgattttgtaactcgatgacaagttgagggaccttcggtatactttttcctttaggaaattcaagtagggccagcatatgtgggctggccactacctgcctgatcaggtgggcggtaacactagctgcacaacgctgctcttctctctatcttccccccccccctcctgtttctctattttgctttcacagattcatcaggataaaggagtaatacagtactcggtatatgattttaaaactgagtgaagtacttaaatgaatcgattaatctgtaatatataaattaactttgctcatgattgcttgagtagttgttgtcggaaaaatgt

SEQ ID NO: 5905 - DNA, 536 bp, Oryza sativa
gcccccccccccccccaaaaccctagctctgggctgcagccccctcccggggaaggcggccgccgcggagagctagggccccccgtatctgtggctggctgggaggtggaagcagcggttgcggcgatggggggctggtctagggttttgatttgggagggaaggccgccgcggaggaggcaggcggccggtggaaccgggcggggcggggcgaggcgcgggcgacgtggggacgggggaagagagagagagagagagagagagacgggacgggagggacaacgaggagagagagagtgcccacaccggtttgcgcgatattatggaggcgggggagtgggatactggcgtgtggggaccctgtggtttagctgggacccacgtgtaagtgtgtggtccgtacactctgttgaattttttttatttataattttttttattaaaagttttacaaaaataattttccattttgaaaattgacggaaggagtcgcctaccgcctctgggaaaaatcgcctctcagagggcggcgaaaa

SEQ ID NO: 5906 - DNA, 1501 bp, Oryza sativa; identical to SEQ ID NO: 1049

SEQ ID NO: 5907 - DNA, 337 bp, Oryza sativa
ccgatatatgcttatctgtagtcgtatgttagctaggatggtcaaacaatcatcatgtacgaatctgattaaaccaggtctagatgctctgacttgcaatatattgagcatcgacttgccattgtaaactccttaattagtcaacattttaccacgatcggagcatacgcacgctacccccacatgcacgcatgctgatcatgcacagcacatctcggtacccggtggtcgcctgtactcgcgtactgcctataaataggcagccgatcgatcaagcagcttaatataaactcctcggtcacttgcaaatcttctctatcttataagttctgaacaa

SEQ ID NO: 5908 - DNA, 1501 bp, Oryza sativa
ccagcctggtaaatgggccattcttgtgccagctcggtacgctgataaaccaatagcatgtgaatggctcgatagcccaacaaacacaaggcctaggctgcgaggtcaccccggccagctcaccacagcggtgtcgtgcgctcgtccgtcggccaccgcggcacactgtgtcttctctcgagacatcgacattgaaggtgctcggcggctagcggcgatggagaaataggcggtggcggtggcagcacaaggtatagcgacgacgttagcctttctttaagcaataaaatcaacaatcaatacaaaatcataggtaagtgcaaaaccattattttatggtgcagtacagagtctagtggagtgcgagtatatactccatccgtggacttgtgggcccattaccacccctagccgtgagagacggcgacctggagaagggtggtgagctagcattggaggccggctaaagcgagcttgttgttaggacgtggtgtggatggtggtggatccaactgcagggagccgttcaagatgaggaaaacggtgaggctggtgcacctcactaccaactactaaaagatgagttggggggaggggggaggggaggtccaccaagggcgcataccaacggattaaaagatgaggagagaggggaggggagggggtggaggaggagaaggtcagccaaaggggcctcgttggcgctattgacgtcttcatactaatcgatggggtcgggcaatgacgcattggtgcagaggaggcatggttgagctgatgtcatgtgatgccatggagggaagagaaaaagaacaggagggttatggtttggagggatttacacgaatcttaaagcaacccgatgatctaaaatctacaagattgtaggggctcccaaaatttaactccaattaatcttggattagggccgaaacaattgatgatacttgttcatgctgatgttgctgaaacaatgtttctttgtagaaatgaatttacatcttatgttgcttgcttcatagagtagtgcgaaagagatgcgcacgatctcgcttcaatctgatcgcattgttgtccttggaaacaagacaacgctactagaacagggaaccaactcatttacctggcgaagtatgcaaggcgacaattaatggaggggatacactgaccaggattgggcatgcagaaatatgtgttcagagcacttcgggagatgccttagcctttatggccatccagttcccaggctcccagctttgcgattggatcaggggagtgcaaatgcagtcatgtggggccctggggtcagagaggagcctgaagaacctgcatcactggctcactggctcactgcatgacaacacaatacaacgaccgcgaacatagttacacaatccacaagtactcagcaaatatgcaaaagcaggatatggtgttacactattgccttacgccagtaatctacgaagacttcattgttcccacaagagagattactagt

SEQ ID NO: 5909 - DNA, 961 bp, Oryza sativa
ttcggatctgttcgtgcaaggctaaattgtggcgtggggtgtctcctctgcatcccttgcctggatgacttcggcgagcaaaggcacagggggggggggggtcatgagttgctgaatttggatccattggatccagccaatggttaagacaaggtggcaaacgaaccaatcaaagatggatgaaacatgaatgagggttgtaggagttcggactgcctatcgagattggcttattccattttttgtgtggtatggctcgttaggcagcagaagatcgaaactagtcttttactccctccgttttatattataagactttctagtattttttacttcatatatgtgtctagattcattaacatctatataaatatggacaatgctaaaaagtcttataatatgaaacggagaaagtagcgttttagctttgttgtttctcagttataagaagataattaaaaaaatatttgcttctgagttcattgattttgtttctaaccaaatagaaacagtgtcaacaaagctacctacgtgcaaggctgctatgcatagacccaaaggatcaatggcttctacaaatatactcctaataaagagtcacaaatcgatcaaacacaacttctaaaaatactccctccatcacaaaatatttgacgccgttgacttttttttaaaatatttgactgcttgtcttattcaaaaaatttaagtaattattaattctttttctatcatttgatttattgttaaatatatttttatatatacatatagttttacacatttcacaaaagtttttaaataagacgaatggtcaaacatgtttaaaaaagtcaacgacgtcaaatatttaaggaaggagggagtataaatataactaccgaggaccaagatagcgataattaaataacataataacactcaaatgcaacaaaagcaagcgcgcgcccgtctctccagt

SEQ ID NO: 5910 - DNA, 1501 bp, Oryza sativa
gtgtgttttttaaaaatattttcaatacaaaagttgctttaaaaaattatattgatccatttttttaaaaaaaatagctaatacttaattaatcacgtgttaaaagaccgctccgttttgcgtgcaggagggataggttcacatcctgcattaccgaacacagcctaaatcttgttgtctagattcgtagtactggatatattaaatcatgttctaagttactatatactgagatgaatagaataagtaaaattagacccaccttaagtcttgatgaagttactactagctgcgtttgggaggacttcccaaaaaaaaaagtattagccattagcacgtgattaattaagtactagtttaaaaaacttaaaaaataaattaatatgattctcttaagtaactctcctatagaaaacttttacaaaattacaccgtttaatagtttggaaaatatgtcagtaaaaaataagagagtagaagttatgaaagttagaaaaagaattgttttagtagtatacagttataaactattccctctgttctaaaacataagggattatggatggattcgacatgtaccagtaccatgaatcgaatccagacaagttttttatgcatatttattctactataatatatcacatctgctctaaatatcttatatttcgaggtggagactgtcgctatgtttttctgcccgttgctaagcacacgccacccccgatgcggggacgcctctggccttcttgccacgataattgaatggaacttccacattcagattcgataggtgaccgtcgactccaagtgctttgcacaaaacaactccggcctcccggccaccagtcacacgactcacggcactaccacccctgactccctgaggcggacctgccactgttctgcatgcgaagctatctaaaattctgaagcaaagaaagcacagcacatgctccgggacacgcgccacccggcggaaaagggctcggtgtggcgatctcacagccgcatatcgcatttcacaagccgcccatctccaccggcttcacgaggctcatcgcggcacgaccgcgcacggaacgcacgcggccgacccgcgcgcctcgatgcgcgagcccatccgccgcgtcctccctttgcctttgccgctatcctctcggtcgtatcccgtttctctgtcttttgctccccggcgcgcgccagttcggagtaccagcgaaacccggacacctggtacacctccgccggccacaacgcgtgtcccccctacgtggccgcgcagcacatgcccatgcgcgacacgtgcacctcctcatccaaactctcaagtctcaacggtcctataaatgcacggatagcctcaagctgctcgtcacaaggcaagaggcaagaggcaagagcatccgtattaaccagccttttgagacttgagagtgtgtgtgactcgatccagcgtagtttcagttcgtgtgttggtgagtgattccagccaagtttgcga

SEQ ID NO: 5911 - DNA, 1501 bp, Oryza sativa
cggggagcgagagcctcatcggcggcggcggcgggcggcggcggagtggcgacagcagcgtgcgggtgagggctggagtgggggtgggcgggcggggccagagtgatagcggcggcaggcgctggagcggcgacgacggcatgtgggcgagggctggaacggcggtggcgggtgggaggtgagcactggagcgtccaccatcccctccagctttgcctcgccatctcgatgtcttcgtcgccgtccgcgtctccttccccacctttcgctgcgctgcctctcccctctcccttctcggacggcggcgacgcttcggcaggcggtggcggagatagaggagtagctcgacggtgtggaggacgcatccgagctcggcgatagagggcgggcgagatctcggcggtgccgcctctcccctttcccttctccacccccggcgatagcctcgaaaggcggcggcgctttggcaggcggcgacggaggtagaggagtagtaggacggcgcggagggcgcacacgagctcggcggcgttgcgaccggccctcgcccgtccgccgccaccgctctcggtcgcagccgccgccaaaaaccacgggacgcaccgctacagctctggtccgcgcccactgttgccgtcgctccagctctccccgcctcggcagacgccgcgtgctccgtcgattcaattgtggtgaacaccatctgggatgaggcgatggtggcgaccggcggtgcggaccagccgtcgtgtacctcgaccttgccgtccccggccatcctccccgcagtcccctcctcttgcagccgcacccgtcatcccgcccgccaccgccacggccgaaggggaaataaaagagagagataagggagggagagggaggggggaggaggaagaaggaatagagagggaaaggatgacatgtgggccccacatgtcagtgggtcccacattatttttctgagaatgacaaataggtcccacattttttttttagttctgatgccacataagcaccacgtgggacgaaaaccgggtcaacaccaccacgtcagcaaaaccaccctccaaaaccgctggaggagtaaaattgcactggttttaatagttcggggagtcgtcctatccgattttctgattgaagggtaggaattagatttggcctactttttaaagaactcaaagtggactttttccgattttaattggactcatctactactaaatttgggcccaataatttgggctttaaatagactcaaagaagcccattgttatgttgaaggcattgtatcccattaagatatcaaaagccactttacatccctcaagtagaggttgaattttattcgtgtccctcaaccataaactcagatacagagtatccccacctctaaaaccattgtagaccaagtccctcgatagtattgagagcagttttgactcatgtggcacttacatggcttgtttaacttggtgcagcgttgacgcaatgcgtactt

SEQ ID NO: 5912 - DNA, 1501 bp, Oryza sativa
cgtccaatagaacaccaaataaaagaaaacgatattcgatttacactggacacagatttgtacgtggcaccacagatcaagcccatcaaagcagctcaaaaaatctaatataccgcccaaatctaagcaaaacggcaacacaccaagcttccaatgatcccgaccacatcagcacagaaatgcccccaagcctcgaagcatgatacccagtaaaaaaatacgctcagaaaagacccaaatcgaaatatccaatcgaacaagctcctcgacaaaagcctcccaaatcagaaagaaacgccccccaaccaaatcagctcacccacaaaagattcaagcaaagcaacccgcccctcctcctaactcgctctcccaatgcgattcttcactacggccaccccccagattccaaccaagaaacgccacacctctcatcgcctacgagtccccccagctcacgtaaacgctaaggattgaagaaggaacaaaacgaggcggacctgtgcacgggaggggtgtatctcttgatgccgtccgggttgccgtccgccatcgcagctcagcgcaggggagggaggaaggatggggggggcctcctcctcctcctgccaccctcttccttcctttctcctcccgacgagagagagatgcagagaagagagagaagaagagcggaaggaggaaggaggaagaagggaggaggaaattggtgggtgtggctgctagtgggcccatcctgtcagtgtgcaaagtggcagtgctttgcgcactgaacgcggtaatgtctcttggtgtggaaactaccgcccctgacaggtgggctcgtgggaacaggccgtcgtgtggaccccacatgtcagtggaaattactagatgtggtagaggaaggataggtttttttgcccgcataggcaggccgtaagggcccaacattgcacgagcccacaagggaatatgggccaggccggatttgctcatctcattcccaatccaaaggtaaacaggcccatcacatcgatgtgcccaaattcatcttggttttggtacatatggttcttttctcctcaatcctcattaaattttttacgcaaaatgaggtgatattaacatatgataaattaagttttaattattacaaacttaaaaaataaaataatatgatattttaaagtaactttcatatataaagttttcgcatgaaacgcatcgttaacaatttgaaaagcgtgccacgagtatccaaaattttttccaacttttgttggagaaaagaataggggccatagagaatatcccagaatctttggttggaggagttgttgacttgctgtcagttgtcagttagaacatctccaacagattggctatttttaagctctccaaatgagcatttggccagccatctaaagaattggagagccaagtttgcattttactccaacagtctctctattcacattctccaatttaacatcgggtcccacatgtcagtctctcgttcctc

SEQ ID NO: 5913 - DNA, 1501 bp, Oryza sativa
ccgatttgagccatgaatttaagtgtttttttttttcacctcacgtgcggctcgattaattttggccgtactgggactggccatcgtgccggtggatcgatacatgcatggagaccgactatatatacatgcacactcccaggatgatcgagttgccggccggtgcatgcaccatgtcgatcgtaccggtggtaccggtgacggatatggtaaaaaaaaaatagtgggatgattcttacagtctttacgtcagaagaccccaacgcccctatgctggatccatctccgggtggtactgcagcatggcatggaggccttcttcctgggagaatgcatggtttgccatatgcatacacaggagacactgcatgcaaaccaagattcaacacaagtcttaattatcacatggaagagaaatatatgtttaagaaaaacacaaaaatattcctctcccagagtactgaatcatcccttaagcggatatcctattatttttatatgtcacttaaaaagtcatcaaaataatttagtaggatagaacaatatgtgatatgctacttcacaaacatgcaaatttaaattccacttatacaaatagaaacaaaaacaataaatttgactatgaatataatgcgtaattcacggtcaaatttgttatttttgtttcgaattgtataagtcgaattttaattcgcatgtttgcgaaaagatatattatatattgatctatcataataattttttttaaaaaaattggtaactttttaaacgatatgtatgaaatgaggggatgtcagtctcgagagacaagaaccacttcttatatatccgcccagtgagatcgcccctggcctgtacaccaaaaaaaaaatccgctcccaacacgccagacgcgtttcgatcgtctcccgatgatttccggtgcggtgacacaagctctttcagcacgaacggattgctcatggacctatctgtcgtaagaaaaaccaatgcatgtcgatgagcgttgcagtgtgtgtgcagatccgtcgaaattaatgatattattctctccaatgctagcatgctagattcgtgaggcgtcgtcgatgcggctatacaaaattaacattcttaaatccatgggttgatcacttcttaaattacctagctactgtataaatgcgcggggcctagaattgaaccttcaatatcatttctacagtagattaattgctcgctcttcctttttctttaaagataatcaacactagcttacttaataaatccaacctccaactatttttttgtcaattaattaatggattaattaaacaacatattgcgacaccacccccatgctgccatgcaccctagctataaatacgctccactcccagctgcttagctcagtctctcgcggtctctcgcgccatcgatcgaaacgggtcactgagtctcgcagcttcgccggcgccggagagagacacgacacgatcgatggcgatcgcgtccatggccg

SEQ ID NO: 5914 - DNA, 1103 bp, Oryza sativa
aacaagaggaaatgcatacattgtagagtaaaacttcagttgaggtccaagtatggggcagatcgaacaatctcgcggacagagcaagcagaacttatgtttctgcatcagggccaacacaaattattctgatgggctagggggtttttccttgggatgctttgatccatagtgatcaatcaattgtttctcattggccagttgaacctacacaaagaaaagcgatgtttcattaagttgataccacatccacatgtgcgtgcgcatgcaaaaatgagtcaacatggtgtaggtcagatcaagcagtgaccagtaatagattctaattcagttacggaaaaatgtatttataccacacgttttcgcttggtaccaaataatactacaatttttttcaccttaaagaaataatatgactgctaaaatcttccatctataccgtttatcaaattgggaacagcattgtccaatgataaaaaaagatgtaggatgatgccttcactgttactccaaccagtggtggaggacagaagggggctgcttcatcagttggaatcagaactcactggagagaaggctttataatggtatttatactattcacaacaacaacattaacaattagcagaacttaacataaatagttcagatggaagatatgagcagtgtgatattttcccaaaggggaaaaaatgtggtactaataggcaccaaccaaaaacttgcagtacagacactgagatgcaattttctcctttaaagatgctcatctttggacctacctctcgactacacactcatcagtataatataaccaaaactgagaataaatgattgatccaactacaaattttgcctagaactatattccccaacccttcctgattgttcaaccataacacagtattcatcagaggcaggggcggatccaacgtgggtgcaggggaatatagttgataagataggaggtgctaaaggtctcataatagcattttagcatagtttaatactgagattatgtgtttatatcggtgtactcagtatttgagtccccccaactttttgtttctggatccgcccttgatcggtgattatcatagaaa

SEQ ID NO: 5915 - DNA, 1501 bp, Oryza sativa
tatttgtgttttatgacttgttgaggtgtgctcgtgattgagtgaattggtgtaataattgactgtaactcgttaagtaaaggccgatattctattccattatctaaacaaagtagcttgcaggtcatcagcatctgaccactgcttgcttgcacatgtgtttcttggcaaaactaggcacgacgactcggaccatggcgactgacgagtgggggaaggagacggacaagaagttccaggcgtggccgcggacggacgggccgcccggtggtgatgaaccccgtcaggcgccagaacttcatcgtcaagtcgtctgaataaatcttcttcatcagccctccctagcattctctcggggaagaaagaaagccaatattgttgcgcgcgtgtgctgattaagcccgtgcacaattcacctcctgtttcagactttcagttaaagcaaactagcatgtatttttgctgtaatttttgtgttaattcccggtgagaaatcagctcgaaccgcacggttaaatgctatagcatcgcgacgatcctcgcagtttgtttctgataatatttagtgttcttcagggacgaaaatgatactccgtagaatagtaacctcgaacaatttgtagtatttatgttcgaaacagatttagaatttgttttgtttgaagttgcaaacataatattcagagagccgcatcaaaattccataaattaaattcagtatacccggcacactttgtcgttccttggtgcaatttgaaaacaaggggtttggagcatcggttgctataggcctatagccttgccggcgaaaataagatgactaattactcaatgatttgtactcaaatgatcgaccaggaattgaaggtagcaatgtagcattcatattgcaaaatctgtagtacattatattgaattgtttcttacaaagaatacatatagccagaagggctgcctatttccagttagtaaagtaggggagtgttaacctatattgaatctggaaataggaagaaaacctcatgtgcttaaaaaaaatataggcctcatttagaatgtaacttgcctacgtttctcttaacaccatgaatgtgtttttattggaaaagttatagtcgaggcaacttagaattaagcatcggagcatgtatttttatggtataagctttcagaaggtgttcttgcatacatgaaaagaagaaaagcaaagaaaaaccattgaactaattgtaagtgtagaagttgtgttgcattacctatttacctttactatgttgaaagtgtaacaaaatatgtgcatctaatatatgaatgtgtgaaccttgacactatcaatgaattctcaagtgttgaaatccaggagatttgtatggtagacctatcggatccaccaatcagatatactccatctaacacccataaatacaatttaaaatacacgtcaacattaatgcatgaaaaatcataaatgcaatgagtgtctaagatcctaccgtgcctc

SEQ ID NO: 5916 - DNA, 1501 bp, Oryza sativa
acacgtcaacacctatgcatgttcagagaaaactatggtgtctgaagcctgaacaccaagcaatgaaaagcatggaatccgttctagctagctagctacccaatcccatgccatcgaagagcatcaagaaagaaggagagaagaagaagaagaaggcgatgagcaaagaagggatcaatgcaaagagaactcacttgacctcaggtggtgcctcctctgcaaggctctcctgctcctcgtcacctccaggcaatgcacccctcctcctcctcccgcaccaagtaccaggaggaggaggagcagagcgcaagccccccacgccatcactgaccttcacctcacctcacctcactgagaccagagagagagagagagagatggaaagaagaagaagaggaagaccgagtgaagtgtgtgagagagattcttgggtggtggtgggggtggggtttcttgcgggcgcatgggaacaaaggcgcaggagctggcttggctggcggctggaggacgcgaggggtgggtgggccccgcggcgcggtggtggtggtcgctgcggcctgggtggggtgagagccgagaggaaggaagcggaggaattattgagtagtagcggggggacttcacatgcatgtcctcttgctcggcagccgcagcagcggcagacgcgcgcgcgctcgtcgtcgtcgccgagctgagctgagctgagctctctcgggtgtcgccgcggggcttgggttgggttgggttgggttggggtgtctctgatcgtgtctgacagggtggtgggggccggtaggtgggccccacgcgctgacaccggtggcctttattttagtggcactgagggtgggtgggtggagaactggagataaggaggagagagagagaagggaggtttggtttttggggggcgaattgaacacggggcgtgaggggggcattaatagtttgtcagccgcaacgggggaagagaagaagggtcagcgtggcacggcgccggcgccatgtggtgcgtgaccgtgtgcccatcgtgtcatgagtcatgactgatgactcatggcacattgattcttcgggggtgtctagatccaccggcaaattttttttcttcatcacatcaaacgttggataggtggtgtttgaatctcttaaaaataaagatgaagattaagttttttacgtaaaataagatggtattaacttataattgattgagttttacacaaacttaaaaaatagattaatatgatattttagagcaactttcatatagaaagttttcgcacgaaacacatcgtttagcagtttgaaaagcgtgccacaaaaatcttaatcttaatccaacttttgttagagaaaagaacatgaccatagagtattaaatattaaaaaaactaattacacagtttgtatataaattgcgagacgaatcttttaagcctatgtcagggttacggataaggtataccctctacccttggatatacgtcatacatcgata

SEQ ID NO: 5917 - DNA, 1501 bp, Oryza sativa
gctcttcacatagacatgatcttggaagactcgtttttagaccgaagcgattctttgaaccgagttctttctctttcttgcgaatgctgatggttggattcaatgttctggatcaggtcccttgaccttagcggcctcgttctttaaaaaaagaactacattcagttgacacagctattgactcagctgtgaaggaatgaatggcgaatcgagggaggaatatggtaaaagctatgctcaaaggtaggtggtcgacaacattggtatcccttgccaactcttgaccagagatagatacaaagcacctgcagctgaggcatatctcagtagcttgcaggaagagaaagatggacttaaacactatagatcttcgcgtgatccgcttcccccagaccagccaatagaagaaatagaaaagaaaggctttatatactacattagatagcaagtggaaggatttgccaatgcgaaattgagtagtaggcactttcttaatatcatgcgaacggaaggctggtatcgatgcccaggctatatatacgctattaaataaattcttggtgtaacatcagtcagcaaagaaaatcaataagaatttcataaagaatgaaaggcaggaaacaaggagaaggaagctagcaaacaatatgaaggaaaactttcaagccttattcgtactccacgggacaccgtataatagtttcttctgaatggaaccgtaccgatctactaaacgaaggtgttcacgagagggaagggcttatcttcaaattcggtatcaactgagcaaatctccaaaatgcctttcattcataacaaaggaaatggcaccgaaacaacttatctgcaaccctgacaccagcaagcacgggcaaattgatcctcaaaaccaaagggcgttagccaagtcgagggttttgaaaagccttacctacaacgcgagtctcctatttgactatcaaccattctagtttcaaaaaatgttcccatcagtgctgctactcgactttctcatctcctatttgtttgagccattcattatagtggtggtgccggggaggcagcttagcactctagtcctaaagagtaagtaattgtagcatgggcaggcaatctcttcgattgattcccctccaggaattactttcattaattagccggcccacggagtgaaatatcgaacttaacctataaataactagtatctcaaaaatccaaataaaaggctttacttttaaagcttgttaatggaattccacaggagtcaagcactagcaaagaagaattggaaatcagtcgcttcccttctgggctcaagtcagcagaagagtgaacttcatattaataggtaaatcctgcatcaagcgtaaaggaagtacacttatttggattcggcgcttaataactcgtagttgacgttggtttcggttcgatcaactatcctttttgaagcggatagttcacagtgctcattctcaaaaaaaaagcggaaaagccatga

SEQ ID NO: 5918 - DNA, 1501 bp, Oryza sativa
gagttattaagcgccgaatccaaataagtgtacttcctttacgcttgatgcaggatttacctattaatatgaagttcactcttctgctgacttgagcccagaagggaagcgactgatttccaattcttctttgctagtgcttgactcctgtggaattccattaacaagctttaaaagtaaagccttttatttggatttttgagatactagttatttataggttaagttcgatatttcactccgtgggccggctaattaatgaaagtaattcctggaggggaatcaatcgaagagattgcctgcccatgctacaattacttactctttaggactagagtgctaagctgcctccccggcaccaccactataatgaatggctcaaacaaataggagatgagaaagtcgagtagcagcactgatgggaacattttttgaaactagaatggttgatagtcaaataggagactcgcgttgtaggtaaggcttttcaaaaccctcgacttggctaacgccctttggttttgaggatcaatttgcccgtgcttgctggtgtcagggttgcagataagttgtttcggtgccatttcctttgttatgaatgaaaggcattttggagatttgctcagttgataccgaatttgaagataagcccttccctctcgtgaacaccttcgtttagtagatcggtacggttccattcagaagaaactattatacggtgtcccgtggagtacgaataaggcttgaaagttttccttcatattgtttgctagcttccttctccttgtttcctgcctttcattctttatgaaattcttattgattttctttgctgactgatgttacaccaagaatttatttaatagcgtatatatagcctgggcatcgataccagccttccgttcgcatgatattaagaaagtgcctactactcaatttcgcattggcaaatccttccacttgctatctaatgtagtatataaagcctttcttttctatttcttctattggctggtctgggggaagcggatcacgcgaagatctatagtgtttaagtccatctttctcttcctgcaagctactgagatatgcctcagctgcaggtgctttgtatctatctctggtcaagagttggcaagggataccaatgttgtcgaccacctacctttgagcatagcttttaccatattcctccctcgattcgccattcattccttcacagctgagtcaatagctgtgtcaactgaatgtagttctttttttaaagaacgaggccgctaaggtcaagggacctgatccagaacattgaatccaaccatcagcattcgcaagaaagagaaagaactcggttcaaagaatcgcttcggtctaaaaacgagtcttccaagatcatgtctatgtgaagagcttgaaccaagcgttcacacgcatacgccctctgaagattggaaagaatccatcagcgagaaaatcaaatcgtattctatagaatatggtagtg

SEQ ID NO: 5919 - DNA, 1501 bp, Oryza sativa
agctactttacctcagaatccctctctagagagaattctctttcaagtttgaattgttccattaacccatctactgccaacacaactacttcttttctcttttcacaaataccttcttttctctctttgttggttaattgagtagggtattctagtgaatcgtacctgttttccgacaggaagctttggctgaaaggataggaatagctcttgcgcaaggaatataaatagcgtacgcgtactagtccagggaataaaaaatatcttacctgtgagggggaggcaaaagggaaaaagctagtattttgaaaagggtatagtagctggtattcggattgagcagtgccataaaaggaaagcgttgttgtttttcctgttcaaccaccccaacttgtgacgtataacgatgcaggtatctggccagcattgaccgttcgagttgatgagcggaacccaaacccatgccaactggacacccgcaacgtatgtccacccgccctttcctttgagaaatcctattcctatcgatttagctacataggcaatacgacgttactacgaataaatgacgagcgaaccctcgaaaaccgaatcgggattatccacttgaacagatgggaaacacaaagcaaggtatcattgtttataaatgtatcgattagctctgttgataaggatcatgatgaaattgcaagtacggatggattgagacccgatctgttccgatcctttggcatgggaaatccttccttttactctctcttttgaatgagtcgtggtgcgctcatcaagaaggggaaagatggatgggaaatgcttgtcaagctcggttctttaaagaatagcatcctcgtcttcctagtgaaaagcgcattgggattctctacttgtggtggtatagtgctgcttttagtgatttggagggtgcctcccgtgggcatgcctgctacgctgattaagcgggtaggcagatggattgatctactcgttcaacttgcttgtgttggtgagttgttctattattgattggtcgagcccggaggaagagtggccttgagtttctcgatacataacattgtctaaatcaacccaagtcgcttcttcatttctctaaacagactggtagttgggtgagggatgtttactattgattggttataggccttccttccaagcatcaaagaaagaaaagagcaaagcaattccaacataaactgacactttaggatcctctaagcctttctatagaacccctaaatagggaaggtactaaaaagaaactcaaaactagcactactaacacaggctgaagaggatgacctcgaaaaagaatacaattaaagatgtggccttccctccaagcacatatatggatatggagcactcttttccaccctatccttatatatttcattcccgccattgacagcaactcactcttttcgaactgcactttgaaagccaaagccaagaaagaccatatcaactactctccaaattg

SEQ ID NO: 5920 - DNA, 1501 bp, Oryza sativa
tttccattcattcaaccttatatatttgatccccttctcccaggtgcgagtctattattgaggaactgcgagctccttttctagagcttccttcccatttaggcggggtgttcaaaggggttccaccgtcaacttaagttaaggaaccccaactcccaatttgtcatttacttcttgtgtttacagctcaaatctctatcgtcgtcttgacatccaattccttacggcagagacctaaaaatacccattgccggctttacttttgcctgtggagacggggtgtggcataccttcccaaaagcatagggatcctatctttgaaaaagcaaagcgtcggctagttctattctaacctgactgacttcctcaccaccaccgcttactgctatttcacgcttatttcattcgtagggccaaaagaaagagctccaacggcggctaaaagctttgaagctccttctacccttcctgtgaatgaattggataaaagcctttatgcccgagagtgaaaggtgctccagcttgcttggtgaacactgacttactgaagaccggaatggaccaatgtgacattgactcaagaaggtagacaaaaaggccaactatagaaaagccaagctgactgaatgaaataccgcagttcactctgactccggttcggtacctactctatatctgaagattgaccacagcgtaatgccttaccgctttacaccttgctttccttattttagctactttacctcagaatccctctctagagagaattctctttcaagtttgaattgttccattaacccatctactgccaacacaactacttcttttctcttttcacaaataccttcttttctctctttgttggttaattgagtagggtattctagtgaatcgtacctgttttccgacaggaagctttggctgaaaggataggaatagctcttgcgcaaggaatataaatagcgtacgcgtactagtccagggaataaaaaatatcttacctgtgagggggaggcaaaagggaaaaagctagtattttgaaaagggtatagtagctggtattcggattgagcagtgccataaaaggaaagcgttgttgtttttcctgttcaaccaccccaacttgtgacgtataacgatgcaggtatctggccagcattgaccgttcgagttgatgagcggaacccaaacccatgccaactggacacccgcaacgtatgtccacccgccctttcctttgagaaatcctattcctatcgatttagctacataggcaatacgacgttactacgaataaatgacgagcgaaccctcgaaaaccgaatcgggattatccacttgaacagatgggaaacacaaagcaaggtatcattgtttataaatgtatcgattagctctgttgataaggatcatgatgaaattgcaagtacggatggattgagacccgatctgttccgatcctttggcatgggaaatccttccttttactctctcttttgaa

SEQ ID NO: 5921 - DNA, 1358 bp, Oryza sativa
taggatttgaacctataccaaagggttagaagacctctgtcctatccattagacaatggacgcttttctttcgtattttcttctttcattttgtaaataacctggtagcgaagctgcagcttgatgattcataggggccatggtgtcaaaaccgggttacctaactagggaaaaactgttccgaagctcttccaaagcgtggcaggctggacagcttttatcgaagcggaccccccgcccatagcaaatgtttgttgtcatatttcaatctagggggctgcggcataacctgggtgtggagacatgaatgagtcgaaccctattcatcatgacgtaatgtcaaagaagtggctcagcgaggggctttatgctgattcaaggccgaaggacaaagctcttcctcttcgtgcttgtcctaaataatgatattcactgaggtgtgctggctctgcttcaatctgttttcttgctccatgccaatcgaagatgaaccattcaccgagccgagtatgtgcaagacaagacacgactagataagtcaaatagaagatattgcttttacacgagcaactcttaccttcatgtaggtacagcccacttttcctttgatgaaatgcgaacacaaacttcaggcatcgaagaaagaagtcaagatcgaaatcgaagcattgtcattgggttgaagatcaattcatatcgacaagactttccattcatctttttgttgatatttggattccgttttcaaataaagtcatcttctagttttaaatcacctttagaatcatcagcctctgtccctacactgactcacttatccgggatcgatcctcactacggtcctttatttcgaaacgaggatagggcttgtgaagattatggataccccatatctacacggcgattatatttagactggatataggataccgaatatagatagaatatctttatttgtatctcgggtttgtttcttaacttgtacgtcaaggaaataccctgagacttagtcggttacgattgtattttatctgtactctcatattctgataaggatatgagttataccttgtaatacggactccttcccctatataaggaggggtccgagtccttcctgggacatcaactttcttggagattatacatccaataatacactcggcggattcatccccagacaggagtagggtattacttcttgaataagaaggcctgaacctgtataaatcctttgtctccaaacccatacacttttccagcttgatagccacccccttttagtattgccgaaatcttgtttcgacagttggcgcgccaggtaggggttgcgtcaagcttttcaccgatcagtgcaa

SEQ ID NO: 5922 - DNA, 1501 bp, Oryza sativa
acgtacttgagatggataatttatgtatttcgctatttcgaatacctaaactcaagcggtgctaatttgctaatccaagccttatcaataataccaacacgccatctgatccaagattagcaacctctctttctctaatagagggaacctcactgacgcattcagggctctgcagttgaagcgttcctaccatccatatatagggaatccataccgtcggcttgtcgatccgggatcacccaggatcgggtggaaggtcggagaagccagtcttcagtggtgcttccatggcagttggatagtagatcagagaggcaggccagtagaatatggagttgtttttgttctcttgttattcttttatggctataagtctttctgtcttggattcgtaatgtttggccattaggtttgaattgccttctctttctgtcttccatttgaattctgggacttatcctgcaatttggagagtagttgatatggtctttcttggctttggctttcaaagtgcagttcgaaaagagtgagttgctgtcaatggcgggaatgaaatatataaggatagggtggaaaagagtgctccatatccatatatgtgcttggagggaaggccacatctttaattgtattctttttcgaggtcatcctcttcagcctgtgttagtagtgctagttttgagtttctttttagtaccttccctatttaggggttctatagaaaggcttagaggatcctaaagtgtcagtttatgttggaattgctttgctcttttctttctttgatgcttggaaggaaggcctataaccaatcaatagtaaacatccctcacccaactaccagtctgtttagagaaatgaagaagcgacttgggttgatttagacaatgttatgtatcgagaaactcaaggccactcttcctccgggctcgaccaatcaataatagaacaactcaccaacacaagcaagttgaacgagtagatcaatccatctgcctacccgcttaatcagcgtagcaggcatgcccacgggaggcaccctccaaatcactaaaagcagcactataccaccacaagtagagaatcccaatgcgcttttcactaggaagacgaggatgctattctttaaagaaccgagcttgacaagcatttcccatccatctttccccttcttgatgagcgcaccacgactcattcaaaagagagagtaaaaggaaggatttcccatgccaaaggatcggaacagatcgggtctcaatccatccgtacttgcaatttcatcatgatccttatcaacagagctaatcgatacatttataaacaatgataccttgctttgtgtttcccatctgttcaagtggataatcccgattcggttttcgagggttcgctcgtcatttattcgtagtaacgtcgtattgcctatgtagctaaatcgataggaataggatttctcaaaggaaagggcgggtggacatacgttgcgggtgtccagttggca

SEQ ID NO: 5923 - DNA, 1501 bp, Oryza sativa
  unsure (1)..(1501): unsure at all n locations
gcgcatctcgttccggcggtcggcgaccgcccgctcggcgaactcgcggacggcgcgcgtggcctcgacgagccgccgctcgctgccggcgcggaggagccgcttggccttccagatgaagggcggggtgacgaaccgcaggagcgagagctccgtggcgagctcgaacgcgcgcgcgaacggcacgtcggggaggccgtcggcgaggcacccggcgtccaccccgaacgccacggcgcannnnnnnnnnnnnnnnnnnnngagcagcacctcctggaggtcgacggcggcgccgccgccactcagccgctcggccagcggcacgaggcgcccgtacaccagctgctcgatgctcctcaccgagaactccacgaaccgcgacgagtgcatctcggcggtgtccgcccggcgctgggcgcgccacgcctcgccgtcggcgttgaagataccgccgccgagcagctcgacgaagcgctcccggtagtagggccccttggggtagttgccgaagttggccctgagcacgtgctcgacgttggccggcgcggaggttatgacgccggaggagcccccgccccacgtgccgcggtacgggaacacgccgccggcgcgcagcagcgcggcggagccccactcgtagatgtcgtcgcggtggacgaacagcgtgggcacgatgcccactagcggccacagcaccggcgccccgcggcgccgcgcccgcaccgcgctcacggcggcgctgaacgcgaacagcaccgcgccggccaccgccaggtcgctcgcccgcacgtgctcccgcaccgcgccgacgatcgcggcggcggcggcggcggccatggacgcgatcgccatcgatcgtgtcgtgtctctctccggcgccggcgaagctgcgagactcagtgacccgtttcgatcgatggcgcgagagaccgcgagagactgagctaagcagctgggagtggagcgtatttatagctagggtgcatggcagcatgggggtggtgtcgcaatatgttgtttaattaatccattaattaattgacaaaaaaatagttggaggttggatttattaagtaagctagtgttgattatctttaaagaaaaaggaagagcgagcaattaatctactgtagaaatgatattgaaggttcaattctaggccccgcgcatttatacagtagctaggtaatttaagaagtgatcaacccatggatttaagaatgttaattttgtatagccgcatcgacgacgcctcacgaatctagcatgctagcattggagagaataatatcattaatttcgacggatctgcacacacactgcaacgctcatcgacatgcattggtttttcttacgacagataggtccatgagcaatccgttcgtgctgaaagagcttgtgtcaccgcaccggaaatcatcgggagacgatcgaaacgcgtctggcgtgttgggagcggattttttttttggtgtacaggccaggggcgatctcactgggc

SEQ ID NO: 5924 - DNA, 1501 bp, Oryza sativa
gccgagattgtattagatgtctttttttttgttttttacatagggctcgggtctatttatacccgagaattacaagatacatccataacagacacgactattatctctaacaaactctaagataccataagtctttacggcagacttctgcccaaacatatctctaaggaaattacacagaatatcctaattaatagatacaattgcctccccaggactctatccatgcgtggcaatcatcttgaagcacatcaacttgaacccgatgacgtacaccgagtcatattatcggaatcggctgtatcggctagccccgtccgactcgaactctgccgacctgaccttagccgatttggactgcagccgattcttactctgtttccgcaacgatcttcatcttggattccacttcgatctgatcttcacctccgatgccaatattgatagaatttaccaaaggagaatggaagaatcgagaaagccaggggctgagggcagaggaagcgatggtggacactcatcgacgtaggactagacggtagcattgtggtgtggccaaccccattctcgagcacgataactaagcatgtcggtcattgggggctcaccggctcggggagaagtgaataggaagtgaagggtcacgatggtgcttgaagaggaggaagataaatgtgctattagtgagcggaggaccttgctagagtttcgccgaagtttgtgcgactagatgacacggactttgttcgcattttttcttggtatatatatgaaatttgggctaaccgatctccacacaacccacgtaacctatcgtgccatgccaatacgacatgacccaacatctcattaggctccgtgcttgggatgaaaacggagcggatacagacggataatactcataccatttttatttccatattctttgtcagatacgaaaacgaatacaaatagctcatatacggacgcaaatacgaattatatcgaatacaaataagaatcgaatatgaccggacacgaatactgagacattttttctgtcggaacacgaaaaccacctcatcttcatatataattagttcattttatataaaatatagtatacgtttcaaaaatatttaaaaatttaaataatattaataatatggactagtgttaagagatggcatgctattaaaatctagaagggtagatcgaaggttgtagcgttataaagaaatgaaatatgtctcatgatatcagtggatatccgaatagagaccatgtgcgtattattatctgtatccgtcgaaaaccctaataccatgtgcgtattcgtatccgggagaaaatatcctattcatatccgtatgcaaactatgcgagaattatccgctccgaaaagtatccgtattttttctcttgagtggacggaaattatccgctcgttttcatggccgacaaagtacggctcgttccgtgagccctgccgaattgggcagtgctcaaacgtaactattat

SEQ ID NO: 5925 - DNA, 1501 bp, Oryza sativa
atatatttagtttatttagaaaacgtgcctaataaattagatagatttagtttatttagaaaatgtgtctaataaattaagtgtaaattggaagtgaggtgtttttttaatggactgttttgggatctttttttaacaaatctcgaaaaacaaatatttgctaatagtactatcaaactaaccctcttttcagttggatcacattaccataatttgttatacataccaacataaaattaataaagacagagtagatatatatgtattgtagacattgtatgcatgatctatagtgtgttttgttaaaatatacctagtaaacatgcatattaaaaatatttaatagtaagaaatataatttttaaactaactatatattgctatctttgtgtggcttatatatgcaataatatatggagaatgctttgtataggggtagagggaacgctatttatatttaatcacttaaaaatgatgcaatgattatctcaatttaagaaccaaattggttgtaagattataagattttctacgagtggttcaatttactgctattgacttttttttctattttctcttttgttttgtacaggttaaatttttagttcaaaactaggaaggtagcccgcgcatatgcgcgggcatgtgcgtaaaattttattacgaatgtccatgtgtggatggttttatatcaaaaatatttttttactttatcataaactaaaatttaacttatttaacgttctttgcaggggcggacctagcccaaaaatcgagtgggggcatcttattagaattgatagtgtgcttaaatttttttacttaattacacattagtaatacactaaatattaaatttgagtgggaccccactccatatactgtggatccgcccctggttctttgaacgttcgttacttgcaacatataaattgtgaactaaaaatacttcaaaaccgtgttcttttaattcatgagaaaatttttgtatcgaaacaattgatgtgtttcatatgaatgcccttttttttgttaaattctgtttgaaattttaaatatattcatttgattagtcttggtaaaatgtttggatatttctatttagaatgggttataaacccaacgaaaagaaatttaaaattagataaactttgtttaattttcatttctttttatcttcattttttttggacaaatccactctatgaagcttcttgaaatgctttgatgtatgtaatttgggattaaaatataagtgggttgatcctacaacttggcatggggtaaaggcatccattctaaattatctcgctccaatcaagtaagaaaatttaaaatagaggccatagtattttcttagcaaattaccactaaaccggagtgtcatgtaataattacacgtttctagattgttctatgctatgtcacaaattcacaatgtactgtagcaagttttacccgaaaagtaaatggatacggtcttttaattcctatctggaat

SEQ ID NO: 5926 - DNA, 1501 bp, Oryza sativa
tccttgtggccgacggctctcctcctctgttcgccgccgccgctgcccggctcccctcttccgtccagatctaggaggggaggggccgacgttgtctgcgatggccaccaccatcagctcctcctccgccctgcctctgccaccgatggatagatctaggaggaagggagggaggattggagcgccgccgctgcctcccctcctcgtcgccaagccgctgctagccctcatcgtcgctgtcgttgccaggctgggagagggaggaaccaaggtgccgccgcctcacctcgtcgttgccgccgcctgccctcacctccccaagatcggccggcggcggatccacgcggcgtcgtcttcgtcatcgcagccgacagcgagacccaggcgtcggcaccatcatcatcgtagcagtcgtcgtcgttgccgtcgcagctggtagtggacctcctcagagtcgccgacgcgcatcagttagaagagagagagaggggggagggggagggaaatgagtggtggaaaggataaggatggtagaggagaagataaggatgcgacttaatattttttctgcaggcatgatttttgtaggcgaaccacgtaaggttccacctgtgaaatcaaatttttctagttggacgtccatatgcgaaaataaaggaaggcgtccacctggaaaaattgattttcacaggcggggttaaatctagaggctctttagctattttcgcaaatagttataagagggtttttttatgtctggaaaaataaaaaaccaacgttggtaaaaaaatcatttttctactagtgagcgagcggaggtgtgtggaccctgcaggaggcgtgtgtgattcctggcagtgcgatggtcctggcccgaaacggggcttggttcctacgtggcaagctaagatacaatccatggtatagtggtataatacgctgtatgcaaagtggcctgtacaattagaaaggagagatatagtgaagaagggagagggtgacatgggtgttcaagttttctcgtggaaatgtggaatcgatcgttcggacgaaagcgctctcggattattgtttgatactgaagtcagtcaacgtagccactagccagtactacatggtgtgctcagtcaacatagagtaccatgcagtcagtcaacgtagccccagcgaattggaagattcgtttcgatcttcagacgatactatatgcttctatgagatgagcatcgcatgattaattgttccgtgcaagttacatttgatttgcatgattaaactgtatatgtaaatagctttagttttaatgttctttatccccttttatatgtatacacaccctcggtccgaaaagacgttcctagctaaaaatgttctttttcaaagggtatgtatgtctgtcacataatttgataacagtctaagtttaattgtcaataaaatcaatctggtcgtcgaccaatattaagtactcattagttaagtctccagatgattgcaatct

SEQ ID NO: 5927 - DNA, 1501 bp, Oryza sativa
ccgcgcgccgctgcccatcgcatcccctcaccggcgctcgcctctctgccatggcgtgtcgccgtgcgcggcgctgcctgctgctggccgacgaagagagagaaagagtgtatgacatgtgggtcccaccattttaaaaaaaataaaatgctgactggactgccacatcagcaagtctatcccaaaaccacctaaaacagtgctcagtggggtaatttgcccggtttcaatagttgagggtgtagaatgtttggtttttgagttcgggggtgtaattcggtcgacctcgatagttcaggggtgtaattcgtactttttccaaaacataatagcaacactttaaacatgttttctcgtaaattatactccctccgttttttaatagatgacgccgttggctttctctcacatgtttgaccatttgtcttattcaaaaattttatgcaaatatataagatataaattacacttaaagtactatgaatgataaaacaactcataacaaaataaattataattacgtaattttttttgaataagacgaacatgtgagaaaaagtcaatggcgttatctattaaaaaacggagatagtatatcatatctatgatctgatcacataattgtatctgttacaatatatctttataacaaggtctattatatttcgatgaaagtattttgaaagttttttcagtgcattggattatttagtgttgcacatagtgttatttatatgtttcattaagtattgttttatgttttactaattcatttgttaatgttgtacacaatatttttttggatgtttcactcattattttatgatgtttcacaaaaccataacttgatgttttatgtgtgacataaaaatgtttcaattaagttaaatattttatttttgtttcactcattggaattaattaatgttttatgtagtggtttttagcgctgtagtcagtattttttcagtgttgtatctcactgaaacatttcatggagtgagtcaaaatattttttttatatgggatgaaacaaggctagatttttaatatacgtatttttttatcaaaatataactgtatttgatcttgttataaagattaattgtaatgaatacaacaatatagtcgaattattgatcggataattaatttagtgagtaaaatcatttaaagtttgataaaaaaagtattagtatgatgaggagagagtagtcgaggagaacatacacgtaggagcttgtggtcctgtacaagcagctaggaaaaatggtactcctacatgaagtccgatacatatttgcttccacaataatctaatgaagtcttcaggcctgctgctgcacagcacaagtgcagaactaaccagccagcaccgcctctataaatacatacatgttgccactcgcacaattgcactgcagactgcagtgcacatctgcacacgttctcgccaatcgccgggcggccatggcgatgaacttcgagatgtggggcgcgg

SEQ ID NO: 5928 - DNA, 1501 bp, Oryza sativa
cataggcacatcatttgagatctggaagttgaaagaaaatgataacagacagtgatatcaattcgtatgcgtactagctaagacgagttggcgtgacaagattggaaacatattgaacacccgcagaaaagcactgtgtaaaaactgaaacgtgttatactctacagaaacaggacaaccgactctgaaagatgcaccgattctctgatttttttgcaaggctattctgtgacctgaaatttcagtcacctatgctgtacacggtgctttcattttccccctgtaatatccattttctgctcgaaacattggtcctattaaatcaacctctgaccatgactaacatcacttcctgaacaatgattttcgtagaccaatccccccgaacactgtcgatcggaacaattcgacattctgcagtttcctcctgctgcaacactatctgaaaatcggaacgattcaggcaccgtatcgttgtctgattcgtcgattcgttccatcattagtgtgttcacaacgcaaagacgatgactgtagtagtatctgcgtgctgattacatccaaatacagaatgatcatctccgagaatgcgaaaggggggcaattgacgtagccgcccccgccgttgtttgcttccccatctcgcactcttccgagacagccacggcctacccactcacatcgcataaacaaaaaacgagtacttacaaccatacgagtatacaccataataccatatactccacccctgtatcccgataatgaaaacgaaatgtatgatatagtaggcatataattaaaacatgcaacgaacaaatagaatactagtagtagaatacacacacgcacattgcctgtgttgttacatgtgtacaacagcttaacctccaaaccccccatggaagctttgcagccttgcatgttactcatttgacccacccctcagtagtagtactaccctctatctctctatatacaaaatgaaagggaatgagattcaattaagcagctagaacaggggggagtttacaagtgttggtggaggggaagagatcttgcaaccataaaagaagaaagcaggcgaaccaaaccaaacataccaaagggaagcaaagaaaagggcaaacatccagcaaaagtcaccaaacttgtaaagggatcgacacatatataggagagcgaggtgtccagtcgagaaggacagccaggccaaggagctcctagcctcctagcctacacagagctaagcaaagaggcaaagagctcagcaagaagctccattaatccattccatatactcatatagagaggaggaggaggaggaagaggaagagaggggaagcaaagcaagaagctttttttacttctcgggtttgcaagccaccgggaaaggccggggcttggtggtggtggtggtggtaagttttctttaaagcggcggagcgggaggccttcctgggcgctccggagatgcagcagcggcggaagtcggtgttcgcct

SEQ ID NO: 5929 - DNA, 1501 bp, Oryza sativa
cgcatcctctgaagaaacaaaattacaggtacctttcttgagacacaacatacgttccagcagcacgttccatttagcatcctgaaggacgatttggccaaagtagtaaggcctggtttagttctcaattttttttcctaaaaacatcacatcgaatcttttgacacatgtatgaagcattaaatatagataaaaataaaaattaattatacagtttgcataaaaatcacgaaacgaatattttgagcctaattaatccctgattaaccataagtgttacagtaacccatgtataggggtggataacgagccagctcggctcgtttgagctcgttgtcttaacgagccagctcagctcagctcgttaatgttaacgagctaaaaagctaacttggctcggctcgcgagatggcttgttaagctcgttaggctcgttaacgagctatatctcattaatatcatattaataaattcaaatttaacattttattatgtattaacataataataaacactaactaatataatactcactgaatatgaataattttgatataattaaaagactaagcactagtcaagaaactccttaagttcgtgaagatatggtgatattttatactaacgagctaaacgagtagctcacgacctaaaaggttagctcgactcaactaattaagactacgacttcgaatcgatctgagccgagcttgctacgagccgatccaagccacgagtttcaagctttttatccacccctacccacatgtgctaatgacggcttaattaggctcaaaagattcgtctcgcggttttcggtcgagttatgaaattagttttttcattcgtgtccgaaaacccctttcgatatccagtcaaacatccgatgtgacatccaaaaattttctttacgcgaactaagggggtgtttggatccagggactaaactttagtccctgtcacatcggatgtttggacactaatttagagtattaaatatagactatttacaaaaccaattgcataagtgagcactaatttgcgagataaatttttaaagcctaattaatccataattagataatgtttaatgtagcatcgcataggctaatcatggattaattatgcttaagagattcgtctcacgaattagtccagggtttaatacctgtaaatagtatcaaaacatctgatgtgacagggattaaaaagttttagcctcatccaaagagggcctaatgcaacacaataatcaatatatcatgtttaaatactaatggtttaatttaagtgataatgattttcttgttttacatagccgtatttaatattttatcttcaatgaatttaaacggccttagcagcacatctctgacaatggcagatctaccgttggaggcttgtgcaagccccacctccaattgctactccctccatcctactccctccattccatattataaggcacaactattttttttgatgttccataatataaggc

SEQ ID NO: 5930 - DNA, 1501 bp, Oryza sativa
gccgccgccgcggcctcctgctcctcctcacggtgctccgctgggtcggccatggcggtggcgcggcgggagtagggtttggggttgcgggttgccctggcctcctcctctgctgctgctgccggttgctgcgcgtagtggtggcggccgccgcgatggtgaggggggagagagagagagagagagaggagaaaggttaaaaaaggtgggaggagtggggacgtgggcagccgaaagggctctcggctttgggaaagtgggggcgtctctcgtagggttgcgtacctgcgttacggcctgagatgggttttgaatttctgggatgttggggtgaactggcaagcgacgggtggacacaggccgtcgtggttgggatgggccttggcctggttggctggttctaccggtgctcctttggcccagatgccaatgttatttttttttttatttttggaaaacaaaggcagagaaccctgctttgatagaaagcaatagatggtttttgccggtgaccggctacagttttagccaccaggtgaccagggcacgcagaaaaaacccacaagtgcacacagcagctgccaaaaccactcggggcaacaaccctccccaggtcactggtacatcccacacaatcagctcacaccctcccgcacctgcagggagccagcagcctcaaacaacaagatatcatgagctccagtcttagggcctgtttggcacagctccagctccagctccacccctcctggagatgaagttcagtcaaacagtttcagctccaccaaaactgggagtggagctgggtggagctctctcacaaaatgaactagagttgcggagctgggtttaggcagctccacaactccactccagactcaactcctggagttaaatttaggagttggagctgtaccaaacaggcctttagtgtgtccttcggcttcgtcaaaatcctccactgccacagaagagagatccagcgacagatcacagtttgaggagtgccccccaccttaggtttaaaaatcatgtcatttctagtgagccaaaattgctaactcctgcggctagtaacaaaacactcttctgtataagaatcaggaagcaaggtggaaaaaaactgatccaacgaagagggggacaaaatttcatccaggggcatctaatccttgctaaggggcaggtaaagattacatgtcgagcattctcagtaccaccacataattctcaaaattcagaacctccccagttatttttgttttgagttgttcataggaaatgtttctgttcaaggggaataggtgctttgtcagagcatggccatctttgggtcagttacagatgcaacagtggacgtgcctaggatcagcgtacatgaatcgaccatacccaacgggtgcgcgttcacaactcaatcagatttctgctaaattatttcggcaaatcggtgggtcagttacacgatcaaaagacgtataccatgctcactgagaacttg

SEQ ID NO: 5931 - DNA, 1501 bp, Oryza sativa
gtgcttcatccccccttttttaacctgtatctctactggacgtatggtccaagttctcagtgagcatggtatacgtcttttgatcgtgtaactgacccaccgatttgccgaaataatttagcagaaatctgattgagttgtgaacgcgcacccgttgggtatggtcgattcatgtacgctgatcctaggcacgtccactgttgcatctgtaactgacccaaagatggccatgctctgacaaagcacctattccccttgaacagaaacatttcctatgaacaactcaaaacaaaaataactggggaggttctgaattttgagaattatgtggtggtactgagaatgctcgacatgtaatctttacctgccccttagcaaggattagatgcccctggatgaaattttgtccccctcttcgttggatcagtttttttccaccttgcttcctgattcttatacagaagagtgttttgttactagccgcaggagttagcaattttggctcactagaaatgacatgatttttaaacctaaggtggggggcactcctcaaactgtgatctgtcgctggatctctcttctgtggcagtggaggattttgacgaagccgaaggacacactaaaggcctgtttggtacagctccaactcctaaatttaactccaggagttgagtctggagtggagttgtggagctgcctaaacccagctccgcaactctagttcattttgtgagagagctccacccagctccactcccagttttggtggagctgaaactgtttgactgaacttcatctccaggaggggtggagctggagctggagctgtgccaaacaggccctaagactggagctcatgatatcttgttgtttgaggctgctggctccctgcaggtgcgggagggtgtgagctgattgtgtgggatgtaccagtgacctggggagggttgttgccccgagtggttttggcagctgctgtgtgcacttgtgggttttttctgcgtgccctggtcacctggtggctaaaactgtagccggtcaccggcaaaaaccatctattgctttctatcaaagcagggttctctgcctttgttttccaaaaataaaaaaaaaaataacattggcatctgggccaaaggagcaccggtagaaccagccaaccaggccaaggcccatcccaaccacgacggcctgtgtccacccgtcgcttgccagttcaccccaacatcccagaaattcaaaacccatctcaggccgtaacgcaggtacgcaaccctacgagagacgcccccactttcccaaagccgagagccctttcggctgcccacgtccccactcctcccaccttttttaacctttctcctctctctctctctctctctcccccctcaccatcgcggcggccgccaccactacgcgcagcaaccggcagcagcagcagaggaggaggccagggcaacccgcaaccccaaaccctactcccgccgcgccaccgccatgg

SEQ ID NO: 5932 - DNA, 288 bp, Oryza sativa
tgagttactaacagataagagtaacatttgtttggcacttcccttattggcccatgagtaaatgcattactaacagagacttggcccacaatgagttactaacagataagaatatcgtttgctagccacatctcatattggcaatgagtacatgcgttactaatagagactcgcccatgagtaaatgatttactaatagataagaagcaacatattcatggaataaaaaaaattattgatatgtattgggattatccaatcatggagggagtaaaaaagttacttagt

SEQ ID NO: 5933 - DNA, 362 bp, Oryza sativa
aaaaccataatctctagcctgcttcttgattgctaataagggtttcatcggggtttcagctggtgagttatctggacgttgcatcggctcataaggattgcatatacatataagttggatttagccgatgacaacaaaggcttcactgtttaatctaatcttgtggatttcatgacatcggacctccatccgatgtgtgctttgaccttcggatcgatgcttatttatcatatcattatttgctgattggtttatactggattatattgttattttattacatcgtcgtcagccgattgcctttatatcattatctacattggacatatagccgattgcttaaaccctatcggcatcggctg

SEQ ID NO: 5934 - DNA, 1501 bp, Oryza sativa
atgaaataagttcatctgaggtcgcttatattgatagcgagttcgattttcatccttgaaccgtaataccagatacaatgggtccctcaactgtcaaaaccggtgctatataggtcccatggcagtttggacggtggtttcagctgacgtggcacctacatggttaatttgactcggtctttatttgacgtggcacataaagcaaactttaacaatttaaaaaataaaacaaaatatgtgggcccacatgtcagtcaaataataagattaaaaatagtggagacccatatatcagtgagccccacttctttacctcatcctctcttctctatctctttccattctccttctcccctcctccccttaagctttcccagatgcggttggcattgctctggtggtggtagtcgccagcggtggctactgtgggcaatcggcgaggaggtggctctggtggacttaagctgcagatgacaagaggttgaggcgaggaagccagtgagcaagagcagaggcgcagtagaggtcgaatcagcggaggtgcggcggacacccgcgcgtgtggagagggacgaggtggggaggccgacaagctcctcccaagtccaaatccgccgttggagacaccacctccaccgcacagagagggaggaggcggggaggacggtgaggggggggcggggaggccggtgagcaccctgaacagccccccgcaccccgaccatggtgggaagatgaagccactcctcttcttcgccgatagcgatgccttgaggtatagccgccgccgaggccacctgacattgccgtcgggattgccatctcggtcgccccatgctcggcctctccatgtttgacccggagctctgcagcaccacgaacgagttgttgcgccacgtcgatgtgcgattagaggggaagctgctggtgacgctgctggactggttagcactcgtgtcgatgacaacgagtgggggcggctgcagcactgcagcagggagtggcacctggaagagggcgtggccgcgatggtgaagaagggaaggaagccggttgacatatgggtcccaccatgttattattatttttttatgtaagtgacacatgggccccacagctttttttatcaaaccgccttgtaagcgtcacatcaatgccatgtagaacgaagacctagtcaatgaagccacataggcaccacatcaaccaaaaccagggaaaatactacgagagatctcgtttgcactgattttgtaagttggggtcatgttgtatatggtatttgggttaaagaacgaaaatcgaactcgctgtcaagttaagagacctaaaatgaacttattccaagttaaaatagtgccaatcatcaactaaggcccagcccatacaatctactccagctgaaaaggcccaattgggccgacaagtcttcccagcaaattccgaacccttccaaaaccctccgactcctaaaaaaaaaggtttaaaaagaaaaagcggg

SEQ ID NO: 5935 - DNA, 1501 bp, Oryza sativa
gtatactctgtaccacggctgttcagtaccggcgaatatgtaaaacgttttcgtgattgggtgccacagatcagggtaacgaccggcatcacgtactgttgctcagtgccgtagcaccctgctcatagttactccatccgatccgctccataaaaaccgaatatattaaatatgatatattctagtaaaataaatctgaatagatatatatttagatttataataatagaacatatcgtatcggtggtactaggttgagtatgttttcattggacgaactgatgagtcaattcaacactaacaccatcacttttattacgtacgtaggagtacgccggtacgcggtggtggacgtacaagtgcgcagcgctggtgcagtgaaattgtgaaaagacgtaccaacacgtactcctgaagctgccggcacgtgctagtaaaataattcatctgtgtcagctgctgcctactactacctccgtcccaaaataatacagtcatgagttttcgcgtccaactttgatcgtccgttttatttgaaatttttttataattaacatttttgttgttataagatgataaaacataaataatactttactcgttacttatgtttttaattttcttaaaaaaattcaaataaaatgaatggttaaagttgggcgctgaaaattatggctgcacttattttgagacggagatagtactacgtacgagtactatgcacctgcaccttgatttgtcacgtgttgttgttgtccacggtcgcaagctcgctcgacccgcttgcacgggctggccggagaccacgcacgccagtggccgcgtaggcgttaaattggccggccggccgggctctacgataaatgggctcatgggtcatgagctaccaatccagcacgacagtagcacaatggctccagcggcacggccgcgcgggtcctccacggcaccagcgaacaccgtgggttatcaggtattctttttttaaaaaaatacttcgtagatagcaccgttgatattggaatatagattttgatcagtcgttttattttagcttttttatgtaattgcataagatataaatcatacttaaaatatttagtgataaaacaacttataacaaaataaatgataattacgtagtttttatataaaataaatagtcaaatatgtgtacaaaagtcaacaatattatctctactattataaaaaataaaaatatttttatcgattgtttgatacattgttcgattcgagtacgatacgttgtccgacttcaaattcgtatcatattcaatcgtcatccaaaaaaatggtccgtcatcgtagggacactggtcgcgtgcgctcagttcaatacatgacatactcatgtatatacttttgtgtgcgcgcacgcgcacacatatatgtatatatatacatgtacatatgtacatacatgtatacatgtacatatgtatatatacatatgtatatatacatatatacatatatacat

SEQ ID NO: 5936 - DNA, 1501 bp, Oryza sativa
caatattataacataaattagagaaatgaagtcaccagtttctagaatgaaatttaaaagagtcacataattagtctcttcatatttattttggagttataggttagaagcatttttgtttgtaataaaatagaaaaatcatactagatttagtaaatacatttcccctaagtaacaagatagtatcaaattccagcacagcacagcagccacaaaagacaagcatttttgtttgtaataaaatagaaaaatcatactagatttagtaaatacatttcccctaagtaacgagatagtatcaaattacagcacagcacagcagccacaaaccattcctaaaccaagcacctctaatcttcgaatcccactgactagtttttcacatagtccgtatgttactactaagacgccatttcagacatcctaattatctctggtacacacctctatatgtacaaaacaaaatgttaaaaatgtaaatgaccctgaggtgctttcaatgatgaatctaccggtaacattggcatgtgtatatcagtggacaaagctcaatttgcacacaagcggagtaaaacacctaaaattcacaaatatgctaaaccttcagtaacggcggttaacaatagctactcagcaaaagtgaactctatgaaggtaggtaaccaccaccatcttacagatttttttttttttggtttttggaaattgaagcatagcgagcatcattacactaaaaacacacagatgctatgaatgattaaacaaaaaaaatcgacaggaggatacagtaacaggaacaagaagggaagggaagagagcggcttattacgtcgtggtgttggagccgacgacgcggaccttgccttcctcgccttcaaccctctccagccaccagtcgtcgagctcgacctagatgaacacacacacggaaagagaagcgggatgagatccagagcccaccaacgccccccgcgccgacgcgcttacgacgatagagggaggggcggatcttacgcaggcctgcaagtaggacacggcgggggcctccttcgccgccgccgccgccgccgcgccgtcgccggctcggggttgggtcgccatctccggcggtggagaggggaacgagttttccccgctttttctttttaaacctttttttttaggagtcggagggttttggaagggttcggaatttgctgggaagacttgtcggcccaattgggccttttcagctggagtagattgtatgggctgggccttagttgatgattggcactattttaacttggaataagttcattttaggtctcttaacttgacagcgagttcgattttcgttctttaacccaaataccatatacaacatgaccccaacttacaaaatcagtgcaaacgagatctctcgtagtattttccctggttttggttgatgtggtgcctatgtggcttcattgactaggtcttcgttctacatggcattgatgtgacgcttacaaggcgg

SEQ ID NO: 5937 - DNA, 288 bp, Oryza sativa
tgaccggcgggaggacgcattgaccaaggtgagggagaaagagcccagaggacggtaggggaggagggatagacccatggaagggggtgtataatagagctatatatatatatatatatatatatatatagtgaatctattctacaccccctcccatgggtcaaacccacctcccctaccgtccctagggcacaaacccccccacctcggtcaaagcgtcctcccgccggtcaaacccgcccaccaatccctcccccgcccaccactttactgctctcgtcttgtagg

SEQ ID NO: 5938 - DNA, 826 bp, Oryza sativa
ttcctgcagccacattgagcaagatgctctctcataaaatcagttaaatcttgtatactttgtgttactaagttctatattataagatggagggagtacaatttagtgatgggatagctaggatggtggtgtagtttagctttatagtcatatatatgcacgatttatatcaagtacaaatgtacaattagaaacgtgatatgatgctcgtgtgtgtctttatagtcgtatatcatgcatattcagtcagaacaagggaatttatggtcataaatgcataaaaaatgatataataagtacaattaatacttaagaatatcatgcagcagtacattttttattttgtatatagaatacatgatataggtactatcgcaactgttaattccgttgacaagtttctcccgcattttttgggattaaaaaacaagagaaagtttcagaaaacctcaagttttaagtcaaaattacaggtatatccacatataacatgacttatagcacatgatttatggtatatatatataagggtttcatataacaagtgaacaagccatacatatggttatgcttatcaagttataataaatatcatttttttaaaactctgatcataaaacatgtggtaaaatttacttaaaaatagagtaaaatttgaaaatcccacgttttataataaaagttgcagaaaatcataggtattatgacttgtgacatataactacaagtatatataattattacaatgtttcacaaaacctcaccctgtatacgttgaggacgaatttactaaaaatttcaactggcccggggtacttcgatgggt

SEQ ID NO: 5939 - DNA, 253 bp, Oryza sativa
tggatcccccttttttaaaaaaaagataaatatttgatgattactgatcattatttctccatggatgtacatatttgtgtcttccattgataaattcaaaatattgttggttaacactccccaaggcaactctcacagtgacaaagctaaactttccagcggagttaaaatcactaaaaatatgcaatatggtatttatatatctgtttcacattgtgcggtttatggtttgagttatattttgttctgcagg

SEQ ID NO: 5940 - DNA, 1501 bp, Oryza sativa
gattcagcctctgattatatctattattaaagatccttcgtccttttttgaatagattactcagctaaaaaaaatctattagtcaacaaatcttccgtccttttaacaaggataaggattttcatccctcgtggggatgtcgcatgaggattaataatcgaactaattgaaaatgtcacttctttgtgactgaaggtagtatatgtcacttctttgtgactgaaggtagtatatttaaagtgtttagtcatctccttgtctctctactgattatagactgcatagaatatgtggaatacacatattttcacattttcccattgacccaaactgttttactgtcttctcaccttatcttattactcaactggattttaataaaatatatttgtcttggaccatatctcttgttttctctttacatttcaattgtaaaattggactacaagttatcacatattacaaactagatcaaatatgagttggtacaagctacgaagagttgctatatcatagatgctgaaggttcatttggacatgttaactttattgcaagggcaatgcatgaggattctgaaggtgaactcttctatgctgagttgaatcctgaagatggtactatggttccgacatgtttctgcttgttacattaagaagataaagttggcgagaatattctttaatgctttttgcacaaactgactatattcattatttgttttgctaacctaacctttaaattcataggtgggttagaatttggagacaatgaaattagtgagccttaattggagattgacatgaagttttgttattcgtgtagttctgacctactacatacaaagaacagagcatcctacataggtggacacttcacctgtccaggttattatgattttgattgacactgcttatgaattgagttagaccttgcttttatggtacgagtgtggattgagttagtgattattaatagattgagttaactgtttgtgactgtgtaaatataagagttgggttgtaaatttttactgctagtatttgtctatacaattaaacagaaatgacatatttggttgcatgttagaaattttgttgaatatgcactgaattatattttgttgcagattttaagtcaactatctgcccatttttctcaacctaaatttagctgaatatataagtacaagtgaatgtttggttttgaaaattctatatatactgccatatcgtgcattttgtgcctaacaaacagaacagccatattgttttttcttgtttcattctgcatagatcaattcatgagttcttacaatattcaagcatttaattacatggaagtaaatctaaaatttaacaagagtatataggtgctacagtacagtcagaaacatggtgacatggtggtgtgcatgcgcagctcggtggagtagaaccacgaagcctctgtgccggctgcctttgtgtcaagactaaaatgaatccaacctagaaatggaga

SEQ ID NO: 5941 - DNA, 1032 bp, Oryza sativa
caattaatatattgcttttactaatccatcaattcattgagtgaaccacattgttcgacgtgatgcagttgtctttcgacaacaatgcaattaaaagaaatatttcgctatagatatatcaaaatctaatataggttgggaatcctaaaagtttgtaacttgtagatatagtataattatagtgtaattgtattataagtttgtaacttgtatataactatactacaacttaaagataatcttacagtaacaagctattttctcgaagcggaagtagtgacactgaaagtcctcaccagtaaaataaataagtcgtgctatgaatttttcttcccaacttgcatgaatcttaaaataaatctaagggtgtaaaattatgtaaaagctacatacaagtaaaatattgtagttacatacgagttataatgtatttatattttacaaaaatcgtatgggtaaataatcaatagtgattcagcctctgattatatctattattaaagatccttcgtccttttttgaatagattactcagctaaaaaaaatctattagtcaacaaatcttccgtccttttaacaaggataaggattttcatccctcgtggggatgtcgcatgaggattaataatcgaactaattgaaaatgtcacttctttgtgactgaaggtagtatatgtcacttctttgtgactgaaggtagtatatttaaagtgtttagtcatctccttgtctctctactgattatagactgcatagaatatgtggaatacacatattttcacattttcccattgacccaaactgttttactgtcttctcaccttatcttattactcaactggattttaataaaatatatttgtcttggaccatatctcttgttttctctttacatttcaattgtaaaattggactacaagttatcacatattacaaactagatcaaatatgagttggtacaagctacgaagagttgctatatcatagatgctgaaggttcatttggacatgttaactttattgcaagggcaa

SEQ ID NO: 5942 - DNA, 1501 bp, Oryza sativa
gtattaatctatcttgtcaatttatttttatttttttgatgactatttagatagcatatgcatgaaagatccccttaagggatgaatacacccttccccgctatcgggaggaaggagcggggagaggaggagtgggggagaagaggaagttgtcgtctttgcacgccgccgctgggagggaggagaggggagagaagtgggtgagaggagtgggagaaagagatagccaggagaggagtggggtgatgggaggagagagagagagagtggataataaataaaaaaaaaagtgggaattttctggaggtatttttgcaggacgtgactccgacttagccgcccgatgggaggaggttaaaatcgggcgctgatgtcagcgcccaatttacgtgtaaaactactttaaactgatttttctcttaaattacttattcaaatcatgatccgattgcaccattaaattcattgtaattaaatcttcaaaacaagaccacacctggatatattccgacgaaatttttttagcttattattgaattatttttaaatgttgcacgatgttccaccaggtatatcggaattgtttcactaagtattcaaaaatgtttcactcgtttaaatcgggtgttatttcaccttatataaaaacaatgtttcagcaaatagcgaaagaatgtttcagttcactgcaacatttgatctatacatagtgaaacattataaatacactaggtgaaacatttttcggtggaaaaaaatgaaacgaattcccttacttgggggtttccaaaatatgtgggttttttttgttgcaatggaatacttcagttcactgcaatattagatctatacatagtgaaacattgtgagtacactcggtaaaacattttttgtggaacaaaaaataaaccaaattctcttaatagtgggtttccaaaatatgcgggtgatttgttgcaaaagaatattttaattcactgcaacattagatctatatatagtgaaacattgtaagtacactagatgaaacatcttctatggaaaggggagggacaagtgggtggatccagtgggggtgcgcacgtgggaggagggggaacgaccgattttcccacctcccccgtcgactgatcctaatcattctcctatttttgcatgcgggcgagtaagagccctttgcgtgcggatattttaagtggtcaatttggaaaatttgatttttgcatacatattttttaagtcatatagaaaaattagagtcgatttttgcagatgcggaactcaacctattaggatgctcgtaaaaaaaatcatttttaggtagtgattttccctgctctaacgttggaaagaaacgtgcaagttggcttgctagcttgtgtacgtatcaagtgtcatagtggatgtaatggagtaattagctaacctaataagatttttttttaaggaaaaaagcctaatcagatttggatggactcatggaggcgacatcgcgaggcca

SEQ ID NO: 5943 - DNA, 409 bp, Oryza sativa
cagaactagatatttgaattgatttacaaaaccaggcgcggagtttaatttatagtgtttcagagtctctcatctccttcctgttcatggcagggtatagttaactgaccatttttggccttactaaaaaacttggtagagccaaaaccttatcgagtttcggtagtactaaatttattatagtaaaacttgtactcgtgtatgtaaaatttgacgtcatacttcctattaaagttgctgaaaatatgataagataaaaatttgcttcgactcaaatagaggaggaaggaggaagtgcccaaatgtaactttgttttgggccttggaagctactacaggaaggaaggagagttattgggtggggctgggccgtcttaattacttagtagtggtggtgaactcctctcat

SEQ ID NO: 5944 - DNA, 460 bp, Oryza sativa
caatatatattggagtgtttaataaatacccaagctaggaacttaatcatatttactatatacggctatgtatatactttatatagatatgtacttgtctttctctctagactaaaacgaaataattacgaaaatgaagcccactggtggagatttattgagtgcataattatggagaataatgtgatggtctgaaggagggcaacaatatttttcgttgagagcgtgagaatgacattttgacaagtataggtacaactcacctccccggtcgattatattgcacccatgcattatactatatggccccatgcgttgaataattaagctacatgttccccgaaagtgctacacatttgtctgtgtaaagtgaaaacaaccaaatattgacttttagcttagtgctatatatatactatgtgatgttcacattatttcccgatagatagtaaaagtgtga

SEQ ID NO: 5945 - DNA, 852 bp, Oryza sativa
agtcactaaatatcatggctgttaaggcgtcgctatggcatcgctatagtgctagggcaccctgagggggtcaaggcatccctccgccttagggcttaatgcagagagggagagggagaggtgaaggcggcagcaactacacccttttcccttttctctgctccatgtcatcaccattttgctcccccttagctctggtttccactctcttctctcccctgcgccagattcatcttgactcaagggagcagccgccagatccatccaagggaaggagcacatacagagagaagcacttgattcattctgaatcagggggaagggagcacagatagaggaatagagctagcatgattaagaagagccggtgcgaggaagaagcgatagagccgtgaggaagaaacgacatcgggggcggcgctgtgagaggagagacacacctggtgcgggtgttagggttatttctttgtctttgggctggtatgaaggatattgggcttttgtgggctggcctgctaggctggttttcttctgatcgctgctaaccacataggttatggcatcgccatgccttagcgttttactgctatagccttaccccttaacaaccatgctacatatatggcaatcatcttgatatgataatgttcttggcttattgcatagttagtgcacactatgttgtagctggcttggttcttcatcagctagtatgccccatctgaattgctaccttttgtctactttgttcatgccaatttggctaatctatgtagccaggcttttacaggtatttcatggattgcgtagttccttgtatactgtattcatgccaattttgttcattgcagg

SEQ ID NO: 5946 - DNA, 1501 bp, Oryza sativa
ccacatcagtgaaaccacatatccatacttttacacggttttgtatagtttatgggtgaagatttctaatattggggattagggaacttagacagactcgtgtaaagtgagggacgtaaggtgaacttattccccaccaaccgcactgcactggtccgtgaattcggcccgttccacgtgctggctcagcctggctgggctcggcccaatgcagcctacaggccgtcccttttcctttttcttctagaaacggcccaacagaatccgtggtagaaagaattcggaataagttcactttgggtccctttatttgttgcccagtccgattttcgtcccttagtcacaaaacaggatacgacggatcccccaacttacgaaaccgtttaaataaggtccctcggcagtatttgactccggttttggctgaggtggcgccgacgtggcttcttttgactagatttttgtccaacgtgttattgacatggcgctgatgtggcaattagatccgaaaaaaataataaaacttgtgaggcccacatgtcagttgcacacacaaattaataaaaaaaaggtgggcccatgtggacccacacgttatcctcacaacctcttctctctgtcccctctctctccctcttgtctctctcccgctcatgggcggcggagcgacgaggaggcgcggctggaacggcgcacgggcggcccgagcgacgaaggaggccggctggagcgggccacggcgtggcggcgctggggggtgggggtggacggaccgggtgccccggcgcatggcgtaaaacacctcctgctcgaacgccgggcccgcgtcggcgaggaggcggtggacgagcaccagcatcttgagcgtgacgcccaggcagcgcgacagcgacgcgacgcaggcgtgggagtggagcgtgagcgcaatcacctcccggacgtggtgctcatcggcggggaagccatggacggtgtgggagaggtcacgcttgacctcttgacacatggatactctcgtttaattatcgcgttattacaaacatggttaattacaacttccaaataaagatcaaagcagacatattatgttaaacttgtgcctgtaaaagctgttttattcagttaggatagtactttcctttcatacacgttatgtgttttagccttttaggatagctaatacttcctctatctacttttgatagtcatatttcatctttgcacatagaccaaggataagtaattctacttatcatctatttaaacatgctactagtcattcctcgtaaataaacgattcattaatatttacatttttcaatgctcatgtagccaatcatgtgtggaagaatggagagtcgtgcattaaatccgagaaagttattaagatgataggttgttggattgaaatatgtctatcaaaaataaaattttcagatttggaaatatcactatcaaaagtagatggagggagtattattacttctagtactagaacaca

SEQ ID NO: 5947 - DNA, 1501 bp, Oryza sativa
gtactgcttttaataaagttctatcacttgtcatcaaggaaactgtgcacatgtatagtaaggagaaacttatctgaatgttcttgtagataaggaaagaaagaagttgagtgaaaataagtagttattaagagtttgtcttgtggattttcagtctgtgtacagatgctaaatatggactgaaactagtcatgtgatcaggaacagccattttttagttgcatgcatagtacatactcatgctcaatcttgatatggataagactggttttatgcatcctcagtttgaataactcggttgctttttttttctttattttgccctggtattagtgttgaggggtttaatcccagatcatctcagtcagctcttgtcattatgagaaatggggccttcgatttaagacattcttacatgccttgtgcctactctaaccgtaaaagagttcacttgtacattagtaccatatcaagatacaatgcaaacactgtttccattaagagcaattttacggtccttaatgaggtaccatgaagtaccattttttctattgtaaatttggtacctcatggtacctaggtactatgaggtactaaaatttacactaaaattttagtacctcatggtacctcctcaaggaccgtagaattactcttccattaaatcatgcttccggtttctgctcactatgctggtttctatgagtttttcattttcttctttaacaaaagggtgacccagatgtttacatgatgtctgaattgagcggcttgcgagttacaatatctgtacctaactgccttattattttgtctggtccttttgcaaattcagatgccaatgagttgagattccccaatgttggtgcagtctagaggaagacagaagtgcaggagcagaacatctgacagtcactcccccattcatcgtttcagaatttttttgctggctcagaccgaatgacaggagaaatcaatggaataggcttcagaaaggaaaccaccatctgttctgtttcccggttgttagctatgggatgctctgatgtcttgaatgcctgaacatcgcgttctgacatttgctgtactttccattgtcatctgtatgatatgactgatgatccatacatttgcagatgtgaaatgttgtgctcaagtctgaatacacagagctcatctgtatgatatatagtactacatcttttgacattttttgctgtgattcctgtgttatcattgtgtttgatttcccttatgtctacaccaaaaagcagtcaacatcttatccagataaatagtggtggttggttataaagatttgctgcaatgtttctgactttggcaaattattttaattccattcacttatatgtattgtgcataagagtaaatataagatcaaacctaagcaaagtcagtttagtacttaaagtcttaaactgcatgcggccgatctggagtttgtgttctgttgctgccgatgcctttcctcacaaggcga

SEQ ID NO: 5948 - DNA, 577 bp, Oryza sativa
gatggggcaacgaacacaggggaagagacaaaagggagggagagactgacgggtgggtcccacggagtttttcaccaaagtttgccaccctggcgcgccacggcgtgggcaaaagtggcaaatagttaagggactgttcactttgatgccattttcaatcttaccaaattttgataaagttaccaaaaaagtggctatatttagtttgctgttaaattttggtaactatataagaaatcctaccaaaattttggcaagttgccaaaattttggcaactttaccaaattttagcatttggtaagatttttttttggcattaaagtgaacaggccctaagagaccacctctttagaggggcaaaaaattaactgcaaatctaactaaaaagggcatttagataattgtcaaacctaaaagtgctaaatagttaaattccccttatccggctgttacggctgggggtggggcccacaccacacacatcgtgagacacaagtttgttacgtctagggatgaaaatagtgccagaaaaaaccatataccattttcattttcatattttttttctcaaaaagg

SEQ ID NO: 5949 - DNA, 1501 bp, Oryza sativa
taggtcaaaatttaggaaaaactcagtagtgtcatatacgctccccccccccggccattaccaaatagcatttgtagtattcaatttttttaatataaaataagcattttttttgggacaacgattcgccaagcattttcagccaataagatagaatttgtagcatccaatcttttatacaaaataagcattttgagaacaatgattttccaaacatttttcagctaataatatacttagaagggaaccaagaaattcaaattcaacccatgaagtgactaaaaggatatattttctcgtatatgcgtgcaacaatctaaaaagttgagaaaattttctacatacccctgaaaagttttgtaatctcttctacgccccttgaattttgcatcatcccctacatgcccttgagtatttattttgatctcttatatccctactttgttaattggctgttagatttttctaaaatgaccatatcgcccatttcccatacttacatggggtctacttcataatttacaatgtgaaaaattgttattcctgataaaatcaaacgggggcataattatttattgtaaaattcgaaaaagaaaatttaaattgttgaacaaattattttttgacaattttagctagaagttataaacaaaaattatatatttgttgggctcaaattttgatgaaaacagtgaacgaattacataaaagttaattcaaaatttatttaaaaattctagatttttttataaaatttattgtcatccattgttttaagaattgtgtttttatcactaaactagcacataagtataagagaggggtaatataatcaatttaaaaaatatttaacggtcaactcatgatcaactaacagaatgagcatagagaaaatcaaattaaaaactcagggtatataatttatgaggcaaaattcaggggcacgcaaaagattgaatgaattctcaagggtatatagaggattttctctaaaatgttaggaacaaatagaagtatttaacatcggaggaactgaaattgcgcactgcatagccttgtaatcttgggcttagcaatatgtattccttccttaaaaaaagattaattctgggtatgaacctcgacatgcatgcatcaagattcgcagttaggatataatatttttatagcacagaggtgtaaatttaatgtgactataagtttctaggcgtatacaaatcaaccaaataccagtagggtctttgattcgtgcaggcaaaccattagtcgtcttcttccttcctcgcgtcgcggcatccgccatcgaagctttgctcgcggctttctggccttcctcctgccaccggagacgccaccgccatcgccgcctcctactcactcctctaggaacctacgccgcagaaccctctcacctccctcctccaaccccgcggctccgtccaccgccgcctcgccgcccccgaacccaaatctaggtttttgttttggttcgggaaatcta

SEQ ID NO: 5950 - DNA, 1501 bp, Oryza sativa
acatacaagtttcacaaacaaaacgaggttgatatcgccgtcgatttttggcggttcgtgccacgagcccgagacgaaggtagcactgcatgctctgttaccaaccttaaacagagaagaatgcacagatgatcctaaaacattttcgtagcggttttttagcggttcagccgtgttgtgtcatctctcgcgcagttggccatgtgatgaacttggatcttttgattgcgaatttgtgattgcaacgaaggtatatgtgttcgtacaagtacaatgctcttttttttttcttttgaaagtggtcgtttaacattttgatgatgcgtaataatagtccatctctctgagcattgggaatgtacgcggctggcctattctgatgggctgcctggtaaggagaaggcgcgaataagtttaagcccatgtgggaagcccaggttgggtcggtccaattaccctcggtttatgtgggcttttggtccacttgtggtggtgggctttggtcgcgtggcatctttagcccacatggtgaagcaacggcccgactaagatttggaagttggaacccatcgtccattgcgcatggtccacatttgactgctgttcttgtgaacttgtatatacgtgcatgtatgtacgaacaaaaccaaactcttactgtatttgcgaatgctaagtacaaaaaacctgcatctcttcagttttttggggggtttacactgcaattatgccactaccttcgtatttaaatataacgatagtatctaacaaaattataaggaaaaatggacccatacgatttttatatttccacaaactaataaaatcaacaatgacatgtttaaatacggaaggagtacatatcaacaagagtgattagacaacaaaaaagccagcctaatttgaactacttccgtaatgaaattccatgtggtacaacttgtcctgattttactttaaaaaaagaaattgacctaatgagcggtgtggtgattaacttgtccagattttactttttaaaaaagaaatggacctgatgagcatcatcgtgattaacatgtcctgattttacatcaaaaaaagacattgacctgatgagcgtcattgtgattcgccactggtgttccttccattcacgagctcatagcacggacagagctgccaacccagcagcaaatcaatcacaaaggtcgcaggtcacaaatcacgatctacatcactacatgactaaatcagtcctagttgcacttgcatcccttgttgagctgattccagactgatttctgcgaccatatattaatcaacttgttcttgattaattaaccctgtcttattgcacccacagaccatcaagaatatgctccttatctactgtagtgtttgctcttaagctagtctgaaccaatcagaccattttattcctccccatggccgatgcatagcaagggataaaccatatttgtctgtgttcttgcatgccttactggcttactgctcctcc

SEQ ID NO: 5951 - DNA, 227 bp, Oryza sativa
acccgacgcgcaaatagatccacggggtgtccatagcacgttttgggcaatcacgccagtcaccacgcttggcatatgctggtaaatattccacgaaactctgctcttatatcacgagcactcaccacgcacaaatccaccaaacacagatttagctaaccaatgctgttcttgctacaagattaatcagttatctgtaggtattgatcagtgatcagttgcagaga

SEQ ID NO: 5952 - DNA, 378 bp, Oryza sativa
cataaataattaagatttatatcaatttattggtacagaattatggaccaactcgcttgtgctagagagataatattcatggatgtaaggctattatggccccatttggcacagctctagctctcaactccaacttacctggagccggagttgtgccaaacgtccaaatccactttttttgagtggagttggcagagctactcctagaaaatgaactacgggggtggggctggatttttgatgctccccagctccactccaccccaaaagacccactaccctctaatttttttagagtatttacacgaaaatgctactcaactacccctacaatcctcctttcctcccgttctctctcctcccctcccaatcccgagc

SEQ ID NO: 5953 - DNA, 1501 bp, Oryza sativa
gcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttggaaggagatattttgtctgccccaatgtagacaacgatttcgttgtatgtctaaccatttacaaaatccgctatgatttgcacaaaattactacccaaactgaataacattactatttttacagggcaatccaaggatgtgtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggtagcaaaccaaatatgatcaaatgcaattttaccttaccaaatatttggtagtgccaaaacttgcttatattttggcactaacaaaatatttgtacggtaacattccaaatagaccctaaaaaataataaaattgtattttaccagtcttggagattttaatcttgtatagttttcaatataaaaagatttgataattattgatatttataaaaaaatataaagcacaatataaaatcgccctcccccagggcggcaagagggccgcctgcaaaattccaggccccccgccgcccatttgcaggtggccccccgtacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgatcacttctgtcaattttcaaaatgaaaaattattttttaaaacttttaataaaaaaaattaaaaataaaaaaattctctccccgtcgagtcgacgcccatccttctcctcgccacgccgccggcgagcggcggcgctgcctgccgtggcgtcctgctgctcccgtctcctcgctggttctcccaccgcaccgcgccgcgccgtcgtcctgctgctgcttcccttcccttccgcctccggtgagcaccaccaccaccgatgaatcgatccaaatacccgtgtgctgcc

SEQ ID NO: 5954 - DNA, 1501 bp, Oryza sativa
aactcatgagactaactttcagttgaaatcactgaggtacaaaacggctgcagaaatgcattgttgagcactcaagtaatgccatggacatgatgagcaatgggatgtaatcctcggcacgaagctggctcaatgaagctcctgacgatcgcctcccacatcttttctatgcctcaatatctcaacacccaaataatcgacgattccacgtacagcaacatgaggtttcccaactttcactctgatggttgagatttgagggaacttaagcaatgcgttacttgcgattcgatgagctactgcttccaaaaggttccgcgatgggccttcaacaacatccttggcaatcctgtaagtgcagagcatgaacatatttcagttctccaatgattggaattagtaaaagaacaataaaataaactgaataatcctacattgctgaaatggacaagcaagatttaatatcttaaaaagaacaatcaatcaagacatttctagtaaaatggtgaaataaaaacaaatcgggattaatttgttactcctacccgtagatatctgtgtagctaaccgtatcagatatgctgtcagtctccccagcaacactcaaatccatccacgcatcaacatccacaacgaacttttgacctagagttttctcttctgatttcactccatggaaaccgtggaactgcaaatctataagcacgagtttatccctgtcgattaactccctctccgccataatggtccttaaagcacggaacgaatccttagtccggcagcacacgggtatttggatcgattcatcggtggtggtggtgctcaccggaggcggaagggaagggaagcagcagcaggacgacggcgcggcgcggtgcggtgggagaaccagcgaggagacgggagcagcaggacgccacggcaggcagcgccgccgctcgccggcggcgtggcgaggagaaggatgggcgtcgactcgacggggagagaatttttttatttttaattttttttattaaaagttttaaaaaataatttttcattttgaaaattgacagaagtgatcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtacggggggccacctgcaaatgggcggcggggggcctggaattttgcaggcggccctcttgccgccctgggggagggcgattttatattgtgctttatatttttttataaatatcaataattatcaaatctttttatattgaaaactatacaagattaaaatctccaagactggtaaaatacaattttattattttttagggtctatttggaatgttaccgtacaaatattttgttagtgccaaaatataagcaagttttggcactaccaaatatttggt

SEQ ID NO: 5955 - DNA, 1142 bp, Oryza sativa
acaggtgaccgccggcagaggcggagccatgcccggggagcgagcggcttgagccggagctcgcctgtccggcagaggaggcggaccgggtggccggcggtggaggcggagcacgcccggtcaacgagcgattgaggcagagctcgttctggaggttggcggcggaggcacagatcgcccgggtggcgagcggctgaggcttagctcgcctgggcggccggtgccggatcgggtggccggtagtgaaagcggagctggtgccacgcgtgatagagaacttacgctccagcgaggatgccctccccggggcccgccgctcgcccaacccctccgcgaccttctttcttcatccagatcaccgccttctccgcccggaccaccaccgccaccgcactggggagtgagtcggaagagaaggagaggggaaagggaggagcggcggtgccggccctcctcgctgctattcgcctcctgcacagctccatctcgtgcatcgccgccgtggacgcggccaccgacacccgtcactcgtacgtcacgtccgcagtcgcctcctgtcctccgatccccgccccgcccaccaacagcaaagagagagggatgaggtaggagtaattgacaagtgggcccatagttttttattactttttttatgattggattgccaaattggcgccacataggatcaaaatcgctccagattgagccaaggggggtaatttatccggtttcaatactttaggggtatcaaatgtccggttttgtgggtttgggggggtggtaattcggtcaaccacgatagttgaggggagtaattcatagtttttccttctaataataaagaagaggggaactaaaacagatcaaagatgagaacttgattttagtttctttttaattattttaaagatcagtattttttttcatggcagagcacatctgagctgtgcatggttatatagaatttctcactggatgatctagcatgagatgcttctacacttctgtaacattctaagcatgttctaagatgcataagtaattatgtaattaccatattacagttgctgcccactgttcatatttagccttaactgggtgaagcaaacaattttgatttgagtgaaatatctggtgaatat

SEQ ID NO: 5956 - DNA, 355 bp, Oryza sativa
aggcggctatagcgtcgcgatgccgaagtgggaggagatggaggctagcttgcttgagaggggtatcgaaccggcccccgctaattggccggaacgatcgaagttctggtactgtgctcacggtggaacgctccacccagctgatggctcactggtcttcggcgatcagatacgagaggctgcgcgttgactaacagacgcagtggaagcctcttctcagggcacgttccgaccggatagagagagggacgagctgtcactcgccctgcagactccagagcatccaggacgaacacgagggaaaggggtgattccttggaagattgggttcaaggaggacatccacacgtacagg

SEQ ID NO: 5957 - DNA, 1501 bp, Oryza sativa
atctcattattgactcaatgcaaaatgtttctaatattatagcatatttgcttgcaactaataattctgaaaacagccttcaaaaagttccaatccttctttggtttatttggaaagctagaaatgatcattatttcaagaaaaaagaatgggagcctttgcaagtttgtaatgtagcaagcgctatgtcaaagaattatatttcagccttgtctaatgagaatgataatgaaactattccaatcatagatgaattctgttgcttctgttaatttgttgccagtaactggatgtttccttgacgcttctgggaaggataatataacaaggtttggtcttttttctacatgactctataaatcatcatatcatctttgtgtaggccaaatcaactctttatgtgtcgccaattcaggcggaacttgcaacttttaagcttgataccttcatctgtgatttccttcaaattacaaatcctccctattttttcaagacaatcaagaactggtgctcttacttcaaaactctaataatatcaatcataaccatcactagagccttttgcctttgcttgcacaattacataacttttcaggtggagcttctttcaacgtcaaatggatccccagagatataaataaaagggtatcaaatagctgactactagtctaaaaaagccagagaatctaaatatgagttagcagctctaaattaccaaaatattagtcatgcttgtaataataatacttgtcctacaaagcaacttatgcaagctactccttggaaagacaattgtgtatctcttgtgcacattttccttctaatgtttaaataaaaaattactaagttgtaaaaacactgtttttagagcacatggcaaaccgcttttctgcagaccgaggagtaaaaagactatcactgacagatgggacccaccaaccattgtctctcactctctcccctcgcaccgcagcttctccaatccgtcactttccccatccctcccgcgaaaagcagacagacgcccacaacccaccaccacgtctagggttccgccgctcctccggccgccgccgccgccgccgccgacccccctcgatctcctccccgagccgccataggtggtggcgggggcgggggagctagcatccgtccgtcaacgcacatcgtcactgctgcttcctggtgagcatccatccgtttcgcatatcctctttctcatccctctctacccacccactttttcccctcgaattcgcgtcaaccctagcttctcttctagatctgaaagctgctgcttttctttcaatttgctattcttaatacgaataacagtttcgtttgttccccaaaaaaagtttgggatgaatccccatgtcccacgttagatccgcccctggttttatgtgcggtattgttgtttgtggtatgggtaccaacagctttcgttgttttcaccttttgcagaaatctgccaccatgtccgacatggagtccatgg

SEQ ID NO: 5958 - DNA, 1501 bp, Oryza sativa
cgccgatggcggtgacggcgtacttgtcctcaactttggcccactgcctagacacaacggtggtcacggttacgcacattgcacaggaatggcctcacaactaactgaaactgaaacttaaactgaaacgatgatgcagaagcagcagcagaagataaggattgcatgcatgctgaccgcgtcctgggctgccttgacgatctccggcacctccgtctcgccaacgaccacgcgaccacgcgggaggaggtcgccggggcgaggcgggagaggaggagggcggagcgacggcggcagctccaaccgccgcactggcctgccggaggaccgggcgagcggtgggcggagcggccgatagcgcggagagcggccggcaaaggtttagctagtcctcgtctcctccccgcctcccttcttcaccgcctcgccaccgacccggtccccggcgatggggaagcacgcgcgccatggcggctccggtcggtcccactcccccgcaccgccggcgacagcaaccaggcgacacgtacaccgccgctccaagccgggcaccgcgccacctccgccgtccgccgcgccctcaactccatccccttcccttcccctccccacccctcgcctcctccgccgcctcgccgccgacccggtctcccccgccgccgtcgcggcctacctcgccgtctccggcccaacttcaacgacgcggcgggtgccctctttgcgccccccagcggccgcgcgcgccagccagcgagtgagcgaggagaaaagagagagaggggaagggagagagagagatgacgtggaccctgacatgtggggtccacgtgggttccacgctaacttagcagccacgctgacttagcagccacgtaggacaaaaccgggattaaaaccaccgaaggatctaacgctgatttagcagccacgtaggacaaaaccgggattaaaaccaccgaaggatctattgtgaccggttttgattagttaagggacaccggatatctggttttgcggtttgggacgtttttttaactcgatgacaagttcagggaccttcggtgtactttttccaaatgctgaagctcctgagagaaaaccggatgcgcctgttgtttcgtgggccaaacgttagcccgaaacaaaacaggcctgggaatggttcccaaacgggtctgggaacgacccaacagacacgctgcgcgcgcaccacacgctcgctcgggggcatagttattaggaccggaccgacaatcgaaccggtgaggatgtcggttcattggttcaaccgttaaaaatcggttgaaccaccggttcaatagttttggaccggttgaattgaaccggtgaaaaatacttcgaaccggagcatatgcagttcataaataccagtatattttgatcacaaataaaacaagctcataactaactcagcttaatcatataaccatataatattcaacatgtgactcatacagttcatagtctcgtactacttcat

SEQ ID NO: 5959 - DNA, 1501 bp, Oryza sativa
aaaatatgaaaacgaatatgatagagctagtttcctaccgtattcgatccgttttcatccctagacggaggttaccgactgtgggaaaaaaaaaagggaaacgtgggggcgggggttaccgagggtggagacgggtgggggtagggtggagtggggtgggggggtaagggggttggggtaggttgcgaggggagcattttagctattacgcatcctgggtgcggtttagcgcttatatatatatatatatatgtcggtgacataggaccgggagtatcatgacttagagacttgaggcagacacgatcacccacgtggcctaaccccctcggggggggggggggtcgggcccgagggtgatacggccgcccttctctttgtctccccgagaggtcggaccgctcccgtctcggccccgagggccgaggcgccccgaccccttgtgggttttgcgccgcgtatatggggtaggtgagcatagcggggctcacctaaccgcatttattgcggtttggacgagcgcgttacgccacatgtagcgcagtatggcacgctcgtttatccggtctgtgaccggtcacagatcggtcagattgcgggttaggtggcaacaggcgatctgacacacgcctcgccccgtcccgtcaagatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacattgcacctgcttccggcggagtggaggtaggtatgggccgtcccatcagaagggtcactcgggcagcagccgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggaaaagtggtgcatgtggtatccccttgagatataaaaggaggaccttgcccacttaagaggggaggggggaaggggggatgatctggagaggagatcccacgagagaaaaaaaaaggagaagagggtttttagaataagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacctagggcccctggccgaaccggcaaaggggggcctgcgcggtctcccggtgaggagccccacgctccgtcaa

SEQ ID NO: 5960 - DNA, 1501 bp, Oryza sativa
atatagatgagtaatctttgataaagaaagtggtacttgctatacatgcatactcccttcatcccaaaataattttatttctatcctcttacctccactcgattagtaagtcgataagctttattgtttcaataccttttaactatattttaaagataatgggataaaatccggcctttgctaaaaaagctacggccaattattacacatattcgtctctaagagatttaacaaaccataaactcaaacaaataagcaccaacacaagataaagaaaccccacaattattgtatcctactcgcacattaatattactttcccattaacatgttataatttagtttttttctctctaatttgttttgcacacacaagttctaaagataaagttattttaggtctgttgtttttgttcatgttgattgtctgtcctgtgatatgcgttttgattcacagaggggctcagtcataatattggacccaatgcaaatggacattgccgctgatcttttatgttgaacggttgaatggtttaatagctgatgtcatggttatggagggggtacaaatgattaaattactattataaaatagaaaaaatgatttaaaaaattctctgagaaattcatatatagaaaaaaaattaaaagttataaagacgtgaaagcgtgaacatttgtccattcatccgttaaggagcaatataccgaattacatagaattatttcaactcctagctactccgattatctgacatatataggcatgtccttttgtcttaattaatggaatggaatataagaatacatacacttgttaggctcctaaacggtataaattttgcaaaatctctctacaaacaattttttgaaacacaatttaaaatctacttaaatttatgatagttataattaattttattagtccgtattctcgaaacatttgtctatttagctaagtagtattcagcagtccgttctattccatttaggccaaaataacacccaggcaggagggcatgcacacctaattaattaatcagataatatagtagctagccagggagtagtttgattaattaatctcctgtcacatcttgctacgctgatggttaaccaaattgctaaatcccctataaatatatataattttatactacgaatctgcccatttacactcaataaattatatgggcgacgatcatatccattaataatcaagtagaaaagcagatcgcaaataaaggcgacctaaatgctaaacgtgacaaattgtcgcaagtatctttcacgtacagttttttttaaatgtctcattattttctaatatgcccttgttaattaattccttggtattatatatttttttgatgaggaaattccttggtattattgcactcaagaaatcagatactcaaaattaacaagagaagcaaagcttataacttataagttacatatttataacggcggtaaaaaaaatattaatcgtgccgacaga

SEQ ID NO: 5961 - DNA, 788 bp, Oryza sativa
atcgactatgcttttcgacctgatcttgggtcctcctaagtcctactcaccctcctccaggacgaaccttgtggacaaatgacatcttcaattatcagaaattgtaacattagtattagtaaatttatattatatctaataacaatgatttctttagttatatatttgctttaacaatggcacaatgattggggtccatttaaaagaccgttcccatttttatgtccattttgtctccacggatcctgttttttatcatgctatcataagagttaagtacgattgtctctttcagaaaaatgtttaagtacatttttttgtgacaccctagaagttttgttgtgacagttgctaatgattgtgtgcactataatactttattaaaatgctatacatgctgccagcttcttggagatggaaggaattacggagtagcacaaataactgtgattggctggttcaagacttcaagaagacacaacaactctcaggagcctctctaagctacaacacatgctaattacgattcgtgatgcatcgctttcctgaggaaataaaacactgctggctgttaaatgttactccctgttaatgggactcctatttgtatccaagctgttgaacatcaaattgtttcatcattgaatggtaagacatggaacactaacgtacagttgttggttcgaatactccgataagggttcaatagagcattcagtttataattggaaagagagaagttatctgaaaaatataattgcacattgctgatagtggtaccaattaga

SEQ ID NO: 5962 - DNA, 802 bp, Oryza sativa
cacctaacccatacacgcggagtagaaaccgcgaggggtcggggcgcctcggccctctggggcgaggcaggagtggtccgacccccccccctcggggagaccaagaggtgggcgcactcatcaccctcgggcccgacgtcccccgagggtgccaggccacgtgggtgattgtgtctgcctcaagcctctagtcatgatactcccggtcccatgtcaccgacagtagcccccggcgttatgccagggcaatcgcccttttcaaggggagcggtcgggcgtgacgccactcctaaagcctggtgacaagtgggaccggtctctacaaataggcagaaacccaacggtcacaaactgcgcacatcggcaatggtaactcggctgtcagcaatgagcggtctcttcaagactgccacattactcgagtagcacacgaatctggacgagccgattcgctttgccaggagatatgtgatggcgcttcggtcggcgagcgcaatcaacgcgcgcacgatatgatctatcttgactgccacaaccgcatatccacctcacgcgccgcaagcgggcgaatgggattagtggaagcgtgggcgcgagagacgagggggcgcaatagtgggcgcgagaaacgaggagccgggcacagcgttggcaagggtataaaggcactgaggaagggatttgtttctttcctttcgccatcattccccttgtcttcgccgcttgcgccctaactccttcttccctgcgcccttctttcgccacacgcgctcgctctccatcttctcttcgtccggcgcca

SEQ ID NO: 5963 - DNA, 1328 bp, Oryza sativa
aagaggagggaatttagacatctaagcgggcctttaagaggcccgcttgcgaaaatatattttcacgtacggccgcttaagaggttcgtttgtgaaaataactagatgaatctcttaaggggttacatgcgaaaatgcattatctcgcatgcggcccctgaactatttcttggtggagcgattcttcatgcgcaaatagtagtgatatataagcgtccagatggtccgcatggaacctaaaagggttctcgtacagaaaaaacgtttgctatgaatctggataaccgtgtgtccagattcatagctaaaagttgttatattttgggacggatgtagtaatcaatatggacggaaggagtacttcatccgtcccaggatatagcaacctatgattggatgaaacgtatcctaatatgatgaatctggatatagacctatctagatttgtagtaatataatacgtcttattctattatagtttgttatattatggggcgtactcactccaccaaaaaacgaatctagaacggaatgtgacacattttactataatgaatctggacgatcaattgtactggaatttgtaacatctagttttatgttcgtcttttataagatctagttttatattcgtcttttacaagacggagagaatgaggggagtaaaaaaaaaaagcattaacgggtcgggtcttgttccattagaaacaacaattcagcccagtaatcggatggaccggaactcatcccgtgccccgggattttgtcccgtgcgggtacagtcagaaaaagtataaaaacaaccttaaaaaatgtcacttccaaataaaatatttctctcagatgccagacacgccgggctacgagctaggtcctgtccagaaattagtttctttcaacgtccattcgatctaaattattttacccttccctatttttcccccatcatgttcttttctgggagtacatgtcctccatcttatggacattattgtgtttgctgaaactaccgctatcagtagtaccaccatttgatttgattaaggcccacatgtcatattcaatatatacttatcggcccatcgattcgtttattcggggaataagcgaaacgctatatttgcaaatgaaaaatagtttatgattaaaacttttatatacgtgttattagcgatctgaaaacaaaaactgaaaaataaacttcgatgaaaaaccctaaaatcaactctaaatttaaagttgaaaatttaaattttagctaataagtataagcataaacgaaaagatgataccatatgtttgacacgaagtttggtaataaaattgca

SEQ ID NO: 5964 - DNA, 322 bp, Oryza sativa
atatagtttaagggtcaagaatcaagatatatggtattgtggttgaggggtatgaatcagattggagcagtatttgagggactcaaagtgaacttattccattgcaggttggggacgcccggaagtctggaacgcagagggcatatataaatagatgcataacaccaagatagtacatgtgcaaaacgagtacgcaatgttggttgatgtctggccaccgagccagaaaggagagcgttgggcttagcccaccaaagcccacgcgatccctaacattgaggaacgagtctcacgcattctctcacacgtttctctctttagc

SEQ ID NO: 5965 - DNA, 1501 bp, Oryza sativa
taaaatagattaatatgattttctaaagtaatttttctatagaaaactttttcgaaaaaaacatcgtttaatagtttggaaaacgtgcgcgtgcaaaatgagagcggtgagtcgggaaagaacacacccgaaatcgagttaatcagtacttcagtagtagttcgtttttccttgttataatctcgtttcacagtttggaggcagaattttgaagtagacttatctaaaacttatttcgttctaaaaaaaatctaaaacatatttgttcatgcggatgaagattgaagatgttgatgaagacgcggcgtgcgcttacacggatgaagataaacaacgttttgtgctcatttacaagaggaggaagaactgaatatatgagaggtgcagaagtgccaagctcaagagttattcagaagaccagaacctgaagataacttcagatgataaaattctgaaggatgactgtgcatccgtattcaccttgttcaaatcagatacactagaagtttcagagacgcagccagaaactcataatcaccggaaaatttagctgaagattgtctgtgaaattgcaaatcgacaacctttttctgaattctgaaggcaaacaacctggaaaaggttaggctcaggttagtgaaatagaatttctgaatatgtaaaatcaatctaggtccccctcccttcgtggcacaaatcatacgatcttcctcttcttggcgcgcactcacgctggcgcaggccaggaagagatgaagaggtgatgtaaaactgattacttttacattttatacctttttaaaaacttattttacaaatacactcttaaaaacttattagatcattggtgccatgatcttgttacttacttctatctattaaacgttacgggtacttagttaccgtgacttaatcatgctctgtactaaacctttactacgtagttcattcaagctatactgacctttccatgatttgtactcatcacttgcctcttcgcttagtgcactcgaaacagagcttcaagtaagatgtttgtggaacatctctatagtttgtcttaccctaacatgacaacgccagcgccgttccccttatcccccagaaagctaagccatcaatgtgaaggggatctgcgcaaatgacatatttgtaaaaaaatataaaaaggacaaacatgtaaatatatctttttttaaaataggttatcggccaatgaaactgatgtctagaatctatttataaatatatttttattacaaataagttattttcaaacaggaaaaaataaattggtctttggtgtcgaccctcttcacgctaatgacttaacatgaataacgccaataactctagccacgaaaaatgtttatttctgaaataatttttttcaagtgtttatttgtaaaacaaattttaaaaatatcaaaatgttaaaagaaaaaaaatcggagtgatgtaaaacctaccgaacccacaaggagaaaggacgaaagcaaca

SEQ ID NO: 5966 - DNA, 911 bp, Oryza sativa
gacccctcagggagatagagggaggggcggcctcatcaccctcgggcccgacccccccgagggggtcaggccacgtgggtgaccgcggctgccccaaacctctagtcaagatatccccggtcccatgtcaccgacaaagatgttttgactttggtcaaagtcaaactactttaaatttgacaaagtttataaacaaatatattaatatttataataccaaattagtttcattaaatcaataattgaatatattttaataataaatttatcttggattgaaaatgttattattttttctacaaacttagtcaaactgacttagtcaaatttgaagcagtttgactttgacaaaagtcaaaaacatcttataacctgaaacggatgtagcagtttatactcccccatctcaaaaaaaaaaagacaaatcctaactatatatcttgacatgatgaatgtccaaatacataggagtatgaatctatttgagatagctaaacagacgacatgttctgagaattttctttttcgcgaacgcatattatgtgaattgtctaggtatgaagtgtgccctgtaaactactgtacttaactctatacctcccttgtatttttgacacaagattattgagcaatgagtaaatcctagagattttcactatagcagaatcatttgctcataattatttattttgagaggacattattgttcttgattaacaatgtaaagtatatattctcctcaacacccggtcccaatgtaaccgtgaagacggagctcagccacacacgcatggcgcaactgccgcgacaccgaccaacccttcgccatgcctaaatccggcacctccatcgccgccttttatatcctcctctccctctcgccgtcgtcgtcgtcgtcgtgccgtgttcga

SEQ ID NO: 5967 - DNA, 200 bp, Oryza sativa
agaggccgattaagaggtccgcctacgaaaagtttgaccgtccttctctcttcctttccacatcttcaaaattttataagttctcatccttatctttcacctcctctcttcctcatccttatctctctcaaccccccccccccctcttctctctctcatttctcacctcctctctccctcgcctccccctcccgagcagc

SEQ ID NO: 5968 - DNA, 1501 bp, Oryza sativa
tgatttgtaaatgaagcttccaatcatgctagaacatgattttgaatttagcaaacataagagttttgcatagtgtatgattattatctatccatgggataaagaagcaacaaagaaattatcagtgtgaccatcatttgagcacaaaatactatcacaaatcaaaccttagtaaccttgttgctgcattccataatggaagctaaagtgctaacatttgcaccccagtagttcacttatgctattaaatcagttggcatcagctaattcaggtccatcaagaagaaagatttagatagttgagaactttagacaacacataccactccatccaatgcctccaatgcagcctgtgcatcctctgcagtcctgaaggagacgaatccgaaacccctggaccgaccggagtcgcgctcgaagatgaccctagcatcaagcaagccgggctgcccctcgaacgccgccctcagagcatcggcacgcacaccccaccccaggttcccggcatagatcttgaatgtgccgtcatcgcgcctgttctcccttgtggccgccgccgatcccaccgccctctcccctccccgcggcacctccgggtagttcacccttgcagtcctccctccaagcagctacacataaggcacacagccacaatgccacaaaattgaccagatttcataacttcatttactccaatagctcaatttcagtgaaatggagcagaattgctttgaattggtgtgtgaaaaaaactcacggccccattgaacatctggatggcggtggcagcctcctcggcggtggccatggtgacgaaggcgaagccgcggctccggtcggtgaccttgtcatagattatctgcaccagtatgagatccaccatcagattcagaccaagatataactcagaaaatgggggaaaatttttgagggttttgattggttggtcatggaaacctggacgttgtcgaccctgccggcctcggagaaggtctgggagatctcgccggaggtcatggtgtaggggaggttgccgacgaagaggcggccgggctcttgcccgagcgccggccggcttctcggcgggtagtatccgcgaggcgccgccaccgccgcgcctcctcctcctccccatcttcctcttcctcctccacgtactcctccccctcttcttcctcctcgttggcgtactcctcctcttccgaagagaactctccaccggcggcggcgaggggaagcagaatgcggcggcgatgaccggaggcgacgaagaggttgaggacgccgacgcggtggcggtgaaggccctggagccgtaggtgagcgggaggcagtggcacacgctcggtgagggccgcggcggcggggtgtagcagcgagcggaacgcgacggcggccatggccgtggaggaggagaagatggcgggagaagcgaggagtggagcagcggtggtggcgttgctactactactaatctcttatccgcttcttaatgggccgt

SEQ ID NO: 5969 - DNA, 348 bp, Oryza sativa
ggactgagtgtcccataaatacttatattggggcataaatttttgaacactcaaaatatttgtgaaccaaaagaagtatatggagaggtgtgtaccattaatccattctttcatatgactgtcaacgccgtaaaatatatctgtaatattactctcagtacagttaattagcatatggccctgaaatttttcggccgaacccggcaattttatatttatatatacccttgccttgagcttaggcatcatgtagcctcgccgctcaagcatcgctaactcagttatagctgtctaacaaagcaaattagctttcgctgagctttgtgttgcttttggtctcctagatag

SEQ ID NO: 5970 - DNA, 1501 bp, Oryza sativa
ctctcaattaaatatgcgacggaagcgtccctttcaccaccttcttctaaagtggcaaggcaaaatccaatgaaatatctgaaccaaagcgaccacgtgagacggctcgcagcacacacaaccatgatgtcccaccacgaagcaagtgtgccaagttggcaggaaacctgctagtctattgagccacttggcacctccaaattgctagaacattagaatcatctaaaaaaaaagaataaaaatctttaggagcataaacttccggaaacttccatgttgcatattttccaaatactcttttccccttttgcactatttcctttgcaacagtttaacaataacgacaaatttccatcaagtccccaactgaagtcaacaaaagaatatcaaaatggaaaaaaaatagcccttctatttccttttgaattgcttgagtaatatgtctagaaaactactgataacttggaatgatcatatctagtaaatcacatgcatatagcgagtacttttacctacttctctatgcttgagagaatgtaagaaacaaaatgagtctaatactaaatatatttaaaaaagaaattatattctctaccttctgtacaccactaataaatcaatatgaaaaatttagaatatgtttcatatgaaaatattaggaattctgattcttagggataataggaaaatctcgatatgtcataggttaaatagaaaactaaatggcattcactaattattttatattatgcaaaattgttgtattctaaaggagaatatgaattgtggaagaatgccaataagtccaataggaatacgaaaggtgccccaatcgatccaaccccgaggttagactcatgagagctagctaagggaattttgaggtttttcagttaaagaaatatattacatgttaagttagaaattaataacccatcaagtggtccttctaggtgttgatagaaattcaatgggatatgaactaactccataaaaaaaagttcttaacttttgtgtgttctaaacatgacataaacaatatagaagtacattgacttattaaaaaagtacttaccaaccgccttatttgatatttatagtttgaaagaaaaaatgaatataactttttaacaaaaaaatgacacataaatatttatgagctatttgctgaaataaattaaaacatatattattttagattttttataaggatggcagtaatttagataataaaactcataatataacaactctaaataatacagcaaatagtgaatatctagaatataataaatgcagtggctaaatccagtgggtgcaccaacaggggcatcgattatctagtatagaataaatgctctcaattaaatatgcgacgcaagcatctctttcgccacttttttctaaagtggcaaggcaaaatccaattaaatattgacgaaccggaggaaccaaaacgaccacgcgtgagaactgagaaggctcgcagcacacacaacca

SEQ ID NO: 5971 - DNA, 1501 bp, Oryza sativa
tgcccttaatccagcaaccggcaaaatccagaattaaccggaggttcaaatctccagtcgtgttcggccgatcgagcagtcgaccgcgacgccccccacacgcatgcagcagcagcggcagcggcagcggcagcagatcggtcgaccacctgctgcagcgcagcgaatcccacatccctattattatctcccacccgcgtataaactgcatccaaaacctcccacaagtccgatctcggacgctccccgccgccggatcgtgaacgaacggcccagatcgtaccgtggctggctgctaccaccaccatcatcatccatcgccgctagctgcagcagcagccagccagccaaccgccccgcgcaacagaacaagagagggatcaaagaacgtgaccccccgtgagggaggaagcagagagagagagaggaggattgaagcattcaaccaccgtggggtgatggagaattggagagacgatgaccaatgttgccgagatgagtaggcatgtgaagtgaggcgagagagagagccaagcagatgtgcagcgattaccgggcgctgtccgcgaccccaaccaccaccatccatccatacacccggagagccatatgccattttttttgccatgtgtcgctgcgacgtaggccccgctttgtcagggtcaaaccgcacctaccacccgtctcccaggaaaaaacggaaagaaggaaaaaaaaagttatttacgttttcgcggacgccgccagcaacagaaaggaagggaggagagatgagcgcggcggggggtggggcccatgggccaaggcgggccgccgcgagggcgggcgggggggctataaaagcggctcgacgcccacccgcaaaccctcgcatttcccatctcatctctcgctcgctcgctcgctcgccgctacgcctcacgattccgacgactccgacgccggtagggtcataacaccctcctagacgccggcgacgacgagggtggttgggttgtggatagcggctgcgacgacgagggcgctctcctgaccgccggcgtggggtgccccagctccaccaccggcgacgactcctcctccgccgcgagcgctcccccagcctgcttcttttgcgggggtagccggggctccggcctcggcggctttcaaagcccccttcctcacaacaggatccaaaatcccgtcctagagttcttctacctccccttccaaaacttcctcttttggcatccttgattcaatttcccttccctttctttctttctttctttctttctttcgatttcttcttcttgctttagatttcttatccttcttcttgttgctaatctcgatcgatccatctatccatccaaacaacctcattcttttttcctttgatttgattcttcgctgctaacgccaccgaaacagacaacagatttacagcaaaagaaaaaaaaagaaggaaggctaacctttttctgtggattttagcgttctccggtttgtgacgaga

SEQ ID NO: 5972 - DNA, 1501 bp, Oryza sativa
gatttatctacgcaatctgcagagcactgtacatacgtgcctagattcgtgtcgctcgtcaccggctggcccgtcaacgattgcatctccggcgacaaactctgacgctaatgttttgggggataaataattgaatcttctaatgcagatttggttggtatcagatcgacaagcgaaaaggagataaaagcaccgtcagcatgcaccttcgattttactatgcaaagttaagctcggtggttctgcttgcgattcgcatgtgttactgtagctgtcatttccaggaagctaggttagcacgtgtgtttaccttacctggtcaaaggttttactacgtaatgacgtaaacttttcttgaagaaacttctaaacatgtgcaagttgtcacagagcacgtacgttctctgttggttacagtcctagggaaagatatcgacaaagacactgaaataataactagtatcaaatcttatcgtcagataaagaaaatgatatccccggctgctatcctaagtggagctattagttcaagggcctggattagtttcatctctcttttttttttttggggaaaagtttcatctctctttaacgtcgtcacaagtggtctcttttttcgcattattgaatcagcaaagagttaaagagaatgctgtgacctacttgataattgagacctaattccatcctctcccctttcctgtggatataccgaattaatctgccatgttccaagttgcatacctgaaaataagaaaaggagatggcatcatcggcaaaaggcctaactgaccgaagaaaacatgcgttgtcgccgatgtagcttgcagatacctaaacatggcgttgttcatccaacctatcctatgtttgtgtttcttatcgcctaaagacgcacgcatctgatagaatggtgatgcgtgttctgctccctgctccctttgtgtcctatgaatcaggtcataagctactgtttctgtgattcttgttggttgtgataattaattgcacactgttttctccatgagcttaatcatgggtcattgtattaattgtttgtagctcgtttgagtaaaggccggatattttattccattatctaaaaaaaaattatgagtctttgtatacttatcattactattactagtactatatactccctccatacttgtaaagaaagtcattttggacaatgacacggtctccaaaacataactttgacttgctgtttctataacaatatttattgaaaaattatatatgtatacttttataaaagtatttttcaagacaaatctatttatataatttttacattttcaaactcaacaacttaagagttattcatgatttatattctcaatgtttgacttaaatattattttaaacgactttcttcatgattacggagggagtatacttgtcaatgtgaactagtaccaacagaaggatcgtgtgacgactgcgttgggggcaacccatgtgtgaagagaagcaacga

SEQ ID NO: 5973 - DNA, 856 bp, Oryza sativa
ccatagattattctattttattttactagtgttaggaataaacatacatcctatatatgagttgttagaatacggcaataccatatacctaatagtctacgttaggatatttttttattaaggaaatacaatggataaagatagcttacattgggatattttttattaagaaaatacaatagataaagaaagaaattagcttcctgaaacaaaagatggtggagtctagtcgtatgatatatatatatatatatataaatataaagatagcattggattcgaccaataatagtaagactattacttgtcactaaaatggtggtattatttatttatgtatgggttcttattccagtatatgaattgaattctactcccatagccatttctctaccctatatcatcataactcctttacacgcattttgagattggcaaaatatttcacacttaaagcaagtttatttgttccgtgtgttcatgttaaattctaattttttttataggaatgttaaattctaattcaagtcgattggaactacagctactgaaccactgttattgttaatacttactcctttgaaatacacaatgccatgtgttaatacttactcctttgaaatacacaatgccatgtttgtgctatgttagtcttgctaactttgggcaatccacaaacacatttcgctgtggttgatcaggaaataatactggaagtcaatcgtttccgtgccactctgattccatctcacctaagaagtagaactatgagtaattaagcatgttcattactaaaataatgggaccaaaaacaagaacatatatataaacatcaaactattggcatttctcctta

SEQ ID NO: 5974 - DNA, 1501 bp, Oryza sativa
cctcctgaaagaacccaagaaattggatttgcatgccacggaaactcaaataagaaacacaaatgaaacacagctcaaacaaagaaggttgacaagtatgtgttttaccatattccttctggaccttacacttatcatcttaattaggacaaggtgctagtcaacaaataccgaggaggctctgactagtttgtttaagtttcttcatcaatttaccactacagatcatgtaaagtccattgacacaagaatatgatagcactaagttggtatatatattcttttattatttaagagctataagatcttcaagaggcatatggggacctgccctacagactataatcaggttaaatatactgacaaaacattaatagcattacacttatgctctggtggatgcacttgcagcagaatgaggacaacaggatggagtatccaattacctgagcagatggactttgtggagcagatgcaataaatggtggagtatatagcaggtagtttcaggatagatacacttggtttggtggcatcaaacctaatgaggcctacatgtgtaggagtaaaagttgtcttgcaaagacttctcttgatgggttgtatatctcttctagtattcaaaatatcttttgtctatatgtatgcccatgtcttcttctccttgcatttacattggtaaagcctactattaaccaagtcctaatttatgttaaaggtagcatgttctattttttctttttaaaaattgtatgtcaatccttagcatgttccatccaaagaaagatccaattctaactcctattacacttcatgtgcaatgagtcataccgtgaaagcccagcttcctcgatttcccagcatttgcatgatccatccctaccttgactgcctcagcatcagaaacagatatatcgatcaaaattcaatccaaatcgtaacaatgtgagaggcactcaactcaaaatatgctactaaagttatttttatgttccatctgtatagtacaatgcgctgatgctgtctagactgaataatcagaaagataatacggtcatatatgatatgaagaggttcaatcctacttgcaatgcaattccgatccgaaaaggctgtgtactcaaatcgaaaatattacactgattcaacccgatgttttaacgcataacagctacggatgcttcttatctagcctgttgcaatagcatcctataatgatgcaaacctacagccagcaactcctgaaaaaatcacctctgttcactcacctaatgattttgtttccaagtctggtgctagcagccactgaatatacaccagccgatccaccatgagccctgcaaaatcgtatgccctcgcatcaagtatccctcaaaacgaaccaaccataatcgttgacgcggaaataaattaccaaaccgaggagacagtgcggtggctcgctgtgtcccaaaccctgagttccccgtcagccgcgctggatgaagagcaaaccccaaaa

SEQ ID NO: 5975 - DNA, 717 bp, Oryza sativa
caaatcgtaaaatacattatgcgtaatatagagagaaacatgcctaatattccatccatacggtatcctatgttaagacaagaacatgcctaatatgcctaatatagagagaaacaaatactatgaaaaaaaacaatagtataggctttgtttagttcacacaaaaattaaaagtttgattaaaattgaaacaatgtgacggaaaagttgaaagtttgtgtgtaggaaagttttgatataatgaaaaagttggaagtttgaagaattattttggaactaaacacggcgtcaaacttatttggatcctgacacttaaacgcggaattcggcccaaatagtacaagtgcccacgccgctgaacaggcccaccagcccatataacatatgccacgtcaccgatccgtggtgctgagctctccaaccaaccagcgacgagcacacggatcgtgtgctttctacggcctatcactagccgtcggatccgatcgcgatcccgaaacctttcctcaaacggtcacaagaaaccgcctcggtccacgcgtccactgcccccccgcaacccacgctctccagccccgcgcctataaaaatccccccacctcccctcctccctctcactgttcgcctttccacgccagtttggtcgctctcgatttcgatttcccccaaatccaccgcaagagaaagccaagtcgccgccgagaagcgaagaggaga

SEQ ID NO: 5976 - DNA, 1501 bp, Oryza sativa
tgatgggccatcaaaacgaggcccaagaaaactatataacgaggactcagatcaggcccacagcgtcctctttctcaaagaaaagatcaggcccatgtcacgaaccaagagaccggattgggttgttagttgttagtactacttgttattactcacacaataatatgagagataaaatatagttcttatatatatgtttgatttttttatttacaaaacgcgctacaaatatatacactcatataaatacacacatttttcttaatttttttttaaaaacatgcacatctacacctaaaaaagattaggctgttttattccgagattaatgatgccaccacaagtatatttgtctaccactaataattaaataattagccgtaccaagttaattaaagtataagcatgccactcacattagagatgtcctcgatccacattcaatagcttcccgtactgtttgtctcttatcttctagcctttgcatcaacaaaacttctcctatatatagacgcttcatttatcacgtttgtatatatttatataaaatatataagtgggtagtatcttctataatgacatgccaagtttgtcttctataattacatttgtatctcattcgtcagcaatttagatttatcaatctacgtacgtacaattttaggagactaaaaaaatctaaaaactttaaggaaatatagcaaatcccaacaaatatacggcctcatcggttacacatattccctaataagtcaaaatattttattagaaaataaaaattaatttagagataaaacttttatatatgcgtttttagcgacttaaaaactaatgctaaaaatgaaactatattgaaaataaattaaaattaacttcaaaattaagtttgaaaatttaaattttaacttttaactttaactcgttaggcaaccgatggagcccatgtatactagacataccgtactgtttgtctatcttcttcttgccttggcaacaacaaaattactattgtagatgtctcattttcgcatttatcgcgcttgtatttattctctaatgacatttgtatattattttatctgcaatttagatttagtaatgtgcaattttaggtgacccaaaagtgtacagttttttcaggaaatctagcaaatcccaacaaatatagtgtactagatcccatgcaaaatacaaacaaggcaagcagggaagaatccaagccgtccaaaccagcccacattcgagggaaatttaactatttgccactcttgtgacatggcaattaacgatttgccacgctctgtcaatgacacgtgggccctcatgtgtctatgacatgtgggcctagtggcaaatcgttaaggaccattcgtaagagtggcaaatagttaaaagcccccagattcgaagcagaaaagcccatctcccaaccacctccactcgcctccttcagatccactccaccctcaactccggcgatctacccactcgccgccggcga

SEQ ID NO: 5977 - DNA, 1501 bp, Oryza sativa
ctcatatatatttaaaccaaaccaaaccaaaccaaccatgcaaataattcctctagctaggcaatgtgcaatattatttgatggtactaattagcaccaacaattaattagcatgatcgtgattagtgggaggagttggtgataattaacagtagtacacgtacatgaggaggttgagagggaggccgagcgcgaggaatcgggcggcgaagcggcggacggaggcgagcgagctgaggtccagcggcatcaccaccacgtcgccggcggcggcggggcactcggcgagcagccgcgcccgcgcctccgccgccgccttgaggctcctcgccggcagcaccagcctcgcccctcgcttcgccagcaccctcgccgtctccgcccctatccccgacgtcgccccggtgatgatggcggtgatgtggcggaggtcggagcaggccgcggtggcgtcctccgcggtggcgcgcgacccgaagccgctcgcccccgccgtgccggccaggtatctcagcgaggtcagcatggctaagctaagctagcttaattatggttaagctaagctaagctatggcggtgatgagttggcgcgagatcgaagagaagtcgtcgcatctcgtcggagaagaagatgagctgagctgggtataaatagtgagtgagtgagtgagtgagtacagttgcactggaaagccatgagctttacataatataatcatgttgttattaggaaataattaagctgatttaagcttttaattaattggaagaagagggggtacagtttattttcgttaatttttagctgattttgtgcgtgtcagtcagtgtgtgagtgagctgtgagcatcagatcgatcgacccaattaattaattggtgataccttagttttaatcatctgtagtattcatctttcctttgcttaacactagctttccagtagagacaaaagtagtacaaatttaagtcatcttcttcctcggttcttcctcatcatctcctcgtttttttttaaaaaaaattcctctctttaatttggaacctttccatcggtcatcacacacatgtcatcaccattgatgcgcttgcacacacgagagatactaattaacaaggaacatatcatatacacataaactttccgtacacacttcgtacacaccaattagcaaatatcatagaaaattctagaaaaaattagacacatatttctaatagtattgtacccactgtgaaatcttatctcaaattcattatattttagccgtaacaaaattctaacagatttttaccctaaaaattgtcagattttccactttttttatggctaaaatataatgaatttgaatatgagattttgcagatatgtgtaatattatattaggagtatgtgtctaattttttctagaatttgtgacatttgtaattggtatgtacggagtgtgcatgggaagcttgtctgcatatatatatatatatatatatatatatatatagga

SEQ ID NO: 5978 - DNA, 1501 bp, Oryza sativa; identical to SEQ ID NO: 1218

SEQ ID NO: 5979 - DNA, 1501 bp, Oryza sativa; identical to SEQ ID NO: 1219

SEQ ID NO: 5980 - DNA, 708 bp, Oryza sativa
cagtcagtctaaaagcaagtttaataatattagagcaagtttaataatattgtcaactaatatctttaaaagttaacacatatcatctacagccaacctaatagtatgttcactcatacaatagttagttgcaggcccggccacaggagaggagggggagggggttgagctatgccaccgcacagggcccacaaagtgaaggggcccaaccccatatatgctgtatataatagcccatagaaattaggaagcctattagcccaggagagaaagagacacacctacgtgaagaaatttccatcattttggcttcctttcgtgctatcgcctattcgcctccgccgcccttctggccacgtcatcttattaaagggcccatttttctaacttcgttctaggccactaaattgacacgacagggccgggttagttgtacatatgtatgatgcatcattttacaaatatgtgatcctgtttaacatgggaaatactaatgtatgttcaggtgtacgcatggatcctaatgcgaatctgacgtctctccacttgagtgctattgcacccgggtgcagaaaaatactttccaccttaatcaaccaggttatatacgcacgatgcgtacaagaatgcagggcactgggaacacactaactagcttgcacttgtgttacttagctagtataattaattaagctcactcgatcgcca

SEQ ID NO: 5981 - DNA, 1501 bp, Oryza sativa
ttacagttagatgggttgggctggcccaaaagggaagatgcactttgcaattagtttttagtgtttttgaaagtaattttgtataggtgggatgtatttgagttaatttggagcttggcacaagaggaaagaaagaaagttgccattaagaaatctaggatgatgcatgatttcacccaaaaaaaaatgatagatccatttttccttagagagacttacaagaaatgtcatgtaagtaccatatgtcagcataaaatactagatcaaaagtaacgcacatcaacatcgcccatttagagataaattgatctggttttactaattgaggaaaccttttactagtactagatatttataggactcctctaggtgggaaaatatgcagtgcaaataacatatgcagttgaaacctaaacattattgttacatctaaaaatggacgcatttgattaatttgtctatgttactaagagtaaaatttatattcccagtaaaacttttactcatggctaaatttataagtaaaatttttactctcgatgatgtagataaatctcatgcgtctatttttagatccaataataattttcatattttcactagatatgtggtttgcactatacatttttcccatgtgatttgtgttcttttgaacactttgaaagtagtaacttctactccttacttttcacgtgcacgcttccaaacagttaaaggtacatatttataaaaaaaatttataaatataaaaaacatattaatttatttcttaaattttttagttaatgtttaattaatcatttgttaattcatcgcttagttttacgtgcgagaaaaggttttcaaccctctcaaatgaacccagccaggacactgatgcagctcgaaggtgagcccataaaatttttgaacctcttcattttttttaccctgaaattttgagcaaccgaaccacgcgaaagatgatccaactcaggaaggaaggaaggaagacgcacacgcaagaatcgagccgccccagctgtcacctccacctgggccccacatgtcaccccccccacccacaccgccgtgggcccgcacctgggcccacgtgtcgtcggcccaatccaacacacccccccgggttggtgaaggcatcatgaaccacgccctctctctctcgcaccccacccaccaacctaccctcacccaccgacacgtgggccccatcgagagcgtggcccacacgtcagtgagaagaggtcgggttgctccgcgtggcaatctcggttgctgacccgcttttgctccggccaataaaaaggcgaggcgaagcggaggagcggaagcagatgacctcgccgccgccgccgccgtcgtcgttgctccgccgcctcccgaccacgcgctgctgctgctttgcctccgcgtcgagcggctggagcgcgagtgcgagcgtgcggctcggatccctcggcgggaagcagcggcgggggcatcgcggcgtggcggtgatgcc

SEQ ID NO: 5982 - DNA, 1352 bp, Oryza sativa
ttttgtgaaatatgtaaaactatatgtatacataaaaagtatatttaacaatgaattaaataggaaaagaattaataattacttaattttttttgaattagacgaacggtcaaacctgtttagaaaagtcaacgacgtcaaatatttaggaacgaaggggacaatattttggaacagccagcgaacactatagttaagtactccatccgtttcaagttataagatgttttgactttggtcaaagtcaaatggtttaaatttgactaagtttatggacaaatataataatatttatacatttccaaattggttttattaaattagtaattaaacatatttgtataataaatttattttggttcgaaaatgtaactattttttctataaacttagtcaaacattttataacctgaaatggagggactagaaatttctagtccttaagaaagtatctggagataccaagattttacactataaattttggtacctcaagatacttagtacgtagagggaccaaattttacactataaaatatgatacctcccggtactttctaaagtatggtaaaattacccatagttaaattgctagagagttagcatgcatattgaaacatagtagcatatctttattactcccttcgtcccaaaataagtgcagttttacattattcatgtccaacggttgaccattcgtcttattttaaattttttatgattactatttttattgttattagatgataaaacatgaatagtactttatgtatgactattttttttatttttttttataaatttttcaaataagactaatggtcaaacgttggacatagattttcatggctgcacttattttaggacggatgtagtatgagctaagtgactaacgtaactgatacttgatgattggtttgccgtgttgaagaacatggagcatatttgtctgaatgccctggcgctctataaatagtgattcaagtagtacctcactattatccttctgtacaactctatacttctgtcatttagtggtttgccagcacacgaccttatgtactttggcagctaatttagtctggtctaaccagttactaactgtaatcatgacagcttgatttgagagagaatgtcgtgattgcagtatcaaaaactagagcataatctacgtactaactgttcttctggaaagaaaatagctggggcaataaaacagccaacagaacagttcagactttcttaactagcgtgttgtgtgtacattatttgcttcttttctcagagcctgtacctagctagttgcattgagcgccttgtgacttgtcttcttttccattgtttgctgcagt

SEQ ID NO: 5983 - DNA, 1501 bp, Oryza sativa
tgatcatttccatggcaagcaactcgagcaaggtcatctacctggataacatgccttccaggaacttcttcttctagattggcttgtgcttcattgaggtcaggtaaagcccctccatcttcctcttcttctgctaatatgtttagatctatagccattgtgatgggtgggtgtggagttggtttgtaggatgatggatgaagtgataaaaggcttgtagctgcctcgctgcttgaggattatggagggtacccttgggcggcaaagcaccatccatggagtttttgaatttgattagaccggttggattattttaagcccttatgttttggcgccatatcactcgaattaggtgtataacaccaatctgtagtgttgatactagtagtagcacccagcattaattggatgcttcaaatattccttttgtacagatgtggcagtgtacttgtcgtactcctactaagcattcaaatgattagccccaatcctataaattgagggcaaaatggtcattttcacacaacactaatttttcctaactaacctagaacgtcctcctttctgggatggagggagtattacgtaaagtctcactaaaagtacaccatacacatacatatatattactaggtgattcctcgcactttgctgcggaaattactaagtaatttttaatatatgttttttttcaacaatcgaacaaggagtaagcatgatgttaattattaacaacaaataaaactgatttgtcaagccatgtttgaagataaataaatttaatagactttgtagaagattatagataaaatttaggttgttggccagtatcgcaagaagcgaaagataggggaaaaagaaatgaaaagctaggatttattagcagtacacatgaaataaactaaataatatctctactttgatacggaatatatagatgaatgtacgctaagtattatgaaaatgatggatatatttgttgaaatattgtggaaactaatgataagagaggttatgattggatctatttgcattttgatttgtagaattaaataaattatggatggtattgcatgtttgcatgagctttttgataagtagttattgctagtggatgatgaggccgtcatgtttgcatgttgagctttagacttagtgagctctaactttatagtaagagatgataagtctcactgaaagtgcacgtatagaaggtaagattttcttaaatagtggtgggttctaggagttgagtctggagtggagttgtggagcagcctaaacctagctccaactctctagttcattttgtgagagaggtccacctaactctgctcccattttagatggagctgaaactatttggctgagctggtgttcttttcccctaaagatgaagattgagttttttacacaaacgaggtggtattaacgtatgattaattgagttttaattattacaatcttgaaaaatagattaatatgatattttagagcaatt

SEQ ID NO: 5984 - DNA, 1501 bp, Oryza sativa
attttaaagaacctgatgaattgctacaagcctacagcagttttaaattttcaaatgacaacaaaatacatctactggacctagtttgtatgtatgttgtgctctgactgtttcgtgcctactacaatagcacaaaatggtacgctaatgtatacccttaagttctttaagaatcattgtacaaatttcttccgtgttgattggtaggaagagagaaaaaaaggaatgtatccaaggagagctggccaactcataggagaagtgagagctcatttctcctgtatcacaactcagtctcacaagcatatgtaataaccatcagcatgttttgtgcaattgtgcttattacagatttatgcattagcaagctttggaataggtattaccttcttcagaaatctgttcaaaacagcccagcattcagtgctatgaagcttctttagtcgagattgatgatgtctcaacatcttgaggacctcctgctgctcgttccattggggtttcactttgagcttatgattattatatgcaacaacacctgctattgctccagattgcagaaaagatggtgtaagagaaattaatgggctcaaacttgaacaagggtgtaagagaaaataaagttaaaccaataagagaaaaaacagtataatatacctatcaaataaccaattatatttataaaggtaagctgtgtatctgcaaagatagcagctgacagcaacaccacagtccaatccctcacaattccagtaacacgagctgtcagtgcactagttctggaaatgacaaggaagactgagggatttagggtgaaagtgcatatgcagtttaagaacaattttcaagttaattaattatgagatcaagtggtcaagatatatgcaagggctcacatagtacatcatggaaatcaagttaagcctctccctttttcttcagaaaaatctcatgaagatcagtctaagggcttctgtgacgattccacccatctggtaaaccacacagatcaagctgattgtattttcaccaacagatgccacaataaccccaatgctgatgacaggcatgatagcaagcattttacagctcgacaggcatgatagcaagcattttacagctcatttcttcaaggccaagggcagctccgaggagaaacacagctactacaatgctcaaacaaagagtacattaacatcatattttaaattaatagaaacctataacttgatcaaaaaccagagagctcacatacttatttccttcaacatctgtgcaaatgcaacagatatgtaaaggtacgcactgctccctagacagtgtgtcattgaaaacattgctccaattgcaatgaccgaactaacatatctcaaagtccaggtgaactggttgaattagatagaaatattgtagagcacctaaacatgtgctgctgggtagctacaaccaaatattgaaaatcaatcctttccaaaagagtacaagccaaatattgctgtgt

SEQ ID NO: 5985 - DNA, 1501 bp, Oryza sativa
aaaaaaatcatttgtgtccgcctgaataaaccattttctagtagtgagataccaaattttgtactaaaaatcttggttcctctcgatacctcttaagaactataaaatttcaaataagaaattaaagcactaaataaacatgtttggatcttctcaaaaaaaaattaaagattattgtattccgttgattgtatcgtgggtgctgaatattgtgccttcaagaggccccagtcactcatatatagagatgatgcggggtaggattagaaggtagaaaacttagccatatatggctttagttttctggtctctattttttatttatttgaataggattccataccctatattttgtagtacaagaaatcatactatggcctgatttagttcctaactttttcttcaaaccttcaacttttctatcacatcaaaactttcctacacacacaaactttcaacttttcagtcacatcgttccaatttcaatcaaacttttaattttgacgtgacctaaacacaccctaggctagtttgagtctaccttctatctcctagatcaggcccactctcccttcatagccattaattatgcctgtcgggtgggtacccagatccatgatcgctacagggtcctgtgacttgcgaaattgcagtacaacctactagcaactggatcggttggttgctgtgttcgtttatcgcggtcattgcttcaaaatatcatataggtgtaggcactatataggtgccgaaagtgctaaaaccaaaacctatagtcatttttccatttttacgggttgaaatctcaaaaaaaaaaaaacctttaaacaattataggtgtcggttaaccgacacatattctataggtatcggtttttttttaaaaaaaagacacctttaatatattaatatattataggtgtcagttaattaaaaatcgacacctataatatacggttttaaaaaaaaagatacccgcagaaatcgagctgggccgacaatcgagccaagccagtttttttttattcttgtgacctcaaaggtgccgggcacctttaaatattcacatcagtgccgcctccgtggtgtcgcttgggaaaaccggcacctatgtggggttcccaaccggcactaatgtggttttatgtggcagtgagttgggaacggtttcctatggcatggaaaacggaacagttcattagtgcgattaattaagtataagtctaaaaatagaaaatagattaatataaatttttaaagtaactatctaccatatataaatacatatatgtatatatatatatatataaatacacatatatatatatatatatggtgtgctacctagttacgtaacacctctcacagagtctccttgcgtgtccctactaggcccagcccacccccgcctgcacccaccaaagtaatttttttactatgattagcaccgtctatttatatgtgtttctatccggcagtaaccatccaaccccttatcccc

SEQ ID NO: 5986 - DNA, 1501 bp, Oryza sativa
tttacgggttgaaatctcaaaaaaaaaaaaacctttaaacaattataggtgtcggttaaccgacacatattctataggtatcggtttttttttaaaaaaaagacacctttaatatattaatatattataggtgtcagttaattaaaaatcgacacctataatatacggttttaaaaaaaaagatacccgcagaaatcgagctgggccgacaatcgagccaagccagtttttttttattcttgtgacctcaaaggtgccgggcacctttaaatattcacatcagtgccgcctccgtggtgtcgcttgggaaaaccggcacctatgtggggttcccaaccggcactaatgtggttttatgtggcagtgagttgggaacggtttcctatggcatggaaaacggaacagttcattagtgcgattaattaagtataagtctaaaaatagaaaatagattaatataaatttttaaagtaactatctaccatatataaatacatatatgtatatatatatatatataaatacacatatatatatatatatatggtgtgctacctagttacgtaacacctctcacagagtctccttgcgtgtccctactaggcccagcccacccccgcctgcacccaccaaagtaatttttttactatgattagcaccgtctatttatatgtgtttctatccggcagtaaccatccaaccccttatccccgaaatttttggatcatccactcagccggcgaacgcctcaccctgccgtcaagatggccagaccagctgggatgcggtgaagaaggagcggctagtgcagtcagcacagctaggggtcgccaaactccacatcggagtggcgttagaggacctgccgttgagggggagccgccgtcatccgatcagatctggagccaccgtcgccatggctctccaccgcggaggcctaggcagccaaggacacgaggtgactgccaagctcctccaacgcctgccgcagcgccgtccacccctcccgccatcggcgatgttcatgaaggaaacgggatgtaacccgatccgctgggaccagcgccggtggcaccaggagagccgcgacaggtccggggcatcaggcatggcttcctcctccttgctcatcacggaccagcgctgtatcggtgagacctggcggctggaggctggccgtccctgtgctatgcgtggattccaggcagatttggcgctgatggctgacattgcctgcgcagggccacacctgctgctcgtcaatttcttccctatctacaagctgggtcctcaccaacacctgcgacacttctcatgttggtccctagctctgctctcctttatctcctctctttcaattgaaggggtgggtaccagcaaccttcttcttgccagtaaaacaaatagatttttcctcttcgattgtgcggtcttaatttgcaacagtatttttttattttatttttttttgcatttgctcattgattttgttgtagattgc

SEQ ID NO: 5987 - DNA, 1280 bp, Oryza sativa
gtctcatcattactcaatttactagatggcaaaaacgacgaaattcctaacattattcaacaactctgtggaaaacaactcatcttcaagttcaagctcagtgaacaaaatctgactgaaggcacaccaaactatgttgtcaaaaggacatttgtgcctgattatatgcttgagaagcaatacctcattaataaggctgaagaggtaaagcaggctactactgattttttacaacacaaaatcttgaaaattttatttctgaaatgtttccacattatgattttacaggagttaatggacgacgatgtggataacatactaaaacaagatagagagacagatcaacaggtatttgaacatataatacaaatattcatttatttataatatatagcacatatgacaaatactttattgcctttgaaggaacaaaccagcaggggccctcttattaaaaaacagatccatctcactgctacccgtgaagcaagagctagaggatagtgaccaggaaatcatgagtgaagatgaactcacttcgtcggacaaacctcccagttgcaaacaaataagacggaggacatacataatagaagacgattcagaagaggagagcaacgaaacaagtatgataaaatgtgtagatgcaaaagttcgaggcaaaatgcaaaaggcgctcatgcaaaacccacaaaggcagaaatcagaaatgacaactacagccatgaaataaacaaatcagttgttcaagaatccatcaaggcaggaaaaagacaggcgaaaaccatcaatggcataggcaaggaaagctctgttgagaaacgtaagaaaacatgtgttcaaccagacaatatagcatgcaacacaaggcctcagagaacaaggaaaatgaattctaagtatacagatagtgcttagagctcatgagaatagttcataattagcagtacctcggtagaatatcctgcagttaatgatactagctagaaagaatagctcatagtcaatacagatcattacatgtactatattataatagctgaatattgtatgtgaataaactgagatatattactatgcgatctgttattttatttatgattttttatcacctctatatatacagacctaattttgcaaccgattgcacatgaagcatccaaacatataattcatgcaaatgattagaaaagaaaaatagcgtcaaccaacctttgcctgcctgccaattcccccaggctcgccaccctggccgatccgtgacccaaccaccgcaccac

SEQ ID NO: 5988 - DNA, 1501 bp, Oryza sativa
tcactgcttcaggggggcagagatgagcagcttttgcactggacactagcctgcattcaggggtgggggcatacatcaatctggatcgttgaagtattatctgacggtgcaaaactcacccgggtgtattctccggtggtgcaagggatagttatatggagaattacatacgccggccgggaggaattttttatttacctctagtgtttcagtgacaatatattattgttcttgttatgatgctagcaaccagtttcttcaccttcagagatgtaactttcttcaagatcagcagatcctgaattgataaaaaggagagtatgctgtacttatagtctataatatataatttgatcaattctctgggtgtaacgtttggcctaggaggcatcaaaaatcgtatggtttcttcagaagtcagctgctgcatcaacaatttggattagtttcagtcaaactctggcttaaagagtggctaccttcaaatctcagacatgaagcatattataatccctttgaagttgaatcatctgcaggtcgatggcacatgtaggtcacaaagttgctgaggtcaaggggttcggagttttaaagcccggccccttttgcctgctgctgctgcatgttctctcgttcttatcgtcagaccagcagcagcaacaggtgtttgccatgtacaattcctgaagagagatcaacgtgtgttttgattcttattatgtgatgaacaattggcatctgtgattatcggttttgatatttggagattattgtcgaagtggttttggagataatcaattttgaggagatgaacagggtttactggtttgtcgggaccggtcagaccaggcggtggttgccggtcagaccggcgctttgtgagcggtcagaccggccggcccgcggtctgaccggctgacgctgtgtcggtttcggtttcgggttgtttctttggatatccgtgattatttcatggttatggcttctagatggatactatatgtatgtaatactgttgtttgctactaatgagtcaagttggagatagcttggtctcgtaatatggtttctttgtttgtttcatgtgtaggtgactcgatgcctcgggagagtatttgtggtgatggaccgggagtcggcttggtggtaagacgatgtccgtggtggtcagatatcatgcgggatactaaggttagagttgatgcacgtggttgatggagattccatatggcatacgatggaggtattgtgtgtgtatgggatgcggagtcggatttggaaggagtccaaatttggtacgattggttatgtaaagtttctttcttgtactagaggttttcctaaggtgtttaggattcttagtatgagtttggttcgtggttttaggctgcctacctcgggtataaatagagggggagcgtgaggcttcccggtatcgcttagcaattgagttgctagtttagttagggtttcgattttagttgagatttttgtaaggagt

SEQ ID NO: 5989 - DNA, 1501 bp, Oryza sativa
agataagtataaatacgtacatacaagaccagattccgtagataagtataaatacatagtacatacaagacagtattcacgtagaatacagaaaaatatatataatgcaaaccttagtgtaaacatgaaaactactgtacaataataaaaaaaatgaatgtctaacatttatccacgtcattcttagtacatgaacatatcctatgcacacaatttttccgtgcacaccttgtacacaccaactagcaaatatcgtagaaaataaaaaaaaattggacacatacagttaaacgtttcatatattctaaaaacttccccctaagcacccttctgtctcatattatatgatttttttttcaagttaaacgtttgactaagtttatagaaaaaaatatataataaccctttcgacataaaacaaatatattttgaaaatagattaaatattaattgttaatgaaactaatttaatattatagatattgctaatatttttataaattggatcaaatttaagtaaatttgactaaaaaagtcaaaatagcttataacataaaggtagtaaaacttttacttttgggtgtgtttagttcacgctaaaattggaagtttgattgaaattggaatgatatgacggaaaagttgaaagtttatttgtataaaacttttactcatggtcaaatccgaaagtaaaaaaaaattcactcagaatggcatggctaaatcttatatatctactccctccattccaaattgatctacatatagtttttttttgaggttatttctaaatgatctacatatttgtgttcattcattaggtctattcgttatttttgcattggagtaaatggatattgatacatgcatacaagcatttataacccacatgcaatatcttgatttgctattggctagaaaatagtggggatggtgcatgtattgagtttgttgctagagtaaatatagtatgagagagtatatctatgaaatatgtagatcaatttgaaatagaggaaatattttttaatattttctcgggcgtagccgcgtagtagagagctgggtacgtgtagtacactgtacttgctggctagcttgaccggcggtcgccgccaacccgaccgccacggcgactcgtctccccactccacgtgggccccaccaccgcatggccggtgcgttgacctgtcagtctcccagggccccaccatccacactgtcgtcgcgatacgacaacgtgggccgtccacgtgtcccatcgagagccaatcggacggtcaatcgtcgtctcaagcctcttaattgggcgccttttcattaaaaaaacagaaaaaaacggggaaaaaaaaagcgaagctttcgagctcctaacaataggagcaaaagagacagcaacgacagcgcagttttggtgcgaatttcggaggaaattcggtgggaattttcgggaggtggaggaagagagggaacgcggcgatctttgcggcgacgacgatgc

SEQ ID NO: 5990 - DNA, 1501 bp, Oryza sativa
ataaacttagtcaaacgtttaacttgaaaaaaaaatcatataatatgagacagaagggtgcttagggggaagtttttagaatatatgaaacgtttaactgtatgtgtccaatttttttttattttctacgatatttgctagttggtgtgtacaaggtgtgcacggaaaaattgtgtgcataggatatgttcatgtactaagaatgacgtggataaatgttagacattcattttttttattattgtacagtagttttcatgtttacactaaggtttgcattatatatatttttctgtattctacgtgaatactgtcttgtatgtactatgtatttatacttatctacggaatctggtcttgtatgtacgtatttatacttatctacagaatctggagacaagtacgggtgatagagatgtcgaataggttatatagaaagttcgttgagaatgtgacttgtgtgatcaggacagagatctttgctcactgaatttcgtcaagtatcgattctgcctctgaaagtctgaagtctgaattccaattttccagatgacgaacaacatacttgcagaaggaacaaaaacgaatgaacgcgacacataacaaactgcaatgctcagctggattggcatcagcaagacgagagcaaaagcaatcactcactttcagattgcacaacatggaagagcaaacaaaagcttccatggaaaaacaggtagcagctcagctctcactctatatgcatggagagagcatgatccagttgcaaacaacccagtcaggttcaagacacattcatggtacagtaagatgctaactttctgaagcctcacacagtgacaaaagtatcacagatttcacagcctcatcagcaaaggggggaaaaaacttggtactggaagaagagcatgtgagcagtgacaaagttaagggcttaaagagaggttctacagagctgggtttagtttcatcctcaaattctcatccttctgctgttaggagcacgctggccctgcagtaggggcagtcgctgcgagagcgcagccatcgctcgaggcaggccgagtggaagatgtgcttgcaccgcagctcgaggagcccatctgcatccccacatctctccaggcatatagagcactccgttgaaggtcccgcgagttcgtcatcatctgttactctgcagcttgctacttcttgtgtaggagccggttcagaacaatgcgcgatgaacgtatgcttatctgcggtgttgaaggtttcagctgtgctctcttggagtttgcagggagcgatcgatacgtcagtgtggaagcaactggttagactgctgaatatgctatctgcggtggtggagacgcccggggctactccaccatgaatggtttctgatgacaacgatgtattttgcctgcaacaatgggatggaatttgtaaatgtagattctctgtagcttaagttctaagctggaggagggagtgcgaaaaagttgatgcggacctt

SEQ ID NO: 5991 - DNA, 1501 bp, Oryza sativa
ggtcgaggggcggcagcaaatccggcgatggggactgtggcggttgcgaggaggagctcgcgggggaggagcggcggtggcgtgcgaggaggaggtctaggggcggcggcggatctggcgatggtgcggcggcggattcggcgatggggaggagctgcggcggcttgcaacgaggagctcgcaggggaggagcggcggcggcgtgcgaggaggaagtcgagggacggcggcggatccggcgatgggaaggagcggcggcggcttttcctcttgctcttgctcgccgccggctcatcctcttgctcttcctccagcgatggggaggaatgtggcggcagatctggcgatcggttgacggtgattgcaaacggcgtccatcccttccctctctcatcccttcaaccaaacaaaaaattaggatcgtcccatcttacaaaccaaacatgtgagtggaatcatcccaacccaaaaatcagggatggttccatcccatcccacttagtcccgaaaccaaacactaccttagttcttctacattttactatctccaactcaaataaaaggagaaatcacacttatagagagagagatagagagtaaagaaccaaatctaccatatcttgttcatttaaccatcttttacacccaaacaaaacggagagaccacacttaacacttgcattagaccacaagtactcatcattagccttaataagtcagttttgcatttcggcacgtgcgtgtcaggggcagaggcaaacctgcctatctcctctcctgcctgtctcacacacacctgacgcgtgtgcgtggggcccacctgtcagagagacattagcgcacgagccaccgtgacaaacactgccttgtgaggtcgagttcgtcctcgcggcccagaaaaaaaaaagaaaaaaaaaccaaaatttgggggaaatataaactgcgattgcggcggccgcaatccgaaaaaaaaaagatccatttttttcttttcttttcaccctaattctgagttcttgacatccggaatcatcacgctcttcccaatcgaggttagtctccatcttgctgttcttcttcccccaaatccattccgtgtttcgtaatctagttctataccccgtgaaattcgggggctttttttttctgggtggtgttcatcccggatttggctggggtttgtctaaaattcgagcttggtttgcttccggtttccgattaggttattactgtttaggtctgcttcagagatggggttagggttagatttgttccaactattcggtgagctcctggatcagcagcttgggggatgcgtgtgttcttgtgctggattgtggagttcttgatccctgctaaagattgattgcttgctttcttttcttttcttttttttgatctggttttcgcaggttgccgcttcgaatctcgccgcgcgccgcggcggctagggttttggtcgccggtgagctgctgcatttggtctccaagatgcagccgc

SEQ ID NO: 5992 - DNA, 802 bp, Oryza sativa
aattcctgcagccctagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctgtcacaccccgaagttttcctcccaagccaaaattgtaatttttataaatgaccctaagaaaatgcaggtgaaatcaggagaaaaccctaagaaagtaatgcaaataataatcggatttgacatgtggaattttttcttgagttctacatgtcgaaattcattaacaggatttttagtggaattttcagagctctagaaataattttaaccaattaaaattgagcaagcaatattttaattccagggaaaatcctttttcctttttccttttctttttcctctctttttcctcctttttttcgaatgggccgccggcccattccctccttcctcccctcctccttgctgggccggccgcaggccgaggcccagccaggccgccccgccgcctcctctctcggggtcgccgacaggtggggcccacctgtcgggtccttcccccacctcccgccgatctcgcccgcgccgccgcgccctcgtctccgcctcctccgggccacgtcgaccacgcccgcgcgtgcgccgcgtctcccgcgcccactcctctccctctcctgctcgcgcccgcgcccgaga

SEQ ID NO: 5993 - DNA, 961 bp, Oryza sativa
gttcacgttatacaacggttagtcttttttttagatgagtttcaccatatttcctcacgaaataagttcaccgaggttcgttagcttaacacgataattttttgtctcttaaccacaaaactagaaatgtgtacccctaaacttacttaaaccgttcaaaggaggtcacatggtagtattgactatattttcgcccgattttgttaacgtggcatcctagtcaacaaataaaataaaataaataaatatataggacccacgtgtaagtgagaaaaaaaatgtagggtcaataatttatggggcccacatgtcatgctctctctcctttccttcttcctcctctctctgcctcccttatctctctctcccctttctcttatcttcatccggtgccggcggggcggggcctcgagtagcgacgacggcgtgaggtggccggctggcgggtgggcgctggagcggcagagttgccgaggaacttggcgcgcgactccggtgcctgacaccgctgtgcctaaggtaggccggaggtcagctcgtaaggcaggcgtatggcatgacggcaactcgatggaatccagcgagggcacaatgtcctgtaagtagatcgcggttgtgcgaatccaacaaagaaatcgatgacgacgaaggtgctctggttggcgcggaacgcgatggtcaaaggtcaacacactacacgaaaagaagctcgtgttcccgacaaatgcagttgccttctttctttgttcacctacattttcttgttctttattgaattggatttgactaaggacaagacgcgttgctagtgctagtttcagtaagcctgtcccttatagaggaaaggcttgcggtggatacctaggtacccagagacgaggaaggacgtagcaagagacgaaatgctttggggagttgaaaataatcatagatccggagattcccaaataggtcaacattt

SEQ ID NO: 5994 - DNA, 177 bp, Oryza sativa
ctaggctccgtcgcagtacagcatctccaccaccgccaatcaccgaagcgcgccaccgctcatccgtgtccaccatcgatctttgccgccgctgcaagatgagatgatataagactgagggtaatctaaaaattctgaacgttcacaattgcattgggaattgcatccgaatataga

SEQ ID NO: 5995 - DNA, 1184 bp, Oryza sativa
ccatgtttcggcggcccaaggcaattgtctagtctacgtcggcgtcgttcaagactgcatcagtacgttcgacctcttggattgctccggtttggatgatatatttgtctgcctatttatcatatgtcttagttaatctagtcttagtatctcaatttagctctatcagttgtttctcgctttagggttcctgtcggtaccggctaaattgttttactagattagattagctaagacatctaccacccaaaaattagtcaaaggcttgattgtctagatattatgtttctattcatacttagtgctgcataagttaagtttgatctactaagtcgtgtttaaaaccataatccctagcctgctttttgactgccaataagtgtttcatcggggtttcagccaatgagttatctagacgttgcatcagcttacaaggattgcatacatattggatttagccgatggcaacaaagattttactgattatctaatcttgtggatttaatgctatcggacctccagccgatgtatgctttaaccttcggatcgatgcttatttaccatatcattattagccgaatggtttctactggactatattattgctatattatattatcatcaaccgattgcctttatattgttgtttacatcaagtgtcagattctacattggatatatagtcgatagctcaaaaccctatcgctatcggctgacataggcatgggctagaattactccatcggcttgtcagccgatcggctcattgatatgctatttgtatattttgtcagttgcagagtcaaactgactggcagacccgcatctcatcgtcctttggatatgcactggaactaagcagatctcccaggccagtgtgtgttttttgcgtcaacagcggcacgggcaagggataaggcggcggaggatgacgacaacaacgccggccctgtggacaacgctgagtctaggttcttcgacctggacagtgtggaggaggtgacctagccaccaccgccgccgcgtcgaggccgtgctgaacgtgccaggtgaggccgtcctcccttgttgtggatattatgggtaccccatacccatacggcatggttatccgactagtcataggggataacttatatctatggaatatgtaccagatcatgacttgggtgttacgtttcctt

SEQ ID NO: 5996 - DNA, 208 bp, Oryza sativa
  unsure (1)..(208): unsure at all n locations
tgaatatgatctaatncactaaccattcgtatgcggcctctctatccattcatcacattggtgattggattatttnaagtgtgtaaaacccatacatattcttttgtctgattgaagtctcatgtctctgatttacaagctaaggctgggcttgggccaccgattcactcgctcacttcctctgattatcgccatttggagacctcca

SEQ ID NO: 5997 - DNA, 323 bp, Oryza sativa
ctttggagtaatctgattcgagagaagattatcttttcgactacgaaggtctcaggggctactgtggatattatgggtaccccatacccatacggcatggttatccgactagtcataggggataacttatatctatggaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcata

SEQ ID NO: 5998 - DNA, 1413 bp, Oryza sativa
cctcctatatgaaaatttatggaaatatatggataccatatacctatgcgtgtacggaaaggtaattttgtaaaaaaataaatatggtggtatgaaaggaaattatctccctggtagaaggtgtcagagtctaactcggaggggacaaggtctccttatcccgggttcaattgtggtaccccgaggtctactcgaagaagggggcagagcactataaatagaaggacccctagatcaaggaggaatagaccaagacaaaccgtagccactagctagccaaatcaagatacatctagaggaaatcggagccatattcgtcgactagatctagccaagtcattcttggcggattagcgtagttgatctaattccagattaatctttctggtattctaaatataatcccatataaattggattagggctattaccttacgaggggcctaagcaagtataaatccttgtcttcattttgcggtctaacccatcgacaaatagttctaaataaatagaaacacattcgctatcgtcatctactttcagcatgcataataaattatggctcatgcaattttttcttacattcccatgcacttccttgtaagcaatattgccatcgttctcctttctacaaccatcccaatgccaactagcccctttgaccgctcgtaggacctccttaatgacatgcggcagaatttgaattgtagttacacttattggacaacattattatcagaatactagactattatctagattcttaatactaggttatgtccaatctagtactagattgctatattttgggataggggaagtaattgtgactatatagtgagaacggggttgatgcactagtgcttgaatgaaccataaagtattatcatgtatatttatgtagcattcttattaattttgcatgcaatccatctctttttgcactatgttccttgttgcgtcgaatctatatcaaatgacatagtttttttttccttgtgtttgtttgattatatgaatattttgtgtttctcccatttctttttttgataaatgtttcttccatttgtagtttttttcctgtgtgtgtttaattatatgaatattttgtgtgtctcccatttatttttctgatatatgtttctcccatttctagttcatcttgtcttagattttgtttatttttcataatcttgaaaaatgtggtccttttaatatcactatatcatagttactagatgttataatgtagtttcttttgttgtgacacatttatcttgttattgtagcagtcacatggtattatatggcctacacatataaatgataggaaagaatctaatttcaagataggattggttgaagctctcagcaaaccattttgccagggagagtatgataggctttatggca

SEQ ID NO: 5999 - DNA, 637 bp, Oryza sativa
cctgactagcagataagggagctcttccttcctcaccagagcaatagtggcagggacatagagtatgctctaggccttattccaaatggaggtggtccatctcctcctgtcatcggctataatgcccccgagacttcaactcttcttcaagggctcatcagagaaccagccgatgctagtaaaaagagaagaaccagattatcggctgttgatacatcggctcctgctccaaagaaggccaaattaaagaagcctaaaccaaccgatgatctgcctgccctagatccatccatttaacaagctctggatgaagaagaaatcggcgaggatgttgatcaagccacagatgaaataagcaatactgaaataactccatcgacttcacctaagctaactcctccgaccccctctgctccagcttacttctctaggttaaatatctttccttgattctctttttataactattcgtcctcacccgatttctcactaatcttttccttgcaaaaaaagagaattgctgtgaagaagaaatcggcatcaacaactctaaaaccggctccaccaataagatatctttaatgctttcactagttgatctcaggagaatttgtctaacacttgtctcttttacagc

SEQ ID NO: 6000 - DNA, 621 bp, Oryza sativa
ccgcgccacggctccagatccgtcgtccgccactgcccctcccctcgcccttgccggatctggtagccagaccaccaccgcgcctcccctcccgcccctgccggatctggcggccgggccaccgccgctgcccccgccggctcggcgacgcacctcccctcccgcccctgccagatctgccggctgggccaccgccgcgcctcccctcctgcccctgccggatccggcggccgggccgccgccgccccagccggcccggcgccgccgcgcctcccctcgccacggcacagagaaagagaggagagatagagaagaagtggaagagatagaggagaagtggagaagagggagccggccggccttatctcctcatgtgggccccgctgggagaggagacatatatatacagtggcagaagtcatctcaaacgggccggacttaaagccgtttgaggtgagtaaacctcacctctaacgggctatccggttgtgacccgtcacaggtactaatcacctgtgacggattaggacttaaacccgtttgaggtgaggtaaccttacctgtgacgggttctattttcaacccgtcacaggtgactagttacctatgacgggtcgtagc

SEQ ID NO: 6001 - DNA, 1501 bp, Oryza sativa
gtctcttagtagcaaaattactattaaatcgatgcttctcaacattccgtttgaaacatgcgcaaactttggcttgctgtgccaagtctccccagaatctgtgctttgcctcattatcgtcgtcaccaccgtgaagccatcctcgccgtcactcctccctagacctgacatgcaccaacgcagttaacaggaggacaccactttctgcctctccggatgagaaaaaaaattcagagagcctcctaatcatgttatgcttttgctcaagaataatgtgtagttataaaactgaaatatcaggtacgctcctaattcatcatgttgttgctaggaaattgaaatcacagagcatgacaacacaaacagaaagattagtctgaatggcacatcaacagctagagggagcacgtaaaagaaaggagtataatttctcatagtaagtttgtttcccacttaaatatctgaacaaaaacggatccagaattacaggtagaatgaaacaaaactgaaaattgcacttgatttcctcaataattgcagatgctatgtattaaaaatgcacaaggatatgaacggaaacaaaatgattatggaactggaagcaaaacagccagcaactatatgttttcaacaggcctgactcaacaaatttgtgaaattattatgttcagctcagtcacacaataaaaataggaaaaggtgtttccagatgctaaaacatcactgcacaggtgctaaaacatcactgggttgaactttgggttaattgaagtgtatagcttaatttaacccagtgcaaattaaagtgcagcaaggaagatgcaactagccaaacaggaacaaattgatccacgatggatcaatgggacatgcatgtacattatacaaactcacgaaggaacacaagcaatcaacacatatctggcgccggcaaataagctgcaattagttgaccaaacacagcagctgtgcttcctccaaaaaaaggcagaagctatagtctatagagatcaatcgagcagacagatcatgtagcaaaataaaacaccaactaattgcgcaatctaacactcgatcgagggctgtgggggagggggtgtgggtgtgttttagctgtactacaccctaggtgtagtatagtatctcgctatatatatatatatatatatatatatatatacatacttaatctatatctagaaatcaaaacatttaattatgaaaaaacctctgtgtgcatggtgaaaagaatgtgcgattcacagcaaaagtcgcaatgccacccacctttttactaataataaccggaaaactatatatagagtgctcagttaaaaaaatatacatacaatttataaatttcctaaggttctcgttacttgcatgatattggctctctttatatataaacctcgccacaatcacttcaattatcatagttacaagggattcaatactagtgccaaatttgatcatcaacacaaagacaaatcgatcaaaa

SEQ ID NO: 6002 - DNA, 738 bp, Oryza sativa
ctatgtaagaatcacacacctacgaatttgaagtgcatatatatcgccaagtcttaatttgtatattactcaggatatttttatgatatttataggaggttaacaatgctgtattctaggcaatgcctggagtatgcgatgctgttcatggcattgtaatcactactcattggaaaaaagatcatgcacgatcgacaatatcaagtggacaaactgcagaaatgacggaaaattagtggatggagtatttctctacctacatttgatgggctaaagagcaaattaggtgatagggtactgtgcatgtgcaagatgatgaagaagcaacacctcatcaaattattacgttttgcagtatacgttttaggacattggattgatcagtatgctatcagtttaattaaaaaagtaattgcataagttgtgacttgggaggtaatactccctccatttttaacatatttgtcgccgctaaattttggacatacgtttttattatttatgttattcaaaggttttgtgcaaatatgaaaaaatataagtgatgcttatagatagactacctgtaatgacaaaacaaataataattatgtaaattttctttgtaagacaaatggccaaacttatgtataaaagttagcaataccatatacttaaaaaaggagggattatcatctttttgaaaaaactgagaagtaatatggtgtactaaattactccctctgcgttccttctagg

SEQ ID NO: 6003 - DNA, 1501 bp, Oryza sativa
acgttggcgttgtcacattcacccccggtgaaagctaagttagtaatgtgaaaggggacggtgtcagcgtcattgcaccaaggacctatttgtaaatatttttatttacacgtgggttcattttaattacaaataggttctttccaaaaaaaatacaaattggtactcggcaccaatcacgttggcaccggcctccttcgcatttataacttagcttccactgggaggctagagggacggcaccaatatcattagcgctgttatgatgtactatgtgccaataatattggcgcagtaaaaaggattatttttagaataagattttttttcgacattatttatcgaataagttttggatgaaaaactgaaaaatccgggagacaccgagatccggaggccgaagaatgttgccgcccacgcgcaaacgctctccacacctgcctgcctgcgtaaaataatacacggcgtggcggcgccccgcgcgttgcgctggtggtggtggagtaaataaaacccgggcggtgatgcgctgagccatatggccgcttccgcctccgcagccgcaacgctccccaccactctcctgctccgccgcctcctcctcctctccctgcgccgccaccctaccacccccgccccccgccgattccgctcctgctgctgctcctcttcctcctcctcccccgccgccgcgccggctcacccccacccgcccgccggaggtgcgtgctccgctcgactccattccatccagctagctttagcttagctaccaaccatccacgatcccatctcgcgtcagttgccgactgcttcagaaaccgagagagaccctgctcgaactcgttcgtgtgcttccacccgccgcgattttttttttttttgaggaggatgatctcggtcgcgcccaccgacgttctccccctggatttacaatgctttctttcttcattctgcttctgcttctgcgctgccatgtaaacgcgaactgaaatcgctcggattatccgtacaactccgccaaaaaaaaaaaaagaaaaaaagtttgaggtggggaatggataaacgtggagaggctgggttcccagatgctggggttacaggatgtagaccgggaaaaagaaacaaagatggatgcaaggatgaaaaagatggtcaccatggtaaagaaaagaaaagagaggagataatcacgatggagacaattcagcggtggccactgggccgccttcgccatatgccgttcccatttgcatcttgactatctcttatctgtccatgggaatcgaaaaaattttcaatactgtgtttcaatcatttttagtgcacgtttgcttatgctgaagttctatatataacgaacatgtgcttcaggtaatggcagtccatgtgtgtttgatttgctcaagtgtggtaggtgcagggagaagactgagaggcgagctgcgcagcagagccatgtcaagttccacgaattcgacggttttggcggaatcggtag

SEQ ID NO: 6004 - DNA, 1501 bp, Oryza sativa
gtgtgcagggttattgtggtaggatgctactagtagtacattcgctcttcttttttcgggtactatggctggctgagttgagaaaattccaaaaaggttgaatggggatttttttttttggcggggttagtatttagcaactactacattcaccgcccgttttatttgaaaattttatgaaatttttttaaatagttagtcacatataaagtaatatttatgttttattatctaataataataaaaatattaataaaaaaaatttaaataagacgaacggtcaaacgttaaatatgaaccgtgcaaaattacagttagctggaacggagggagtacttcatatgcactggtgttacatgacgcccatcttagactcgcgcatttacacatttgcaggcttgcaacccgtccgccagtcacccactgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcggcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagaaaaccgtaaacggttgagtaattaaagtaatattgaatctccactgatcaacgctacaccacgttgaacaggcccaaccaacccacctgaactacagtgcattgggtcgatttattaagagtgagactaatcacggtgaatctggtcgatcgcccataaccgcgggcacggctattcgaatagttttactctggccagaggtgcacaactgtacccacaagacacaacccaccgatatgtcaccgcgtcatcatgtgcccatgatgcacacgtcaccatgtcgagtgattgtgacgagacccttcacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaccatgcacccacagcccaccattcagtcgcattttagttggataattacgaccataaaaca

SEQ ID NO: 6005 - DNA, 1045 bp, Oryza sativa
agagtgcaatgaacagtgacttttcctatttatcccgattttagtgtattttccatataaatttgattccacaattcctagttttacatatatgcattttactcaatatttgtgttatcttaactaatgaattcaccctagattaatattatccatatttatttatttatcgcacaaatgaattctttttagattaatttgagttattggccctaaggtgaacttatatatttttgaagactttggggtactattaaatttaatataacgacttgtcatgattaatacattagcagattggtcaagtttagttgtatagcaatatattttacacggataggtttaatctatttattctataaatagtaaattaagactcggtacaacattaatctaattttaaacactcacatattcttgtttatatataaggattaatttatttatatgaccattattttatatgagtgattttcatgtcatgagtaactcggcgacatgttgcaagtatcaatctatatattccggtgaattacttatttataaacacgatcactataatggtgatcatcatttcatgtgttcttatatttcatgtgagattcgattcaaatgaattagatttaatcttactatttctttagctaattgtgacatcaagctatcaatcatggttcgaatatttaatacctgatttgtaatttgtaatagaaattaatatttgacttaactatcttgtgcataattatttgtaggattaacaatattatattctcgtaaatttacctattacttaaatttttagatccttactttactttctttgtgatcatttacggtttggcaagcaattgcaatcataacaaccagcatgatgaaaaagttttgaaaagttcgaaattttagtgatttttattgttgggaattttcaggatgttacagcggcgcaggaggggtggagccgcgtcgtgaccctcttgcgagcgtctccactactgtgtcgccgtactctacgagtttgttctaggcgcggcggtgtccctca

SEQ ID NO: 6006 - DNA, 1501 bp, Oryza sativa
atactgaaaaaaaaatgatgacctaagatccccttttgttctaattaagatatagattttaccttgattttcattagcacacatttcaaactgtatttcatacatatagaagttactaaccccatcctgaaataaattcatttgtcagccatctcacaatatcacacatgccaataaacacaaaatgaattagaatacctcagttatatcatatcccaatacaactatttttatattttatatactcccaatataattattctatatttttataaactccaatacagtaattacaataaaaataaacttgttttaaaataaatggtactccctacgtcctaaaatataagcaatttttagtacagtagcaagtcaaatatttttaactttgaccattaataaaaaaataaaaagatcaatcatataaaattaatgttactatgtttatcattaaacaaattattataatatatataactttttttcatttaaaacatcttacttttatagatattgacatattattggtcaaagtagcatctagtagaccgtgtcaggtctaaaaagaattatattttgaaacggatggagtagaaaataaaacaattctaaatgaacttgagggaggaggaagtagcatctttggggagcgagctcctctaacgtaaagttagtgtggattccttagagcaagtttaatggtatagccaactactagcttcaattcatttatagccaatctaatagctcgtccatacaataattacacagtaatacactattaatatctggtcccacctgtcatatatacactgcgtcttgtagtctgtgctacagctagctacaaatctgtagcacgctgctcttctctcttcttatttatcttcttaaaatatatttgcaactggcttatagtctgctattgtagatttgtagccagctgtagcacggattccaagacgcactgtgtgtatgataagtgggaccgggtattaatagtgcagtatgtaactattatatgaatgagctattagattgactataaatgaattagaactattaattggctatactattgcccttgctcttataggtgagtcccaccttcatagcccatatgtcagtggcaacgctgtcgttctctctggagagggagacggcgacggcagtgatggcacagccgccaagacgataggaggtgcggtcgccaaaaaagcgcaaacccagattctcacccttttataaccattcccccccaccaaaccaaccaccgccccaaaaaatacccgccgccttttctcccctccccgccctgatccaccgcacggccgcgcgcgcgccacgccggtgtggagaacgatggccgccctccgcctccccaccccgccgccgccccgcgcccccgcgccgtggctccattcttcccaccgccgtcgggttgcggcgccgcggggcgcgggcgggggcgggggcgggggcggggcggtcccgccgccgccgg

SEQ ID NO: 6007 - DNA, 1501 bp, Oryza sativa
ccattccacccccttcccttctctcgtcctcctcctcctcctcctcctctctctctctctctctctctcttcaaaataggtgggcggtgctctcgcctcccctccccgccggcttccgcctccagatccgcgccgcccgccgccgccgcgctcgctcgagcgggagctatagctgccgccttcgattcgacgctgcatgtactggcgagaggcgtagcgcgtggcgtgctctccccgacgcgcgcctcgcctcctccccgttcatgtaagtgggataaattcctcgccgcctcacctcctcctccagtacttctgtcacgacgccgcgtcggcgaggtgggtgggtgtgcttttcgcggcgagccgattcgatccgtcggcgtcggcgtcgtagggggagggggagggggaggctctgtcccgtttctacgcttccccgggtgggatttgcgcgcgcaatcaatgcggatggggggagggggtggttattggaggccgttggggaggggttccatttccgtactaccgtactcgatctgaattttcgggctagctgtgcgtcagacgtgatctgcagcaggtgccgaattcaactcaatttcgccacgaattgacaccacccccctcacctgctgctctggaatttctttcctcggttggattggaattcaaggtagcagcatgcaacttgcttgaaatactccaattagtgaggcttggttatgtacacacttcataattgtcgtgttaattgggaaggattatgcaggattacgagcataccgctaacaatttaatacttctaaatcagctgatgtggctagaggattaactttgttttattacttcctctgttcttgggaatagaacaggagaacataagtatagttgggatgggatttgatatggaaacgaatcataggtgtcactgtctgaaagcattgaatattacagttattgtctgcaatatccaaagtagatttgatcatatccaatgtaaatgatgaattgttcctatttacaaactctgctcttagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttccaagtaggaaaatatgctgacatggatctcttgtagagagcttatagataaccattgtgggtgcccttaggtgtttcagatgccatgagatcttgtcttgctctaggaagcaaggatagaagtatgtggctgtaaacagcaagcatagaaccatctcttttatgcggtttcgataagaatatatataatctgcattttctccccttcctgattttgacaaattatcttctactgagttatctaaatgtttattttccttagtacaaga

SEQ ID NO: 6008 - DNA, 1501 bp, Oryza sativa
tttcagatccttttggtgtagctcggtcttttccttcttggcacaggggtcgtaccgctgcagcagacctccgtaggagggcagcaaagccagtgcgtggaaactctcggtttcaaaaaataccgtttcttgagcactttttggtgcttacaatgtttatttgtggtttattgatttgctttgtccgctttcatctcaaagctgatggagagctgtcggctctcctctgcttacgagggtgaagcttagggtgctaatgttcgtagcagtcgcaacttcattagcatcaactgttttagctgcatttaccttttattacttgatagaaattaaagcatctatttttgcgtgtttgggtgtgggaattaggatttctgtttatgtttcatatgttttctgtggagcattctgtatttttatatattattatttgtataggactgtagtctactcaaattagaggggtgggtacttcgggaatgaagaatgtaaagagattagaagtgtgtgtacttcgggagcggtatggagtatgtgacgtgtggggtctaatgtacttgtggtgtacttctactaatgtacttgcggtggtgtaatgtacgaatgatgtatggattatgtacttctactaatgtagttgtggtggtgtaatgtacgtatgatttatgaatgacttaccatgaatgaagaacgattaacgttctcctttgctttattgcaatgttttgaatggaagattagattaaatctattatacttctactgtaataatcttctggacacccatcatctctccgttaacaacaaagtacaccaatggaacaatggctgagatcgggtccacgcctcagccactaccccacacctgacacctcgtccatctacctcacgagctggcatgctatataaaccccaagctcaggctgagcaactgtcacaccccgaagttctcctcccaagcctaaaatttaatttataagagaccctaagaaaataccggtgcaaagcaagagtaaaccctgttaaatcaatgcaaataataatcggagtgggcatgtggaatttttcttgagttctacatgtcgaaattcactaacaggatttttagtggaattttcagagcgctcgaaataattttaaccaattaaaattgagcaagcaatattttaattccagggaaaattcttttctcctttttctttttctttttcccttccttttccgaatgggccgccggcccattctctcctttcctccccctcctccctgctgggccggccgcaggccgaggcccagccaggccgccccgccgccctcctctcccggggtcgccgacaggtggggcccacctgtcgggtccttccccaacctcccgccgcgcccgcaaccgccgccgcgcccacgtctccgcctccttcgggccacgtcgaccacgcccgcgcgtgcgccgcgttccccgcgcccactcccctctctcacccgctcgcgcccgcgcccgaga

SEQ ID NO: 6009 - DNA, 1501 bp, Oryza sativa
cactcaccccacagtgtaagcatccatatatgtgtggcttaattggatggagacaggtgaaggaaacgaagcccacagtgcctgttaccccaaatacgttacctcaagcccactgacgaaatttattccccacctacccttccacctagcgactcgtcttctcctccactccatcaccgtggcctacctctcctgccgcgccgccgctctgcttctcccgcgcctcctcgcctcccacaccgccgcgcctccttctcctctcctcccaagcagcagcagcaggagatggggcggtctacggcggtcggcggcggcggcttccgcggcgcggtctttggcggcacggtctgcggcattcttggcaacgactcaccatcgtgtgggcggctggcggttcttggcagcgcgcggcgaagactcggcggaggcggactcgagcagctgctccatccacggccgccgctctgcttcttctccctcgccgcgcctccttcccctccctctctgtctgccgcccctcccctctccctttcccactccgtcgcggcgatggtgaagggccatggtttggttgcgttgcaaatccatccattcactcccttgcgccgtcatggtcttcatcgccaccaccacagcggcactggcaccggcgtcatggcgcggccgccgcccgcgtcacactcaacgccatcggagagacgctttgccacagctgaatgtacacagaaaaaacataatattctctctctctctttgttttttgatctatttgtgttcttcgatttgtttgcatggttctgatttgattttgattttgatttgtatttgtgttgaagcaactggaagtgttctaggcccctccccggcagccaccggctcgtcgtcggcaccccgacccagcctcccgcgccaagcccgccgcccccaggagggcggttcggggatttcaccaggcgaaatcgatgtgagggcagagctcggccaggaacgatgcccacagtgcacgcgccttgctttttcggcgccgcgcgcttcctcgcttcgacgaagtttcgcgctccttagcttagggacaagtcgccaagtgaggtcccaggcgcatgctccacgtagaccaaaagctgagctggcgcgacgaggttacgcgccaactcagtgaggcctcagaggttggtgcactgcactactgtatttcctattcatctagtagaacactaggtagacctgggacttgggctgtactttatcgggccggcccaagtcacgtcggcccacacggtataaaaatcctggcccgttttggcactaagcacgatgggcccaagtcccacatcaactaggcacaatttccatctctgcagggcccaatggaccaactataaggctgtagctaattcaaccaagtaaaaaaaaagctctttcttttaagacaagactattcggaaagcaatgattattttcgaaatcaagctctctcacgaaatttctggcagtgtacggc

SEQ ID NO: 6010 - DNA, 320 bp, Oryza sativa
actaggtcatagctttgaagatagtccacaacttcagagctcacatttcacaacagtggggcgccctagagactacacccgagtgccccactggtttattgtattattacctcaaatcagtcaacagtatctttaagcattacatgatcacacatatttacatacatgtatacaaagatgtacacatacaaaaacatttcgagccatgccccaccccgagggaaaaagaattgctgagcacacaaaactggctatctacatgaacatgattgatgagcaaaactagcctagggttagagcattattggaagctatacaga

SEQ ID NO: 6011 - DNA, 1501 bp, Oryza sativa; identical to SEQ ID NO: 4440

SEQ ID NO: 6012 - DNA, 229 bp, Oryza sativa
aggatgtccagcagcgtgggcagcctaaattgtcagcgatccctccggatcttgcgtctgtgggacacgcgttgctggacaacgtgggtgaaattttgcccgcgaggacagggacaacgacgacttccttaggtttgtggtctctcatcacttttcgctcctccgattaatcagtcgtgttctcgagagagagaagcagtctgacgtagtcgtttccgtgttggacaga

SEQ ID NO: 6013 - DNA, 1501 bp, Oryza sativa
cgattaagcaaaccacttcccttccgcgacgcggcggcgactccggcgacgcgacatcggcgatgctcctcgtcgacggcgagcccgtctccgcctccgcctcccccaccttcggctcctcccgcggggtgcgcctacttggttgttggagggatttcttcccaccccgtctctcaccctcccgattcttgcaggggagcggcgggagggagctggtggcggcgctcatggggaaccccgggctccgcgccgcatcggagaggctcagggcggagccggagaggcggatctcgtcggggccagaggaggatgatgcggacgccgcggcggcggcggcgccgaggcacgtgtacgtgttccagcgggagttcgccacggttgatccggcgcgcgtcgaggtgcgtgcgtgatgcccgggatttcacctcgctgtagtaggttcaggcctcgcggtttgattgggtagtgtcgtagagatggggggggggggcactcagcgattaattccggcgttttgatgatgaattgtttgagttagttgttgcttagcagtagcgccatgaaatgcttgctgtcaatatggattttgtttcactagaggggatcatgggttgctttcaatataaatgctgggcatttgacatggagtgaagctctcagtagtttacgcatgatttagcttggaagcaaaggtgaggccttctgggaacgaaggataagggcataaggcccttctggaatgcgggaatttttcccgattctcgtacgaaattaactgattcctgtgaaattcctgcgacaaaccttgaaactactgcattctaaccgaagcttaaagttgcggtccttatgtttggaggtttgtttggggacattgtaggcagtagctgtaggtggtaaacttagtactaggctaccagcagaagtttctttatgcgatttctatgtagctaacgaactaccaagtccgttgtgctgtttaagtgtttattagttgactttgttagtgaccataaaaggactgttgacatctttgagttgaaaatgttctgaataaggatataagttgtcttcgactggaaatgccgatttgtgataactccaatccatattaaagttccatttggcttagagtctgttcatcgactgttgctgttacagtcccttgaacattttgatggaattttttccttatttcacttgggtcttttgcatgtctgttgctaaaagttaaattattattcctggaccattcgatgtcagtatattgcactttatatgttaatccattcttttgcatctgtagttagtgggcacagatgaggtgactacatgcgtgggtgtagtaattcgcaacaacaagactggaatgtaagtgaaaaaggaagtgagcatttaagctgaacctgtaaggcttttggtttcttgtgtaatttagtactcttatttatcttttccatcacttgatgatacctctttctggtattcttaactaatttca

SEQ ID NO: 6014 - DNA, 1501 bp, Oryza sativa
tacttttccctttcttcagtttcttaggtatgatgcctcgcaaaaataattggagaggaaaatataaaagaaagagcaaagcagcaaatagcaacctagtgctgcgttgtagttcgtggcactttagctgccgaacaacagagaaaatcacttgcttataaggatttgaggctagccaagagagtttggactttttgcgcgaagcgagaatggaagtgcagtgcgttgagtgtaggtgtggtccaagtagatgagttaggcccgataatgttttcgggtcctgtgtattacatttggcttatgagacaaccaacgaccatgaagatatctcggtaggtgtggtccaactagatgagttggcccaatatcgtttttgagccttgggcattacatttcgtgtgtgagacaaccaacgaccatggaaatacctgggtagctctgcctctatgcatgctacctgtatctttgtttgccaattctaagttaccccatgcgtcttacaaagatgctgcctctggatgtgcggttgcctccgcctaggaatcaagcttgacacaacaagttttaacaatttttcttggtgcttgtcgccgacgagattcgttcgtcaatttattgttttttgttaaggtagcaggtcgtcttgacttagctggcacccatctatgctccccttggtccgtggtctctgtgatcccctttcgacaaatcgtcttgatgtgctgctctcctccgctatcttccacgtcagctctccctagccccaaatccgctcccgacaagataatactatttagtttttggctttaagttgctttctatgtgcctttttattgctatttttattgtatttggtttgcttggaaattgggagttggtatgtgagcagccatatatggacaaagcccatgtttttcctctgagaaaatcaaacagtgatgccttcttgctggagagatttattaactctgattaaataaaccggaactttgcctaaaattatcacctttgctactaatcacagagttgatctatacaccgctcattttgtatagccattgattcaccttgatttattcttcgctttgtctcctgtttctttagtagaagcagcaactaggggcggagctacggtgagcaaggggcaggcacacggttccaaagattattttatctatagtaattctatgtttatcaattgtgcatcctccctcagttcagttaagtatactgtagaaattgttacctctctagaagttcgaaatcgttttccttttttttttaaagaagttaccctgtcactcagagcaagagaacacccaaaagatgggaaaggctgggtcgagcacgaatgtcgaggcggtcccaacggctcctcgtaccgtcccgacccgatttaacctaacccaccaccactcgccctccggttcgctcgtcgcctcgcgtctcgtctcctgttcggctcgactccacccgccgcgagagagagagagagagggag

SEQ ID NO: 6015 - DNA, 964 bp, Oryza sativa
atctcttgattgcaattgtgtaattgtcttaccattttgtagccaaaccttaccaaagacatggagattgctattttgccactccacaaaatagttttcaactattttccattttgcctcatgatcagatagtcccatatgccatgatcgtgaagtggtatcataatcaaacgaacaatcttcaatgtagcaaatcatcaatctttgttttaaaattggccacactaagcattatattattgctaacctaatgtccaatcattttgccttctacttcctccatttcacgatgcaaatcattctaacatttcccacattcatattgatgttaacgaatctagatagatatatatggctagatttattaacatcaatattaatgtggaaaatattcattgtgaaacggatggagtaattcacatcgatttcaatggtttaaacaatgttagaattctctttttttttttcaaacaaaaacgaactttaggaaaacggccggtgaccaaatgtcgtccttctctttcccgcatctctcgactccattactcttctctctcccctcttctgtttccgatccgatctgcggtgcgtctcgcgcgcggccgccgacgagcccccgcggccccgcctcctcctcgccgcggccgcccgagcctctccccggcccctcgcgcgcacggccggccggcgagcaggctcggagagagaggcgacgacctcccacttcgaatcgaatcgaaggtaatccccattctcttcttgtagcgctcgctcgtacgcgccacttcgattgatgagccgccctgcgtgcgtggtgtatacagattgggaatccgttcggtttgttagcttgggggatttggataattggattgggttgttgttctcgttttgaggttgatgcggcggtggggatatacgttgaatcggaggcaacctgttgatgaaatgtcactgaagctcc

SEQ ID NO: 6016 - DNA, 851 bp, Oryza sativa
aggtattactctgcaaatatacgtgaataataacagtcagatcaaattcagcttaagaaattacaattcctgtttatcttcaggatgccatgagaatcggctattacagaaaatctgagataaatcgggaaaaaaaatgctgaaacagaactttagtaccacatgtccacaatcccttatctaaaacttcaacgcacgggtcttttgtctttctcgagtcttttcctgataactttgacatccaaagtaatgtgaagtgcacagttgcaggtatattttagtctttgttagcacaaactttttggttccacctacactactggtgcgtgttgaaaccataacatttacagctggtaaatactaattacctaatattttacagcatttgtcaaaccatggaagttgtggatagtcagtataatttgttaggtaataatatgatattttttcaatctcaaacaaattatggttagtgttttacatgcctaatgtacagaataaataccgctattagtcatataaattataaagggtagaggtgcatcctctttgatagttaaatctgttaggcaatagaatatgccgtctgtggatatcccagctgctatagatagcagatgtaaatcagggattagctactatagatagcagatgtaaatcaagggaattatccttgccttgtacagcaggccagccggccctatataacagaaggcgccccctcccattgaggcgtggccaattgccccctaatccaattctctacatggtatcagagctccgggtcccgatccccatctaacctcgagatcctctcctccagcgccgcccccttcctccctccctcccca

SEQ ID NO: 6017 - DNA, 873 bp, Oryza sativa
ggtgggggggttggttcgctaccaccgccgtggattccggtggttcgtgtgtgcgtgtgtgcatgcgctccgcggccggcgccggagtgctcgtggtggttgttttttgcgagaaccggggcttgggggggtttggggttttgaggcgaagtggggtttttggtggtggtttcactactcgcttgcgtgcagtggtttggtacgcgatcggaggctcgattttttttttcattttctcccttgagaaaaatgtgtctagttcaaacccctcaccgctctgatttttttctcctgttcttttttttgggggtaaaagttactgtgcgtggcctttgacgtttgggttttgaggtgaagtgggtagtggtggtgttcgtgacgtgctttgcggttgctcgcgtagtggttggtgcgtgatcgggagattcgggtgcccaaaattttctcttggttagaaatgtgtggaggtggtccattctctctccgctttcagttttatttctctctctgttttttttggtaatttactttgcaatcctattgatgcctttgatgcgcattaagaacttgttttctgagattttttttttgggtgctcatggtctttatagaagacggagtcttttgggatttttgtgggggttgaaggtggtgtcttttaccgagctcggtgtgtaaccaaagtattcactcctgcaataaatgcttaatgtttcggacaagatttggttaaacttttgaaactttgaccatgagtaacttctcaaatgcttagttttgtgtagatttgccttgaaaagttctatcatagcatcataagcttattctaatggtgaatgttttaaaagtttaatcaaatcttgtcctaaatgc

SEQ ID NO: 6018 - DNA, 945 bp, Oryza sativa
tccatcgggatcttggtgatgaaaggaaaactttggctagggtctacggtggattgagggcggaaagggagaagaacgacattgcttgcaaaaggaactccaataaatctcgtaaataggtcttataaaccacgaagtgatggttcatatttcgagaaagccggagaaattttctacataaatttagcggtttcctatctatgagggctgttttttttttacctcaatccaaattcaaaacttgccaatgttgcgacctatggtcgaggagaacttgttcaaggattacaagccttctctaattctcgagtgatcaaatatcccagcaaagttaactttctcgaattatatagccgggaacgttgtttccatcatttgcattgagatcagggactactatcaatgtttcaaattaggtatattttttatacttgggttcgtaatctcctaaaataccgtatacctatatacgaaggagtgttcaaatataggaatgtagcagataataaacaaaactccttccggatcgtagatccatagaagaaagtcaatagctagttgttggatagttctcgacgagtattagttggaaggctagattaattagctagcttgctccaccactgtaatatgtgagacattttaaagctatatatataaactaaattaaggatattatttatcttgttggtctaaattggtaaagaaatcccttattttcacttactttaccacaatctcatgtatactttcgtacccgcatttctcatgctatactaataatgtagtcgggtacatccaatcaacaatgtatacgttatatcaaaatcaaaaatcaacagagttatctattggtaaaatgaagcaagtatacgcgagcaacgcacgagggcgaagaatcctctaccaaaattattagtgcaagtaaaacttagaaaatttgca

SEQ ID NO: 6019 - DNA, 380 bp, Oryza sativa
aaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtattttttaccttgaattttagcaaaaaaatcgcccccttgccctcccaaccgatttgtgaacagtacaatggtcgggatggaaagcagttggcagtttgggggtatttatagacccaacacacctcaaacgagttagataaaaaaagcccgtcaaaggtattgctcatacctttgacgggcttctattcaacggcccgtcactggtatccgctcacctgtgacgggccagaaa

SEQ ID NO: 6020 - DNA, 418 bp, Oryza sativa
  unsure (1)..(418): unsure at all n locations
ggccgttggccagcagcatccaacggctagtgctaacgccggagggccgggcgaagttaaaattgatattattatactgtaagattttgctacataatttanaattagtagactaagccaccgcataaacattaataaccttgtaaaaaaaattacatggtttnttagtcacatgatttcatatccgtggagcattcttaagccgccatgtgacacttcaagaaattatggatatttctacgaatatttatactacttaaaaaatacgcaggagggatggtgaaccaatctagacgtactgacaccgcaccccgcgcctccccctctcacgaccccaccagcgcctcctctcacgcccgcacccgtgccctaaaaacggcccgcccctgccgccacgcccacaccgccgcccctatca

SEQ ID NO: 6021 - DNA, 509 bp, Oryza sativa
gcaggatccggttcatcttcttcagcaactgggggggttatttatatagagcaagggtgagtacgggagtactcagcaagccaggggaaataagtgtttaatgcaggcttcaaggaaaggctgttgtttttgcaattgattttatttgaactctttttctaaaataactaggtgagtgcttctcaaacgacacgaatgagacagtgcgtctcgtccggtcggagtatgtgcaatgtatcagtcttcagatcttgaaacaaggttggcacccggccaacagcttttcaaacggccacccgggccaacaacttttcaaacggccacccgggcctagctgatcccgtcagctgctgattttccaaacatcgaacccattttcacaacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 6022 - DNA, 1501 bp, Oryza sativa
ccgccgcaatccgccgccgacggactccctccggcgaatccgagccgttggctcgtctcccctcgtcctgtgctgccacccggtgtgctcgctttcgccggtatcgccgtggctcgctccgccgctcgccgctgtcgcccgccgtccattcgcggccgggtcgtcgtctacctcccgccggcccgcgtggctgccacgtaggcgccacgtcggcgccacctcggccgcgaccggataagccgacccggccagccgctccctccgtttttcccccgtgcgcatggtccgcggtgagccgtgaggctgcgcgtgggcccgccgcatccgttcctccgcgaaccgcgcgcgtgcaccgcgtcccagccccgcccgcgtgcgtacgccgcaaactccctccgcacggtgagccgagccgctgacaagcgggtcccacccgggaccgcgcgtagtgagcccggtccaccggactctctctcctctctccaacgcgcgcgcgcgcttgggccgtcttgggccggccggcccgttaagatcggccggtccgctccatttcccttgggccgcgccctagccgcccgagagaagtctacttctcctccctcttccttttcttttccaaaaaggatttaattaaatccttttcctttagatcaaaaattcaataatcttagaaattcaatatcttcccaaccgtaaatccgtttgactccattcaacttccaaatttccccaaatctcgagatctatctaatggcacgcttagaggtcattaatagggctttatttttttgccgtttgttgagttgtcccgtttcgcgtgtagtttcggagccagaagacccgcagtgcgaggatttcgaggatcaagctccagatctcgagcaaggcaagccacctttgaacatcttgagcctatatttgaaatttaattatattgcttgcaaaatattatgcattgataggatcgcactaaatcttttgtcccatctgcaagacagattggcggacttacctaacttgttgcatttgatccttccattgttaattgccatactatgtccccttgtaaccacccagttgcacctcgatattcgtgcactctgtgcaagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgctgagagacatgtggattcgccggggtggtgtcggggaggacccctgggctttctggcacagtatggtctgggacctaacctgttgttggtctgggacccctctcgtcggcata

SEQ ID NO: 6023 - DNA, 1501 bp, Oryza sativa
ctgcaaaccggttctaaagatgtatttttaatatcagttggtaacaccaactggggctaaagatatatatttctaggtacctaggcttttagaaccgattataaatagctttagtaccggttcttaatgcatcggccggtatatttgtgatttggggtattggataaaagttgatgatggtgaaagtctgacgagagtggtgatgctatcgccaaaggggccacaacaacagtttcatgtagatgcagtgccaagtaagcatgagcagcgataccacgcactataagaggtgtgtggatttttaacattttattatgtcataatatatgaaatcagttgacgtaattccaaacgtcaaaaagccacgtcataaatttagtatgtgacgtttgtacatttattgtcacaagcatttgacaatgctttattgtcataaaatcctggggcttgccacgtggcagctgacataacagttgacatggttaaaaaaaaagtcacaaaataagattcggcctgctaaagcccatgtagctcatgggccacaaatatattttttctggggttgttgctagctggcccagtatattttttgcttgtttgtttatgaatgcagcctgtacaaattttcaacccacaccaattcggcccatatgatttttccaacccgcacaattcagcccatatgatttttccacccccacaatttagcccatatatttttccagcccaaataattttttcagcccacaaagctcaactgatattttttcagcccatacaattcagcccagatactatatttcagcacatacaaaatcagattcaaatgaattaacattccacaaatgattgcaatgtcacatgcatttcacattccagaagtcttgaaatgcaatatcattacatccatccaccaattcagtacatatccaaactctcaaatttcatattcctgctactgcgagagcaacagcagcacatctgcaatagcatcacagcagcagtagcgcaatggccaaaagcacagcagcaacagcacaacggccagaagcacagcagcacctaaataacatcccacaagcacaatggtcgcaagttcagtgtcaccaaaatatcatctgaacctaattgagtaggagtgcttactattcagcatctgatgatgcaaaattgctgccaaacaattgagtagtttcttattgtacttgaattacatgtaccccagtggcataatgtatctatgaatcctataatacatgagtaagcaaaatttagtagactcaagtaaacccccgcggggcattgcatttacgttagaaaacattggccgcagtttcattgatagaaacagacagagttgtccgaagtccagtgcaaaaaagaacaagtaccttacggcatctgacttgaatcccatcaggttttatagtgctaaactgatcctcaaattgggtcattgtgcatttaatggtagaatcctcacatgtattgtatgagcagc

SEQ ID NO: 6024 - DNA, 1501 bp, Oryza sativa
ttgtttacaaattgcttgttcaagaaacaaccgaattttattgtagcacacaaggactagtctgctccctgaacagataattggacttggataggggcttctttcctgatgcatcctaaccctaccgcacactgatttactagctagaggttatctttctgcatgaacagaagtcatcactgcagaaactgaattagttcaatgtgagatgaactggtgaggatcagtctttgtgtatggatgtacataaatggatgtggttcaccgcatttcatgggcttcaacagccttcaattagttgatttgatatatgatagcttttcatttggagagtactattggtgaaatggaagagagacagtggagaaaagataattgttgctacatatgacaacagtgagagtcaacttttagcatttatcaaaggaaattttgatgtatggagtgaagaaaagaaaacaagagtgataaaaaaaattatttcggtgcagtaataattaaaaggctttgttgtgtcaactattatagaaagatagtttttaagtgatatttattaaatatataaaagctttcctacatgcccttacattaattcttgaagcttgggttagtttctaccctgcccaaataattaaatataattaaattataacctaattaatacttcgttgtaaaaaggatgatgtactacagtacagtgggtaggccaacaccccaactattaatcataaattaacaccaaatattcaggattttaatcacccaatatcaaatcccatataaattaaatgtctcattttgttcatcacaaaatatattaatcaaaacccttgatttcacaggattgagctcatttccagccagagaaaggacatgaagacaaactcactcgatcacttgtattaatcgattacccttttctttgttgtaatagtttttttttttttgccttcgtataattatgtttgattcgcttggctttgattcggaaaaagaaccccatacactaaaatccacacgttttttaatttttgtgccatttaagtgtgttaaagccttcattgctgaacactttttaactgccagagcatattttctaacaatatttgttctgagctcttctttttctttgtcttgcaaattggatcactatacaagccatggaaataaagatcaacagattttgttaccttgcgtaactcgacgtctgttgacagtatacgcattaattttcttgcacggaagaatcaaaacaagttgaaaaaatgtggtgcatacagtccactttaacaaacttttatccattcatgtccaaatcgattaggtgtgagtcacaataaatgttctatgcaaacaagctaatcacaattatgaacagcaaaaaaaattgtgtccgttcttgagatcactttagtctttatagctatatatagaaaccacccatagatagctatccctctcataaacaaattgatagttaagattttctgcaacaaaaata

SEQ ID NO: 6025 - DNA, 1501 bp, Oryza sativa
tggcggcggcgcggccggctgaggaccgcgcgtggtcggagcagccgctgccagagccgtgcaagcagcgccgccaccgggagcttgagcggcaggaggcagcgacaggcgcgacggcggcggcttgccaggaccaagcgccaccatcgccaggagctggaggggcgggagggatggcgccgggacgggggaggacggccggagcggcagctcattggggctcgacttcgacgacaacggcgaggtcttctgcatgggtcgctcttccactggggctcatatgggctcgctcttccactcctctccctgcccgtcgccgcacgtctctcggcggagctgcagcgggcggcagggcgcggccggagaaggtggagcggcagcgtcagcgggcgagcgtggctgcgaagcggcgacggcgggcgagcaacggctccggacacgggcgaaacagaggagcaggcgagtgcggctgcggaaaggcggcaggcaagaccgctctcggcgcgccgccttgttccagcgctcctcctgctcgcgcacgctgaggcggcctccagcaggcgtggcgccgcgacgcccccaagtcgtcgtcatccctcagcgccgatgaacctcgcagagcccttcccgttgctcacgtcatctcgccgtgagcggtcttaacatctcgcccgccgccgacgcgtcacccccttcttcggtgtcaccgcaccaccacaccgcccgtcgccagcggccctttcccacctcgccccatggtcggcctgtatgagaaaactaggaaagagagagggaggacgaagggagagaacacaggagagagatgatgatgacgtggtcaccctgacgtgtggggcccacgtgggtcccacactcagtcagctgccacatcggataaaatcggagttaaaaccgccgagagatttagtttgcactggttttgttaattgggggatgcgttgtatccggatttgcggttgggggacgattttgtaactcgatgacaagttgagggacctaccgtgtacttttttctttcttttcttttattttctattgggccaaactgggctgctttgcacttgggccgtacaagccatctcaacccatttgcacccacgtcgccgtgcatccgcttccgacccggcctcctccgccgcgccgccgccgaatcgctcctcctctccggccggacggcgagcatctcgccggagcaggtattgatccatctctcatcgtatatccctccctcctccccgcccctcgctcggaacaatcttggactgattaatcgattggttgatttctatccctcactgaattgtcgacttcttgcgagttgcgatattttagaccggggatggatggatggatggattaatctccccaaatggaacactgttggaacattggatttcatgtcgctgtcaatggctgccgggatttgtttattcttggtgcgaattttgtctctcggattatgccagatcccacaccctca

SEQ ID NO: 6026 - DNA, 1501 bp, Oryza sativa
aaaatatcaccaacagttcaccaactgagcaacataagttctattcctctctttttctatgagatatataccaacgtagtgatatatatatagttttattcctctctttttctatgagatgtgcatagcgcgatatcttattcagttttaaattttaaaatgtgcagcgtgttagccgtgaatcatgattcatatgagtgcccggccggcgattgattaaacgatggggaatatgaatacgcctctttagttcagaccaaaatcatgccactcatccaacaccgacagaaacgcgtgaacaccaaccaaaaaccaatgaagttttttttcttttgacaggatataatatggcgtgaataccaacataatatttttttctgttagattagtgttgttgctgaattatatggcgtcagcttgtggctaatcgatcgatatggtccaaaactaagacgcatatacctggaaggaactgaactgctgcaggatctgttcatcaatcaacatcttggctcggtaaggttgtagttcacaaatgcacatccgacgtatatatcatatcatccattcatccccgtatatatgaaaatgacgatattttggcattgacctcgcacctatggaatcaccaaagccttttgtttgttattactgtagctatgttgtttccttcgtactagttagccttgcacttttttttttagataataatcatcgaagtattaacaactgtaaccggccgcttgttagtatcgatgaaaactacgttttcatttgttgcaaataacttgataaaaatttccttgacaccatatccgtacgttttccaaatcagcatggacgaactcctaatttcaccatatccattccctccaccaatcagcccaatgacctaattaactcggcatcttgttagatacatttccatcctatcatcccttggttgtagacgaggtaatttgtcccttatcttacggtgcgtttgaacattaagttcacctgggctaatctatttcaagcaaaataagatagtagatcattaaccacgattaattaagtattaattattataaatttgataaataaatttatttattgatttgaaaataacttctatatataatttcttttacaaaagtttcatttataagtttgggaaatgtgttaattgaaaaaaaaaacgaacacaatcttagcctacttttcacccgtagatagaaggaacacctcaatgccctcagttgaatggcaaacaatcagttaaaagcagaattatgtttaccaatgtgtgatggaaaatgaatggtcaatgtatcaatgatcaacggtggtccaaacaaaacacatcctatcctacatcttgtgccaccatggcgtattattgtacaaaagttaagtactagtataccgcagcgtgcaaagcagcatggtcaaacacatacgccatcaaacacaacggatgaaagcaaaggtcaaatgccccccaaaagcacagctaaaa

SEQ ID NO: 6027 - DNA, 1501 bp, Oryza sativa
gaacatttgttaatcaagtagatgtctggcttgcatagctccagtagtccctttcgtaaatatctcctcaaaactattcttacgtggatactggccaatctctgatccaatcgaaatggatgagcaaaaaaaaaaaaaaaaaaaagagagagcagtttctgagatcatttttattgatttgattggatcaagaatattaatacattattatctaaaaaataatacattgaagacggggtaatttttattctgagctagttgttttccaaacaaacagatatagcagcagtactttaagagaaatgttacagcatttcaggccacaattaattccttggtccatgagttcagttgctacgtctgatggaagcaatttgtttcaagaatcttttgtcgttaggttttatctgctcaatcttttatgcaaacgccattgatccttggcttgacctgtatgctctgttcattggatgcaggtgtatccattttctgaataatttacaggaagtttaaggaaatacaaggcaagggcatctggatactagccaatctctgatccaattgaaatggatgagaaaaaacgagagaaattttttaggtcatttttatttgatttgattggttgaggaatattaaaactttgtggatggagtaatttttttatgagttaatccttatacagaaagaaatagatgtagcagcagtactttaggataaaattttcacagcatttcaggccacatttaaaaagagggtttgttcagattgatgtcatttcaaaccatgttattatttgattaaattgataattatgcggctatatttagtttgttaccaaattttggtaatgtctatagaattttgacaacattatattgagtacatcctactaaaaattggcaatgttaccaattcgccaaagttttgttattaccaaattttggtaaggtttattttggcatcaatctgaacagacacagagtgttccttggaccttggtctatgagttaaattgctatttgtgacggaagcaatttgtttgcagaatcttttgttgttaggttttctatgaccaatcttttatacaaacaccatcgctccctggcttgacctttatgctctgttcattgaatgcaggtgaatccattttctgaataatctacagaaagtttaaggaagacaaggcagggcatcttgattgaagtctcagatgaccgtctcttgtaatgtttctataacttctgatgatgtggcgcctagaacaatatcaagagcctagttgatatcttacacactaatcgtatactctgtccgtttcatattacatattgattcttttcatagtcagactttttaagtttgaccaagtttataaaacaatttagcagtattttcgacacaaaatgaacatattattaaaatatattaaatgttagttgtaatgaaactaatttcgtgttgtaaatgttaatttttttctataattttggtcaaacttaaa

SEQ ID NO: 6028 - DNA, 1501 bp, Oryza sativa
tctgtcgtttttaatgtgttgtggagcgctacatgtttcgttttgttcaagctatctaggattctctctccaatgcacgagtagaataagcaattagcatgcaaagttgctcgtcctacacgaatctgcagctgcattttcagtgggtgtatcaccaattattagagcacagacaaacgcgctgtgtctatcagagtaaaagaaagaatatgcaactgccatatggttttatcagtaggtgctcgggtacgtcctccgaactgaatgatgcagctccttgaacaagcaaggaaaaaaccggaatgaatgctaacgactccgttgcaaagaaacttttagatttttgactttgcatttctggatcgatctgccacctaatctcatcatcgaccacttatgttccgagaacgatgcctcgccttctctccagcatccaatcaggtttagctttttcgtactactactgcaactactttttcattacgtggtgcatgatacagtgactgatgatgtggccaaaaatcatgccttgatgatcctgaatatgacaggcagatttttagtttggagaaggacaaagggtgaaaaattcgctaaaatgtcatggaaaaacgtcggtgaggagtttaattttagtttgacgagaactctgtacaagctacatactgtacacaaaatattcagagggaagaagcaggtacgttgtccttaatttgtgtatgcttaccacgtacggatatagcactagttgtcagcaaccactcaaccggagaaatcattcccctccaaacgagccaacgaccacctctctgatcgatcgatggaagaagaaggctccaaatattgccagctactactactttcattggccctgcaattattcgttcagaaagtgatggggagagcgagggaccgtgcagtcaaggcatcacagcttagctgctgcattgctgcacctgcaacaaactgaaactaaacgggagtcagcgttgtactgcctgaatctggtggcactagcacacacgatcgggcgagagaattaggtgcacccaacgaacgcacagggaagggaaggccatatgcaaaggggaaactattctaaagcacagtgtttctgttcgcacaccagcatgcatgcatgcgttgcactctgaaaacgacgccgcgatagccgaagagctatctacgttgttaacacgttcgattcttccgcgaatgattggttatatatccttcgggttcaagcaaaggtgccgctagttagtttgtcatacttaaacaattaagcctgtgcatggcgagatatgtcatacacatgtcagattaattgatcgcgtgtgcgtgtctatatatagccagcttcctttcttcttcgtcacaccgacttaacacttggtcatttctcatttgtgcgtcacggagtgagcagtgtacatacgttactagctcaaggctgcagcggagagagagagagagagagagagagagatgggcgctgtgg

SEQ ID NO: 6029 - DNA, 853 bp, Oryza sativa
tcccgcgcacgcgcgcgcggcgcgcgggcggggcggaggggggagcggggagagaggcgctcggggcggctctcgcacgcgcgagcagcgtgagggcggggaagagagagagagagagagagagagagagcgggagagcgcccggggggagagggagagatgggccggggaagaggggaagatgggccgagcgagattcggcccatcgaccttgggggaggcaaaatagacttttgcggaggaatttgattggaaggaattggattcggagttgaactcgacgatagatcggggattgatatcttgagatggcacggacactagacaacaagcaaagaaacaaatttcgcaattagggtttttaagagataattttcccgctaggcgccacgacggaacgggcgctacagaccaacccccctaacaagaatctcgaccccgagattcagcacctaagggagcaggtccgggaactcggcgcggagaagatcttcttgctcccaggttgcctcgtcttcggaatgattgctctattggactttgtagaacttgatggtcttccttcgagtctgacgttctgcctcttcaagaaccttgatcggtctttccttgtaggtcagattcttttccagctcgatattacccaggggaacttgctcttctggaactcgaagacatttctttaactgggatacgtggaacacgttgtgcacatctgcgagaccttcaggtagctcaagctgataagccacttcgccacgtctggcggttatgaggtaggggccgatgtagcggggtgctaacttgccggacatcccaaacctcctcataccacggaggggtgatactcgca

SEQ ID NO: 6030 - DNA, 1501 bp, Oryza sativa
cggatgccatgtcagcaaaaccacccatatataatgctatgggacctatgctatgggacctattttgtacggctttgaacatttgagaggtgaagatttctggtatttgagattagggacctcggactgactcaacgtgaagttgagggacaataatgaacttatcctatcttactataaagttataacccactaattctaaagctcaacatgcaaagatgtcacatcataatacattaacaatatatcacatcatcatccattaacaattattacatttaaacatcatacaagcatgttatcttatctataattttataatttattaaattttagagtttaaaaatgtaaacatgttaaatcatcactccaaataattcacataatatttcaatatatatcttcatcatttatgataatatcatatatacctatatggtacatcctcacttagttagtgttatttctctcttctcccattaaatcatatcacatcaattatttttagccttaaatgattaatctatggtccaaactatctcactccctttattctcttataatacttcaatatcttacttttacatttgaatcgtctatatactatttaaatttaaattatcataaaccatatcaacttatgtaagtatatgttgttagccatcttacatattatttttacttattgttatcatactgaaatcccgcagcaacgcgccgggtttcacctagttccgtagatgattggtcactaaaaaaaattaggaaatgccttttttttttcttcaagaagtaaacgttcttgtactagttagatgcttagtttgagttgattttttcagttatacagactcataagaaagtacgtgaagatcccttctaatcatcagactaattctatgtcacgaaaattacttatagcagtaagaatccaagaccagttcatcaactggtaaatactggagcagttggaggcctgaagaaggtgcaaggcaaaacacctgacaagccaaatgttgcacgcttttgaaattatctaatgcgtgtgtgcagagtataatactaaaaggtttactgtttgtactaataataatacaataaactaacaattcagcgatttctggccgacgagttgctctctcgagtaatcacctctatctggtcacgatcaagaaattagaccccttctgtcacatcagcagatcagctcaagtgctcaaccactacacaagtacacgatcaagtaggcaagtagtacgcgttggcgttggagggagtccacacatcattgcacgaaaaagcggcgtctgcaactaccgtagccggaacatgtcaaacctcgttcgagccctggtatataaatacacccggcgacgccatgtccgctccacgaacaacgcaacaccaagcttagctaatctcacagtcaccgagctgaggtagctggcgagatagatatagctagcacagagagcaaaaatttcctagcgagatcacttta

SEQ ID NO: 6031 - DNA, 1501 bp, Oryza sativa
tttcctatggtccaatcaaacggccattcctgtgtttttcctgtgttttgcaatcctctgtcttacaattgtattcctgtcagaatcctgtgtttttcctattccttcgttttttcattcctacgatttaaaggggccctaaaaagtaaatctaggactacgatatatactagtactatgaatctgtatgtccagattcatattaataggatgtgtcacatccagtactagattggtttttataggatggaggtagtacgaatttacctatgcacttatctatatattaggctgtgttcttcttgctagctttcccaacttaactccctcattttctacgcgcacgttttccaaactgctaactactctcttcatcctataaaaaataaatctaggactatgacatatatatatactagttctatgaatctgtatgtctatattcatattaataggatgtgtcacattcaatactaggttggtttttataggatcgaggtatcacgaattacctatgcacttatctgtgttctttttgctagctttcccaacttaactccctcattttctgcgcgtatgttttctaaactgctaaacatggtgatttttgtaaaaattttctatacgaaagttgctttaaaaaatcacattaatctatttttttacaaaaattgctaatacttaattaatcatgcgttaatgagtcattccgttttgcttgtgagaaggattagtttccaactcactccaaagaaaacagcttagtgtaatataaattaaaatttttattcgatgaaaataatatgattgaatttgcttttaacttattttcatatgattgcccttttattgctaattttggaagactatgctaatttgactatgcgtgtgagaaagtaaagttgaaagactattgagaaagtaaagttgaaagactaattctggagactatgctaatttaactgtaccttatatggttggttagagggaagacaaatttggtctcacattgtagaacaggtagtacaaacatctttaaaagctcgatccggatagagtttcttatatgtcaattttaatataacatatttattagccctaggagaaaaccaaaagttgtataggctttattagggcagtcccaaccctccacctaggatggtgtctatggcattaactacattgctatgtaggacttttaacttacgtggcactatattaattaagagagagagtgaatagaggaagaaactgggtctcatgcaagacaaagcttcaacacgagaacctagacactatcaagttttgcattgggagagaatagtgtcttcataatagatgaagaataaatatgattagtagagaagagagatgatgtatttattaatagcctactttaaaaaactatgggttgtggagtgtagtttctattgtgatgttttattgacatgacaccttagacactacttatgcacactatgggttgagactacccttatta

SEQ ID NO: 6032 - DNA, 1501 bp, Oryza sativa
agcttgttccaaaagccagaagcttaaaaagaagcccaaattattgtacaatctcaagaagctagtcttggaaatgaaccctattgttcactccgtctcattttaagtgcagccatgagtttccgaatccaactttaaccgtttgttttatttgaaattttttttgaaaagaaataaaaaacataaatcacgcaaagcactattcatgtttcatcatctgataataataaaaatattaatcataattttttttaaataagacggacgataaaagttagacacgaaaactcatgctgcatttaaaatggggcgaaaggagtataaaataggaatgatgttttggacttttcaaagtcaacaagctaggtacaactttgactatttaactcttttgcataaataagaaaaaaaaagttataaaggtgtgataactaatttgaaagtttttgttacgacgcacttggctttaaacaatacttcgttgttaaaattaacttttcttgaccgcccggataccataacattattcttttgtgactggaggtaagcattttaccttgtagcgatggtactcatcaacagtaacatctgccgtagcattatttgctatttcacctggtcagaaaaataagcaaactctagtcagtctttacaccacgactcacaaggtcgcatgtacacgtatataggattagaggcgctctttgctctgttgttcttcgatcgttctccctttttctgaacaaaaagaaatgttatacgtgttctaacactaagcatgattcatgtacttaagggtaattcaatacggttcagtctgtcctatttatagggcagaaatgtcataataccagtgttatatgccttctacaccttttattttaaaagaaccacacgttccgttccctttgtttcatattacagctttataagtcccttgtaagtcaaatctcttttcaaatatgattaattttataaaaagatagcaacgtctataacaccaaattagttttattatattcattgtggaatatgtttatagtatatttaccatgtgttgaaaatatcgatatatttttttatataaatttggttaaactagaatagatttgacttcaacaaatttaaaataacttataatacaaaaataatataaaacagagggagtttttaacttgtttgttctaagctctgtaatcagttttgataacagaactgttgccactgtacatatatccttgtgagtgaagtgaagatgatcctaaatttaacgtagggggctcctgcatatatgcagcttagagcttgtttagagcttgtttagagcttgtttattttgaatgccaaaattttggcaagatattaacgttgtcaaaattttagcagaatttctcatatattaaccaaatttaccaacaaagtaaatatagatttttttttgataaaaatagcatcaaaatgaacggttccttaatttgctcaccgggagtcttgacgaagg

SEQ ID NO: 6033 - DNA, 1501 bp, Oryza sativa
cccaaaatcaactctaaatttaaggttaaaaatttaaattttggctgataatcataagcataatagcgaaaaaatgaggcccattgataatatactataaaaaacctaatggccagtataattttgaagaccgtgtaaaaacatgcactcattacatcttcttttggaatggatagagcaaattataaactctcatttaggcatgtactcgaattagggatttggttgagattgataggcatgtaaaatatgggccaaatagagacatggaccatacataatggggtatttgaaaaaacataattgtcgtattataaacatggtaatttccaaagcgttttttttaagaaagacatttggcgcgctttattggtatgaaaacataattagatcatttgctcgaacgtttagcaagaagctaggggattcaacccaattacaagaattctttgagatgaaagcatgtctagctaactcatgtgctacaccatttgcctctctattacaatgctctatagtaatattatctaaacccaatctaagtatatgatattcatgaaaaattacaaccaacgttgtaggagagaatccaccatcttgcatggcctccactacttgcaagtaatctgtttggataataaacttatcacacccaacttgctcagctagaaagagtccttctctaagagcgtatgcttctgcaacatgaggcaaatacatacacacgcttactatgaaacatcctcgtgcatctcgaacaattgcccctgttcctctagaacctgatgttggaattaatagatgggctaaggcctattggaagattaattctttgaaaaatcacaaaagcccacctcatgggatggcatgtatgtggagtttagtaccaccttgcttattccaggagatggggacctccttaaaagggaggatgccctactagccacttgaagcatgtgtggtggagagaagaggggaaacacacgcgggcgggcggcacacgtgcacgatgttacgcgtcgaatggtccgcaaaattggcttccttttgcacttacgcgcgacttatccggttcgggacctatctctatataaaccgagccgctgccttcacgcaacatacgtgaaatcaatctgtctactctgtactgtgccgtcgctcgtagactactccatcccgctcgccggcgtgcatcggcgatcgggagagcaggtttccggccggcgtgcatcggcgatcgggagagcaggtttccggccgcaaccgcgagtagttcctgccgagcaaccggtctttccgccacctcggtacgtattcgacatgttgcgcatatttgatttgttcatattttactgcttagtttacatatgtagatctaatgatgcgttcaatctagtttacatctacaatgtcatgatttatttatggaataaattaaatcattatgtgcttataattttaacaatccaaaaaccttattataggcgctgtgattttacta

SEQ ID NO: 6034 - DNA, 428 bp, Oryza sativa
ttccctcttgatggttatgtgacatgtttcaatttttttttcattgggccaaaacaagtcattggtaataaaggaatcaaaattgatgctcccaaaactgattaaatagttaattttctctccctctcgtggtttgaaaaaggttaccacgatcatgtagggcatgcctgtcctgggtactcttcatgaatgaattagcataacaatttgctgaaatccaatgagtcaccacttcgttggttgctgtctagctttcccttccattttaagtccattattggattatgaagtttgaaataaccatttttcttttgcctgaaaactatttctacaaatatctctaatgtgttgatccttattcttttatattataaatacatatcaggctatgtcgtgttgaacccttttcttatatttgtgttgacaga

SEQ ID NO: 6035 - DNA, 1501 bp, Oryza sativa
taggcggaggttaattttacagccctctgtttattcttcaaaagaaacggcattcccagccatcatggggatctcttatatagtagcactttatctaaagatagggcactatgaattgtttgtaaagagctgtgttgtcaaagttcatttcttgtgttttcccccaaggtagcatatctgaatggtgactaacaggttaaccgtagagccaggattagctgcctgacttgatgagaatatgtcgtctcacgttccttaaatactgatgtgaaacatcatgcattttgcaggctgttgagaagaggagaggaagaaagaagagccttttcttcaagtaggtttggctcctataccgtggtgtataatttgtattcgtgattggctggatgtatgtaattaagcgggtgataggtttggcatattctttcggctgtatcttctgctgtaaaggaccataggcgatttaaacacaagggccccaggtgatgggagttttcttcttcttatttttttcccttattccttttagaaacatgagttttgtcgttgcaagggatggaagcgtgccgctgattagaattgaagctaatttatgctaatagaatggaaaagataaataggcaagtcctaggatgctctggaaatattccctgcatcgtagggtagtgaccatcatcagttcacgggtgacctccctgcctgctggttacttccaacgagcttgcaattttggagatgacgcatagcagtacctgaacatgtatacaagtataactgatgtatcatatgctgtgtaattatttgagacgaagtagacttgcagtagtttaagataacaagggcatcttagttattccagcgtgtactgtactgctggaagaaaacacttgcattattaggcagttgtgcgtagaaataatcgtgggttgcagttgtgtctacatcctatgaacattctgtggatggtaacattgaggcaggctatgtccacaccacactacacttgccaaacggaatgtgaatgcatttagggcctgtttaattggtgaaatgaaaatttttgggtgttacatcggacgtttgaccagatgttggaaggggttttcggacatgaatgaaaaaactaatttcataacttgcctagaaaccgcgagacgaaccttttgagcctagttaatctgtcattagcacatgtgagttactgcagcacttatgactaatcgtagactaattaagctcaaaaaaattcgtctcgtgatttacatgcaaactgtgcaattagttttttctttttgtctatgtttaatgctctatgcatgtgttaaaaaattcgatgtgatgtttttttaaaaaaaattaggaactaaacagctgatcaaacatccaaaaatttttatttcacgaactaaacagggcctaatcaaggccttatttagatttttactcctggcttgctctcggttgctctctgttcggaagtcagtgttcccaaccggatcag

SEQ ID NO: 6036 - DNA, 1501 bp, Oryza sativa
gccagacgacgacgatggtgaagcctccgcagccgttctctcaattttctggtccggccttcttcgcttcgccggatccgggcatgcttcccattccaccttcttgttggctcactagtcactagtgtggttcctgtcgctgagaatgcttgcttctagttcaacatgggtgtcgtgtgtaagtgtgttcaggttgtagagattggaatggtcgtcgttgcatgcatggtgccccggccgcatgctttgtgctcaatcagcactggaaatttcacacggttgtgttagcctaattgcagttgtaatgttagctagataaatcgaattaatggttttgaggatgaggctgtccttgtatgatttgttatattttctgttggaattaatagatgggctaaggcccatttgaagattaattctttagaaaatcacaaaagcccacctcataagatggcatgcatgtggagtttagtaccaccttgcttattctaggagagggggacctcctaaaaagggaggatgccctcctagctacttgaagcatgtgtggtggagagaagaggggaaacatgcgcttgctcgccatgtctggtaggcggaaaattggttcctcacccttgcgcagatgcagcctccttttgcagttttgttttgctgcgggaaattcggatttgttttgttttgccttttgcagttttgttttgctacgggaaattcggatttgttttattttggaaacattccgaaaaatccggtgcgtgaaaacgtccttttgcagttttgttttgctgcgggaaattcggatttgttttgttttgccttttgcagttttgttttgctacgggaaattcggatttgttttattttggaaacattccgaaaaatccggtgcgtgaaaacggcatggagtccggataggttacgcgcgacttatccggttcggtttacgcgggcgccctgatcaggcgatctatctctatataaaccgagccgccgccttcacgcaacacacgcgaaatcaatctagggtttacctcctactctgtactgcgccgtcgctcgtagactactctatcccgctcgccgacgtgcaccggtgatcgggatagcaggtctccggaacctctgccttcgacgtcctgcaccgggagaagacggcaataaggtttttgggaagcgcttcgcgcgactgctccctgttcgtccgcgacggctcgccttcctctccgctcgcgtgcttcgcgccttcgtcgacgctcgcaaccgcgagtagttcctgccgagcaaccggtctttccaccacctcggtacgtgttcgacatgttgcgcatatttgatatgttcatattttactgcttagtttacatgtgtagatctaatgatgcgttcaatctagtttacatctgcaatgtcataatttatttatggaataagttaaatcattatgtgtttataattttaacaatccaaaaaccttattataggcgctgtgattttacta

SEQ ID NO: 6037 - DNA, 1501 bp, Oryza sativa
cggcaacgttcggatgtgctggcgcctggctgccatagtagagcagcaatgcaagcttgggtcatgcagcatgcagctagctgtggctgctacgatcgtatctagcggcaccgaattaacactccctaacatttagtacgtacgacgctagttataacactgttttcatttttatccttcccttttaatttctgtacttaacgcaactcttttggagtacgtgcaatatatatgtactggttcttgtatgaaaaccgacaccatttatgtcttttctttagttaatgaaataaaatctcggtctttactcaatgagatgtaatcaattagtataaatttgcgtagacaaaattgcacatgaacaagtcataacaagcacaccgaaaatatgaacggggtagtatgtcatcagtacagaaaatagttgagagattagcatgggagtcagtgtaatactagatggaatagagggcgaaatgaatgagatccagaaagagcagactctagctcctgcaaacactgtaagagtacggcctggtttagttcctaactttttttaaaaaacttttaacttttttatcccattaaaatttttctacacacaaacttctaattttttctatcacatcatatcaattttaatcaaatttttaattttggcgtgaaccacaccctacgcttgtggaccctggctatcgcaagtgcatttaatgcagggtcccagcagcaccacatgaatttgcagccgtcctggtggtgtagtggggctatagctagctgtaggtacgtgtacgtgtaaatactatagtatacagggatcatatattagttacgtgctctaaaatatgtataggctaccttgctatcactaatgttttagaacacatatatattgtgttgctgtgtttggtcatatataatatactacccctaccctagaatataaagacattacatagtataatgaatctagatatgattatatctagattcgttgtgctatgtaatgtcccatccgtgctgtatagtttgggtttttttttacggaggaagtatatggttagacacgattactaagaaagtggtaaaattaaatgaaaaaaatgttgtaactggataagaagtgtaggcatgtgagaaaatttaatgatggatattatgattggttgggatcagaatgttggtgaaaaagttattatattttggaacaaactttgatagctaaaaattattatattttaagatagaggaaacattgattgtatgcatgctatatatatatatagaattatacggaataaatacaaacggaagggcctagctagagctaccagctgcgtgcaaatttattccgtataatttggaaggatatatcttgcttcattttgctattagcttgctttggctatcttaattaatatttaaaaaacgaatggtgctgatttgctctctcatctttataaatatgagcactcgtctctctgtacatagagagagtgag

SEQ ID NO: 6038 - DNA, 254 bp, Oryza sativa
ataacggaatttctataccgaacacaaccatacactccatagtaccatacaagcacagtccgatgtacagagccaaataaatgtccagattatacattccaaaatataaatacagtccaaattacaagttgcattaatacatagtactgatgaatcccctaatgattttggtaaaaatcattaagttaaggtggatacacatcttgtcatatgatcaaatggtttcgcgaaaaatcaataatcagacaacaaga

SEQ ID NO: 6039 - DNA, 1501 bp, Oryza sativa
tatgtaatgtcccatccgtgctgtatagtttgggtttttttttacggaggaagtatatggttagacacgattactaagaaagtggtaaaattaaatgaaaaaaatgttgtaactggataagaagtgtaggcatgtgagaaaatttaatgatggatattatgattggttgggatcagaatgttggtgaaaaagttattatattttggaacaaactttgatagctaaaaattattatattttaagatagaggaaacattgattgtatgcatgctatatatatatatagaattatacggaataaatacaaacggaagggcctagctagagctaccagctgcgtgcaaatttattccgtataatttggaaggatatatcttgcttcattttgctattagcttgctttggctatcttaattaatatttaaaaaacgaatggtgctgatttgctctctcatctttataaatatgagcactcgtctctctgtacatagagagagtgagagataacgcgcgggcgctagctagctagctcttaatgtgatatgtatacacaatttttcctttatctgtcaaggaatgggtaaatgcatggttgagagaattaattgagtttcagttatagatatatagctggctgagacgaccagttagccatcgtcggtcgacgaccaatcagatcaatcagttaactaattatggatcaggagaaggcggacggcggcggcaggaggaggaggagcagggcgacgagtagcagcggcagcggcgcgagcagcacggcggcggcggcggcggcggagaggaaggagatggagcgcaggaggcggcaggacatgaagggcctctgcgtcaagctcgcctctctcatccccaaagaacactgctccatgtccaaggtagctaggaattaggatcgactactcactaattaatttttattgagttttagtttgctactacaagattgttgatcgagcttatatatgctattggatgactaattagtgttcaatgctggttaaaataatgttcatatatgcactaatttctttggtttgctctaaggttaattagatctagttttgtctcatcggtccttacatgaaatgttaattaatgtaaatccacatgaaattaggctactatactagctagacattgttagagagttcgatcttgcgcgcggtcttaattagacaatcctcaagacttcattgaatgggccggccgggccggcttaaaattgtgtgtctcgatcggatccttccaaattgcttgcatagcataagaaaataaaatttctatatgtcgagattcggatgtgccatcaactcaattccactcattttcttcatgtaaatagttctgatcaaatttcagccaccctgttatatattacccggtgcaacgacgggcattttgctagtagatgtaaaaaatgacaagtaaacttattattagaagcacagagctagggtacaatatttttggtaggataaga

SEQ ID NO: 6040 - DNA, 1501 bp, Oryza sativa
ccctttcctggatagagcaaagagctcctcctgtgcaaatgttagagttgagacacatttgcaagcaagtcgaagaacagcatgttaggtaagcaaatatggttgagttgtgtgacctcgtaccatccttgtgctgcttgccaacgtgtataaaatgtggaaacgatcacctgagctcatcatgttctagcagcttaacacagtacttttcttgtcggttaatttcgtgtgttctttaaacttcatctccatttttctgccatcacagggagaagagagctttgtccgtgaaggatctccattcaaaccgggaacatggtgatggtgaaaaaaatattgggaagatcgtcgacgtgcaaggaagccaatctaaccctgacagagctagcgaatggagtggatgctcagatgacgagcaagagacgggaggaagtaatgtggtgcagtcgaccaaagaagcaccagccgctgccagctccggccccagctccaaaaacaagccgcagaaaaagaagaaatctaagaagtccaagcgtagcggcaggaagtagtctctgttttgttttgctcttctgcctgaccaggcgtcggatggccttttttgcttacaccgttgtaagtccagcagcaaggccagctttgcttaactggatgtactccctccatactgaaatcgtttttgacagcgacacggtctccaaaacacaactttaacttcctgtttctataaaaatatttattgaaaagtgatatatgtatacttttataaaattatttttcatgacaaatctatttatataatttttatattttcaatctcaagttgagagatatttataatttatatttctaagttttgacttaaccttatcctaaacgatctcctttacgagtacggagggagtacttgataagaattgtttgcttatacagtgactgtccgtgcattagtggaaaaaaagggaatgctttctcacccccagtctttgtgtttgatttcaaaattaatttttaggggcttttgcccccccttttttttgcacagttctccattcaatgttgctaagaagagttaaaaaaatcaaactaaaattcatccttaattcaagttatgaaattcaaaactgctccgtttcctattatgtctctttttcaaagttagaacttgttaaaagtttgataaagtttatagaaaagtgtaacaacatttataatactaaattagttttattaaaccgatcattgaatgtgttttgatagtttttgttttatgttaaaagtattgatatattttcatacaaacttgatcaaagtttgaaaagaagttaaaggaggttgacttataaaaaaattgaaaagaagcattgtactactccagtagttaaagaggctgtaccgctgtactactaagcaggcggctccgcctggccggtgacggtgagatactccagtaaaccccacgaaaaccctcaccctgaccctgctgctcccccgcggtggg

SEQ ID NO: 6041 - DNA, 1501 bp, Oryza sativa
tgtgttgtcgccctccacggtaccgcagccatcatccgtggctcagcaatccctccgtgttcgccggtcgtcgccggactcatctccccgtgcctcccggtgagctccgtcgtcatttcggtcggcgtttcctgccgcaccgcaactccctaccctctcctaacctcttcatttccttccctaggtccctccgaccatcggccgccggttcctgctcacggaacgccgccgaaccgccgtcgtcgttgcctccccgaggagcgccgccgcctcttcccgccgccggcgacctcccgctctgcctcgtcggcccgcacgctcggtgagcccctcctcccgctccccttccctttcgcgtgcatcgccactgcccgtgagcgccgccgtcttccggctgctcgccgccgttcggcgccgccggctgctgcctccggaggccgcacgctgcccagcaccacggctcggccgagccggtttcatgccgtgcccgtgccccagccgcgccgcctcgtggccatccgatcggctttgggccgatccgggccgtcggttcccgtggaccggcggtggatcgcctcggtggtcccggtccacggtggaccggcgcccttgtgccgctgaccggtggggcccgcttgccggcgccgcccctcccctttgatgacgtcagcgaggtccatttcctttgtaaaaataaataataattgcgcaataattcgtgaataattatagaaattcatttaaatggctcaaaacttctaaaattcatatctaattcattcgaactccgaattgagccattcaacttgcaaaattcatctaaaaatgagctctacatgtttgtttagtttttatgtactgttttcttggtttttattagagtttttcctcgttttgcgtgccagcgtgtagttcccgtcgtttcggaagatcgcgttcgcaaggataagagttcagaagatccaagtgaagaagcaaggcaagtcacacactccccttgagcatgttgatcccaatttataaattttttaccgtttacaaataaatatgcatgttttgctaattacatgggatccgggtattacctatctgctcgcttgtgccatgtttacttgatatctgttctttgtcaaccttgggtaataaatcgcctagcttgtgttactttgatgacctagctagtactatatgcttagccatgcttaattaccactagctcagttgatggggtaattacagttttagaccttttagtatcagaatgagctgcgtgctcgagacatctggccatgcttcatggtcgtaattatccaactaaaatgcgtctgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagtcgacgcatccaggcaagggtgggcgtga

SEQ ID NO: 6042 - DNA, 1501 bp, Oryza sativa
aaaaatccagaaagagaaacaaatatttaatcattgctaaatgacaattatacaccatgcacattattcttttttacaataaatatcactccatatttctactaccgttaattgaaataattgtaaaaaagatctaaatcctccaatcaaataagaccaatgaatgcaccatagtgagactttaaaagaagagaaattttacactacattttttagagtaaattatattagcggtacataaatttgtcaggtgcgtgcaatttagtgtatgaacttataaaatgctcgtctcgttttggtgcatgaatttgtctggtatgtgcaaactaagactaaaatggtgcgacaagaccgatttttcttagattccactttatctttctttgtttctgtcccttgcatcattactcaaatttttatttttttatacaatcattatgccttattatatgtttatccttcttagactaatgtttacatagagtttaaatcaaccacagaatcaacaagattaaccttgcagtgcgattttgacattattcgcacgcatcaaacaagctcgtgcacagaaacgagcgttttagaagttcatgtactagattgcaccaacctgacaagttcgtgtaccgctgatgcaatttactcttttgtttatctcaaaatacacagtatctaaaagtattaagttttatattaaaaaaatacggtgtctctcgatacattaattatccagaatggtaaaataattcttaaaaagtatattttcgccctcggaatcaaaaacatttttgagttgccctagcgtggggaaaatctgcagaatgacacgctaatcttctgcccccaccgctcacacgattacatggacaaccgccacgtacgataattaagggcacaaggctacggcctcacccgtgttcaccgtgtacgcaacaacagtacgcatgcaggagtatcttttttcttcggaagaggaacagtgacgccgttgctacctccaaggagagacgggacgaaaagatcgaaggacacttgagacgtgcgccacattacaaatgcacgtacgccgtgacaggacaacacaatgtgtgggtgtattactcctataaggcttactgtgcctactttttatgtaccggcacgtaatagggcttactagaatctagactatcaaatcgtgtgtgctctagcgacgcatgcagctttctacaggacaggtcgttttcacgtagtatcgatcggtagctcgctcccttcctccaagtattggacaaaaaccaaaagctagcgtgaatgcagatacatcgatccggaccaatgcaacgagctatggagatttgtcaagtcaaccgcgtgcagcaactatagcccaacactacagtggccgctatataacgagcccaacgcgacgcacagaggtgtgtgggcgaaacacaagaaacaaccggagaaaccgagcccggccgaccgcaaggacagcaagctagtagccatcctcgca

SEQ ID NO: 6043 - DNA, 1501 bp, Oryza sativa
aaccaggaatataccattccaaaccaggagctaaacaaattattaccagttataacatccataattattgtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctagtgctccgcaatgaatcatgctatacaaaaggtaaagccgttgcccacgctggcttgtggttggcacggttaatgtttcacaatagtagctcgtgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaatgtttctaagcatggctaagcaatcatatctaatatctagctgaaccaatatatatatagctcaactagtcaagttataatcacccaaggtatcaaggaataaagtaatcaatgcaaacaggccataacaaaggaataggttcacaccacccagtgacatttgaaaataaatgcacagttgaaataaatagagaatttaaatataggatcaacatgctcaaaggattgtgtttaggatctgtgtgacttgccttgcaataatcggtcttcaattaatcttcttgaatacttacggcgcactcgcgaaccttcgcaacgacggaaacgacaagctaacacgcaaaacgaagaaaaagactaataaaaaccaaataaacagtacataaaaagtaaacaaacatgtagatcataattttagatgaattgtgagacttgaacggcctcattctgacttcaaatgaatttattatgaattttacaagattaaatctatttaaagcccatttaaaaagaattcaataaatttaattcaatttatggacaattttaatatgtagatctttattttacacaacttttgcaacttgaaccacattaaactgagttcaaatgaattagttatgaatttttaaagattaaatcggattaaaacacttatattgattttaattgaattatgacgcaataatgaattatttttgaaaaggaaaagaaggattattgcgtcagcggctagggtttgcggtggaccgggtgcacggcagcggttcacggaaacgaacggccgagatcaaccctatccaaaacggacggccgagatcaaacggtccacgaccggctcacggcggacgatcccga

SEQ ID NO: 6044 - DNA, 402 bp, Oryza sativa
acttgctttcgcgttgacaaaaaaatcttgaggaaaatttcctacctatgttctccaacgagtggcgaaaaggttggattattttttatactattatgaatagtaatgggccccgtgggccttttcaatcttgcattcggccttttactgttcggcctctgcccgatgggaatttactgtttcgtctacccttggacacgtggcgggttttgattggtctatagtcgaactgtcgcttggcgagtctatataaccctgccgcgggttaccaccttcccccccgctcttcactttttactaccgccgcgctttccttctctacctgtgctcttagcttttcaccatctctgcgctcctgcgcttgctctcttgactctttcccccccccctctcgtctttaga

SEQ ID NO: 6045 - DNA, 1501 bp, Oryza sativa
gccgaggatgcggcggcgccggcattggggcaggagaaagaagaggtcgtccaacggcggagacggagacgattgattgggttcccgatgggccgtttctgacattcagcccacggcccaaaaaccaccctccatcgtgccgctcttcttcctgggccgaacgctctcccatctcttctcttaaaagaaagcccaccgttatttgtctgtccatcgagaggattttagttttttttttgttttctcggagaaaaatgtagaattttttgtttcagaacaaaatgcttgcgaaagaacgaaaattgaaggagaaaacgaaggactgagacaattgaaggagacgtccgatttgtagtttgcctgtactagtacggtatgtgtccaggcatttttgttttctattttaatttctgatgagacgctgattacgaaatgaccaagcagaactgaactgtgctataccatactatgtgctgcttcgcaacggaaaagctagtgggcgatcaatctcccctcctcctccacgtgatttccttttttggcaccatattactttcctattttagtaaatttatacatctaaagtttgtacatctcaagtttacacatctaaagtttatacacataaagtttagagacccaaagtttataagtcaaaagtttatatatatatagtatttctatacataaatttttctaactatttttttattttttaaaaaaattatggtgtcgtaggaagagaagaaggggagaaagaaggggggagaggagccgtatagggaggggatgggggtcgattagggctcccataggatggcctattcaaccaaagaaaaagccaaaatttgaattttcaaacttaattttgatattgattttgaggtatttttaacgtagtttatttttcaacattggcttttaaatcaccaagaacacatatataaaagttttacctataaatttatttttatcctctaataagccgttaaaaagccaaacgatgaggcactagctttacccgcttggcaaatccagctggagtagctccctgggacgtgacgtggcttgggttgatttactagagtagtatttttttttcttaaaacgaaatgcacaagaaaggcaggggaaaataaagaaaaggaagaaaaagagagagcggggaagcggcgcgggggtgggggcgagtcgaccgttggggtgcgtaacgttccaaagcccatcacaacacaagaaaaggaagcaaacggaccattggttgtgtttgctctggattccatcttcctcctcagctcctcctcctcacaaccagcttcttcctcctccacctcgcccaattctctcctccacggctccacctctgctcgatcggatcaagatcagaatcacgatcaggtatctcctcttgttcatcatcaagattccatccatccaataattcgcctctatttcatcatccccgccccacgccttcaatcgcagatcgatccgcccgcca

SEQ ID NO: 6046 - DNA, 416 bp, Oryza sativa
tcctgcagcccactccatgtatggcttggtatcggatgcgtcaattggtccgtggctataggagagaaggacttaggcggatgacataatcttttgatagtccacatgctctacatacatagatatcccatttaaaatcatacaagtgtatattatttaaatcactaaatgagtgtcatcaatgtgttaagagcgaagcacaatcatgtatataactagggcggatattacgagtgcatttaaagatgcatattagttatccaaaacctctcgactagacagctagatgtgcgtacacaccaatcaaaaacttcattacagagcgattgcttggttaatcactaatcaattgcatacattgatatagttgatgcgcatgagggataacctgaccacacacaaagaataggggggga

SEQ ID NO: 6047 - DNA, 1501 bp, Oryza sativa
ttcatgcccaaatccctctgttaaagttcagttaagcccaaaatcatgcaatcccgaggtgtaagaaatgaaattaggccgactagggtttcggcttgaagagattagaagaaggggaaggcaaaattcatgcaaatctcagataattccccaagaaccgaaaccctagctacagtaagaccccaaaatttccccaaatcatgaaaccctaaccctaaaatcaaggggaaaaaggagcacggcgggcttacctaagggccatggtggccggcggcgaacaccgcgtcgccaccaacgctgtaagaggcgagcgcgcggctgaggacttggtccccgagcggcctcgcgacccgccgtgctggcccggctcctcctcctcacgtgctcgtcgccagcctcgtctcgccgtcgccgccttgctgaggtagccgtcgccgccgcggattttccttgcgcgagcgaccgacgggtgcttagggcaccgtcgagcgttgctcgatggggatgcgcgccagatatggcggtacgcagccccggcaagcaaagctcgacgacgctatctccgacccgtcgtgcgctggctcgccgccatctcattgtcgccgcgggtgtgagagaaagagaaggggaaagaatggggctagggtttcgccggggggggggggcggttttgtcccgcgcgggagcgatcccggccgtccgatgagatggacggctcggatcggctcgctcccgacgcgggctgatgaggccgtgcgggaggcggcaaacgccggcccaggcccaggttgatgggcctggagcccaggcggaaggcggcgcggcaataacgggccaggccgcattcggcctggctcgagaaagcggcccagttcaagattaaaaaaaatgtgtgggctgcatagtaacgggctgcatagtaatgggcctaattaaaagaattgggctgatataatattacaattaaaattttcctttttgaagaattatgattatgatttttttgtgtttaaacattgaagaaattttattatgttttagttaatgataataagaataataagtgactttgttatgtgataaaattctctttcatttatttatttattttatgattattacattatgtttattacttaaagttattattgttttatgtattatgagtttatttccgctacaaataaatattataattaagtgtgacaaataattgtcattctggccaaagctgattgacttttatttgatcacaaaattttattaattcaattcaaatctggccaaagctgttttgattgaattaataaaaggagttttaaacaaattgataaagtgtggtttgtatttattattctggccaaagctgattaataaatacttattcacaaaattttattgttcatttccttctctggccaaagccgttttgaatttgatcaataaaagaaggtacttatttagctgctgattctctcctatgcagcatcttatgcctcac

SEQ ID NO: 6048 - DNA, 247 bp, Oryza sativa
taatctgatccgtcgtctcatgtcatcatgatcgttgtgctaatcccaccgattactccgcccccgagcgcgcgactccgccgctccaatccccgccccatcgctcctcttcacatcctccctcctcttctcatctcagccgcacgaatccccgccgcctcgatcactcgctccgctcgattccccgttgccgccgttggaccagccaccctcctcctcgctctgtgtgcatcctccctctctcagc

SEQ ID NO: 6049 - DNA, 1452 bp, Oryza sativa
agtgagcaaatgaattgtactatacatgcatgtatatgtatttatacatatgcatatatatatatatatatgtattccatatatatatttgcgtaatatatatgtaatatatatagggtaagactattgtacatctggggtatagaacaactattctatacccccctcgctctcaagggccacacccacctccccctcctttccaaggcccaaaaaccacctcccacatcggtcaaacgccggtcaaagctccctcccgccggtcaaagctcagtcaaacccacctactaactctcctcaccacccatctcttcttagctctcgtttcgcgaaactgtgcagtaacgcgacggtcaccgtgtagtaacactgtgttttacatgcagtaacaacgctcaaatatagttaaaatatagtcatgatggatctacttttgataagcatttttttttctagcatcatggtgcaaacaattttaaaaaaccatacatgacatcagagatattgttcttaaaagcttttctttttgggatttgactcttcacaagtagtaatacaatagcattacttgttactactgtacgttactacagttctatcacaacgttaccataagagtctagtaaacacaataagctttgcagtaacaaagtgtcttgcattttcttgaatagtattactacctaaactaggaattgaaacaaaaatatatgggttaaagcctcacatgctaaccgtatacttgttactacacaaaagtagaagcgttactacataataggtgcatgttaccacttccaagtagatatgttactgtatgataaatgcagtgttactatgtcatttttacgagatgaagttcgaataggtgggccataggtaagtttgtaggtggctttgagcaaggtctgattgatgtaggagtgttttgaataattttatacatttggtaaaaccatgttactgcatgtataaacccctgttactgtaaattacacattctattactgcatgtggagggctaaagttcaaaatgtcaatctttgaaaagcaatagtcataagatatgtattattttttaaaaccgtttccaccatgatgttatcgtgttactgcatgtgcaggattaaacttcaaaatgcatctacgtactcccctcctcaagaaccgtttttccttgtcgtaggctttccggaactttcattatatttgagggatgaagtgaataattcaagtcatcaaacaaacataatgaaacatccgacgcctcgagagaagaatattggagacattgctaggcctttagcttgccagtcaacttcagcctgagatgtgcccgtcaaaccactcgtaggcggcgaccagatgtgttacacattcaggagacttgacaaaaatagctaaagatctacaacatctcaaatattctcaactcatactcatgtgaatcta

SEQ ID NO: 6050 - DNA, 1501 bp, Oryza sativa
tatttcatgcatggaccatgcatgcatgacatggcacaggcagcaggaatagtagaagtctagaagacgaagacacatgactatatcttatggttcttgttatgtattatgacatgatgaactagtactatatcttatggctcttttcaaacaaaggaaatttaaataaattttataaagttgagaaaaccctatatatatgtctaatcggaacgaaggaatagtcattccaaattcctatgaaattccttatggttggctcgaatcatagggatattagagaacttttaacttgaggtccaatcttttagaaaatattctttgcatctatctatcttccaataattatattatgttttttctatatatgctccatttaagcagtcatttctgttgttttcttgttttttttcttttatctctctgtgtgtgtgattaatggtttcatgtttatacatgtagactagtagtagtgctagccaagtttaataatagagatgtctaccgcctttaattttatccctcatatctcctcatcgattcgatcaggaggtgtatatatatatataaaacatgtgtactaccttcatcttaagagattttgcccatatatatatctacataagcaaaatcttttgtatttagagacaaaggtagtacaatatatctcatccataatacacaaactctaatgttatttatttgtttactatcacactagtatttgcactttttaaattatgtagaggctgctttttatactgagagattgttcgttctctctctcctcacttaccccacactcatcaccaaatgcaacataacactgttaaaagacaacacttgagtcttataagcacgatcttgagttttattatacttgctcttatgtacgtactccttctaattccataattatcatgtttgactagaactttaacaattttaaatatttagcttaaaaaaacactggaacatagattagttttaaaaagtactttaataaaattaaatatctacttatatttttatatattataattgaaaatatatttggacaaactctgatagcggtacgtaagctcagggatccatttgattggattggtcaatctttttctagctaccaggccaattggtatgcacactctatatccatgcatgctgatagatcatgtcatgcactggcaaatagtgtaagtgatgtacatgaaaagaatagatcgactagctagttttctgtcgtcgcttgtggagaaaaaaaaaacaaacaattaacagtcgcaaacctatcactttggagaatcccatatatgtgtgctactatcagaggtcgtttcgtttgacagctctagcttaattagttaccccgaatacaaagattgaacaattaacaagtttagattggttgtatttttgcttgattttgccatgtgttaattaacactgtaaacattctggtatatatatgtggggtatcagttaacaacactcttgacat

SEQ ID NO: 6051 - DNA, 1501 bp, Oryza sativa
gtagacaacaccctggacgcttatcaggaaacagactatatatcgttcaaagttttttgttgaaattttaacttgtaaaaaccatctggttttagttaatctcatcgatattattttcttcattaaagcaggaataagaaggcatgtagtttgtacatgcatatatatactgaaattcattattacagctttcagagatcagcagcagatttgtcatgacaattacatattcttcatgcgtgagtgatatatatatatatatatatatatatatatatatatatatatatatatatatatatatatatatatatattcaattctgttgcttttgtcacgaatagttgttagttttaaccgagcgtgcttaaactgaccattatttttaagcaacttcaaaataaaaaggtttaagtccaactcattcataaattatttttttattacaaatctaatggtataactttgatgctaaatactaactagatttcttaaaaatattgttggtcaaacatagctaggcaactcaatgaaaactaacaactatttaattcaaattatttttaatggatatggtatatatcggtatacagtctaattaatttgtcaactgaacttgggttactgatggttctaaccattgtgtatacatatatgcaaacaaatttagtcctaattatatgtcgtaacatgagggtacgtactgtgttgatcgttttgtgttatgaactaatcacatggaaagaagtgcatatatatatctaatgtcaagagtgttgttaactgataccccacatatatataccagaatgtttacagtgttaattaacacatggcaaaatcaagcaaaaatacaaccaatctaaacttgttaattgttcaatctttgtattcggggtaactaattaagctagagctgtcaaacgaaacgacctctgatagtagcacacatatatgggattctccaaagtgataggtttgcgactgttaattgtttgttttttttttctccacaagcgacgacagaaaactagctagtcgatctattcttttcatgtacatcacttacactatttgccagtgcatgacatgatctatcagcatgcatggatatagagtgtgcataccaattggcctggtagctagaaaaagattgaccaatccaatcaaatggatccctgagcttacgtaccgctatcagagtttgtccaaatatattttcaattataatatataaaaatataagtagatatttaattttattaaagtactttttaaaactaatctatgttccagtgtttttttaagctaaatatttaaaattgttaaagttctagtcaaacatgataattatggaattagaaggagtacgtacataagagcaagtataataaaactcaagatcgtgcttataagactcaagtgttgtcttttaacagtgttatgttgcatttggtgatgagtgtggggtaagtgaggagagagagaacgaacaatctct

SEQ ID NO: 6052 - DNA, 567 bp, Oryza sativa
actcaactgcatgtgcagttaagtgagaggatctgcctccaaccacaaggatccaaaattatcaccaccttctacatgcgcaaacaggttcctcgatccatctgatctgagtcgcatccaattttggcgccaacacatgcaacttcctccctttttccccatggattaatgttacctcggtgaagcagcgatccgattaaactaaactaatttgcagccatgtacattaacgaacactccatttcaccggtccaccatgcatgcaccacccgccaccaccgcggcgcgacgccgacggcgacataaacaatcacacagaaccgcgtgacgccgccggccggctatatataccgtcctcatctgacctgctgccatcggctgcgaagatttcttggtcagttcagttgagttcaaccatgaacaccgccgtcgaggttaggtgcgccgccgccggcggcggcggggtgaatgctgcagcgtttggccggaggatgatgaggccggcgccggcgggacactgcagggtgatcagggcggcggcgacgtcgacggtggcgagcgggaggg

SEQ ID NO: 6053 - DNA, 1501 bp, Oryza sativa
aaatcatcatagattggcgcttaaagtttgcagcattgtactggcagcgatcaccattacggatcttagtggtgttgtttatgttgattggtagccgaactgataaactatggcaaacgtgcaacggcagtgaggtttgctgatgcaactgatgagccgtcagtggttaggcagttaggcaaaacctttttgtttgctacttcacaattgttaaaccgtgtggtacagtggctgcataatggcaacataaagtatatatgtgcactaatgttggcactagctagttggtgacctagaattatatgaatgaattaactcgccacctttgtacgtaccctgataatactactgtaattaagttcaatccaactactgcattataggagtacccgacacagaccgagaattcagtaacctgattgataaaccttgagttgttgacccaaaccgttattatgttttttttcctttaacgacagcgacaaagccccggtaattattcattgatcagaaaccaaagtttgctgtcaatggcagagcagtatagcacaagttcatgcatgccattatgtttcattgcacaggaagataatttcaagtatgtgattgtactatatcaaataaattacactgaaactccgtttgaacccttggattcatagggcatatttacggcttgattggttaatttgcagtgatctgttgtccatcgactatgcttttcgacctgatcttgggtcctcctaagtcctaactcaccctcctccaggacgaaccttgtggacaaatgacatcttcaattatcagaaattgtaacattagtattagtaaatttatattatatctaataacaatgatttctttagttatatatttgcatttaacaatggcacaatgattggggtccatttaaaagaccgttcccatttttatgtccattttgtctccacggatcctgttttttatcatgctatcataagagttaagtacgattgtctctttcagaaaaatgtttaagtacatttttttgtgacaccctagaagttttgttgtgacagttgctaatgattgtgtgcactataatactttattaagatgctatacatgctgccagcttcttggagatggaaggaattacggagtagcacaaataactgtgattggctggttcaagacttcaagaagacacaagaaactctcaggagcctctctaagctacaacacatgctaattacgattcgtgatgcatcgctttcctgaggaaattaagacactgcttgctgttaaatgttactccctgttaattggactcctatttgtatccaagctgttgaacatcaaattgtttcatcattgaatggtaagacatggaacactaacgtacagttgttggttcgaatactccgataagggtttcaatagagcattcagtttataattggaaagagagaagttatctgaaaaatataattgcacattgctgatagtggtaccaattaga

SEQ ID NO: 6054 - DNA, 1501 bp, Oryza sativa
aggatatggtcaccattgcaaccacgaatggttacattatggatgggatggattacaaacattcgaagctcaagctgacatacattacgctggtgagcaaattggttgttcgtagatatactttaacatttaggagatgtccgacttggctagtcatgtttctctctacataatatatggttggaaagtttattaagattgtgggcttgtttggattaaaataaatcttcactactacagaatcgatttttctgtacaagaccccctctaggctgaagacgggccgaaactgcgccaacatgcaaagttgcttccccagggtcggttcaaagactgcatgcgaaaatacattatctcaagaggccgattaagaggtccgcctacgaaaagtttgaccgtccttctctcttcctttccacatcttcaaaattttataagttctcatccttatcttctcacctcctctcttcctcatccttatctctctcaaccccccccccccctcttctctctctcatttctcacctcctctctccctcgcctccccctcccgagcagctgacagcgtgctcaagctcggcgacggtgactgtagtcgatcccttctctctcaactcctctcccacgaggattcggcagctaactcccctctaggcgggatccgccgtcgggtggcgccgcaatgggttccgctgtcgagcatccccgtgacaggcggatccacgctgccgctgctaccggggtgagaaggggcaacggtggaggtggtgaaggcatgggggcagggcgacgacgatgagtatgagctgcggggcctctgtggcaacgacggtgacgagcgatagcagactatagtgttaatgtcacctgtggatgggagctagatagggttttagcgatttttctttccgagggtgggcgacataatttaccgcccgcagaaggcggattttcgcggacaggtgcgctgccctagcaggcggcgacccaaccacatgcgaaaattggttttgattgtatgggaaaataatttttttatagtgctttgtcctaccaaaaaaatttggcaacttcaataatgttatatggatgttttgtttgctatcaatttttacacatactatacaaattctatactatcaatctagtggtactaaaacataccaacattttggcactaaattttggtatgacaaaaaaaccggctccaaaccaattggccctattttcaattcaacaaaaaagagtatcatttggacttcccaacaaaaataaagcactagttatggatcactgtatgtgagcaaccactttgccatcaagaatgttgtaccggccaccaaggatcactgtatttgagacttgcccactacacgctgctgctacttacccaacggtggtggtgaccggtgatcagttgcagatgaggccgaccctacctccttgtccagtggctggtgtgcctgccatttcacatttacttcagcattcagcatagagt

SEQ ID NO: 6055 - DNA, 1501 bp, Oryza sativa
ttttctatccagcatttgaatggtgtttccggatgtcaaaactcaaaacacagcaacatgagagcaaaacacactgtaccaaaaagtcaccggttgcgttaaaacaagaaaaatacagggcaacctgctgaccaaaaggaagttcatcatcaaacacacaagacacaacttgcccctctatcccttctcaaaaaaaaaaaaacttgcccctctacaaaaaagagaaaaaatgcacaacttgccacggccggatacccgtggaatattcgcgccagctccaacgccgctgcggcgcatcgaacaccaaacacaggtatagtccccacctcgcaccctgccacgtcacccgctaaccggaagcaccggtggacgccgccgacacgtgtcgacctcctcaacacgtggcgcgcgcggggtggaaccgcacggctccacccgtcctgccgccacgccgcaccggatccagtggaagcagcgcccagtgtcacggcctccacgctgcgttgccgcaattatgcgtcaccgcgtggggcccactcggcagtgagaccatgcaggctccgctgctgctgtcatcgcgagaaagcgattagcgggaggaggagtaacatcgaaggaaaccactaatcacggattattttgagcaattaccgctctaatccggggcgataagacgagggaaattactaattaagggaggggattaaccggtaatggtctttggagctggagagctttgctataaaagagctccaatggcgtccctcacacctccccgcccaccattcccactttcgcccacacacacacccagatccacagccatcctcccaccgccgccgccaccatctccaagcccacgaacacccacagccaccgtgagctcgagcgaggtaagaaaagctttagatctgagcgacttcgagcgtcttcaaggtaaagttttctcgaaaccctcttcttcttcttcctcctctggctcccccacctgttcttctacggtttcttggttaggttgcttgcagagagcgagagacccagggccttttagatccagggctcccagatctgctgtttttctttcatcttctttgtgttctagtgttaggttggtagccaagaggggttctttttccacacctcacttgctagatctaccaccaaaaagccatctgtttttttactgtggctgtcgatttctccctccttcctgcctgttcttgattttggattcggaaccaggcaaatctttgttactactgttttagtatcagaaaaaaaaatcccaaaaaaaagagtgagtagatggctgcagctatagatctgtcaggggaggagctgatgagagcactcgagccttttatccgagatgcctccggctcgcctccggtttgttcccagtttagtcccacctcgccattctccttcccgcacgcgttcgcgtacggtggcgggctggcccagcagccagagctcagcccggcccagatgcactacatcc

SEQ ID NO: 6056 - DNA, 648 bp, Oryza sativa
ggaacagcgtcgtgcccggacaggggcaccccacctgcgccgccgccgccgcgcccacctgctcaggcaccaccacgctcgccttcgccatcaccaaagaaaccttccagtcaagaacaccccaagaagaagaggtgatgattggtttgcttgtgtggaggcgggaagaggaggagtgaggtatttatagttggagagggaggagggagacggcggcggcggcgacggcggggcccgccggtgggggtggtggccacgggccacgccgatgtcttggacgcgtccgacgtcgccacacccgcgcgagcccagctcggcgccaggtggcccccgcgccgcggggcacgtgccgggcccacgcggacgtgtggggccgcgccgcgtgacacgtcaccgcctttgtcccgtggtgattctctttctgttgcgaggctgtttgttgtgcagatccagctttgatgataaacccgtgcggtttttcctttttgttcgttacaactcgtgtgtatttttttcaattgcatcgagagcgacgagaaatactggaagattagaactccccacggggcaaagtgtaattttcttgagaacttgtactgtagagattaacacgagtagcaaatactgctaaatatttttatttgaagt

SEQ ID NO: 6057 - DNA, 1501 bp, Oryza sativa
cctccataggggatcagttagaatcatgtgtctcaaccataaaacaaaatatagactatcctcaacttctaaaagtagtgtaaactacgtcccttggtggttttggatggtggttttggttgacatggcgtgttgacccagtcgtttttttatgtggtgcttattatgtggcatcacaattttaaaaaataaaaaagtaggacccacatatcattggcatcaacttcttcctcttctatcctctccctttgtcccatgatcccatcctctctgttcgcaggcttttcctcttctaccttgtccctctctcccatcttttgtcagcaggtagacgcgtcaatgaggaagcaatggaggggatggggcgctccgctccaatgtggcaccggggcactagaaaccagagtgggaactccggtgcaagcttggtttggcaagagtggcgatgcgggtgaataccgaaaccatcggcaaccgatattggagagcgagcgggtacggacgcggccatatccctccgcctccacaccctctttctcttggtttccctgccttctcctcaaggtcttccaactcgattggtggcggcaggtgagcaagcagagggagcaaatcgatggggatgactgcgccatggcctccttggccatggtggcccctacgacgaagatgagaagaagtgtgggaggaggccgatcaagcgcaggagctcctcaagcagcggctgcacagcaagctcttcccgccgctgccctgacgggatacgaagggccgccatcttggcagtctccgcaggcaaactctgcgggggcagaggcagcgatgggaactctgcacgctctgcttcggtgggcaggagcgacgactagcggcagcccttgaagaagtcatcgtaagcagggtttataattccgacgaaaaccggtcgaattccgcaaaatttcgacgtttctacacggctcaaaattaagttttgattggaatttcaaaggttaaacaatagatttggtcgaaatttatcgaaaaccgtgataccgatggggctcgaaatttaattgtcaaccggtaatgtaaaccctgatattcgtaagccatgggcaacattgttgtgctcaatgggaggggccactgacatgtgatgtgggtgatgggagagtggttggttcactaacatgcgggttccacatgagtttttatttagtgccacatcagcgccacatcattcaaaatcactctcaatatttacactggttttagaagataagagatatgttatacccattttatggttttagaagatgagggatacattatgctcgttttatggttgagggaagtaattgaaactcagccagatgagggatgaaaagttaaccttttcctttttgcaaataggccgaactggaaatggtgagattatgggccgatttttcacaacgatacagtgatgaagtactacgatagtgccaaacatttttccaaaatcgaaggaacaatgagg

SEQ ID NO: 6058 - DNA, 464 bp, Oryza sativa
tcccgccaaaccatcagcggcttttccattgtacttctctacggctcgcccgctgagtcccttctttattgtcattgagattttaaaatcgaacatgattatcattgtttttttttaccttttcgaagttcggaacctttaaaaattgaaccttgtagtttttagagtttattgtcttgttgggttttattttttataatttttagaagtctcgtcaaacaatgccactatgctcctttatggcccgtccgccgcctactctttctttattatcattgtgattctaaaaattaagcacaactatcgttgcaattcattttttattttctagaagtcacgtcaaacatcaccggctctaaaactatactactatacaccccgcccactgcttctttttattgtcattgagattttaaaaattgaatatgattatcaatggggttttttttttactttctagtagt

SEQ ID NO: 6059 - DNA, 813 bp, Oryza sativa
cagaataaaaaataaaataatattcaaaattagaaaaactaaaagagagttcaagtaggaatacaattttgaaacaactgaaattgaaaataaaaaataaaatactaaaataacacaatacgatattaattaaaatttgaaaaaaaataaattctgaaattagaaaaagaaaaataagatttcaattaggaatacaatttataaataactaaaatttgtgataaaaataaagactatttaaagaaagaccatctaaaacacatgacgagataaattaagtaagaggcctataaaggagtagagtggtggcggttgatacgacatataaaaactgttaataaaacaccaaatagaatcctaataacgattaaaaggagggacgataggcaggccgtgaagcaaacgagcaatgtgattgccgggactactagaaagtaaaaaaaaaaccccattgataatcatattcaatttttaaaatctcaatgacaataaaaagaagcagtgggcggggtgtatagtagtatagttttagagccggtgatgtttgacgtgacttctagaaaataaaaaatgaattgcaacgatagttgtgcttaatttttagaatcacaatgataataaagaaagagtaggcggcggacgggccataaaggagcatagtggcattgtttgacgagacttctaaaaattataaaaaataaaacccaacaagacaataaactctaaaaactacaaggttcaatttttaaaggttccgaacttcgaaaaggtaaaaaaaaacaatgataatcatgttcgattttaaaatctcaa

SEQ ID NO: 6060 - DNA, 1501 bp, Oryza sativa
acaaagtactaggagtcatcactgctcgctgctacgtcttacaaagagaggagtttattgcagttcatgtctaaatttgtagcacaaaaaaaatatttgtgtggtgtaaaactgtaatacaatcagtaaccatataaatacacccaccaatccgacatagcaagagcgtgatcctacattgaactaattgatcagcctttcttgccatcaatataacttgcaaaaggaaatccagcaagtcactaatcaataacacccctaaacctccttaatttcttttttcaccactcaagtaatttcctcatttccccagtttcccctacttcacaatcagcaagaaatgaacgcaattctttgtaaagaactaggacccgggaccgggggggcatagcaccagacgaacccgacgcaaaacaaggcaaaaaaatcgaaccagagcgctcacataggcgaggccgcgagacgccggtggaggactccccgccgacggagccctcgccccccgccggccagcgacggcggcggcgccacgacggagccggtcgccatacaccccccccccacccaccccgcgaggagagacggcagcaatcggaggcggagcagtggtggcggcggcggcggcagctggccagtgatgagctcctccgcgtcggcgtccggtgaggtctacctatgccttgccttcccctcccttctcttttcttctctcttttttccgctatccgtttcgcttgtttctgtgggcctggagagtgggtccgggtgggtggggtgggacccacttttacagccgcgtccagtcacgcggtggtgaggtggtccggtcggctcccttccatggttccatggcccatggctgtctgaactctggaccatttgacgacgcgattggccatatgagggacgggcgtacgtgacagaagaagcgtcgcgttcgtgttcatggtgctttgctatcctgatggctgtacacatggatttcaggaaagctccagggtggtgataggagtagtataacagcctcgttagttgatcatattctctaataaaccaaaacagtttattaatttaaaagtcaacactaaaaaaattatgttgaaaatattttatcaagttcgaaaattcaaattttctcttttgctttgacttgtgtgaccaatcgatggggctctatgtgttgctgtttatggatggatatcaatctatgattggttgatgggcattcgcgaatctgtttattttttggatgcataggctattgaattgtcactacatctaaacaggacatgatggcacattggtttgaggttaagccaaaaactcaaaacagtgggtatacctgtttaagagaatataagcaagattcgcatgggctagataatggcggggactaatagtatcgtgaaggttagtttagtgtgtgtattttttattcataatttacttgtttcccggagaacttttactttattcggaaataaattgttcagatacaagg

SEQ ID NO: 6061 - DNA, 1501 bp, Oryza sativa
cagaaactaggagagaacctaacgacattttcttatcgccaaggcttttgactattgatgattgattcctatcatgcaaaaggaacatattcagactgtccatgattatccacggatctgtggcgagaattggactgcgatgtaaaggcgagattcttcctagctagtgagctcggaatcggattccgggacaggcagctcaagatttggggtatcctagaacagcgtggctgatggacgtaggatcaaaattgacggtcctgatcgttttgatgggaggaagagtaaagctgagctcttccccctgatcatactgaactttgttcgtgaagcaccagcctgatgtcattgcctgttcgatactagtacgaatgattttagaatcggtacggcacgattactctgcttacacctgttcttggaacgagaaaaatagcatgaatcctgcactttatttgcctgtgtattgtactaatatattgtgagacagagcatctttctatctgtttattattagctgttaggcaagtaagcagaagtgtgagcatcaaggttggcatcaggttgaagcggtttggtctgaaacggtaggccaaagcagatgagaaaaggcgagatgaatgtatccaaacaaggtccttcaagctagagtttcagtcttccaaagagaaaggctaagctatagcatttcgtagatgatgccattggaaggttcatgatatgaaaacaaagtgacttgaaggaatgttaggctggtggatttccccaaacaagtgtccacaactcataaatactccttgtatctgaacaatttatttccgaataaagtaaaagttctccgggaaacaagtaaattatgaataaaaaatacacacactaaactaaccttcacgatactattagtccccgccattatctagcccatgcgaatcttgcttatattctcttaaacaggtatacccactgttttgagtttttggcttaacctcaaaccaatgtgccatcatgtcctgtttagatgtagtgacaattcaatagcctatgcatccaaaaaataaacagattcgcgaatgcccatcaaccaatcatagattgatatccatccataaacagcaacacatagagccccatcgattggtcacacaagtcaaagcaaaagagaaaatttgaattttcgaacttgataaaatattttcaacataatttttttagtgttgacttttaaattaataaactgttttggtttattagagaatatgatcaactaacgaggctgttatactactcctatcaccaccctggagctttcctgaaatccatgtgtacagccatcaggatagcaaagcaccatgaacacgaacgcgacgcttcttctgtcacgtacgcccgtccctcatatggccaatcgcgtcgtcaaatggtccagagttcagacagccatgggccatggaaccatggaagggagccgaccggaccacctcaccaccgcgtgactggacgc

SEQ ID NO: 6062 - DNA, 1286 bp, Oryza sativa
cattttaccattacttccgggctttaacaacaacactctcctaagacccaaatccatggaagcataacagggttacaggagattgattttgcagctagtaggcatcttgcaaccagataactcatatacggtactaaccatctgattcccaatgcaacagaagccaaatgctattttgcatattaataatcaatattgccaaactttccgaattagttgtcaaacctcagaattgagcacaagaatagcctgacaaggaaaccacaagcatctaccctttccccaaactatctaattattatgcacaagggaataccaaccacgtaccttcctactcgactactcctagaagctacacacagagagtaatgaaaacaaacagacattatagccttatgcactgaaattctcaaagatttctacaatttaaggcctctatctagatttgcaatacagcacatgaaaccaaacaaaagctccacgactacttcgtactccaatgcctaaacatgcttatctctacagtttaatcggaatcttcagcgttcccatataatctcatcatcacgagaacagtcattaagcacgcacagaacccttgagaatttatgattggatttggaaaccacacccttgctaagcatccgtaccacctaagcgtaaaccctagctctaagcgccgggcgcaagatacttctcagcgagcgactcaccagctgggtatgctttgcgacgacgcagtgctcgccggagcctggggggacgaggtacttgcctcggggggcggcgcggacgtggccccgcaccaccgcgaggatcggctggtcgccgtcgccgccgccgccgccgtactccgcgaggagcgagcggaggtcgggtatggcggccgccggcgcggaggcgatgcgccgcagctgcccggacgcggcgaggtacttgacccacgaggcgacggcgagcgccgccgtgccgaggccgagcaccgccccgtccagcgcggcggcgaggcgggccagcgccacggccgtctccctgtcgcgcgccgacatggctcaccggggcgaggcgatcgatgcggtgggggcgcgacgcgccgccgacttcgctgctttcgtcgctgtgtcctctcctgtgtgcggtggcgattttgccgatttggggccgagccgtggacagcctgggtatttcacggttacagctggtcccgccctcgtggacctatacgaaccttcgagattggttgcgctactcctcctcccagccgtgagccgtccgatcatctatct

SEQ ID NO: 6063 - DNA, 418 bp, Oryza sativa
tggacatgtgctcaaaggatgtaataaatatgatttttttttaaaaaaaaaagatgaattcccagtaactttttttagggggggtaaaaaaaaaattttcttgccttaaaaagacatggtttgagagagagctctggccatgcagcaaggacgagccaatcagccaatggtatatgctgcaaaaaagcaaacgcatgcatgggccccagttgtcagtggcatatgcatgacctctaatttatatggtttattttttccctcgtaatatttcccaacattttctgtgtcacgtaggggaagctgcttagccctgatgaatcccctaatgattttggtaaaaatcattaagttaaggtggatacacatcttgtcatatgatcaaatggtttcgcgaaaaatcaataatcagacaacaaga

SEQ ID NO: 6064 - DNA, 187 bp, Oryza sativa
aagccgcgttcgcctccttcctcctcgagtcgtcaactccgtctcgcaattcccaaaccgcaccttccaatcctccgagcaggcaaaccctaccccgacgacccgcgccccacgaaacccctcccctccgcccgaatcactcgctgccacccccaaattcggcatgcccgtccccggaaaccctagg

SEQ ID NO: 6065 - DNA, 1501 bp, Oryza sativa
agaaagaggattggacgctcaccagaaatggatgcgatacggcgggaataggtggacgaacaccagcggcctccggcgcggcgaaggcgggatggatgggatgggatggggatcggcggcgcttggggccgcagtcgaaggtctcgaggagacggggaaatgtatccttaggttgaggactgaggagacatcaagacgattcctcttcctgcatatgggccgggccgtcctgttacgaatacccttttggcccatttactagcacaagattttggaaaaggtacaccgaaggcccctcaacttgtcatctgagttacaaaatcatcatccaaccacaaacccagatatagagccttccctcaacttacaaaaaccattcactttatgttctttgatggtttcgaacccggtttcgtcctatgtgatggctgagtcagcgtgggacccacgtatgtccgcgtggccacgtcagcaccctctctcttcctcctctctctctcactcttctcggcaagtcgggcggcagctggggcggaggccatcaaggcaaggcaggaaaggaggaggcgacggcggcggcctgtctcgaatggcgagacggaagcgctccacgccgcggtgcttaaggaggaggagcagcagcacgagatggaggaggcagcggtcgtgacaagcagcagcgccacaagcggggaggagggcgggcacctgccgcaggggtgggtgaagcggaagaggtcgcgccgccagcgatcggaggagaacctcgcgctctgccttctcatgctcgcccgcgggggccaccaccgtgtccaggcgccgcctcctctctcgacgacggggccagcaccggtaggtgcggagttcaagtgctccgtatacggcaagtcctttagcttctaccaagcgctcggcggccacaagacgagccattgggtcaagttgccgactccgctcgcacctccggcaacggccactccaccgctcgggtgttcgaccttattgacgatcgttcgcaatcagtttcgaccgttaatattaccaaaatagaggaaaactagttatacttgcaatgcatatttaagttagaataataacttttcactagtattaggattactaatcttttgcagagaataaccataaagtggagaagaatcgacatcaaatcaaatgatcaaataaatgtggttgggggacgattttgtaactcgatgacaagttgagggaccttcaatgtactttttcccaagattttcggtcacttcacccaccgctgaatatgagctacagtctacagatatgatgctaggcatgccctataacaaagtaaataaaaaaccatgtaatcctaacctagtatcttactataaagttatcccccactaactccttaaatttaacatgcaaagatgccacatcatcatccactaattatcacatttaaacatcatgcaaacatgttatattacctataattttatagtttttataatttaag

SEQ ID NO: 6066 - DNA, 1501 bp, Oryza sativa
ctaactgaccataagcattgtcagttgtcaccttgatcattcaactggattttcgtatgagatgtttgcgttgtaataacacctctttaaagaacatgtagcttattttttaaaaaaatcgtacatcgttttgatctatttacgagcgcatatcatatctactttttttttatttgagacacaactaaatggtcgtggactcgtgggcttgtggctcatcagatacctcctttctttaataaataacaccattgactttttatcacacgtttgactatttgacttattaaaaaaattatctaattttaacttattttgttgtgagttgttttatcactcaaaatacttccaacatgatttatatcttacacattttgtataattgttttaaataagatgaatgattaaacatatttttaaaagtcaacggcgtcatctatttaaaaaataaagggagtaattggtgcccactaataattattacaaactacttctccgtcaaaaaaatcctaaatatgtatatggacaacatttatatccagatacatctcaattggactttttttttaactgtgggagtaaaacttaagatacaaatacgacgcattatcatccactaacaattactcatgcaagcataactaatcatctaaaatatgatattgtaaagctcaatatacaagtatatcaaatcatattcctcacattgttttcataaatactccaacattcattatttctatagtatgcaacatatatcatatcttactataaagttatcccccactaatttattaagcttaacatgcaaagatgctacatcatcatccactaaacaagatgtcacatcatcatccactaattaacaatatgtcacatcatcatccactaacaattatcacatttaaacatcatgcaaacatgctatatatttatagtttttataatttaagagctttttaaatacaaacatgttaaattatcatccaacataattcatataatgtttcaatgtatatatttattatgttttatgatatcctatatatttatatagttcatcctcacttagttagtgcttaaatgattaaactatggtccaaattatctttctccttttttcctctaattaatttatatcacatcaattgtttttagcatttagattattaatctacggtccaaactatctcccttcttttcttcttctataaagtcataccaccttactttttacgtttgaatcaccattctacatactatttaaatttaaattatcataaaccacattaatttacttaatctgttgttatccagctatcttacacgttattttttatttctatcataataaattcccacagcaatacgtggggtttcacctagtttactcatacaatttgtaacaaaacgtgggtatcacctagtaatgctcgttggctaaaactccaatattagagggtgtggatagtgattgagtgggatttaggtcctctcacta

SEQ ID NO: 6067 - DNA, 1501 bp, Oryza sativa
ttaacatctcatagtgacttggatcaggaaccatgatctcatcataactagccttgcaaaccttattccaacaattcccataaaccatcctatcccatatcactgtcctccaaccaacaaagcttttaagccagatatcaggatcaggagcatcttctttgcagggtggttctaagtcccagtcatagagtatgtttgcttcttccccagggcgtcttctaccttgagtaggttcttgagtgggttcaacagtaggtatcaaaaagtgctccatctcaataaacttgatcactccacccatacaatgaacatctcgaatcatatgcggagaatcatggcaataattacccggcatgagctctggcagacggatgaaacgtaccacagggtgatcagcaagcacgtcgcagatcaaaatgcccttccaaagatctacccatcctagcaggcttcctccaagctggatcgtcttgtgtggtaaggctgggtaatacttactatcaaccctttcaagattgcaagaagggtccaatggcactgatttcatagtccactgatccgatgccgaggaataaaggtggagagtaaactcacgaatattgcaagaggtgaacaggagagcagccaggaagaattgtccatggtcaccacaccggatgataccaatgtcctcgccgcgattgtatcgtggatcgtgggttgggatccggcgaagagacggcgactcggtgccggatccggccttgtacacgaagtactccttgtcaaccctcccggagaacatccccgagaaggccatcggcatgagcagcaggagcaggtcctccgactagcaggcgacggagggcgcggcggtgaaatcggccgccgtcagggtggggctgtgcacgcacgagatggccggtgggttgtcgacgcagaaggagacctcgacgacgtcgccgtggctcgtcgtggccgtcgccgtcgtggcatttgtgcactgcgcgtggtgcaccttatcctcgaggagcatccacgcgggaggccggaaggcggtggcgaggcgggtttgaatcatcatcgtgtaatgatctaggaactagggttttggagtacctctctagggaagagatcgaagcagctattcgatttatgtacgggatttttttttttgggatatgtacgggaaaattaattttccgatcttgaattattgattgggatttgctacgggtggcgccacccttttctccctggacctatatctactgtgtgtggattttagtttaaaaaactcggcccattccttgtggataaggcccatccaacagcatgtctactaccacgcggcccaaaaagcgcttggttgctattgggcccatgggtcagggtgtgaggcggtttcaccagtcgctagctcaagcctctaaacccttcttctccccagctcaccccgttcgccgccgccgacgccgctcgccgggggctatcgccatgtcgccggccgccgcctcaccgg

SEQ ID NO: 6068 - DNA, 1501 bp, Oryza sativa
atcatctttgttttttttttttttcaaaaaaaaattgcaaggagtatcagcttttccttgcagggagcattgctagcgaaacagaagcaacgttccttgcaagtttgatcaatgcagtacagcttctggaaagggagctttgataatagtacagttgtacattaagtacaaaaggatgcgccaatagtcgactggagaacggagcagaggacacgtcattccagatagagccatctctagctgctcgtgtgtgtttgtcagcacatgatgctaactagtacgatctccgggcaattaacagctttattttttttatacttatacttatcaactaaaatagttctcaaccttaaattttgaagttgattttagagtttttcatcgaaacttatttttcagccttagcttttagatcgttaagaacacgtatataaaaattttattcataaattatttttcatttgcaaatatatttttggcttattccatttgcaaatatactatttagcttattccttaaataagccaaacgatagggcagtaagttatcatatgacattgataagaggttcatcgtttgttattcagtttatccagccaaaatttaaatttaaaactcaattttaaagttaatattaatgtttttgtcttaatttatttttcggtgttggtttttaagtcactactaatacatatataaaaattttaccttttctttttctaataagcgttgcaacctatgatcagcaataggtgaaatgaagggataattaattgagagaaaattaagcaagttaattaattaccttggtaaaaacacattgaggaaaaagttttttttttgcggggaggaaaaagataatttaaccatgtgtgaaaatacacttggagataacgcgatccacttgtgcctcttgtcggtccagtttgaaacggacgcaaactatggagtactaccttttttttttttttgacacgaactatggaggaccaggaggagtactagtactagtaaagggaagctttcagcataccaaagcatttgagccatgcctttgcctgcttttccatctgatccgtccagtcctcatccgacgcacgggaggcaccctcgccgcgtacctcccgttgcaactgacggcgcggatcggagcgtccgtcgaaacccccgtttccgccggcggaatttcacgcatttccccgtgtcaaaatggtccgccaagtcaaaagcccaagctagccccctctccatccacacacccccaaaccaaaattaaccaaacccccgcgccgttaaccctctgagcttgtgatgaattaacgatcgtgaccgatcaagtgagcgattaataataacccagcggcacacaattaagcaatgcaagaagccgtcgtcgttaacaccggcggccggtgggcaccaacccgtatttatatacacttctatccggccaaagcagcgggcgcggccgggtaacccaaccacacacgcacgacacga

SEQ ID NO: 6069 - DNA, 1501 bp, Oryza sativa
attgttaatgctcaacacttgaacaactcctccctgaaaaatcaaaagttgatcaagcatgcagtgttctgaacatcatggcatctactcagattgaaaacatttcaggtgaagtctaatcttgagttggtttcaccttcttgtggatgaagaggatggcagtgccatcaccgtccctgacgatcagctggccgctagcaccgatgatcccgcagccgtcgacgctgaagacgaccctctgatcacggtcggtgacgacgaacccgccgccgttcaccgtgggagggcggcggcgcaccatcagcacggcttgcgagctgctgcagaagatcttgctaacaaccggcgtcagagctgcgtacgcacccatctgatacggtagctctttcagttcttggagctacgaatactagttgtgatcaacgatgaattgtttttacaatgtagcttctgctaatgcaggaaaggaataaatagggtcatttgagtgtacgtgtgtcgcatgactcatctgtgcacggatgatgcatctgcctaaccatggtctattgtgagtttgtgagccaagcgatttggatgaagttgcagagctgaagcaacgtatggcaaacgacctggtgatttggtcatggaaaagtatggcaagtgtacaggaggagctcataaagaatctttgaattcgattgctttgggccaccgaactgctttatcatcatcggattaagtgtttacattcaattcatgaaggtttatgcctgattaagagcacaattatgctccagtcaggtcgctttaattttgatgaacgacagatggcaacgctaagtaggaaacttggcaggttttggagataatcagataaaccgacctgagcttatccttgtcacaagtggtagctaatcatgtaatcgtgagagtatccagccagcttttaatcctgatttcctttttccggctctaaacatggtcatgaatcttcagcgctaagcaaaaactcacatgtcacagtcacctaagcaaactctcatagtttcattcacatactatgaatttttatttatatatttattttttataaaaatacaaaaaatatatatttgaaatttgtttttaaaaattatataaatacactcctagttctctttgcgagggtgtcttttaaaaatcgttgttctagaggatgagaaggggcctaaatgtatttttttatttgtatagacactttctgctggttttaattactataaaaactagtaacgcttattcgacactttaaataattttaaatgaaaaggtgataaagacatgaagtttatctctattggagatcgtttgaaatgtagatatgggattttatgaaagtagattttagatttttttttaacggatgtttggattcttaaacaatcttaaatgaaaaggttgtgaactacaatcctcgagctctataatttgatttcatccaacttcatatgacatagtaaattccatgtgtaccctt

SEQ ID NO: 6070 - DNA, 267 bp, Oryza sativa
cacccattcctccactcgcatatcccgttacctttgccgccgcggcgccgccgccctcttccgctcgccgccggccgagggcgcccgtcgcgcgccgtggagcgagcctagccgcacgagctgaaagcacctaaaaggtcagcgcgtcccctccccctttcctctcctttcgccgctcccgcagcagccacaggacacctgagacgggtctgggggtgcaggtcgcgcctggaggaatccctaggggctaggggaggtggctggaga

SEQ ID NO: 6071 - DNA, 1501 bp, Oryza sativa
tcaaccgtccacccgtatataggtttaagcaggttagccccttttttttttctgttaacaatatttgttgtattgtacagttcatatatacttacagacgcatacagctgaaatcacccggaaagtggattctcacggcccccaaacttcatcaagatgggggctaaggttaaatagattgattactttctcatgaaaagttattattgtaatagcagcaatggaactaatttcagagctaatgaaagggcttaacagaagtggaaacggtgtgctatctgatactacttcagacgtgtgtcctcaatatctgacagaagttttttttttaagaacaatatctgacaaaagttcaatctatgttttttttagaacaaagtttattggaaacttagaagcacagtacatgaatcagttgtacatcgtcagctataaaagctgattgaagagctgccgtagtagcacagctactttgaagcgagacatgtcatacattttgacaaactagttggacagattgacgagcatttgcttctcttgccctttttctaaaaatctgccatcttgtttagatttctttatatccagagttccagaccatgctaattgattttccttgagtaaaatcttgcaatttcagaagcagaggatgaagactccagtgatgtggctgggaagcaaaattcctttgacgaaggagcttcactagaggcaaattatcagaaagcataaccatacctgcaatgttaagcattctgcatacgccaatggctaagtatatacttgcaagttctgcttggagagcattagtataaagtattgaactagcttggacacaaatcgctttacgagtctgtggatcatgcaaaaacattccaaatcctaattgatctttccaagaagcatcaacaaaacatctattcccaggagggttattccattatcagcattttgagtggactgaattaattgatctttagagttaaaatcaaggacttgagttcaatctacgttgttccatctgatacttcataccctgtatatgacaaaagttcaatctacatcttacgaaaggacatatagcctcccatagtaggatcaaattttcagattagattgtttgagaggctaagttcttaatttaaaaggttttcagattagattgtttgagaggctaatttctcaatttaaaaaggctgtaaacatcctgttggaaacaaaatcacaacaattgaagcactacaagttccgaccagttcatcattcaagcaaacccccgaggccccgacccttttctaacaaatatgggaccgaacgaacttcaacataaacaatttaggtggcagttgcagaaaaagcaatcatcataattgaaatccattaggctttcagtttccaatagcagaaaacttgtctgagattcaatgacagagacagtttccagttatcaatagcagcaaaagcagggaatagcacaaacgaaaataacgacacaggaagt

SEQ ID NO: 6072 - DNA, 430 bp, Oryza sativa
gtttaatgcacattcagcttagaaattctggttcatgaatttctaggcgagacatcctagcttcctccacgcccggaatccccgcctcatcccctctcgcaggcgatcgatcctccaccctcccgtacgcggtaggcctcccgcctccgccaatcaacgccgtcgtcctctcccgtctcgccgatgggatattgacccggcaccaacgtctttctcgctttcgtctccccgcgccgacgagagtggcgtcccgaccgtattcccactttctcagttccccacgagaaaatggacatttcgccatgttcaaaacgcggtttcgctagaatgccatcccgaagacgtgattcgataaactgccaatatgaagcgtgcgtctaccgccactttgccattttcgctattttattcattttcgaaaagattttct

SEQ ID NO: 6073 - DNA, 1501 bp, Oryza sativa
agaggaatttggttggttggatggtgtggtggtgtctgctctctcttgttgtttgtggccacactaggggtggatatcttggctcggctcggctcgctccagctcgttagtgtaccgagctggctcggctcggagccagctcgttcggggaggccgcgaccgacgagggatgggcggatggcgaggaggaggggccgaggacgcgaggtgccaccgtgcgaccggctcgctgcgggccttggtcgccggtggtggcaggatgcgtctcgctctcgcactctcgctcgtgttcgccggttcgcgtgtgggttgtggccgcggcgcctgtgttccttactgtctgcgtgcctcttctctgtgaattagggattctagggtttgtttactcaaggaaataggctattgggccactaatgggcttttctggttaggtagcccggctcggagtggactcctggtcctggtgtttctctggctcgttggcctcgtgagcagcttgcgagccagctcgagctaaacccttggctcagctcgttagcttttctcaacgagccgaccacgagccgagcgcacccctatttgtggtgctcaattttttgggagaaccaaagcgaagcaactgcaactgcgagcaccaccgggacatgccttgtgcattcaaagcacaccaacaaaaaaaacgattcagcccaaaataaaatattttattactatatactatctccgtcctaaaatataaccatttatagatcctggcaatggtctctgagatactattttgatcactaatatttataaaaataagatattttaaataaaagagttgtatattatgataatttgtttacatgattgacctttttattttgctattaatggctaaagttaaaaatgtttgacatgttactatgctaaaaatgcttatattttgggatggagggagtagtattttgttgtttgccgtttgaaagccattttagtaaaataaattgcgataaacaaaacttctaaaattaaatttcatttttttttaattttttgcgagtgtggctaacacaacaataaggctgcattcgttccagccgattcccaactctcccctctcgttttccgtacgtacactttcaaactgctaaatggtgtgtgttttataaaaatattatatatgaaagttgcttaaaaaatcatatttgattaatttttgaaaaaaaaatagctaatacttaattaatcacgtgccaattgcctgttccgtttccgtgtgcactcttcgtgttgggaagcaaaaatgaaggaacccagcctaagcgacgtgaacaaggcccacaaacaaattttctttagcaaatagtaggatttttgtcgaaatcgtataaaactatatatattttaagttgtgccatataatatttagttttcaaatttcgcagtacacaccacccttattcaagtttttatgcagttggataatgttagcttcataaatcatttggatgaccat

SEQ ID NO: 6074 - DNA, 300 bp, Oryza sativa
  unsure (1)..(300): unsure at all n locations
aggtgttctgtaaacaaatgaaagcagaaaatatgcatatataccagctactacccctatccaaaaatgtagctatttctagcacagtaacttatcctaaaatgaagctatttctctacntacactctcctctcaaccaatcacaactatagagttctcttcatgcagagcaagatcacgccatggaaggtcacatcatgaccaaggcgagttattcttctttcttgctgctataacccatccaggcagtctcggcgttttctgattcaagctacttgttgtttttttgttcttggcaga

SEQ ID NO: 6075 - DNA, 1501 bp, Oryza sativa
tccatcctgacacgcaggcacagtagtacagtacagtaaaaaaaaatatggcaccacctttttacacccaccacctcccctctcaattcactcctcgtctcctcctcctcctccttcacatcgaagcatattctcgtgaagccctcgaggaggaacaagaacaaccaagaaacactcctccttctcctcctcatcctagttcagtgcagcgcgatcgtctcctcctcttcttcttcttctccatggaacagtagcggtggtggccgggtgggttttgtttttgtttttgttttgttttttggcagccgcgccgatcgaatcttcctcccaaggtacgtggccgtaccactgttcccaaaccgcattgttctttcatttctttctccccctctttcttttgtttctttgtgtgcgcgtgtgtatgtttgtttttttgaggcttgattatgtgctttaatctaagcaagaaaaggaactggatggtaatgagctagtgcttcttgtggattttgggtgaacgcgtatttgattggttcatccgttcatgtttgggtgaacgcgtatgtgtgtaagcagggcaacgattcgtgaacagattaggtttttttttcttttttgtgatttggtgatgttttttttttcctctcaagcaaactgtggtccgttcttgaatcgacttcaagttggtcccgtcgctgcttcattaatcttgcatgtgtagtggtctttgccctgtcactagattgatgtactttgtttgattccatcattgattttgccctgtagccccacaagaagtgtgggctttgtacggattccatttactgagacattgatcgaactggagttcatgttgatactccttttgagttcactaactcgtgattcatttcttgtttttttctttgttctgcatatgagtcgtcaaggaatagggctcagttgcttttgttctacattgcgcttcagtaatgtgatttgattgcgcgagttctgaaaaaatcatgatttattccattaacacccaaaagaactcatctcttgaaaataatgttggtgattcctaaagagttttacttcttgttgctttccgtaaaacaagaatcaacgatacagttcagtctatttatgtgtattttcttttggttctccatcttctagagtcaaaatgatggtgaagaaaaaaacctcttggagccagattgtgaaaaatggcaggccagcaaacacgtctgttaccacaagaaacctccgaccacaagatcttggggctgtgatatttggctgcacaaacaataccatcgcagagtgtcactcacggcaacttttcggtacgttcttgtctttcttaattcaaactctttgcataagatatctatttgcaaaacttagccatataaaattgacacattcatttcttcctgtgagtaagataaatatctccacctttcaaaggattgcaacttgctaggtaatccaccaacttagtagctatatttgt

SEQ ID NO: 6076 - DNA, 1501 bp, Oryza sativa
cctcattggctagcttttggggtgggaaagaccatttacgattctacaattggtatcagagcctaactagtttaacatctcttgcccaagggacagagaaattttaggagttgagggagctacttttgaagagaagtacctagaagacttcctaccccagagggtaaaatgaagagtgaacccttccaacctgtcaaggaaagatttgcaaaaaggctatgtgattatagatggccatttggcccgcccggcctaggcacggctcaagaagaatcgggccggcatggcatagtcgacactttgttttatcggccttttgcaggaggtgcgttttgctcatattggaagagggtgtaatcaggggcgaacgtaaaacaaaagtgacgatatgaatcagcagctgctgcagctagcgccaccgaacaggccctaaatatataccaaagggtaaaaaaaactcttatctgcacttgatcctaagctctatctaattaattaaggtatagcatgcagcctacaaccttatgcaaggtttaaaagaaaacgagtgtagcaagtagcagtatatttaaggagtgtttagatctatgggtataaagtagttttgacgtgtcacatcggaacacatttaaagtattaaacatagactaataacaaaacaaattacagatttcgcctgtaaattgcgagacgaaattatgaagtctaattaatccatcattagcaaatatttattgtagcaccacattgtcaaatcatgacacaaataggcttaaaatattcgtctcgcaatttacccgtaatctgtgtaattaattattttttttgtttatatttaatacttcatatatgtttccaaacattcgatgtgacgaggtgaaaaattttactaagagatctaaacacaccctaaattacatacggttccaagcaaggaaggaatttatgaaccgtggaatataattctactaaccatcattgagataaagaagcatctgtaatctttgagactatgaaaagcaaaaaagaaaaaaagaagaaaagaaaagagaaggaggcacacgggcacacggcacagcattccaggccactgtgccccactctactagttaggcactgctggtttgaagcttcgctaccgttgctgcctcagaaacttcagactttcagagcatcgccctttgtgggcttgtggcagcgccactagggattaaaatggcttagaaacaaacagaaactacctgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 6077 - DNA, 1501 bp, Oryza sativa
acaataggtgttataaatactcttcaaattaaagaaacaaatacatccaaaaaaatggtgcaacagtttcctcattaaaaataaggacaatttagtgcaaactgcaaaggttagttcacttcagccaatttattaactttagtattgatgccaaacaaagattgctaaccgaatagcagtatatgctgtatgcctacaaaaaatatatacatgctaacatagttgttggacttacattttgcgataaatttgtcatcccattcatcataagcagctttgtccatgttgccatcctcatctccctcgctgtcatcagtttcattctcagaaataccctttttttaaataaaaaaaaatgttaaacagtgccaacagatagaaaacaaactgattatagttagttaactacataatcaaaagaggctgctaactaaagagaagaccacaaataaatctctggtgatcatggtccttagagtgaagtatattttatactacagtaacagctcaagtgtagtgaacaaccctcaactatctaaaccagttaacatatcccatgtaagataaaaaaaactggattaagtggtggtttcatggttttgacatcccgtaaatatactttttgactaatatggcaactattttttacattttctattaattgggtgcaatattatagagaacttatattaaagaaaaggttaaaatggggctggatttcccttgggggtattttaaccggttatgttggttgtgcttgagggttgattttggaccaagatcataatgcctgctattgctatagtggtattcagtaatatcaagattgggaaatgtacccgcaccccggaccccggtacaggcataatggactagagtaaaaaggcagtagtagagaaataactgatcgtcatgtgtatatatacgaggcgattacccgaaagagaaaggaagggagcatagaatagaaattacctcgagatcgaagacggggtgttccaggtcatcctcagactccatatctgaaatccatccatccattcagtaaaaagattcaagtaaaaaggaagaaaaaatgacggctggtacatgaaaaggaagaggggcggaccgtggtcgtggagggggatcatgtcgcggtgcttgtggactggaaatacccacccacccacccaacacagatggataaagcgtgagatgctggaggtgaaagaggaaagaggagagagagggggtcaggtcaacgttgtcttacaggcgtcgatctcgtcgtcgtcggaggcggaggcggccatcaccggcggcttcacggtcgggggcctcttccacttccccttccccttctccttccccatgcgagcagaagcagagcggatgaggcggcggcgttgttgttgatttgtggggttttagggttttggagatgttgcggcggtgcaggagaggaggcggggcaacacccacatgggcttttctgcctcctcctattgggcttcacagg

SEQ ID NO: 6078 - DNA, 1501 bp, Oryza sativa
caaataaatctctggtgatcatggtccttagagtgaagtatattttatactacagtaacagctcaagtgtagtgaacaaccctcaactatctaaaccagttaacatatcccatgtaagataaaaaaaactggattaagtggtggtttcatggttttgacatcccgtaaatatactttttgactaatatggcaactattttttacattttctattaattgggtgcaatattatagagaacttatattaaagaaaaggttaaaatggggctggatttcccttgggggtattttaaccggttatgttggttgtgcttgagggttgattttggaccaagatcataatgcctgctattgctatagtggtattcagtaatatcaagattgggaaatgtacccgcaccccggaccccggtacaggcataatggactagagtaaaaaggcagtagtagagaaataactgatcgtcatgtgtatatatacgaggcgattacccgaaagagaaaggaagggagcatagaatagaaattacctcgagatcgaagacggggtgttccaggtcatcctcagactccatatctgaaatccatccatccattcagtaaaaagattcaagtaaaaaggaagaaaaaatgacggctggtacatgaaaaggaagaggggcggaccgtggtcgtggagggggatcatgtcgcggtgcttgtggactggaaatacccacccacccacccaacacagatggataaagcgtgagatgctggaggtgaaagaggaaagaggagagagagggggtcaggtcaacgttgtcttacaggcgtcgatctcgtcgtcgtcggaggcggaggcggccatcaccggcggcttcacggtcgggggcctcttccacttccccttccccttctccttccccatgcgagcagaagcagagcggatgaggcggcggcgttgttgttgatttgtggggttttagggttttggagatgttgcggcggtgcaggagaggaggcggggcaacacccacatgggcttttctgcctcctcctattgggcttcacaggagaccactggcctggcccagtacgtgattatttctctctctttccatttttttatggaaaaagtgcacccaaggtccctcaacttgtcatcgaattacaaaatcgtcacccaaccacaaaaccggatatccggcgtcccccaactaaccaaaatcggtcataatagatccctcggcggttttaaccccggttttgtcctatgtggcgggtgactcaacgtgggacccacgtgggccccacatgtcaggctgccacatcagcacacgaaccttcttgtgcttggcgttgagctccttagagacggaggccttctcgttcctggctgcgctgcgcgccccccgaaatccctcgaccccaaatggaaactcctcccgaatccgaaggcaaaccaggcgccagaccaggattcaccgtctcggtgcccttcccccctctcctcctccct

SEQ ID NO: 6079 - DNA, 1501 bp, Oryza sativa
tgtactatgctaaaactagtactaatctactactataccccacgtcccaaaatataataaattttaccccctccatttactttttgatagttatattttcaaatctaaaaaaaatatttttgataggtatattttaattcttaatgactttttcggatttaatgcgtgactctccattcttccacacaagattggctatatggacatcgagaaatgtaaatattaatgaatcgtttgtttacgagaaatgactagtagtatgtttaaatagatgataagtagaattacttatccttgatctgtgtgccaagatgaaatatgactattaaaaatagatggagtgagtagcatttaagatttatcacaaaatataagaactttttcattaacattttttccccaaccaatcacaatcttctaccattcaatttattcacctttcctcacttctaaaccaatcataatatttctctattaaattacaagggcatctttgaatcgcagggttgaaaaaacggtggaataagaaaaacacagaattctgacaggaattgaagtgtaaaacaaaggtttgcaaaacacaaaaatgagattgtaccgcataaaaaacgtaggaatcagatgaaaaagattgactcaaaggaaatctacacggaatgtgttattccatatgaatttcatcggatttgaaaaactacaatattttaaattaaatggtcaaatagaaaacaatttataggatttaaatcctatgaaatttctaaataaatcctttgatttcatggagccataactttttcttcgcacctatatatattttgttggacagagatagtactattagctcgttgatcgatgccgttatccatgcatcttactcctgttcatccgtcgtcacacccaactctttgtgtcccaccagatcgggtgtatcgatcgatctatccgtgtagaaggggccggatatgtactactctgatcctgtaatctacttgagtatagttcaacgcacatcgcctcgtgcggatcaaatctgtgggcatgatcgatcttatgggcaatttggcaccctccgaatcccctgttctacacgtatctggtatacatccatccaaggcatcaattttagcgcacgttcccagtttcgccagtgcggcgccaagttgccagttgccctcgtcaaatcgccgaaaggctgcccatccgccacgtcccgatccaattttatccaaacaccccatgatatccgagagtccacgagagcgaggcataggtgtcgcatctaattttatccacgtaagataaaagacgacatgcatattatattacatctacactatctttaacatactaacccaatgattttattttatttgtttgatcactatactctttcttttttaagtttgtatgtatgctacttctttcaatctactcatatgctctttccttacttctcttcgtcacctcatcatccaatccaatcactataaaaattgat

SEQ ID NO: 6080 - DNA, 987 bp, Oryza sativa
tgtgtccagtcactatatttccattactcttattagaaaaaaaaaggcaaaatttactatagaacattgaaaaaacgtgtaattagctgagctgcatcgcaagatcgtgaaacggttgaaagacacttcaaaacacatgtaatttaatagtggacactatggagattaaaataatatatacacctagctgagaagagagaatttttacgatcttacggtatccattatctatttacgtacattttctttaatgttatatagcaaattttgtaaaaaaaaatgctcccaatacatatccaagtgtagaggcgccgtcagagaacttattaatattattattatttagaccttttattttttaaaagttttattagtaaacatttccaagaaaatatttttaaatctaaatcttttggccaccagcccgtctggcgtggccaaataactctgtcacgccacaccaaggtacgtcaccgtgactggcgttgccaaactagcgtgaacaaaaggttcagtttttaaaagtatttttttgaaaagttatattaataaaaataaaaaaaactaaaaaatacccgtcaaccggggcgaacctccatgtgcgaacgaaagcaatatatcggataaagccacacgatcatccgaagagttaccgctgccgccacggtgccaactgccacgccaacgcggcggccgccgatcgaaatcaacggaggccaaaggagagtggaggacacgagcgctcccggacacgcgtcgcctccccattggccgtggcgcaatccggacggaggccatcgcgcggctcgccggtccacgtggcgcttccccactggcccccaacttatccagtcagataaggttgcacaccaacacgtcctcctcaatatatttttttccgccacgcgctcgagactttgcttctttcatctgaagagagaaattctcagcttatagtcaggtgaggtctgagctgaggttgagaga

SEQ ID NO: 6081 - DNA, 203 bp, Oryza sativa
gggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 6082 - DNA, 1501 bp, Oryza sativa; identical to SEQ ID NO: 1946

SEQ ID NO: 6083 - DNA, 1501 bp, Oryza sativa
catttgctaatgatggattaattaggcttaataaattcgtctcgcagtttacaggcggattctataatttgttttgttattagtctatgtttaatacttcaaaagtgtatccatatatccgatgtgacacaccaaaactttacacccctggatctaaacacagccgacgattagttgatgtgcacacgcccatgtatatatgcatgctcaccaatgactttactcccgtgctgatgaattgaatactccctccctcacatgatataacaacctaataccagatggaacactttatattacaaagaattcgtgcatactttatgtctaaattcgttgtactataaaacatcccatccaattctaaatttatatattatgaggcaaagggattatatattatgtctttgactatagtattcactcgatcctaaatatgtgtttgggttgagaatgaggtgggataaattggacccatccatgtttttaggatgggatagtcacatctatccgtttggtacgagggatgtgatgatcctacttcttaagggatggccaacatatcagccagagaagaaaaaaagtggttagaatagtatgccagtttttgcggggcaaccgggcaaagccaatgcggatcttagggcaatattcctttctagagatcatccttatctcacatatatattgtcacaccctgaagttcttctcccgagcctaaattaattaataaatggtctcgagaaattacctgtgtaaaatcaagagaggaaccctaattgaagtaatgcaaataataatcgaaaatggcatgtgggatttttcttgagttctacatgtcaaaatatgctaacaggatttttagtggaattttcagagctctagaaataattcaaaccaattaaaatcgagcacaagcattattttaatccctgggaaatccttttcttttttctttccttttccccttcctttttccctaatgagctgccagcccatttcctcctccctcccgcgcccttgctgggccggccgaaggccacagcccagcagccggccgcgcctcctctctcacccggggtcgccgataggtggggcccacctgtcgggtcctcccccaaccttcggacgctgccgcatccgcagccgccgccccgcaaccgcccgctcccgcgcttcccgggccacgccgcccacgtcgccgtctcccccgcgcctcccgctcctccactaccaatcccgctcgctcgcgcccacgagatggccgggattcgaatttcgaatcccgcctctctctcctctcccactcccccacgtcaaccggcgattcccgcctctcctggccacgtccagacccctcctcccctatttaagcatcaccgcccctccctctccctttttccccatttcaccgagctctcccatgccctctaccgccctagagccgtgcacccgccgcagtcgccgccttagccaccttcggctgccgctcgccgccgctaga

SEQ ID NO: 6084 - DNA, 1501 bp, Oryza sativa
accatacctaattcctgtttgtatgccccctcctacaagagggatggcaaccagaggcggagttaggattatgtgaagagtagggcctaatcattagagtatgaacttcttgaacgaattttaataggaaaattagtaaattccttggtattttttttgccaggtgtggggcccaagcccaagctgccccacacctggctccgcccctgatggcaactatgtattccccccagactataaggggagggctaaagccattgtaaacggggatcacattctgaaaatctactaagttcagaaactctcatcatctctagaatagataaacccaattctttataaacattgcaacaagggatctagacaaacacataggagtagggtgttacggttctgagtggcccaaacctgtataagcccctcgactcttgattgattcccaaactcttttgtaaacattgcagtaatggatctagtcaaacccacaggagtagggtattactcttccgagcggctagagcctgtataaacccctggactcttgtttgattctcgcgttcctaacctcagatccacacactagcactttgtccgaatcacaaaggagtgcctttcctccccgccagaggagctcgggctccgacaagtatgatacaaccttgatcaaataaagagccattagtttggttcttaaacctaagtggattggaacaaccatatcgattaataaacattagcaaaccaaatattgggagaatgaaaaaaaggtaagagagaaggcattgagagagtagagagctaccaataagaccaagtgtatatgcgaaaggggttgtactctaggcattagttacggtgctcaagtagcacctccaactctccaagggagcgaattccaatcttaaataaaagaaaaaaaatattatggggtttccctcgctgtttccaataaaaagaaaaagaccaatgtgttatcatctagaatgatgtttccattatactcagtttaaataatatgtagtccgttgcatgaatgataattattgtcaataatgaatttcaggcttaaataaaagaaaacaaatattgtggggtctccctcgccttttccggtaaaaaaaagagaccaatccgttagcatcttgaaagagtacctcagcactagtgccgcaaccgttgaatattctctagaatggcacaattgcttacctgtatcggtgactgactgagtgtgcataagggaaaatgatgataaccacagcacatcggcctcggccacaataggttgtgctgatcaagcgaaatgggtagctccaaaatgaaaagcaaatcctatcaaatgcatgggccatttattccatgatagaacttgatgaattatttttaatgtaattcctcaaaatgttattgaaagatattggaaggtagtaaggtggtgtttacatccagggacttaacttaagtccctgtctttagacactaatttagactattaaatata

SEQ ID NO: 6085 - DNA, 1501 bp, Oryza sativa
acggcggcggagcgtggtggatggggccccagcacctcgagatattggtggacgaatgtgacgagcctgtcgccgacggaggcatacacgggtggacagatgatggatctgctcttagggggagggtacaccgccatctcgagggtccgggtgtcgaacacagggatgccagggctgaagctggcgggatgcatggcaatgatcttggtgccgtgggcagcgaagaaccttgagtaggcgtgctgcgcctggatgcggatgagcgggttgtgcttggcggcggcggcggcagggcgggcgccgaagtcgtcgtcgacaaccttgtggatgctgtatcctgcctcccagtcgtccagcaccaggtacaggtgccgctgcttgtggttgtggttgtgagagctgaagggaaccaaacccagcttcaggctcttcttcttcgtactgctgttgctgctgcaatggcgttcgtcttcctcctctgactctctgcacgccctcttcttcgtgttcgtgctgctgctgcaatggcgttcgtcttcgtcatctgactctctgcatagcctcttggacgacattattatttctgatgacatttgcttcctctcgatctggatctgcccctccctcccttcactctttttgtatctgcacagcgacaacctcaaggtttaacatgagctggggaaagcctacatccaatttgctggatatataaagcctaaactaaaaaaactccgtctaagaatcggaatcgaatcggaatacgcaccgctaatccgtttacgaaccggagactgatttgattccgaataccttaaacaaaaaagaaacttttgtcccccacaggcaatgctctactagaagagagaaacaagggttaacgcgagcaaatgtgcgtgtgagagagaaatagagatgagaaagaggattggacgctcaccagaaatggatgcgatacggcgggaataggtggacgaacaccagcggcctccggcgcggcgaaggcgggatggatgggatgggatggggatcggcggcgcttggggccgcagtcgaaggtctcgaggagacggggaaatgtatccttaggttgaggactgaggagacatcaagacgattcctcttcctgcatatgggccgggccgtcctgttacgaatacccttttggcccatttactagcacaagattttggaaaaggtacaccgaaggcccctcaacttgtcatctgagttacaaaatcatcatccaaccacaaacccagatatagagccttccctcaacttacaaaaaccattcactttatgttctttgatggtttcgaacccggtttcgtcctatgtgatggctgagtcagcgtgggacccacgtatgtccgcgtggccacgtcagcaccctctctcttcctcctctctctctcactcttctcggcaagtcgggcggcagctggggcggaggccatcaaggcaaggcaggaaaggaggaggcgacggcggcggcctg

SEQ ID NO: 6086 - DNA, 595 bp, Oryza sativa
ttcattctccttaaaacctttaaaaattggagcttctagtttttagactttattgtctcgttgggtttcgtttttataatttctagaagtctcgtcaaacgctgccattatactcctctacgacacgtccactgtattttctctttattgtcattggcattttaaaaatcgaacataattatcgttcttttacttgttagaagtcccgccaaactgtcagtggccctttgcaattgtactcttttatggctcgcccgctgccttctttctttattgtcattgagattttaaaatcgaacatgattatcattgggtttattttttactttttagaagttctgaacatttaaaaattggactttgtagtttttagagtttactgtcttgttgggttttattttttagaaatcctgttaaacgatgccactatactcctatacggcccatccactgcctactctttattgtcattgggattctaaatctttattttctataagtcccgccaaccgtcgtcggctctgcaactatactcctatacaccccgcccgttgtttttcctttttattgtcattgagattttaaaaatcgaata

SEQ ID NO: 6087 - DNA, 1501 bp, Oryza sativa
gatcgtgatccacatcaaccatttcaccgcccaatggagaaggtataaacatgtcatgctcatcttcatcttcttgattatgtgcaccacttctgtctgctgctgctccacttcctgattcttgctctccatgcttcacccaacatgtatagccctccataaatcctcgttgtatcagatgaccgtgtacgtcctctccgctatcaaacatattctcattcttgcaatctgcacatggacaacacatgtaatcactgttttttcttattcgatcctcctccgcggtgttcataaaatttattacgccctttctgtactccgtagaatgacgtttcaaatttttcgcatacatccaacttcgatcaattgctacaaaataaaaaaaaacaaattagaggcacatattataagatcattattgcaaaagtaagacgtgatgaaattgctcaattaatgattaatattactcacttgattgatccattttgatcacctacaggaatttaatttctgttttccttggaaaaagggcaaaaaatcgccccctacagcctcccaccaaaatagtgagcagtgggatacaattacactaggtagtggggggtatttatactgtgcaacaaatatctataacggccctaaaacaatcaaccgtgacgggcatacaagtaatctctatcgggccttaataaaaggccgtcaaaaaaaagtgttatctgtgacgggcactacacttatctcaatcgggcctctagttggagcccgtcacagataaccctcatctgtgacgggcttattttagggcccgattgagatatggaaccctcatctcaatcgggcctcaactatagcccgtcacagataagtgtcatccgtgacgggttttatttttatgccgatataccatgcctgtgcgaccatatctcaatcgggcgaaacttcggcccgattgaaattacttccttgtgacggcccacaaattccagtcttgttatgggccgtcacagatggaaggatctgtactagtgactgtacctgtcagcaacacgaagctagttataatgagttgtgttatccaacaacatcagtgggttggggtttcgtccacgaatccatcaatgctaatatgctgtgcatatagtgcacgaaacaggtacatcaaggaaaagctagcaggtacttagttttaagatcaaagtttctcgaaatgaaaataattaaactatatattggatgccatgaaggtgtacaagcatatatatgtactcaacattatttgacttgtatataggcatgctatcactggagttttctataatataggaaatcttgacttaccagagttggtagagagaaagtagctagagttgatcaagctgctcctgttgttgggactgatggggagggtgcctttatataaatcctgaaagtgtgtattccggaagcataacattagcatggctggagccaattgtagaccatattggataacgatcagatg

SEQ ID NO: 6088 - DNA, 1501 bp, Oryza sativa
ctcatgaaattacatacagaaattcttgtatattttattttagttacatatataagacatatacgcgcatactccacccagatacatctctctaataacacatgcttaaaagatacgaaaaccagcaactcactatgggaatgtctagatcgactttaaacgtctgaaatcacttttctatttcattgtgtgataatgtaatatttctcacaaccatttactattaaacaaagttccttcttttcaaaatggctcaacaataaattattctagctaacaacaaaaatcataatatatatatcataaaaaatatctagtatcacttatttgcttatttgttattcactcgtttgaatcaaatgttagagtactctatgatattaaaagatattgtgggacaatttgtacaagcggcaaaagcaatagtgggacggtagattggctgtcatcgtcactacataatttcaaaggagtacagaaagggtagcatagatatttaaaatcgaggaaatacgaatggctgattattttagacgtgtttaggggtgaatttggattgatttagatgttgatggtgtgaataaccccaagttgcagggatggcaatggggccccgttccccgtcacccggtggggaattcctctactagggtgccaaaacaggagagaaataatccccatggggatgttaacgggcgaaattcatacccatcgggtgagcggggatggggacccggtaactgcctgcctgtcatgtgggtcctatctttctcacacacatatagcctgtgtgtacgtctatttcttcaagcaaggagactagctagctagttactccacatctgtatctgtacgcatgcaaagtaaactagtcctatttatttgtaaatcgtgtgtctcgttctcgtcgatctccatcctagcactgtgatagctcatgcttggattgagggattgattgatttcttctctgaactttttgtgattgagcccactgtaactgtagcgattaccgggggtattatgggccgtgggtacccgcgcggggccggggacgggacgggagacccaatcataaattggaggcgccggccatctctcctctagacctcctgactctaataaatctcctccattcccccaaatccatccatcatggagttccctcatcgccaccaccaccacggccaccgcggcgacgacgacgacgacgatcgccgccgccatcccgctcccgctcccgcctacggccacgactcagcccctccgccgggtccctacggccaagcgcctcctccggctgatccctacgctcgccacccgccttcccacgactacgctcatcctcctccggcgtatgggggagggggctacggcaacgtcgtccacgtttcccacgaggtctccgaccaccagaggcccacgccgcactacggtggatccgagtacatcagccccgtccaagagacccgcccttaccacggtggcggaggagccccac

SEQ ID NO: 6089 - DNA, 380 bp, Oryza sativa
tttctgtgtctttggaaaaatagaacctacggaatgtcttgtactgctttaattaattgtattcttttactatatgcgtaacttttgtgtactgtaaagcagttgcctttaattagttttgctacgagtccttaatttgagtgtgttaggacgatcaacatagtgttatatatagtaacatatcaataattttcaatgttatttgctttcatttccaaactttgttgccacaatcatttattattctaaagaacaagcgatcattaaccccatccgacgcgctaggctgatcatgcactgtcattgatgtaactgcatcgtcactatatcttgtgtctgccacccccttgtcatcacgttttgtcaccgttgtcggtagc

SEQ ID NO: 6090 - DNA, 1501 bp, Oryza sativa
gaagtcatctttgccggctcgtggttcatgtcggaaggacaaggtttggccgtatcagaatccttcccgagcttggatgtcgtcgatgatccattctccatttcgacgggtggatttttcgacatggagtcgccttggtttgtagccactgcgttctcgttttcggtcattggaggaccggttgagatcggcgtcgtggtgtaaaccgggaagacgatttcgccgacttgagtccataccagcattgttgaagcagggagcgcttggctgaggctggtgttgacattgttgtcgacaaagctggatgacatagtagtagaaccatgagtaccaagcccccctacctggcgcgccactgtcgacgggtgatacccgtagaccggatatagagggtattggggtacgttggtacaaggatctagtacgacatcgaacaatcaaaagacaagaattatactggttcaggccccttagtaggtaatagccctaatccagttgatatgggattatatggtggaaaacatagattacaaagggaacgatggaacttgtcggatccggcgagatcgtagtcgagtggattcgactagctctcgatgacttggctcctcgcagacttcggcttcgtaggctgtgtgggttgtgttggctctgagattcgatgatctatgccctccccggggggtcccttttatatcacagatctggaggtctccaagtaggactcggagatatcagacccaatatgatacgtcgacgacccagttctgtccgagaaggactcttcccatctgtagatttcgtgaaaggtttccttaggatatgtaggaaatatctgcgtgcgcgtaggtatgccatgtcgatatgtaacgtatatcgaagggtagagggtatgcctgacccgtaaccctgacaccctccattccaaattgatctacatatttcattggtacactaagaccaagaaaaactaataactctctcatactatatttactctagcaacaaactcaatgtatgtacgatccccactatttcctagccaatagaaaaatcaagatattgcatgtgggttataaatacttgtgtgcatggatgcatgcatcaatgtctatttactccaatgcacaatgaatgaacacaaatatgtacatcatttaggaataaccaaaaaaatatatgtagatcaatttggaatggagggagtagcatatttaaatggatgtttagaagaattacttatctttagtcattgtgccaagatgaaatatgactatgaaaagtagatgaagagagtattatggttcatgttttctgctacatcttgtctttctcgaagaaacctcactaaaatcttaggacctcatccttgtctgccaatcggcctcgtctcgtcgccttcaccgctctccgccgttcgcgaccactctcgtcgccttcttcctcgtaactgacagttactctgaattgatcttggttgcacttgcacgaacacccacca

SEQ ID NO: 6091 - DNA, 1501 bp, Oryza sativa
attaacagagatctcaagacagtattatgtatgattttgactgaatcgacggggaccacacgggcctcacatatcagctaccaattttttcttcctccttcctccacctctctttctctctcttttccatctttgggtgatggcttacaaggaaaagggcagcgcacaagcaatcggcgggagaggagctaggtggtggcgatggtgtcgagccgagcatcccgcagcgcgacttgtacaacgcacttgccgagcaactgtgcgtcctttcgctctagcccgctgtcggtgaaggcgtcatcctggttctcctcctctagataggggagagagagtaataaggaagaatatattgttttcactgacacgtgggtttcatagggtttaattttgtatttttgtttctagtgccacgtgagtcataaccacccttgatactgtcttgggacttcgtttaacctggttttataagattaggaatttgttatatctggtactgtggttcgaggatgtaatccaaactcgacgtcaagatgagagatctaaagtgaacttattcctttcttagatgactgactttaggctggagaagacatgagcaagaatggaaattaattaaagtcgaaataagaacaagaatcaaaatcaaaatcgaatgcactaatggtgtggcagagtcatgagtgggtggcatcaccagccatagtttaaatcctggtgcccactaatattacacacatacacatagtctttcggcgggtttctagtgttatcaaagatatactgctgctttttttttgtctcgtgttaggagacatattccttggtgtgtgtaatagtgtgtgggcgtgggtgcctaccgtgtaattagaaaaagggaaaaaagattcaaaatcgaatgcaatcaggtgggaaaaaaattctctgcggcagtgccgcacgagtgcacgacaccacccatgcgacaccgagcagactagtgacgcgtgtccaatattcctactgtagccgagtctagcttcggagccgagccgatgtccgatctcctaccccacacctctgtccacttgatcgttgaaaaagccaccgagcagcatctaccagctgcacataaagtctgaataatttcactttttaatagggcattttttatgcaagcattggtgataatatttctggggatttttctagggtcaagtggacagaggtgtcttgccatcacgagatttaaattatcaaccatttccaccgttttggagatttaaattcagatattagtgttaacatctaaatttgacaaatagaacgggaatagaaaagtatgatcgaatttgaaaagacccggctggtctaacttctttttaaatatcgcatctactttttaccaagttttagtctagttttatccatcttcgtcggtttgccttgtaagtcgtccggtctgtcccaaaaaccttccgttctattcacgagacggatgtttatcctatttcgtattagg

SEQ ID NO: 6092 - DNA, 1501 bp, Oryza sativa
actcctcagctcttggttgaataactcactagattctataaatggcaatgacaagaagggagaatactattggagggatgttgctgcagagttcaatggtaatgcatctagcaataaccgcaaaaggacagtcgtgcaatgcaagacacattggggtggtgttaagaaggacattgcaaaattttgtggagcttattctcgagctagaagaacctggagcagtggattctctgatgatatgatcatggagaaagcccatgcattatataaatcagaaaacaatgataaaacttttacattagagtatatgtggagagaattaaaggatcaaccaaaatggcaacggatacttgaagaggacagcaagaacaagaggactaagatttctgaatctggtgcatatacatcatcatccaaccaagaaactgaggaggagaccagccgaaaagagaagcgtcctgaagggcagaaaaaagccaaagccaagcttaaagggaaaggaaaaaaacctgcaccgtctcctttgggggaccagccatctcaagattttgttctcttcaacgaagctgtaaaattgagagcagaagcagtgctgaaatctgcagaagcaaccaccaaatcagcggaagcaaagaaggaacaaactaggatggagaagtatcagacatatttaaagttgttggacaaagacactgccaattttagtgatgcaaaactcaagaggcatgaagctgtcctcgaaaagctagctacagaacttgcagaagaatagaagatccctaagttatgtttgtacccctagtacttagtgtgtcactgtttcattaagtttaacttgctagtaatatttagacttgtgataggtttgtagggcaagtaattgttgtattgtgaactcagtgaatgatgaatgtaatatttcactagtgagaaggcatatgaagtgataatatttgcccacaatcataatatgtctgaaccttctgctctgtagtctctgatttgtcccataacaacagcaatttgttcttaagcagcctgcagaaaaatatacattgataataattagcacaacattttataatatggtggtttgaatagatagaaaaggaaggtatggttgtttaaaatctagctgttagaatacatccaaaaagcaagacatggttgtttaaaatctagctgttggaatacatccaaaaagcaagacacagttgtctaaaatttagctgttggaatacatccaaaaagaaagacatggctgttcagaatctagctgttggaaactagccgttgcaatggaagcaaaagcaaggcatcaatgttacacatagctagcaggatgaaccatatataaataagacatgcacatcacgaaggcagcattccccttcctttccttcaacttcttaccaacataacaacccatctccaaaaaagatgtccactgagtcacaagataattctagtcattccgatgagtccatcactagtgagaagc

SEQ ID NO: 6093 - DNA, 1501 bp, Oryza sativa
taggaatgttgctagtatgttcggcaattggctaaagggggttcaacccaagctaagagctcaaatcgttgtggggatttcagctttgtgttgggcggtttggttatgccggaatgatgtagtctttaatggctccaatactaattttctgttgcaggtgattttcagggggactttttaggcaagacaatggtctttgctacttaaggaggaagatggccaaaaagtgagagaaggttgcttgatcctagagatgagagtttctagctttttcgcaatgaagggatggaacttaaggaaaagattgggagattaatgttctcttgttcttgtgtggtatggttgaaactttgtattaactttttaagaattgctgttgctagagcctaagtgctcgggtctagttgcttgtgatggtgttaaaccttgtgtaagggtgtgagtctatgtactcttgtgagttttgttggggctgtgtacatccttttttgggtgtagaggccggtttaatccattatctaaaaaaaatgtgtgtggattatgctgcattggtattcttataaattgcttgtcttgtatgcccataagaaggctctatcaaaatctttgataaattttgtagtaggccttttttgtgtgtgttttaatggcacttgaggaatataaatacatgtttttgacaaagtaaacataacttctgacatttacacacaccaactaaaggtacacacaaccatatatgtgaaaataaggatttaaatcttggtgtgcaaagtcatacacccacgacgttgtgcagctcatagattccatctcatcttccaccaccctccacccataaaactgagatgagcatcctccctctctctatatatgctacctcaacttgcatactgccttctatcctcctaatttatgcaaagaaaaacgattaatttaaacaactaatgcaccaaggaattcacaaattatatgacgtttggattgtcctaccaaagtatgtaaagaatttccaaccacaagcctcgagtgtgtgtggtgggtgtacatacatggcttcaacatgtggacaggtgtcattcttcatactacaagaatccataattttgttggcgcccaaaataaaagcgccaagaaaaactttccacattgttagccgccaataaaatggactttcccttgccctctagacttggtgggtattccttgttggttggctggcaaagcttattactttggtagttttatgtttttcttggtggtttgtgcccctgaagaaatatatatcttgattcttgtcatgaggttcatgacaggaagaaagaacaaagtggaaaaaagttctagcgcaaatggatgcaaaggaaaaacaaggattcaataggaaacaaatacaccattcccatccatcccactttaaccgaagtcttattcataccattttccatccatctcactttaaccgaagtcttatcaaaacaatacctattcattcatcttc

SEQ ID NO: 6094 - DNA, 1501 bp, Oryza sativa
aagccatggcagccatggaagaagaagggacgggaagaggaacgccattttaatttcttggtgatcgtttcactactctcgatctgaccagcagacaatgccatgcactgtttgtatatatctgcgccctcccgtgggtggaggttcctctgtcgctcgatcgtcaacttgtcattcgccatcctaatacttgttcgttcccaatatttttgaggtattaagaaagtatgttaagatgattattgaaagaagtgtgtgattggttgaaaagaaaaagtaggtcaaagagaatagtcaatagagacgcctatccgttggctaaatgctgaaatatgtcatacgttgtattagcaaaacaaaaaatatttgcgaataaaaattgtatatatatatgtcttagtgatttaaatatcacagtaaaaaataaactttgatgaaaaaacttgaaagttataaaattttagttttttacagtgaccgaaaaattttagttttttacagtgaccgattctatatagtggaaatgacggggcaagagtatatactccctccattaaaatatataataacatacaattggattagacatatctttgtattataaatctggatatggacatcgagattggtagtattagaatgtgtctaatttgatcctagattattatatgagttttaaaacagagaaactaagtcttaacaaacttaaagtcttcgttattgcacttcaacggttaattcgctaattaatttgcttcaaaatatattacaaagtactataaaaaattaacaccataaggaagtagtttcatagcatgaggccaaatacattgttattttgaagtgagcatactggttaggtttttttggtggaactattttactcgggtaaaaatcctacatttgacacgggtgctcgtatttacggctaattattttttcagtagtaggtgacgtacacgccaacagcgagactcctgtggtgactttgccaatttcaagatatgcatgtttcaatttttcgttttcagtgtttgtatcgggcggtgctgatatggcgaaattttcgaaatttggaacaaaatttagttaaatttgaacacatattaccaaaattcacaaaaaattaaaaatattgaaaatttcagccaaaataatatcgtataggagtgggtccaaaatgaccgaaatttctgatttcagtctgaaatgtcagaccctgaagatatgtcagcccaatcttccagatgtgctcgtaggggtagggtatacgtgcgcgtccatatgggtaagatacattgttattttatttatttttaaaaatttacaaatattatgttttcaaaaatacggacgccttctatttatttttggaaggaaggaaattaatctccctctaccctaacgctcgggccgtctcctcctcttccaaactcccaattacctttttcctcctcctccgccgcttctcctcctcctcgtcttctcaggctcccctccg

SEQ ID NO: 6095 - DNA, 449 bp, Oryza sativa
attgcgagcaaattaataagcaccactcaaatttcggttttggaacattacgatattcttcatcgacgtgtgcattacatgtatatatatattcccacgcatatatacacacatagataatatatataatattttttagaggatctaacatgtataaatttatatatatatatatatatatatatatatatatatatatatatatatatatatatatatatatatatatatataccatgataataaacctacgtgtcacactgctctcgatatgatgcatgtatacatgcaattattcacgcatatatgcatgcatgcatgtagccaaccatattacgtgggagagcatatacctcttcatgatttggtaaaaaatgtatatgccctcatttatgagtgataaactttgccattatctaataatacttaaaagtcgaaaattccatcca

SEQ ID NO: 6096 - DNA, 483 bp, Oryza sativa
cccagtcagcgaataaaataaaaaattccctgggtcccacctgtcattccctaggggttatctctcgcgcacaggccacccactataaatggccaaaaggcccgaggcccgaaggcccggcccacggcacgaccttttggcccggcccaagcatagcacggcccgactgggtcgagcccgtgctagcccagcccgaccgccgtgccgtgcttgggcctccccaccggcatgctgggctggcctggcacgatcaggccggcccggcacgatgggccggcaggctaggcccggcacacaaagtatagggactaaaaatagacatataaatgtcatggtccaaagaaaagggacctaaaatagacttattttatctatttatatcacaacccaaagaagagggaggttaaatagactttttgagctatatatgtcacagcccaagaggagggaggaaaattagacttattctgagaaaaagcacga

SEQ ID NO: 6097 - DNA, 1501 bp, Oryza sativa
gacggcgaggctgtagttgtcctccccggccttgcagtagatcctgtgggtcaccggtggggctcctccgccaccgtggtaagggcgggtctcttggacggggctgatgtactcggatccaccgtagtgcggcgtgggcctctggtggtcggagacctcgtgggaaacgtggacgacgttgccgtagccccctcccccatacgccggaggaggatgagcgtagtcgtgggaaggcgggtggcgagcgtagggatcagccggaggaggcgcttggccgtagggacccggcggaggggctgagtcgtggccgtaggcgggagcgggagcgggatggcggcggcgatcgtcgtcgtcgtcgtcgccgcggtggccgtggtggtggtggcgatgagggaactccatgatggatggatttgggggaatggaggagatttattagagtcaggaggtctagaggagagatggccggcgcctccaatttatgattgggtctcccgtcccgtccccggccccgcgcgggtacccacggcccataatacccccggtaatcgctacagttacagtgggctcaatcacaaaaagttcagagaagaaatcaatcaatccctcaatccaagcatgagctatcacagtgctaggatggagatcgacgagaacgagacacacgatttacaaataaataggactagtttactttgcatgcgtacagatacagatgtggagtaactagctagctagtctccttgcttgaagaaatagacgtacacacaggctatatgtgtgtgagaaagataggacccacatgacaggcaggcagttaccgggtccccatccccgctcacccgatgggtatgaatttcgcccgttaacatccccatggggattatttctctcctgttttggcaccctagtagaggaattccccaccgggtgacggggaacggggccccattgccatccctgcaacttggggttattcacaccatcaacatctaaatcaatccaaattcacccctaaacacgtctaaaataatcagccattcgtatttcctcgattttaaatatctatgctaccctttctgtactcctttgaaattatgtagtgacgatgacagccaatctaccgtcccactattgcttttgccgcttgtacaaattgtcccacaatatcttttaatatcatagagtactctaacatttgattcaaacgagtgaataacaaataagcaaataagtgatactagatattttttatgatatatatattatgatttttgttgttagctagaataatttattgttgagccattttgaaaagaaggaactttgtttaatagtaaatggttgtgagaaatattacattatcacacaatgaaatagaaaagtgatttcagacgtttaaagtcgatctagacattcccatagtgagttgctggttttcgtatcttttaagcatgtgttattagagagatgtatctgggtggagtatgcgcgtatatgt

SEQ ID NO: 6098 - DNA, 212 bp, Oryza sativa
  unsure (1)..(212): unsure at all n locations
cgtgacgtcctagatcgctcngnccntncnaannnnnnntntgnncccctaaactttgggaattttctcatcacctggacactatggaatggtttgattattgtggaattgaattcaccccgccccctctattcaaaatccccaaaatggttttaggctgggctcggggtgcatggttttgatagtagcacctcggccatataaggaccggt

SEQ ID NO: 6099 - DNA, 619 bp, Oryza sativa
  unsure (1)..(619): unsure at all n locations
agatgcgatgcgatcntcatngacnnnncnaannnagntcggaccactttctagcattatccacattactatagatgctaatgaatctagacacatatatagaactaacgtcttacgttgtgaaatggaggaagtatatgattttattaaaatattttttaagactaatctatacacgtagtcactatatttgaatgaaaaatattttagaaatgattcataattaaagattctaaaatttaacctcactcttgtatagaacgacaagtattatcggcccagagaaaatatactatggattctattccaataataaatatataccaatctataaatatattctataccacatacaatccagagttctagactcgccataattagtatttaaaagtggtgctcataggggtagggtttgctgtgtgccttcatagggttgagtctacgtgtgttgtgagtgattgcgttgtactgcgtaaattttttaaaaaaaattaaagaagagttgtgctgcgtttcagacctctacttatagcgcagtagtgccatcatcccattccgaaggaaaaggaagaccgaaaaaaaaaaaaacattagtgccctcactgcattacagcaa

SEQ ID NO: 6100 - DNA, 1501 bp, Oryza sativa
aaatggttgataatttaaatctcgtgatggcaagacacctctgtccacttgaccctagaaaaatccccagaaatattatcaccaatgcttgcataaaaaatgccctattaaaaagtgaaattattcagactttatgtgcagctggtagatgctgctcggtggctttttcaacgatcaagtggacagaggtgtggggtaggagatcggacatcggctcggctccgaagctagactcggctacagtaggaatattggacacgcgtcactagtctgctcggtgtcgcatgggtggtgtcgtgcactcgtgcggcactgccgcagagaatttttttcccacctgattgcattcgattttgaatcttttttccctttttctaattacacggtaggcacccacgcccacacactattacacacaccaaggaatatgtctcctaacacgagacaaaaaaaaagcagcagtatatctttgataacactagaaacccgccgaaagactatgtgtatgtgtgtaatattagtgggcaccaggatttaaactatggctggtgatgccacccactcatgactctgccacaccattagtgcattcgattttgattttgattcttgttcttatttcgactttaattaatttccattcttgctcatgtcttctccagcctaaagtcagtcatctaagaaaggaataagttcactttagatctctcatcttgacgtcgagtttggattacatcctcgaaccacagtaccagatataacaaattcctaatcttataaaaccaggttaaacgaagtcccaagacagtatcaagggtggttatgactcacgtggcactagaaacaaaaatacaaaattaaaccctatgaaacccacgtgtcagtgaaaacaatatattcttccttattactctctctcccctatctagaggaggagaaccaggatgacgccttcaccgacagcgggctagagcgaaaggacgcacagttgctcggcaagtgcgttgtacaagtcgcgctgcgggatgctcggctcgacaccatcgccaccacctagctcctctcccgccgattgcttgtgcgctgcccttttccttgtaagccatcacccaaagatggaaaagagagagaaagagaggtggaggaaggaggaagaaaaaattggtagctgatatgtgaggcccgtgtggtccccgtcgattcagtcaaaatcatacataatactgtcttgagatctctgttaatttagttttgtaaattagagaatgcgttacatctcatattatggttcgaggatgtaaaccaacctcgatgttaagatgagggacctacattgaacttaatcctctgatacatgatctatgtagcgtgtaaaggccaggccggcccactattcgttcatattggcccaggacgtaatacatggagtattcttcattgtcgtctctcgcgtcgcggcattcacttggcccatataagtaaatggagtatacggtgttac

SEQ ID NO: 6101 - DNA, 1501 bp, Oryza sativa
attgttttgttttgttttgttttattttagtttgttgtttaaattaacaaagtgtttatcaatcctgttgcaatgcatagatattttttttactaactatatataaacttgtaaggaaaattttagtaaataagtcaccgcttagacactaactatatataaacttgtaaggaaaatttaagtagtaaataagtcaccgccgacgggccaacaccacggcggcgaggatgctcgccaacttcgccgccctccccatttcaccgacggcggcgctgagatggaagaagtttggggtggtgatgtttattaaatatttttgatatgtttttttcttttgaattgatatgagattgtgtgagaaagggggtggaattattgggatggaattgatttcctcaaattctaaggcatcttaagatgatgatcatgtagtttgtttaaaatatctctaatagcatactggaaccaacattccaaaattgatctgtcatattgtcatacaaaacatcatgggcattcatgggcttgctacacatcaccgctaagaaatggtccgtcatattgtcatacaaagcatcagggcattcatgggcttgctaaacatcaccactaggaaatggtgaacaaactccacaatatcataaaacgtgtccagccaatcaccaagcaagcatctgtttatattttctatttgtagaacaaagagaagtcgaagtggtcgcaggcacaacagcgggcggcgaagtagcaggtggcaaggtggcttagctacacagggtggcacgggcgaaaccctagccgccgccgcccctcctcctccatcctccgtgcctcgccgctgccggagctcgtcgccggcaaagccgggtgacgcgctgggatggcggcggcggggccattctcctcggctccatctcgcccggtgagggcgtggcgacgatggcggcgggacgacgaggtcgcggcgacggggatggcgcggcgacggcgctgcggtagggctcttcacggcgacggcggcggggctctccgcggcggtcggctccggctctggctccagcgacgggtgacggagttgccagatccggttgcccctctccggggtggccggatctggccggaggcggcggcggctagcggcgagcaaggccacggcggcggaggcggtgggggtcgacgcgcggggagacgcggctggaggccggcgtgtgtgctggccgcggacggtgaggaggctgcggaggccggcgcacgaggaggccgcagtgccgcagcgaaggctcggccgaggagcgttctccggtgccggctgccgcacacctggcaggggggtggctggcggtggcgatggtggtggatgtggctgcgacgaagttcgcgacgacggcggcggactgcggcgcgtgccgcgacgccggtgaccgtgtcaagaacctcgccgccacgagggaggcgtggcgccctcgttaatgctccggccatgaacgccgtgcccgtgaaa

SEQ ID NO: 6102 - DNA, 1501 bp, Oryza sativa
aataactcattgcacagatttcaattggcaactaaacgttgaagtttctaggataaaatttaggggaaaacttactgccaacatatgggaatttgcctgtgcaatctgccagttagcgagccacaacttctggcccattcccgctcaactctatgatcttgctgcatgcaccaaaacaaagcaaaaatataatcaaaccaagagcacatagcatcaaaagcccctgccactcaaagcctcaacagaagggatgaactgatgcagggaatcaagtacagggacgtactccctctcctcaaggagctccataggttccgagttctcctggaattggcacaaaatttagaaaaaatatcaccattaaattagtagcaatctcatgaggagatcgagattaacagagagagataggatcttgccctgaccagctgcacgattccctccttgcccgtatccgctccacacaccggtccgtcatggtccatgggtgtacctcctcattacagccccgcccttggatatcgagctcatgccgttcgcggccatcctccccggtgcagtggcggcggtcgcctccgcctccactgctagcagttctaggatggcgacctggtggggagcaaagatggcggcctccatggtggctcgtctcaatggaggaggtgcaatggcatccgtaacccgcagtgccggagcggggtagggtttggggagtggtgcggcggtgataggcgaggggcaggggcgtgccggcggcggggtagggtttggggattgggtgcggcgacggttggcgaggggcaggggcaagaatcgcggcagtgatgggtgaggggaacggacgagaatagcggagcgcgagagagaagggtgtttacacccaaatttggcacctagagataaaataggaaaaattgccaaagtttggaagtctgccggttttctccgagtgggccggtctgaccactgtgtgttgagcggtcataccgccggttgagggccggtcagaccggcggcatgtggccggtctgaccagcaggtccgagtccgaatgtgtttcgtcgggtctcaaggtttccttgctcgggaaggcacgtttcgggtttcctttggtttctaccccgagttagacgtggaggagggcctgtagagggcaagaccaacccctatataagggacatggccggttcaattgtaactaatcaatctacaatcaaccaatcgaatcgtttttcatattgcttttagttttctcttagtttgtccatctttgtcgatttgcgctgtaaatcgtccaccgccgctgcgagagtgcaacatctctttgtaggtttgtcatgaaaaccttccgttttcccacgagacgggtagttatctagaaatcggctccgctagcccgtttagttatcaaaacccatgttggtctagtttttgctagatcgaggtggttggcgactctaagatcaccgcaaggcgtaaggtgctgcgatcgtgcttgtca

SEQ ID NO: 6103 - DNA, 1501 bp, Oryza sativa
tcatgaaccacagtgcagtatacatgacaaaaccaataaacatttgaactaaaattgacacagctacagtcaacaggtatactaagcccctctctcaccttttccttttgttttccttattgcaacctttgcttaggatctgtctagaccagatcaagagagcaacctagattaatttaacagaaaaacatcccacaactgatgtaacagaaagaataggcaagcagataatccatcattgataaatgtctgaaatcaccatgttcaacctgcaaaagaaattttgtcaacaagaatcggagatttctgaaattaattaccacactggccatcaaagccaagtagagattgctaaataaaccagccaccgccaagttgtgtttctgcttctgcaaagtatatatgccaagtaacgcttctgcttctgcaaagtagaggattccttcacaagtgattggtcagctttagggcctgtttcgtacagctccaactcctaaatttagcttcaagagttgggtctggcgtggagttgtggagcttcctaaacaacgctccacaactctagttcttttgtgagagagctccacccatctccactcccagttttggtggagctgaaactgtttggctgagctctggagctgtagctgtgccaaacaggccctaagggtcattccaaaagactggaatggtgtgtttgagaaagaaaacaaaggactgcaacggttacattttgcctaaattttcagattaaactgcaggttcattaatagagaaatcgttattgtaatttacatatagctgttgcaatctacagtctaaagtgagggttcacctgggtgggggcagatcctccaccacagccatgtcgcacaccccagctgtgttcaaagagaggaagcgatccgcgcagcctcgagccctctacggagtagggctttgactccacgctgctcctgccataatatccccaatgttccggcttgagaaaatggagacagtgagttgcagatcgagattatgtgtcatcacaatcatgcgagcaacagggtgcaggtgcagttgctggtggcctgtggttgatttccgacggtgtcaggagcagagaacggggaggggccagtaggtggagcagatgctggatcggcttggcctctctggcaggggcgacctcgacggaggaaccaatcggatcaacttggactcggcaacaggcgtgagaaaccggcgacgcgatggggtgcgatcggcggggcagaggttgcagcggcggagaaatcgcgatggagcagcggatgggcggagaaatcgcggtggagtgcacggcggcggcggcagatggggaatacctcggctccgtgggggtctggggaagacctcgcctccggttcagtgcgtggcggtgaaagaaagcgacgacctcgagggtagcggtggattgcggcggcggcggcggcggatggggacgacgtcggctcctgctgcggccagtcgcggcaga

SEQ ID NO: 6104 - DNA, 1501 bp, Oryza sativa
catggaggccgccatctttgctccccaccaggtcgccatcctagaactgctagcagtggaggcggaggcgaccgccgccactgcaccggggaggatggccgcgaacggcatgagctcgatatccaagggcggggctgtaatgaggaggtacacccatggaccatgacggaccggtgtgtggagcggatacgggcaaggagggaatcgtgcagctggtcagggcaagatcctatctctctctgttaatctcgatctcctcatgagattgctactaatttaatggtgatattttttctaaattttgtgccaattccaggagaactcggaacctatggagctccttgaggagagggagtacgtccctgtacttgattccctgcatcagttcatcccttctgttgaggctttgagtggcaggggcttttgatgctatgtgctcttggtttgattatatttttgctttgttttggtgcatgcagcaagatcatagagttgagcgggaatgggccagaagttgtggctcgctaactggcagattgcacaggcaaattcccatatgttggcagtaagttttcccctaaattttatcctagaaacttcaacgtttagttgccaattgaaatctgtgcaatgagttattattcgtttctcgcattttgctggtgaaacttgcttattgtctcttttttgttctgcaggagcgcaaccttgggagggatagagtcagatcatggctctctgatcattttgtaaatcttatggcatctttagcatgcagctgatttgtccccaattttttttccttgaagctaaaatcattgcaacatcagtttgcttgctcgagacctataataatagccaaaatatcataattggaggtttggagatgctcctatactggctggaaattcagctggtcacggctagtaagtttaattattttctattgtaatttgccatctccagattaccctgctccttgcaataaatcaatctccctatggtattagatttttttttctactcttccgtcaataaaaacgatggcacatgattggtggagctgtataggtgaacgacggcacacatgtgttcatacttcataccggcataggggcacattgcagaaaaaaaaaagagaagtagatctcaggttcaatcgccgctgcacccagggtctcacgcatcgatctgcatgcttatttgtagtcaaactaatgcagctccatggttctgatttgatttcatttgatttgctagtgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtcttggttaaggtttctatcttgtaatcctgccccccatcctatataaggtgggcaggaggccctctagggggcataga

SEQ ID NO: 6105 - DNA, 1501 bp, Oryza sativa
taacagaaaaatgaggagtggctaaactcaattagctctttagaaaaatgccttaaatatgacctactaaggccctatggatgaagattaaggaagggcatgcaaaacaaaaaaaaaatcgttagtgcatggttaattggcttttaattatagtaaagctgaaaatagatttatttgatatttttgagcaactgctataaagaaatttttcgcaagaagcatatatttcatcagacaatcctttatatatatacatttctagaagttgtctttttttacggaggatataggtggtaatagaaaacaatgtaaaatcctttttttaaaaaaagagtttgtaataattaaaacttaactaaataatacgctattagatttctcgttttaggtgcgtcgtcttaatcttcatcttcttcgatgagtttcaaaacagcaccgtaataataccaagttcgtccttaaaactgacgaaaaaaagaagagaaaacccattgtgctggatggatgccctggatgagacgaagagaaaaggagtcagatccaatcgaaatcaaaagcaagcagaatacagatacatctgtatcatcagccttgttcacgtcaaatcagggtggccagctgccgccacccgccaaaacgggctgagaaaatcaggagaaatcagggggcatttcgcttgcagatctcgactgtgttatttcccgcgaattcccaactcataatatccttgttcttcacgtgcacaatttttaaacagttaaacgatacatactttataaaaagtttatataaaagttgctataggaaagcatattaatcattttttaaagttttcatagctaatattttattaattatgtgttaatctgtcacttcattttactccctctgtaaaaaaagacaaaccctgagttttcgtatccaacatttaactatccgtcttatatgaaattttttataattagtatttttattgtcgttagatgataaaatatgattaataacttatctttttaatttttttataatattttaaaataagacggacgatccaaatccaatgttagatgtggaaacctaggttttttttttaaggagggatggagtaggtgtgaaggggctccaatagagtattcttcccgtcgtcctctcctctcctctcctcgtgcgctccgccccccaacgacaccgacgggtttatctacccttcctcgccctctcgtcgctgagctacccaggaagaaaaaaaaaaaaacttccctccgccgccgccgcctccgccgactccgacgccgccgcggctacaagtaccaaccccccgcgcgcccgccacgccgctccctgtggcccaccgcctcctcgcctccgcctcctccgccgcgtcttctctacgcgcactcatggcgacctccgcgaccgcaggggcagcagcagcagtggcctccccggcggtggccccgcgcggcgccgccgtcgcggcggtggcgcggcgagggttcgt

SEQ ID NO: 6106 - DNA, 1501 bp, Oryza sativa
ggtggtgattcttgaccactccactccctaccagccctgccggccccgtgaacagtgacgatactcttgtcggcggggcggtgccgctcttttcggacacagatcttgctcacgccgctagtgcttgtcgctcgtccggcacgccctgtcgccgcttcccattatcatccgcacgggccattgctgtggagaagaagggaaggaagggctgaagggggaagaggaaggggagagagaggaggaagaagaggcgaggatgacaagtggggcccacatgctaagtcagcctattagactaggtcaacgagccatgtcagcataggatcaacatatttgatattatttattatatatatattgagggatacggattcgattggacttatatttgacggagtcagagtgaacttattaaaaaaaaaaaaagggaccacccgtggattggaccccaatctcgcctcttactcggcccaatcaaacaaggtccctggagctcgagaccggagcattttatcccctccgtacgaaggaattcgccggcggcgagcgcgagcgcagtggtcagtcgagtgatccacccgacatcggaatccaccggcgcttccccacgcttgcgccgcagccacctcgtccactccacacttgcctccgcgccacctctgcctcttcttggttccgcctcaagaaacaaccctaagccgccggcaaatcgccggccgtttcctttgaggtatatacgtcgcctccacatcctcttcttggttgagatgaccgagtaagaaggccgcgtattagttagagagatcctgttgggaatagtcccacattgctaatctagggggagttgaaccaacttaaaagtggggggagcccctcacctcttagagctagcttttggggtgtaacaaggctttctcctggttttgggccaacagatccaagaaaaatcgctcaaccatatgatgggtttactaaggtgcctgtgcatccaaatatgtcattccaacagatcctgttaaagttagttcgctttgtttgtacacttgtttgcaccggcaatttcagattttaattcatatataattgcagacatttgtggaacattggtttatttaaccagcattagaattgagatatgtagattgttacattacttcaaattttctgcctacagagtacagattcaaaagtttgtctatgctaactgatttggaggcaagtaattaaataagttactatgttcattaatgttttgtagatgaataaataaataaataggttattttcttgcttgttcttatttgtttatctcattatctgcgaagataagtaggcaaactggaaacacattcagcaaaaggtttagcatttcattactgtctgtatgcttcgcagacattttgccatgatgtggttcattataatttccttaattttgaccagggatctggatacctgctgaaccttgagattacctaactagcactgctgcgtttctcaa

SEQ ID NO: 6107 - DNA, 734 bp, Oryza sativa
actttaattttcctctgatggagaaattattggtccactttttcattggatgtataatatgttagttagagataagagtcaaatataaattatagagataagatatatcctagagatagaatcctagagataagatagagtcctagagatagaatcctagagataaatctactcttacttgtattgtactctaagtctctatcccctatgtactcctatatataccccatgagatggtcgatgtaatagatcagaaaacatcagaatataacagtttagatttttccacatggtatcagagctgtagacaaacgtcgatcgatcctcggttccagctaggttccatccacgctgccccagggagatgagatcaatttctcactggggcaccgcaccgcatttgctagctagcatctccaatcatttacagattagtttactgcatatcattagatgcgttttccaataattagttttagatctattagctagccacagaaaaccatatgatcgtcaggagcaatgcggcaggtgttacaggagcagacaacgtcaacaagcatcataccatccggcctcgtccatggatcgatctgcatcggctacttcacaagaagcaagggcctgatgctgttcgtcgccaacatgtgcacacgcctgtgctgcacacctgcatcaagacaccggccgatcatctgtgacgtcttcgcggagtccaagtcaagccgccgagc

SEQ ID NO: 6108 - DNA, 205 bp, Oryza sativa
  unsure (1)..(205): unsure at all n locations
aagttagtgtgcatcgtttcctcgcagttccctccaatttatcgcaaagccctattaaggctttgtcagattattgactgatttgctgtgcttcacaccctcaggtaagtagttcacctcatctgtaattgtaaacacactcatctttctgtttgaagttagaacagagcaagaagctaagcttgggggggcgtggccatgncgg

SEQ ID NO: 6109 - DNA, 1501 bp, Oryza sativa
agtcaacagtgtcaaacattttgaaacggagggagtacttgtagactcgaccaaatctcataattggtactccctccatcctaaaatataacaacttttagccatcaggatttgctaaaatatagcaacttctccaccaacattctcttcccaaccaattataactttccaccattcatgttttccgcctatctccactactcatccaatcacaatcctccaccagttacttctacctacttttttaataaccgtgtccaaccctaaaacttcttagaggcttctccggtccagcgttctgtacctcgaggtacatgtaacgtgaggtaccgattacaatccaaccgttgatctctagaggggtacgatgggtagtgaacgaagagaaactcagcgacgcgcataggctggccaccgacacgaacagggcgaaggggacgggtggcaatcaaccagggccagctgggtctgggctcccgacgcctcggcgcctgcctcgcgacgtggtgcatcggcgtggtgacacctccatgttccaccgctccgtggattgagcggccaggaggtcaaacgacgccagcggggagaagcataagctgcgaggctgacgcgagagatgatggtgaaggaaagatgaagatgcttgcctactagtgaaggatcgatatgatgtactggtcatgccatggacagcagcatcctgttcgtcctccagtccacgattcatgttgcttcagattggtaccgagctcgtctttgcttgtgttcaggcgggcactgagctcgtcgctgtggacatctcttcgttggtgcattgaggtcgtcgacgccctgagctatatcggctccctgcagtcggcgcggccggatttggaccgggagcaggaggggcaagttgggattgggcagggtggtgattgctggttgtagcgagggaggcggaggccagcgagcttggctgcgccgccgccgtcgaggaaggaaggggatcgggaggagtgagattgccggtgtcggggattcaaaccgtctctgcgaaaactgtctattatgcgaaagtccaattctgcccttcaacttgttccacgtagaggtggccaaacgggccgggccaaaacgggcggcccgaggcacggcggaacctgtagccggcacggcccggcacggcctactacagtaacgggccgtgccggcacggcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacgggcccgtactgacacggcg

SEQ ID NO: 6110 - DNA, 702 bp, Oryza sativa
caagctttattaaactcaacgtgatacgagttggatgaaatagaccgtgcaactactagctagaagagatacgtaatatatccatgtgtggccatgtaaatggagtcgttgctacatacaaattaattgagctagatacatatggagagcaaaaccatggttaatcagttttgcatttcgatcactggaattgatggactgtgttgttattaagctagggtacaagaaaagccggcgataaattagatggatcgaaaccaaaccacaagagtccaaagaagaaagtacaaaggatctctggacatgctcacgatgaataatcccatcgatcgagctactatacatacaaaactcactactagtaattaagtgttgagggttcgagaacaaattaattaatcgccaaataatgcatcacaaacatcatcaacctagttatcggtttctttttttaaatcgagaacatcttgattaattatgtaaagccctttttgtcctctcgaaaaaaaaaaaagctaagcacgcatttttttccgcgtaaattaaaattagagaaataaataaataaaggagggaattgggcagtcgccagggtatatattgagagggaggagcttagcatttggcgacactcgtctctgcgtgcgtttcgttccttcgttgcgttgcgttggttcatcgatagatcgttctcgatggtga

SEQ ID NO: 6111 - DNA, 842 bp, Oryza sativa
accgccattactacccctgttggctccgtcgatccagagaagggaagaggtgagggaagggaccagtagcatggtgtagatgaatagtacggcgccggccagcgtcctattacttcggtcggccggatccgacggcgagaaggccggggtcgctggatccggtggccttggcctcctcacgggccacgacgacggctaagaaagggcaaaaaggtggcggcggcgcgtgaagagcagcggcggaggcggaggtgcaagagcagagagctgcggaaaccccgttgccggcgagcgaggtgagggagaacaagagctccgacgcacgtggcgctcacggccggctccgccgacggggacgggggcagggccgtgttccccgtgccggtgaacaccgcaccatggccgtcaccgttgagggacactagctccttcgcgccgaaaccacccgctatggtcgacgctctcgagttccgcaagtgttaacaaccaaatttagtaagatatgaaccaggttcaacattggaatcgaagcggattcgacaaagagttagattcgaagaacagagtatgcatcggctgtggtggcatcggttggagtctgcatcggctgagatgaatcggacagaggacagctgatacagccgatggagttggtatagccgattctgatgaaaatggcttcggggctgtttctagaatcgattgacgtgcttcacaaggattgccacgataaagataaagctctaaataagacaactgtatctattaattaggatattatgtaatttccttagagatatgtttgggcaaaagtccgccgcaaagacttagggtatattaga

SEQ ID NO: 6112 - DNA, 756 bp, Oryza sativa
aaagagagtccttataataacccaatacgatattaattaaaatttagaataaaaataaaataaaatacaaaatcagaaaaaaaaagaacagttcatgtaggaatataatttgaaaataactaaaattcgaaattaaagttaagcaatattgaaacaagagtccatataagaaacaaatatgatattaattaaaattcaaaataaacaataaaataaaataaaaaaacagaaaaaaataaaaaacagagttcatgttggaataaaatttttaaacaatttaaattggaaataaaattaagaaatatcaaaagaatagtctatatagaacacaatacgatattaattaaaattcgaaataaaaaataaaataaattcagaaaatagaaaaataaacataagagctcaagtagaataaaatttataaataactaaaatttgtaataaaaaaataaatactattgaaataagagaatctagaacacatgacaagattaattgaagttcaaaaataacaaataaaataaattttaaaaatagaaaaataattataagagttcaagtaggaatataatttatgaattaaaaatatcggaatgaaagatatgcaattttcaaaaaaaaaagtcaatctagaacacaacgatgacaaatgacaataaagagggaagaagcaataagcctataaaggagtagagtactagtggttgatgggatatctaaaaactataatcaaaaccccaaatagaatcccaatga

SEQ ID NO: 6113 - DNA, 1066 bp, Oryza sativa
cattaaacacctaagttcccgggacttgctgagtacgaaagtactcacccttgctctataaatatatatgtagttcctccggcctgaagagaagatatagtgaagtgaagattagggtttcgtcctggttcccagccgtcgcctgtggtgttgggtgttagtccgttggttccgctgctgctgctgttgttggtgtttcctcgtccgtgtcgtcggttgtattctcgggctgtctgagctgcaacctaagttaaggtaaataagtcctctatttatattaaggattgctatgattcatatttgtcaccgtgggtaccagcactatgtcctgggactggtaccgagatcgcggtttcgtaggaagcggttcgcgccgtttttcctacgacacgctcctatcaggtgccgttgtacggcggtatcagattggggtgtgacaagagatggtatcagagcataggttggccctaggatcgaaacccctgaataggatggcattatctgaatacaaaaactatttgtgaaagctaaggtgtcgttgtcccctttagctctagttttgcgaaaaatcttttgtgtccaaaagtaaaagctagtcgttcgttttgacttttatcctagagtaaacctatcttcacgcccagttgaagaaaggtgtgctcaagcctttaggagtcttagttaagcccttgttggtaggctaaccttagtaccgccacccgctcggtaggagttgtggtgaactagtgcgtgtgtgagttttgtttggtagtccgtgttcaggtgttaaaccaattgggttaccggctggaacacaccacctatgtcttctgtgatttcaaaaaccgtttagatgtagggttttgattcccctcttttttaatcaatttctgggtgggcagatctcagcccttaaaagcagatgggacgtgttccacccgtaagatccgtgcccctaaccgctttggttttgaggaagagccagtccagccagaaattcccgatcaaccagttaaccaggcagatgagcaagaagctgagagtgatcatatggctgtttccggat

SEQ ID NO: 6114 - DNA, 1501 bp, Oryza sativa
  unsure (1)..(1501): unsure at all n locations
aattactttttgtgtgaatgacaaataggcccatatagtttttaattctaatgctacctaagcgccacgtcagtaccacaaaccaagtcaacatcgccacatcagcgccacgtcagtaaaaccgccgtccaaaaccaatgagggagtcaaattgcactggtttgaatagttcggggagtcgcttatttggttttatggttgagggtcacggattagattcgggtcacttttaagggagtcaaagtggacttattccaatgcacgatgcacgaacgactcaagccacccgttggttggaccgagcctcgctgcgaggcgctcgggttggtcccggcacaccgtgcggagtggaggcccgtcaccgtgatgcgccgttcactttccggcttttcccatcgcagagaacgacgggaagtccagaacacgcaacgtgtgcgcgtgggggtgcagaccgtgcagcgcagtggtgggtggtctcgtcgtttccaccaccttccccgcggagaagacgcggtgcacgttcctatcaaaagcgcggtccttcagtactccttcgcatatcgtcgccatgacgttgaccctggaccttgagagtcctgctaaaacaggattgagatcctcaacatttgagtgcaccgtgactttatcactaacatgtgaatccggagatcatcagatccacatgtcaataataaaggcacggcgcagtcgactgcaaaagattatgttccgctaaaacactccccgaggaaaaggagacaggaactggtgtactatgtcgtcattgacaccttgtaattgtttcctgattgtctctcagatttgccgtacagggtatagatgcctgtggctgtgtagttagctcgccttggagtttcgaatataggccttcccaggatgaggagggggaggggnaggcctgaagcccggcccccctccgaacgcggtgatggctcgatcgagtcgccacatgcagtggatacagtcatagcgtgtttggttacctacacatgggttggctcacaaggagcgcgagtttggtttctcgcacgggctcctggacctgattccacttgtgcaaacctaccttcctagctaggcccgagggaaacgctcgatttgagcttcgctcgccatcttggctgggcgcgtgcacgcgcgggtgcaagaggaggcggggatgcatggatgcatgaggcagggagggttgaagcatccactcacctcctgctcacatttggtccttgaggccatggggtgagtgtagattcggggagaggggcagtgacctgcgtgccaccggatgactggatctggcgtggctggggacacgagcaccgagcggcacggcgatggagaggaattgcagagcggaccgcactgagtagttgactagcgacgagatctactagagtagtacatccttaggctgacctctccacttggccgtcaccgcacgatgcctagatctagcagttggttggctaccttcatcgagagc

SEQ ID NO: 6115 - DNA, 1501 bp, Oryza sativa
ttttgcctccctatataggaacttcagataatgctaactaacaaggaataattttgtgtgttttttgtttgtgggctaaagtcggagggacagggaagctggtttgctagtgattggtgaaaaatatttggattaacttatgatccgtgcgcattcgcttgttagtcgcctagatcacgtcgatgcattatcagttctcctgccggcgagaagtgatatctttgaagctagcgaaactgtattgttccagttgttaaaaaaacgtcgagagaatatatatgacaaaacaaaataatgtattaaatgtattaggatttgtcatgacaaaacaaaatgacattgtttgtcatggagatatcactacactttcataaaagtacaacagagaagagtgtacaaaatcgtgcagaagtatatttacatgttgccaatagatattggtggtgattccttacattccaaactccaaatagtacatgcattgttttttttagaaactcttataatttgctctgttgaaactctaattacaaaatatagtaattatcattaatcttattggatttcataataattagtaataaaacagattaattgtcctaataaacactaactagctgggtggcccgcgcaattgcgcggctagcacccaaacaaaatcatatattttccagtctgattttacttaaaatttattaaatagctatctcgttgtcttaagactttgaaagacaaaaccttatcatccacgtatttctaattatatagcttttaaaagtcacaccagctgctaccccttacttctgtcatatccttctttatttgcttactcgatttatcactatttttattcattctctttgaaacctttaaaaattggatcttataatttttaaagtttattgtctcgttgggtttcgtttttataatttctagaagtccagtcaaacactgtcattatactcctctacaacccggcactgtcttttctctttattgtcattgggattttaaaaatcgaacataattatcgttcgggttccgccaaaccgttagcggctttgccattgtactcctttatggctcgcccgctgcctccattctttattatcattgagattttaaaatcgaacatagttattattggttttttttttactttttagaagttccaaacctttaaaaattggacctcgtagtttttagagtttattgtctcgttgggtttcattttttttttaatttttagaagtcccgttaaacgatgccactatactcctctacggcccatatgccgcctactctttattgtcattgggattctaaaaatcgagcataactatcgttggaatttattttttattttctagaagtcccgccaaccgtcggcggctttgcagctatactcctatacaccccgcccgctgcttcacctttttattgtcattgagattttaaaaatcgaatatgattatcaatgaggttcactttttaactttct

SEQ ID NO: 6116 - DNA, 1501 bp, Oryza sativa
aagttgtcttttttgaaagtttctctctccatttagatccgatataataaaataatacgttcagcatccaccagctaattaccatgtttttagtggtgtcatgtaataaatacacattctttggatgtcatacaacaaataccataaactttgaggatccttttttgcctgatatttatggcgaattgaggataccttagctactagtaaggtttcttatgatggaacctgctaatctaagtttaagttctaattttagcacgaatacttgtatttacagctactacctccgtttcaaaatatagcaaactatgatgggatgagacccatctaagactatgaatctggacatgagacatgtccggaaggagtaattattttcactggtagcgatatacatgttgacagcgagtctatgatgtgcttgtatttatagctaattatttttagtggtggacaacgtaccatattacttgtggtgacttcgtcgaactcaaaatttgtaggtatatacagacaccagtggtgaccggtaacctcgtcaatcttaacatattactaactcaatcttcaaaagtattcattagaaccaaatgtacacgtgtgtattatataagagtgagcttatatgtctgtgatgttttcatcgagctcaagatatacggaccaatttttttagaggtgctcatgagataggttaagtacgtatgcattaagaacaaattcgataaatgaatgataaatcagcaaaaattaattatcaaaaaaagacactaatattacttcgccatttggtgagattgtggttgcatagagctagcgtagaagattaagaagcaataattcaaaaaagatgaataaataaaataaatttagacgattcaaaaaagatgaataaataaaataaaattagacgattaagaagtcaaaaattaattatcagagccaggtttcgatcctgggacctgtgggttatgggcccaccacgcttccgctgcgccactctgatggtgttgtttaggatgttaaacgtttctaatttaaacaatgctctataactaatcattcggctaagaacactaaggcatcgttcgtttaggggtgataggggagattggctctcgtttccggcgcacacttttaaactactaaacggtgtgttttttcaaaaaattttataggaagttgctttaaaaaatcatattaatccatttttaaattttaaaatagttaatactcaattaatcatgagctaatggctcacctcgttttgcgtatcttcccaatctcctcaatccccttctcctcaaacactccctaactcattcattattaggtataagaacactaactcatccattctcgaacactaactcatccattatccattctcgaacactaactcattatacattctcgaacactaactcatcattctcagtataataacttcactaatcattcggtattcagatataatataagaactttctatctcaga

SEQ ID NO: 6117 - DNA, 1501 bp, Oryza sativa
tagtaagaattactaaaaaaaaaacctgatgaggcatgggcttgtcccccaaatccgaactgtaaattttaagcgttgtgtgcatgatgtcacagctcacaaaggttcgtgcggattgcggccgggttttatgaatgctaaagctttctactttaaagtaaagaacacatcggcgcaatatatacctagattgatcatcactacgcgtagttatcctggcatatatagatagtactacctggagcccgctgctttgttttgggggtaaacagacgcatgatgccagagtgtcataggcaattcaagcagtgatgaagcaaccgaatagtagtaccttattcggggtcaagttggtccagtccagtatttaaacctagacttgcaagttactacatcttctcataatcgcaatcgatctcgtgttcgaatacacaagggggagatacttgctagcgcggtgattccctctgtctctccgaaagatcgaaaaaaaggcatccatacaagtgttcccccatctaatactaatctgcctatctatctggattatccgcactttccggtcgataaaacaactcgaattatcttctccgatccattgtaccccaagtatttatacatgcgtacgtacatatggctagctagctagctcaaaattatgctggaataaaaccccaacagctagagcagtttgacttcatccaccaaaagagggagcagcagaagggaatatcatgtaaacaaaccaaaaagtacgtgacgaccgcaccagtgctggtgtatataaatccaaaggaggcgggagcgagcgagtgaaaccggcgacgcgcatgtgatcggccgccgaggacgaggacgacgcgccacgcagtatccgttgccgttgggcgcgcgcgtacgctcgttgacgtgctcgtggtctctcctgccaaacgtacaacgcgcgcgcgagtggtgtggtgcgcgcgagattttaccggccgcgcgcgcaccgctaaaaaacgattttcctgaacagagcctatttaaattgtagagcgtctgaaaaaataagctttcacgtgtagcctattaagagagccgcacgcaaaaaaatacacactctctctgcactcctacccactttaaatttttcccttttttctcttctctcctctctcctctctcctctctatctctctatctctttttcttctctcctctctatctctttttcccgtcctctcctctcctctcctcccgagtcccaacggcggcggcggggggcgtaggtggcgacggtggtgtggcaacggcgtgcgagatccggtgggtggtggccaaccctcgcacggatccggcagcggcagtgcggccgtaggggaacacggatccgggggcctcccccctccccccggatccggctcccctccccttctttccctccctatatccggcggaggggaggggcgtcggcaacggtgcggccggaggggagcgcggaggcctccgccatcgacga

SEQ ID NO: 6118 - DNA, 490 bp, Oryza sativa
ccaatataatccctagtagagaaatagaatttatctcaccatttatttataggttaaatattagtagaaaaaatttctcttagcattagttgaagtatttgaggtggtactataaaatatatctattaaacggtttagattgattatgttgacaattactccttctatcttaaattaaatatatttattttgagatgggaggagtataaacaatttctttttcagatagctcaactgtcaacagtaatggggaaccaataaaaataaataaccatgatcagtggaagccagtgtacaggaactaaacagcagacacatactccctccgtcctataaaaaggcaaacccttggtatgcgtctctaactttgactgtccgtcttatatgaaatttttttataattcgtatattcattgctgttagataattaaacatgattaatattttatatgtgccttgtggtctttctatttatggtattttttataga

SEQ ID NO: 6119 - DNA, 1501 bp, Oryza sativa
acgattgcttaggaggattggactggcattagctatgtcactggtagatgggactcatgaattatttatattttgtttataactgtaatgacatataagcaccacataggggccacaacagatgaagaccatgtcaacctgtcgtgtggaacgaaaccaccatccaaaattggatgttttccccttttttttcattgcagttcggctccgctctgttgggccgaagccaccgatgttggcccaacttaagtccaccgaggttggtcacggtggggaaagggccaccagctctccggcgtcccccggcagcgcttcctccctaaaccaacctcagcctcggttgctccgtgcccgtgcgtgcgattccgcgtctgccgctgccggccgccgaccgccgaccgccggtgcgcaccttcgccgagggaggaggagtctgttatcgagcaatttcaacaagggcggggccttaatctcctcgtgcagcttgtaaacctcagagtaggggtgggaaaggtaaagcgttcttgcttttgggggcgaagtgtacaaagattaactaatatattactatatggtgacaacttcctaaacatgatgttgaaagaggtagtgatatgctagctttacttttcttgcatgtatccactactaggcagctaatttgtttgaacctccgaggacctacatgtgtttgatggtattcaatctgtgctcgttttcttttcagaagtttggtgcgtggattaaattagctgaaagagaaatttgggagatgagtgagcttgcgaacaagttcttggttcttcatctagatggtgaaggtggtggagcagatgatacagaagaagcactgatccaaacatcttccagcatcaaagaggctgatgccggtaaaacctgattgttacccctgttcttctaaagtaaactaagtaatggattatggcattacgctgatatagatttccgctgctttattcctgcatagagaattgctactgtaactcatgtttactccagtattcttagtttaagcagttacattttgtatagtatgcctgggggttcactggactacaatttaacttgaattaaaaaaaaatccagcaaaccacggtgcctacttttgtactgaattcagttagccttgcaaaatgttttgctcttttgacattataaccacatgccctatatgttttagaatatttgatgtttgatcttgaataaattccttttctgttatgttgaaaatttatttacaatggacttgttccataagcatgtctaccagcgtcatggtatgtatcttattagataaaggaattttcattaagcaaatgaaagcattatgatacatgtaaggaagaccctttttcttacctgtaactacaactgacacttatgttcatgtcttatacgattctttccattgaatttcttattctcaatcaatatatattcattaatggggttagatgttgcatccaccatgcaggtgaaa

SEQ ID NO: 6120 - DNA, 1223 bp, Oryza sativa
ttcgccgcatccccggcgacctcgtccacccctccgtttcgctcgccgaccgccggagcaccgtcgaccccgtccacccgagccgcgccgccgccttcctccgctccggtcgccgtttccgtcgtcgccatcgacccggggtgagccgtggaccgccgcttcttttcccccttcccttcccctccctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgccctcgggtgcagctgacgcgtgggacccacggcgccggccggtgtgagcccgggtgcgcccggtccaccgtggaccgtggggctgccgcgtgggccccacccccgtggaaccggtccgcgcgcccctcccctcggctgacgcaataaatccattttaaattaaaaattaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacactgcagcttcggaggatccgctcttcgtggaagttgaagccggcgtttgggaaagcgagcaaggcaagtcacatcatccttgaacatattgaatcccagtttataaaattattttaatttaaattaatgcattatcgctttatttaaattcccgcgttaccactgttttatttagccatgcctatttacctttgttatgaccttattattgttgttattgttattattaccttgttcaccctagaataaacaaaaccccaactagtgggtactctattcatggttccactagtatgaatttaggtagatgcttcgctgattaataggacaacattaggtggttttataactttagacttggggaatattcatatctcttggacactatggaatggttggcttatggtggaattggacatacacctctcttcctctttcaaaacccctaaaacctgtttttcggtggggtttgggtgcatgccagttgtgggaagtagcaccccggccactataaggactaa

SEQ ID NO: 6121 - DNA, 218 bp, Oryza sativa
gttgggtgcatatactttgtacctctgagggtagaaaatcatggtacttattggtatttttctagaatggaagtcttctcttcttgttatcttattgttttttttttttttgggggggggggttataaatttttttttttttttttttttaatttggaaccaaccttacaaatttaatagtcgtattagtctcatcaggtcttttcttgaacatggta

SEQ ID NO: 6122 - DNA, 428 bp, Oryza sativa
aaaatgttttgatgtccgtttggatgatcctaatacgcaaagtctccagcgagatgatgccgcgagatccttctagcggacatgtttgtttcatttcatctatattgacaaatggaagcaacacaataaataatagaaacaacagcaaatactttaatgtgcatttacatttttgccaaatgtcataatttaaattaaaaattggttacataattgcataggatattgtgctggttgtttttggaattttggaatccctgaaactagtacatttttcctcattttctctgataacctagtatagtagttctatgtttccagaacgagttgcattgatacagtaatttgagacctctatttatagtgcatcttgtgcataaacccattccaaactaaaaggaagacaaaattaattggtagtgccatgg

SEQ ID NO: 6123 - DNA, 431 bp, Oryza sativa
ttcagaaaataaaaagtagaaatttcgttaaatttaatcaaaataatgcatatatctattcaacttaaagtcaccataggtacatatatctattcaaatcaaaacaatggagaatatttgtatagatatacaataagtactccctcaatttttaaatatagatggcactgttgattttttaacacacttttgatcattcatcttattaaaaagttacttaattattatctattttattgtgagttattttatcctgttgaatagtataggaagagagaaataccacgaatatttgacccattttattaagcctttatagggccggtatatatagaagtatgttgggagaagataagaaaagattacatatatgaaggagtccacacacaaatcaatcatattctattatgactctaatcaattcctccagg

SEQ ID NO: 6124 - DNA, 1501 bp, Oryza sativa
gagggagccgatgtgggtgcacgagagagatgcgatgggggtggcgatgcgcgagcactatgcgggagaaggaaccgacgcggatgcgggcgtgtggacggatcagcagagcgattagattggatcgaacggctaggaaaaaaagatgacgtggaagcacaggaaccagagaattactaatagtggggatgatttgtagaggtgtataggattactgtaccgtatcatttggaatagacagctcaatgtacagattaatcgtcatcactgggatttcactcgtatatgaaaatcagcataagttactccctcagttttttaatagatgacgatgttcacttctgaacacatttgaccattcgtcttattcaaaaattttatgcaaatatataagatataaatcatgcttaaaataaaacaactcacaacaaaataaattataattacgtaaatttttgaataagacaaatagtcaaacgtgtgataaaaatcaatggcatcatctattaaaaaacggagatagtatttatatactatagacacccatttgcattatcgatagcacccacacgttgtataacatatgtaccctggtggaataattagccgtaaaatacaagcacccatagtctaggatttgaactcgagtggtgatctggttccaccacaagaaaacctaaccagtttgtaaaatcaagagttataggtgtatatatttttaaagacactttaaatgttgcctaaaatatttttaatgtagagacactttagagatatttttattcatattttctcaaatttatcttgtaaatgcatgtttttttcaacactttaaaatttgactaatatgtaaaggcatattctcgaggtatttcaattcctgtagaggtactttttggaattttaatcgaccctaagtaactagatatgacataagagtggtatgattagagcaagaggcatcgagttcaaggatcaccaattgtatggaaagagatagtattttttttccttggtttgctatggttgtggctttttttaatgtcttagaaaatacctttaatgtattttttattgactattgcatctagaaaaaaaataaaaaaaacacgagtgatggagggcaatggaatggtaaaaatctaaacattctatataaaagagtaaattgcgctagcaagcaagttcaacaacatgcaaattactctttttggtataatgacttgggtagtccgtatggacctgtccaaaacaatctgtggagattatgggtaccctaacccatacggcatggttatccgactagttttaggggatagcttatatctatggaatatgtaacagatcataacttgggtattacgtttacttttatattatggagcggcctaaagtcttgatttgataatattgtaccgataccgtattggttaaggtttctatcttgtaatcctgctccccatcctatataaggtgggcaggaggccctctagggggcatg

SEQ ID NO: 6125 - DNA, 1501 bp, Oryza sativa
tgctgcgcgcgtgcgggacatcgacctagtattgttcccgtaggattcgtgcatgcatggcgctgatgatgagagatagtttaattaattaattgctgggataagcatttatgcagtgagtgaaaaatagaatattgagcagttaataatgcatggccagccggctaattatatactaattaattaccactagtaggcagtaaataactgtactggaagcagactagctgctggtactatatgttgcattttgatctgtcgcgttgccttttcgcgcatcgatcaaaccggtagtggtagtaacactggttgcctgcggcaggtagctaagtttgctactgtgtgaattgtgagttgcatactttgtgtgtgtccagccgggcacatatttccgggtccggccggacggacccattacaagagagaggacgtggagcaggcaattatactagatcgagattttctgcgttattctctttggttcttcatcatggcctgcatgtgtggtgtttcatttgatagttttttccttttggtctaggaaaaataaattttgcccaattgtgtgtgtatgtaggctgtgtttagatccaaagtttgcatccaaacatccaacttttcccatcacatcaacctgtcatacacacacaaactttcaatcacatcgttccaattttcaaccaaacttccaacttcaccttgaactaaacacagccgtagtgtgtgtggtatgtgtgcagattgctggtcagtaaaatgtgtctagtccacgtagtacacaccgtcaaaggatatgctttggttgtggtggtagttatcgctgtcagcctgtcaccgtatgctcgatatgatggtctacactgttcgtacgtgctctgtgttggggagggccagggagcattaattccgattattagctagttgaccagacaaaagggatagtagtagtgtaaggattttaagtttattccctgtgtgggtattattttaagtagagtatataatgatcaaaatatagttgggcacctgttccatttgttatgtttttttacttgcaagtacacatgtaagacatgcaagagagtctcattgtgtgctaaatcccttgaagattaattccacaactaattcatggaatcttactatgaaattcatatatccccacaagtgtttttttttggcattcatcagataattatcttactttgacaaaagtgtgatcttaattaagagtttgacttatattgtttgttttaaattagctattgccttttcgaagttctatggatatgcatccgacacatttctgttctataatttacacaatctaatttccgttctgtagtttacacaatctaatttttcctttgtgtcattttcacaacctggctatttatatgcatgtggtaatctgactgttttatattattgtgtttaccttttatttgtattccacattatccactgatgttgctcaattatgcaggaagcacatgacaag

SEQ ID NO: 6126 - DNA, 1501 bp, Oryza sativa
ttaatattacttcctccgcccaaaaatgaagatatttttaagagcatttttcccatcctttaagaggtaccatgagctacgaggtatcatgaggtaccaatctaatctaaccgttgatttagcaggggtatgatcggactaaaaaaacatctcttcgtcgttcgtgcccatccagcccgccatcgtcgtcgccaatagaggccgccaccgccgtcgtgcatccagccggccgccggccgccgccgtcgcccatccagcccgccgtcgtcgtcgccgccgtcgtcgccgtcccccatccagccggtcgtcgtcgtcgccaatcgaggctgccgccgccgtcgtgcatccagccggccgccggcgtcgcgcatccagccgccgctgtcccgcatccagccgcccgccgccgccatgcatccagctgcccccgccgccgcgcgtccagccgccgccgccgtccccctcgagcccgccgcgtccagccccctccagccgccgccgcagccactgtccagcccaccgccgccgtcgtccagcccgccgccgctgtcacgcgtccaggcgcccgccgctgtccccctcgagccagccgccacgctgctgctgtgctttcccgacgttttttctttctctcgtgaaacagtaaaggacagaaatacccttccacccatagtaccacttcaatgaggaggtgcagtaccatgaggtacggatgatttctaaccattggatgatgccagatcaacggtcaggatttggtactgcacaacctcaaggacagtaaaaaacctatatttttaaggttggcacgagtattaagaaagtagatgagaatgattggagaaagtgtgtgattggttgaaaagagaaagcaggtgaagaagaatggttgtgattggttgaaaggaggtggtaggtaaaaaaatagcttcattttggaataaggtactgtgctaaaaataactatatattttgagacggaagaagtagggtagaaggagggtgtggtgaaagcgagtttagaagaaaggcctaagagcaggtacaatagcaggctataaaccaactataaagatattttaaagagataaaggaagagagagaagagcaacgggctacagatatgtagccagctgcaacacggactccaagacgtaatgtgtgtatgacaggtgggaccaggtattaatagtatagtaagcaactattgtataaattagttattatattggctatagatgatttgaagctagtagttggctacactattaaggtggtgtttggatccagggacttaactttagtctctatatttagacactaatttagagtattaaatatagactacttacaaaactaattatataaatgaaagctaatttgcaagacaaattttttaagcctaattaatccataattagagaatgtttactgtagcatcacataggctaatcatggattaattaagctcaatagattagtctcgtgaattagtccaaga

SEQ ID NO: 6127 - DNA, 1501 bp, Oryza sativa
ataattttgcaaagtttgagatatgtcatcggtatctcaatgacatttagaacccacatgagtcaatgacatgtgggtcaggatggcatatcttcaattttgcaaaattataatggcatggttccaattttcccatttttgaaatatatattttataatattttcaaataaaataaatacttaatcgttctaaaataaatcaattatgtataggatgtaacatattctgatatagtaataaatctgaatactgtgtgatagtattttaggttgatttattttgggagctgcgtactgtatggcggcacatgggggatgtggggcgcgtgggacttgaattgaccagacaaggatcggggaagcggtggatggatggagttttgaggagagttgagtttgggccgacgtctcgcactgcacgccgaggccaccgctttgacccctattctcgcccgcttcgcccgccgcctgccgctgctaaaaaaagcctgcgactgcgacactgactggacaaatcaccgtctcgcatacatgcacagtccttagcttcttagagcaagtttagaccatgtttagataggactaaaactttcaagttccctatcacatcggatgtttggacactaattataaatattaaacgtggactattaataaaatccatctataatcttggactaattcacgagactaatctattgagcttaattaatccatgattagcctatgtgatgctacagtaaacattctctaattatggattaattaggcttaaaaaatttgtcttgcaaattagctttcatttatataattagttttgtaagtagtctatatttaatactctaaattagtgtctaaatatagagactaaagttaagtccctggatccaaacaccaccttaatagtgtagccaactactagcttcaaatcatctatagccaatataataactaatttatacaatagttgcttactatactattaatacctggtcccacctgtcatacacacattacgtcttggagtccgtgttgcagctggctacatatctgtagcccgttgctcttctctctcttcctttatctctttaaaatatctttatagttggtttatagcctgctattgtacctgctcttaggcctttcttctaaactcgctttcaccacaccctccttctaccctacttcttccgtctcaaaatatatagttatttttagcacagtaccttattccaaaatgaagctatttttttacctaccacctcctttcaaccaatcacaaccattcttcttcacctgctttctcttttcaaccaatcacacactttctccaatcattctcatctactttcttaatactcgtgccaaccttaaaaatataggttttttactgtccttgaggttgtgcagtaccaaatcctgaccgttgatctggcatcatccaatggttagaaatcatccgtacctcatggtactgcacctcctcattgaagtggtacta

SEQ ID NO: 6128 - DNA, 302 bp, Oryza sativa
tgaatcatacatcattgcctgaagaagggatctctgaatcctacagggtcagcaatagcttatctgaactattgatggtaatatttcaaagtaatacactttttctctgaatcatacatggccattatgttgaattttgtttttctaattatcagggagcaatgacagatgctgttattgttattggtgaattctagtagtacagattataccccatatgcactcaggagtatggctcaacaacctccttgtccatcatgttcagacagttttagttcctagttctgtgtaatgagccataa

SEQ ID NO: 6129 - DNA, 1501 bp, Oryza sativa
acaaccattcttcttcacctgctttctcttttcaaccaatcacacactttctccaatcattctcatctactttcttaatactcgtgccaaccttaaaaatataggttttttactgtccttgaggttgtgcagtaccaaatcctgaccgttgatctggcatcatccaatggttagaaatcatccgtacctcatggtactgcacctcctcattgaagtggtactatgggtggaagggtatttctgtcctttactgtttcacgagagaaagaaaaaacgtcgggaaagcacagcagcagcgtggcggctggctcgagggggacagcggcgggcgcctggacgcgtgacagcggcggcgggctggacgacggcggcggtgggctggacagtggctgcggcggcggctggagggggctggacgcggcgggctcgagggggacggcggcggcggctggacgcgcggcggcgggggcagctggatgcatggcggcggcgggcggctggatgcgggacagcggcggctggatgcgcgacgccggcggccggctggatgcacgacggcggcggcagcctcgattggcgacgacgacgaccggctggatgggggacggcgacgacggcggcgacgacgacggcgggctggatgggcgacggcggcggccggcggccggctggatgcacgacggcggtggcggcctctattggcgacgacgatggcgggctggatgggcacgaacgacgaagagatgtttttttagtccgatcatacccctgctaaatcaacggttagattagattggtacctcatgatacctcgtagctcatggtacctcttaaaggatgggaaaaatgctcttaaaaatatcttcatttttgggcggaggaagtaatattaagtgacccttgacggaggtttgatatgtcaagtgacaagaaatatgctgccaccgagggcttactaagaaagtcaccacatcctcatgagtatctatcatcttcgttctaatctctccaaagcggaatggtttggagtgaattgtactagaaaattataatattaacaaatatgattgcatccttaagaatacgtacgaaggtagagtctgatataacacgtactcttagtttaaactatcacttagagactacttcattctcttatcttataacacagttgagacaataacgtctcttaatattatcaatgcaccataatattttttattactcttctttccttttcttcatctccatataattaattttttttaataaatatactaagagtcgactgtaagctgatgttataggtagccatgatgttcttcttttctcctctctttgatattattaaattaatttgtttatgtggcaacggagagagtccgctaataagctattgtgcatatccttaatgcaactaccaatagaatgttgtagttatacaaatagatacaatacattcactaggctagagagaaaaacgagaagtctaattatttct

SEQ ID NO: 6130 - DNA, 1501 bp, Oryza sativa
gccgtcttgtcgcgcctcgcaccacgcgccgccaagccatgtgccgctaccgcgcctcgagccccgcgctgctgcatgtcgccgcgtcccgtcgctgccacacgccgccgtcgctgcacgtcgccctcaccctcgagccccgtgcgccgcccgttgcgtcgaccattaagtcggccacccttcctgcaccctataaataccccctcccatctcccttcctccccacacaccatgttggctcccatcacaaggccccaagagcccccacgagctcgtccacccctctctgcctcttcttctctcttgtatgcattttctcaaacaccttgtgtgcatgcctgtccaccaacgccgccgagcttcgtcgttcctccatccctcggtaagtcctcgctcctatgtcctctcctagttccgtgaaactagagccccctttaattttgccaattagcaaccgtagccatgccggtccggccaccgttttgccgccggtgagctcgctgtggacaagccatcccggagccccttctctccatctagctagcaaaatggaaccctcacaccccgtagatgctcccacacccatcaattcggtcagaaattatcgctatcgccctagccccatgttgcccgagctcagccatggcgtggccgagtttagccgccagtccacacggcgccatgcgccgtggccgccttcgggtggtcactggagttcctccgagcctcctctggtcgccgctgggatgccctcgcccgggctggggcgcacgcgccgcgcctctgctccgctcgatggccggcgcgaggaagaagacgacgggaaaagaaagaacgagaaagagagagcagcggggtccacctgtggaattttgcattgaaaaataattcggtaggaaaaaggaataaacccggggtcccacttgtcagttggtacaaggctgtggatatgtcttgggttaaaaataaatcgtttatgaacagcagcttttcgcattttctcggattaattcaaatttgaatttttacactagcgtaatttattcattttaactcggatttaagtgaaacttgaacctaaattcatataaattcataagctttccaatattatataattcactatttaataaaatatatttataatttttaataattagtatcaagatgatgcataatagtcaacttaaaaatgagctaatgaataggattgatattgtacaatagagtagatgtaataatattggtctttaatatgttttgtcactgtagcaaccacataaattaattataattaatgtttcaaatcaatacgagcataggaaatattagtgccattaactaatagatgcccatatataattatatccatgacttataaattatttacataaagtttagcctcatattttgtaactaaaatataaacacacatagatgaatctttaacttggttaggagaataataacagagctagttgtatttggaccacttaaaagt

SEQ ID NO: 6131 - DNA, 1501 bp, Oryza sativa
aggacctcgccgccggccgccgttcatcgtcgtccgtcgtagtttcttgcaccggtgagttcgcgtcgtcgtcctctacgcgtagacgtcctccgttagcccggccgagctctctattgccggtggtcgtgtggagcagtgccatggccggcgatgatgtcagcgatgacgtcatattccctttttttagttttctttattagatgcaaatcgattaacttcggaaattcataactaaatcatcgtaactcggattcgagtggttcaagttgctaaattcatctaaaatcgagatctacctgttaaaaatatccacatgtactgtttatgcttgtttttgtgctgttttgttgatttcgttcatttgctttagtttccgacgttccggaggagagcgttttcgttgaggaaggttcggaagcctttgcggaagctcaaggcaagtcacacagatcccaaacaaccctttgagcatgttgaacccgtttaaaactaatgttttatttcaacttatgcattattttcgaatgtcatcgggtggtgagtctttcccaattaattaatggccgaagataactttattttcctatgggttataatttgattagctagaaccttatatattggtttggttcagctaaatgctatataatgggatgaatcatattatattattaattatggttatatttaatggtagctcacgatggttaatcgtgttatgttaatattagataattaaaactggattaaggtgggttgtgagcacatggttttgaaggtcgtgctcatgataattaaggaccggttcacgagctactgttgtgaaacattaaccgtgctaaccacaagccagcgtgggcaacggctttaccttttatataacatggttcattatggggtgccagactgagaagcggcgagaagtccgtggggatcgctggggagtccatgcctctagttatatttatagagggggtgattatgatccaggaatggtgcactgtggtgagttgtattgtgcaaagggtattgtcacgatttccccctttgcagtgctgtggtggtacttcggggcatggcaacatgtgtggaatcgtgtcttgtgggtacagcggtacatctctggccagagtaaaactattcgaatagccgtgcccgcggtcatgggcgggttgagcaatgtttttcgtaattagtctcacacctctcacaaataattattgatgcaataactggtaataatttgtttagcttagatctgtacagccgggtatggttgttcaggatggttgagcctgagcagcatgggtgtgctgttcagtgttgattaaaatttttgattaattactctactgtttcactactcttaaatctttactaaatgctgctttcgcaaatgagactatattatgccatcctttggtatccttgtgcacttgcatatttgctgtgtggcttgttaagtatgtcatatgctcattcttgcaataatcaatca

SEQ ID NO: 6132 - DNA, 702 bp, Oryza sativa
agaaaaatgttcactgggggtccctctttttatggaaaagtgtttagttttagaatcatcgttaaccgaaaattcttcctccgtttcacaatgtaagtcattttagtattttccacattcatattaatactaatgaatctagatagatatatatgtctagattcattagcatcaatataaatctaggaaatgctagaataacttacattgtgaaacggagggagtaaatctagattcattagcatcaatatgaatgtgggaaatgctaaaatgacttatattgtgaaacgaagggagtaacatatataacacattactaatcttgcaaaaccaaatcatattggatccttaggcaatatctctcctgattttggttgacgtaacaactgagttagtagcatgggttcatgggcggagctaccatgattcccgggtattcccgggaatacccaacttttttatcgaaaaacaagtatatttctaatatatacatatgtacacatattagtgcacctaaatcctcaattattcgatccaaacatagccctatacacatgtacatatattagtgcacctaaatcctcaattcttcgatccaaacacagcccaaccagcctatatgacccatcagacatcagttgatccacttagccaccacttagccaccactcttccagacggccccctctcgctctccctcca

SEQ ID NO: 6133 - DNA, 1501 bp, Oryza sativa
atgcccttcgtggaaggatttgaagttttcagcagacaagggacgagtctattccggaagcctgggaacgactgcagaagtacgtggccgcctgtcctcatcatgggatggacgactagctgatcctgcagaacttttacaatggactcaccccggtgtcccacgatcacctggacgcggcagctggaggaactttcttctctaaaaaaggttcaaggagccgttgatctaatagagaagatggtctccaacatgggttggagcgtggaacgactccaaacccgtcagcgaggcatgcataccatcaaggagacggatttgcttgctgccaagctagacctcatgaagcgattggatgaccacaacaaaaggccacaaggcaccgtcaaggccttggactggcacattacgtgtgaggtctgcggcggcacgggtcactgtcacgcccagaaatttagcccaaatttccagactattttgtgtattaaatccctgtccaggaccagccagggcacacaaaacgacaagtaatatacagttccaaacgtaaataaagcgtaaatacttacaaaagaggcacttagtcctcacaccgaaagagaacgacagcagcggaaaaaggcgatcctagcggggcttcagctctactccacaggcaaaacacaactggggtctgagccttggtcttataacttcgtcttcaactcagaagcactacacttctgaaaaagggggaataatagcaaggctgagtacaaccaccgtactcagcaagccacaccaacgatgcagacgtgcaatgggatacaaggatggcttgtggctatttgcataaaggcgattgtaaaacattttattgagcaaaacggtaaaactattgagtaattaaagtaatattaaatctccactgatcaacgctacaccacgttgaacaggcccaaccaacccacctgaactacggtgcattgggtcgatttattaagtgtgagactaatcacagtgattctggtagatcgcccataaccgcgggcacggctattcgaatagttttactctggccagaggtgcacaactgtacccacaagacacaatccaccggcatgttaccgtgcccggccggacacgtcaccatgtcgagtgattgtgacaagacccttcatatgactcgctctaaccaagcacaccacacctcaggtttcacccccgcccccagcaggcagcgggcagtcccctctcgtgcctaggtgaatccggaagcgacagaggccgtcgcagggcccgccccgctccatcacgcccacccttgcctggatgcgtcagccagagaaaagctatgctttaagtcaggcagttacccattcccgcttgtggcaagcgctgtatgtcttctagtgcatcccgcgaaccggtccttaatcgccatgggtgcgaccagcaaaaccattcacccacagcccaccattcagtcgtattttagttggataattacgaccatgaaaca

SEQ ID NO: 6134 - DNA, 1501 bp, Oryza sativa
ctatgccccttttaaggtgtgctttgacctacttttacaagatatggctgttaacaaccccccccctccgtcccaaaatatagctacttctggtatttaaattttgtcgcaaaatgtagtaacttatgcacctagtcccatctcaaccaactacagccatctctcatttaatattctccatctatctcctcatctcaaccaatcacaacaatccgtcatttgatttcacctctctctccttaatcgcggtgaaaaactccataagtgcttatattttggaacaaaaggagtagaaaattttaaaagttaaaagtgtaatttgttgtacatttagataactaaaggtgacatccattttctctaaatgttcgaatttgtgtatattattaataactagcaaaatgcccaagctttgctatgggcagaagaaaaataatcataatatgtcatagaaaaatatttgtttatcaaatatcttagtatcacttgtttgcttttatgattatctggtattcacttgtttgaactgaatgttggactattccacaatattagaaaatatcagggggacaatttgtaaaaaactgcaaaagcaatagtgggggtgggcagattcactgccaccactagaggcttttaaaggaatatagatgtgtatttgtcatttatttacaaagtccgcaatcctttactctgtttctatagcatgcaactattccaaagctgtggacaatacattgccaaacagaagtacataatgtaaaaccaaaaaaaagaacttgattactgcagtaaagagtgggacattttatcaccatccgtaagagtggcaaataattaattattccgtaaagggtgtcctagagccctaagcacatacacggccacggcacggtagtcgggtactatatttcattgttatacgaaagatgaagcactggtccacaacctaaaggacgaaacatgcatatggaagcaatctcaaatcaaagagctggcgcttagcttataatcaatatacaacgacgaaatgtttggaaagacagaaaagcctttccaatgcgcacggtgaacctgaactgaagcttccaaatccttagcctcatatgtgaggaactgagaatagcatatagtcaagtaggagtagcatcgtaaagtgaaaacagtcagctccaataatcaaaacccaaaacagcaattaacacaaatcagtgcaacgaaggtgagtcgaccatttgagaaaagagcacatggatttggattcgcgtacgcaattactgatccagctcgcgttctaccaacttttggtgcgttgattagtatgtttcgagtatttgaccagcggtgcaaaaccacatggcggattgtcgtgcggggcatttccacaagcacctcgctggcggctgcgcgagatgccaaccaccacacggccacagccacagggcacgaagtgaatcccattctatccctagaaggcgtggtctcacgcacagaagggtaa

SEQ ID NO: 6135 - DNA, 642 bp, Oryza sativa
agtagtttgggacatatcaactaataatgttatcttgagtttgtgttgttttgatttaaatagtcacgttggttcggaagaagaaagcaaccaaatcgcttaatattgttaccatgcaccaatacaactgcaccatgcgagaacttagcttctaagagcatacccaggagctcatccatatttgatcctccaaatgcccatatggattatcatccaaaaaagataaaagattcctcattcatatccctttcactccaacagatcattcatatcacaccatcctatattggggtaatattctccaactaaccttacatttgtacttttaagggatatattttgaacgactaaattttgacggtgttatttatcgcgataatatttcaaaatgagtaaattttaacggatatatttttaatgggtaattttttaattgatatatttgaattgagtgaagcatttttttatgtgtgcaacggcaacatttcgaacggctacatttccaacggctagctagctcattcaaattatccaacggctagcacatgcaacatgtaaagttcagctctatacataccgctacattacttgctatctttttgctccatccacattattgtgcatagttcttccatcactcaa

SEQ ID NO: 6136 - DNA, 1284 bp, Oryza sativa
ctctctcatcaacttacaactaaattttggagacaaaaaaagtgtgcaaaacatagctccaaatgtaatatggcaaaaaaaaacattagaggatgaagttgcaaaccttttaggcaccttcgatttgtatgtaatcaccaaaataaattcactagaaattttggcatgacctctcctcttttttgaagaaattttgaagcttgcttgggcagctagaggaggaagaagacatatatataggggtgggactttagtcccgggtggtaacaccaaccgggactaaatatcccggggggcctgacaggccctgacagcatttgaaccgggactaaagatgatctttagttccggttggtgttgatcaaatatgcccgttaccctttttaaccgggactaaagatcatctttagccccggtttttattgcatccgggactattgtggaattcagccgaccgacaaaagatggtttctccatcagtgaagacacaatgtgtgtatgataggtgggaccatatattaatagtatagtaagcaactattactctctccggttccatattaattgacgttttagacaaggttgatgtcaaatttttataacttagactatcaataactttaaaaatatttagtttaaaggaactagaacaacatatatatatatatagatttgtcttttaaagtactataacaaaagtaaacatgcatttatttattatatattataatagaaaaataaggtcaaatatgtatcttgtagaccgtgtcattgtccaaaacgtcaattaaaatgaaaccggagggagtatgtgaattggctataaatgaattggagctagtagtggactatactattaacctggctcaaatgccaaaattggcctgttcagtttcctcgtagctaaactcttggggtcaaaaaaaaaaaagtcctgttcctgatgagagagtgagacgtacaagcaaaatcaagggagaaattatattagcttgcatgccgtccctttgtggctgatccgacattcgaggggggcgcctcttccaggatccgccttctccggctacgcgcctctcccaacgaacgccaacccagacaggctgcctgttcgtcccccaccacccattccgattccaccgcgcgcgcacgccatgagcgagccggccaccaccacccccacccccacccccgccggagaccacgacgcagccgccaccgcatgcaagcctgcggagacgaccacggccctgatcacctgcaggagcagcagctgcagcgcccagc

SEQ ID NO: 6137 - DNA, 1501 bp, Oryza sativa
ttttatattataagacgctttgactttaaactgttttaaatctgactaagtttatagacaaatatagtaatatttataatactaaattagtttcattaaatcaataattgaatatattttcataataaatttgtcttgggttaaaaatgttagtattactttttttctataaacttggttaaatttaaaacagtttaactttgatcaaagttaaagcgtattataacctgaaagagaggtagtaatgttcatcctccctgtgttgttggagttggacgttggtctcaatcatctgatggtgaggtgctggatccattgctggatcgatcgttgattcagtgcattgctgatccgtcaatcttcgtactcccaaatataaaattcagcgcattgctggcaaattattgagttttccctctgtcttcaactttaagtttattggtattctagaattaataagtgctggacaactgatataggcaatcatgcatactcgcctttcatgaactcggtcttaatagccggaaatattggatgagaatttgtcttgtcagatctgtccagctaaaattccagaacatttttttttcatttttggatgaggccaatagttcctcactacgaatagtttggaacatttcagatctgtccagctaatagttgctcactaagaatctattatctattatatatatatatggtaaataaaagttcattaaaaatcctatagacgctcttaagcctgatgttgcattctataaactcctaaaccgccacgtgacagcggcggcggcgcccccttctccttgtagcggcagcggccccttctcccgaaagcagcggcggctacaaggaggcagcggcggaggcccccttctccttgcagcggcaacggccccttctcccggcagtggcggcagcccccttcgccggtagcggcggtggtcccctcatacagatccggggaggaagcgagaggaggcggtgctatgcgcgggtaatttttcctcctgtggttgaatcggtgatgaatgtcgtgtgagattgatatgatcgggaggggaggagaagcgaagcgagcgctcaggaggaggggcgttgcggcgctagcttttttccgcatctgattattttcgttcttttttttttcgcatccgcttttttccgccgtaacagatggacatagagatagtgatagagaagagaagtagcaactctgtgtagttgctttgcacggcccaataactgctgctcggcagctataggcctctagcgcttgctcaagcgcgccagctcgggctcgggccggagagaacggaatgcttcatctcaacaaggcccgcgggcgcatgacctagatcgaacgtcccacacttctccacaccttacgcgaccccgaacctaaaccctctgcgaaacgctcctcctccggacctccgcccaccctcccccaaaacctgacctcgccgacaacacccggcggcggcggcggaggcggaga

SEQ ID NO: 6138 - DNA, 1501 bp, Oryza sativa
gctgccgcaatgacatgcgtcatgggttgggctgggtatactgtgctgcatgggccacgggaacagcccacagagaaagagacagatgggtcgggccaaaatgtgctgcgtgggacacgtgaatagagaattttttttatttatacttttttttattaaaatatttacaaaaataatttgttgttttgaaaatttacaaatctaatcgcctgccgccctttgggagggcgatttttaaaaatcgcccttccacagggcggcaagggacctaaatgtaaattttccagcataacttgttagctctatgattttacaatttaaaattatattatataaagtcagatgaaataaaactttatatcaaaagtgtagagctcaaggagatctacaattttgtagttaataactttttcatttaagatgtccaaatattcgttataaaatataaaacacattttaaaaaatctcagatctacatttcaaacgatattggatggagataaactttatataaaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgcccttggagagggcgatttttaaaaatcgcccttctagagggcggcaggcaattagatttgtaaattttcgaaacaaaaaattatttttgtaaatatttttataaaaaaatgtataaataaaaaaaattccgtgaatagatgggttcgttgcacgcatcttgagcagaaatccaacgggcaagaattcggctgagaatgaaaaaaatttcagcaggcagccgtctagtaattcccatttttttttagcgggttgttttgtgtgccgtagatggaattttgtcttccctaatcggacggctactcgcgtcgggtagggttgtgagtttgtgacgtcgtcccctgcaaaaccacaattctccacacgcagccgccggcgcccgtcgaaatgctggccaggcctgggcggctcgccgcttccacccttcccaacgattccgccgccgccgccgcatccaccgtcctctccatactccgcggcgaggaccccgccagcctccccgcggccggcatcgacccgtgccccgccgtgttccagcaactccgcccgtcgctgcccaccgtcccggactccgcgctcccggcgctggcccgatgggcgggcgaagccaccgccgtctccctcctgacgtcccgcggcctctttgctgccgcctggcgcctcctcctggccccttcccccacgcctcctcccctcgccgccttcgccccgctcgtccgacgctacgcccgcctcggccgcgcccccgccgccctccgcgccttccagttcctccgccgccaccccgaccgctacatggccggcggcgacatccctgccgcggcgtccc

SEQ ID NO: 6139 - DNA, 1501 bp, Oryza sativa
tgagccattaacgcatgattaattgagtattaactattttaaattttaagaatggattaatatgattttttaaaacaacttttctatagaaaattttttaaaaaacgcaccgtttagtagtttcggaagtgtgcgtacagaaaacgaggtgttttctctcccaatcacccaggaacaagagttgataatgttaaaaaggtgaattttggcatgtcgatagcaagtccttggccactataaagaccactcgtggagatggatttttatccctcgagagggcaccctctcattttgtgcatttcatttaaaaaatcatcaacaaattttaaaaagaaatgttaagatagatcaatatatgatatacctttccacaaacatgtaagttaaaattcgacttttacaatttgaaacaaaaataacaaatttaaccacgatttacgcattctgttcattgtcaaatttgttgtttttgtttctaattgtataagttgaaattgaatatgcatgtttctaatttaggatctatatttttttgtctaaatgcaaagcacatcttgatgtaattgtagaagaagttatcttttttaaaaatttgacttatataatttgaaacgaacatgtaagttaaaattcgatttatacaattcaaaacaaaaataacaaatttaaccatgatttacacattctattcattgtcaaatttgttgtttttgtttttaattgtataagttgaatttgaatatgcatgtttacggaatgatatatcacatattgatctatcttactatttttttttcaatttttttgataaccttttaagggacatgtaaaaataaggagatatccctttaaggaatgattagtgtttccctacactcttctcctttgcctatgcatgcacacaacaatgagaaactaatgcgaaatggcaatatgtccccctgaaactggccctcagatgtttctgtcacacctacaaaagcataaactttgataatgtcacatgctcataggcatagcaccggtctaagtggcaattattacaataattttaccatctatgttttcctaataattatcccatcctcaaaagaatatgtgattgtagaagaagttatttttttttaagggaaaacactgtagggaaagcccccacagttaatatattgaaaaaaaataaaaggaaaataattacaacatattaatccaattagtaagtgtatctctctcaaataaattaagcctatggactaaaagggagagatcattcttaaagagaactctctaagaggaaacaaaaagagcaatattatcaaaaattaaaccatttctttacttccatatgttccatatgtagaagaagttatcaagggactacatccagtcagaaccatatccaacacattctaggccgatgtgcaattagtggtgagctttatgtcctaaaagaaaatgatgttctgatttttcctattatatgaatgttcagccacatcatcgg

SEQ ID NO: 6140 - DNA, 1501 bp, Oryza sativa
acttcttctacaattacatcaagatgtgctttgcatttagacaaaaaaatatagatcctaaattagaaacatgcatattcaatttcaacttatacaattagaaacaaaaacaacaaatttgacaatgaacagaatgcgtaaatcgtggttaaatttgttatttttgtttcaaattgtaaaagtcgaattttaacttacatgtttgtggaaaggtatatcatatattgatctatcttaacatttctttttaaaatttgttgatgattttttaaatgaaatgcacaaaatgagagggtgccctctcgagggataaaaatccatctccacgagtggtctttatagtggccaaggacttgctatcgacatgccaaaattcacctttttaacattatcaactcttgttcctgggtgattgggagagaaaacacctcgttttctgtacgcacacttccgaaactactaaacggtgcgttttttaaaaaattttctatagaaaagttgttttaaaaaatcatattaatccattcttaaaatttaaaatagttaatactcaattaatcatgcgttaatggctcaccttattttgcgtatcttctcaatcttctcttttcctctcctctcaaacaatccctccgtggtgtgaaggtaatctcacttgaattagtataggctaccatttacacctgaacattagaaaccggaaatctattgggcaaatacttattttgcgggtgaacatttttttattaaatttcagacttcggtgtgtcctatggtcagaatgcagtaccttttagacttattcattctggattacaaactctggaaaacggttggagatacacagatattacccaacaagaaaaaccaggacattccatttatttctctactcctcctttcatatatatctatgttcgttattcttcaatttctttcatgtagatatttattctaaagcgatgttaatccattaaattatgcatgctacatattaagtcctataccaaactgtggagattatggataccccatatctacatgacagttataatttagtcggatatatggtaccaaatatagatagaatatctctatgaggactcgggttagattctaaacttgtatgtcaagaaaatacccgggatcctagtcggttacgattgtattttatctataatcccatattccgttaggatatggacggtactttgtaaagcgaactccttcccctatataaggagggtccatgtgcctctcggggcgcgattcttttttccaatttatacaatcaataacacactcggcggaatcatccccggacaggagtagggtattacttcttgaataagaagacctgaacatgtataaaatcccttgtctccaaacccatccactttcctagcttgatagccacccccttttattattgtcgaaatcttgcttcgacagttggcgcgccaggtaggggcagcgtcaagtttttgccgactaagtgcga

SEQ ID NO: 6141 - DNA, 1501 bp, Oryza sativa
cggcccagattcggccgaaccgccaaacccttgtgacgccggctccggctggccttacacgtggatgctcttgatcgctccccaatgacggttgcagggcatattggacatttcgcataggctacaaccgtcatacctgcctatttaaggaggagctcatctacacttcaaaacacactctagcaagctcaacatttctctctatagtttagtgtagtattctagtgctaagtggagtagaatagaatagctctcggaatcctcggagtcttcgaaggaattcatgtatggctctagtagcttttctttattcttttgtaagactttcggaattaatggaatattattctttatatactctcggtactttagtttatctaagtatcggctttactttatatatgtatcgctatagttgtgtaactaggctaccagagaggtgtgtgggtttaatgttcgattattcggttgccctatgtcatctcgggggatatagagtactatttaataatgtagatgtggtgtctagattattaaatatcattatctgggcatattatgctgcgggacagtagaggtggatggctgatggtggcagctcagtacgggtattcctccacgttattatatattcctaagaaactctcctggggacggtactcctccgtatttagtcccggttggacggccatgacaggttgtcgtaagaaactcgacaacccgtggtggtctctcgaaacaccagaagggcattgttagggggtattggtcgcacaactgtgtactagcagatgtaaactaagattgagtgtatactataagtatttgaattgattgcttttctatttcttcccccacatagcataggattgtttaacgagagataagagtttttttgattcctgtcactctacccttgtgaatattttaacccctgcttagactctgatctacaagtgacatatatacattattagcatagttctctcttacaatcttcccttgggattaaataaatacgataccttggaatactcccgggtgaaatgctacaatggtatatccgtgcgcttgcgaatttcttctgtaaccatatatataccaggaccatttctggcgccattgctggaaattcatattttagtaatgtcattatgaaataccaacacacgcatgcgaagtgatctatgcaaaggcgatggatgaaaagtgtcatgaacaaaaaaaaacaagcttgttaagtaggtaaaagataagatgtgattggttgtattcataattcaagatagtgttgacgtaaaacacgaggcctgagagatctgcttaactccagtgcatgtccaaaactcgccttcgggtatgcaagcaacaagaaacaaagacaaagaaaccgcggttaaacctataaacgatagccgatcggctaagggccgatgacatatcatttatctttgacccgatatcatatatgtatcgatcggcagccttgaataaataagaa

SEQ ID NO: 6142 - DNA, 322 bp, Oryza sativa
ccaatcactgtcctacgctacaccacgttgcaataggcccaaccaaccacctgaactacaccagttcattaagctaatctaggggtgagactaatcatggtgaatctggttgatcgcccataaccgcgggcacgactattcgaatagttttactcttgtcagaggtgtacaactgtacccacaagacacgattccacacatgtcaccatgccccgaagtatcaccatgatactacaaagggggaaatcgtgcaagaccctccgcataaccctcccctaaccatccacaccacgctaaggtttcacccccacccctcaaaagg

SEQ ID NO: 6143 - DNA, 401 bp, Oryza sativa
cctgcagcccttgtagagggacgcagcttgttgcttgaggacgatggtgctgctgctcgagttgacggtgcagcagcgttagaagatgtccaagagctagcacgacctgcagaaatgttagtcctgaagctagctcttcgtccctgtacttccctttcagctttacaagcaagatgaaacaaacgattaattgaattatattctttgtaggctagaatgtcctgaatttctcggttcagcccacccatgaatctagccataccagcatcatcattttctaccaatcacaacgaagcattcctgtttgcaaagcttgataatactcctctacagatttgtttccctgtctaagttgttgcaatttgtgcagcaaatcacgtgcatgatatgaaggaacaaat

SEQ ID NO: 6144 - DNA, 1501 bp, Oryza sativa
caagaaaaccaagaaacccccccccccccctctctttctccttactcccgacatgggatgcctccgcgcgtcagcccactcccgtgtcaccttggccttcctccccacatcggccaacgagtccgaccttcttcctccacatctataagtacatacaacagtcggtccgaccaggtcgctcacccgcgatgctaataagtggtgcatcccacagcatagtagtcgtctttctccccacgtcgccactactcgtgattccactccaatccacaactcgaaagcatagtcatgaccccaaccatgtgcttcattccctctctaaattcacattcaatttggccttgatttgtcagattgagtaaaattttattggtgccttcaaagctctcctttctgtctctctccatatccaaggggctccggccgtcgtttgccatcgttcgaggcatcgaaggatctcatagcaccaacaaaatcggttggttgccaatagaattctgattacttgtaggagccacctccgtcggcatctttttcgtgccctcgtcttcgatacgtaggacatcaacgccacccgaagatctaaggaaagacatcatccacacctacccgaagtgcgtcaccacttcaagctctgttccgctgccatcgactttccattattctcaccgtgcccacgggtgagctccctgtaaaatcaaagtgttttttattcttattctgtgatgaacaattggcatatgagattattggttttgatatttagagattatcggcgaagtggttttggagatgattggattttacaggtgatttacaggtactgctgtgatttgggtccggtcagaccgggaagtggttgccggtcagaccggcgtgtatcgcgcggtcagaccggccagctcgcgtcgggctggccaactctgtgtcggttttggtttcgggttgtttgtttggatattcgtgattgttttatgttggcttctagatggatactatgcgtatgtaatactgttgtttgctaacaatgagtcaagttgaagatagcttggtctcggaatatggtttctttgtttgattcatgtgtaggtgacttgatgcctcggtagagtattgccggtgatggatcgggagtcgacttggggataaggcgacgtccgtgacggtcagatatcatgcgagatacttaggctagagttcaatgtacgtggttggtgatgatccatatggcatacgatggaggtattgtgtgcgtattggatgcggagtcgaatttggtaggagtccaaatttggtatgattggagtttgtaaagtttgtttcttgtacgggaagatttactagttggattaggacttctagtatgagttgggttcgtggctttaggctacctacctcatatataatagagagggagcgtgaagcctgtatcgttttttaaagcgattgagttgtaagtttagctagggtttcgagttttgtcaagattttcgtgaggagt

SEQ ID NO: 6145 - DNA, 1501 bp, Oryza sativa
tgcaggtgtgagagacatactgtatttctgaagctgaagcagctgcaggctgcagcctggccacgcccagagccacagctagagctagctataggcgtgtttgtactgtttgcactgcacccctatgccacatgggtgtgttcctggttccgggaatttccttccgaatcgaggaacggggactacctggaacttctgtctcgaaaatagatgggtcgttattatgctacagaacttagaaataggattgctgctaattgtataatttgaataggagtgctagaactagggagcaaggaggagaaaggttagggcaaataagctcatgattatgggtgtgtttagttctttgggtgtaaagtttttgaagtatacggacgcacatttaaagtattaaatatagactaataacaaaacaaattacatattctgcctgtaaactgcgagacgaatttattaagcttaattaatccgtcattatcaaatatttactgtagcttcgcaatgtcaaatcatggcgtaattaggctcaaaacattcgtctcgcaatttacatgcaaactgtgcgattgttttttttcccacatttaatgccccatgcatgtgtccaaacatttgatgtgacgtttttggtaaaaaaaaattaggatctaaaccaggcctatttatagtactgttgtttagttttggtggcatatttaaaatttgagtttcaaactgtcatgtttgtaagtggcgtcaataatgcggatacggtagaatatatgcttttgtaaactcattaatgttaacttggtcagatgttttaagttcattcccaacctaccaaaagcaacagtatattctccaaataagtacattaattagttcattgaatgtgccaatgtgtacttccagatgtctatagatgcacttttttctcttccttaatgagtgctaaattagaaataatcccctatatggatagggagagtaagaatctccatgctcggatgctcttatccctgtaaaatcaaagatgtttttgattatttttctgtgatgaacaattggcattgaagattatcggttttattatttggaatttatttatgaagtggttttggagatgattggatttacagatgaattgcaggtgttgttattttatgtggaccggtcagaccgggcagtggttgccggtcagaccggcgtgtattgcgcggtctgaccggacgacactatgtcggtttcggtttcggattgtttgtttggatatccgtgattatttcatgattatgtcttctagatggatactatgcgtatgtaatactgttgtttgctaatattgagtcaagttggagatagcttggtctcggaatatggtttctttgtttgttccatgtgtaggtaactcgatgtctcgagagagtatttgcggtgatggaccgggagtcggcttggggataagacgacgtccgtggtggtcagatatcatgcgggatacttaggctagagttga

SEQ ID NO: 6146 - DNA, 1501 bp, Oryza sativa
tctcatccttctgggctgggttataacggtagggatgaagattgactcatgaaggagctgagaaatttcggctggtatttcaagagaggaatctgaatcttctagaggacataactcaacagtctacaaaaccgcatcatgattcattaagccctgcacctgaacaaccgaaagttcagagcatttctgagtattagcaaccacacccttcagacagacattctgttgttgatactgaaattgcaaaatcttgcttcgctagtcaatctgcattgggctatggtcaaccaaccaatccatgccgagaattatgtcataacttcccagaggcagcaccttgaaattggattgaaaggagaaaccctgcacccaccaaaggcaatttgtcaactcccttgagcagtgcagtatacccccatccgcaatcctgacttgaatagcaggaacaacacgcagcttacagttcaacttgccagccagcttttcagacataaaactatgcgtgctgccagagttcactaacatgagaatttcttactgctgaataagtccttgcaatcgaagcgtacagacagatttcgtaccaatcatagcatcacgagaaatctgacagacttcgccttgaggttcagactcagacccaatgtcagtagttggttcaataatctcaggcataccatcagcagcagaatcagctaacaattccaaaagctcttccacaatatgcaactgaacagtaggtccacacttgtgatcgcgactccaccgttccccacatgtatggcataatccctttgctttgcgataagctctcagggcagctaccttatcttccactggcagtgtccgttcatcagctcggccaccaccaaatgtcttggaagcaaacgacggtgtagcagaacgggccgtagctcggtaactcgtcatagcctcctatcgagcagattccagtacttcctcctacaggcaagcgagatccacagcagtatccatgtccgtgggacggtgtaaaagaatagcaccatgaatatttgcccgcaacccatctatgaattgagtaaaaaaaacatggaatcccaagaggaatgatgagcgtgaaactggtgcattaactcattaaacctctccgcataactaagctaagcaccgaacatgtctgcttgagcctgttaaattgacgcactaagccctggaactcatctctcccaaattttgcacacactagctcagaaaactcactccaatccataaattcaacatgagcatttgtggattgaagccaagtcaaagcccccccccccccccccggaaaattgcaaagaagcaacacctacccacacttcagagcaaattccactcacacggaaataggtttcgcacttcattttccaggctctagggttctccccatcaaactgtggacaatctacccgagcgtttcctccgtgaaaccccgcagtaaaaccccgattcgaaccctctccaaattccagagaaa

SEQ ID NO: 6147 - DNA, 1501 bp, Oryza sativa
  unsure (1)..(1501): unsure at all n locations
cgagcccggcggcggagtcgccggccttggtggcgcggtcgaggaactccggcgggagcagcggccacgagtcctcccggagtgaccagaggaatggcgcgccgctggcctcgagccccgcggccagctcgcggagctcgtccggcggcggcgcggcgaccgtgccgaagctgacgtacgcgacggagcccgcggggcggcgcgcgagccacgcgaggcagccggggggtcgtcgtcgttggcttgcgtggcggcggcgccggggaggaggtggtaggggccgatggggaggcagttggggagcgcgtcggcgagggcggcggagacgtccggcgggaagaggcccgggaacgcgttgatcgcgacggcggtggcggcgcgtggcanccgccgcgccacgcggccgaggagcatggtcatgacgcggtgcatgtcgccgccgacgccgccgccgccgaaggggaggtcgcggacgcggtanctcccgaggccagggtaggaggtgagcagctcgtcgccgcgagcaccgtggaggtcgtcgtcgtcaccgatgtcctcccggatcgcgtcgccgacgatgtgcgccaggagcgcgcacgggccacccgtccagacggcgacccagggcaccccaacctcggcggccatggacatgaacgcgtccccgaccacgcagctcaccgccaccccgccagccgcgtcgccggccgcctccatcgcccgcctgagcccgccaccctccgcagcctcgacgaacatctccatccggcgccacaccggccacgtctcctcctgatcaccatccgtgggcacctccacgaaccgcaggttgttgttcccggcggggacgacggcggtggcggggaggcgcgcgagggagtcggcggtggagaggaaggagaaggtggcggagggcgccgccgtggcgagggcgcgcgcgacggcgaggagcttgggggcgtgggagctgaaggggaaagccaccacggcgacgtgcgggtgcgatggcgacgacggcatcgtgcgatcgttcttgcggaaataggcaaggtgacgaagtgatatcgttgtcttcagtcttctttcgcgtctcatccatcagactatatatattgccacgggaagcgacttctacgactggatttttcactttgggtcccttgtgaaaacttatttagcaagcaaggccctaaacaagtttattccgtgattggatcctttcgctgcgccaacgccattggctcagcgtctccgaaaaagctaattcacttatacgaaggtgatggtgccaatgtcattagtaccgatgagttatttataaaattattttgaagaaggacttatttgaaataaattccaacccgtcgggtagatattacatactgtgcaatgtttttttatttagaaatgcggtacaaacataagtgctaatgacacgtgtgcactcattcctatgaacccacacatacatccttctgctatgagtatcttgaaaaaattg

SEQ ID NO: 6148 - DNA, 1501 bp, Oryza sativa
tactttagttgcagaagctagctttacaaattttaacagtttgaccttttgtaaaaactaattttataaataaatcacgacaaaaacttatttcataaatgatccttttgttcagcgtcaaatcgtatagcactgaacttagaaacctcagcgccacgtcaactggtgttaaatgccatgctactgcggatgggagactgagttggcgtgccgacgtgcattcagcgccgtgctatttggcgctgaggtgtctaagttcagcaccatacgatttagcgctgaacaaaagggtcatttttaaaataagttttggccacgattcatttataaaattagtttctgtaaagggtcaaattgtcaaaatttgtgagctagcttggcttcactatcatcgagaaacgataagtctaatgtgtactccctctagtcgtagatatatttgacacttctaatcaaacttttgaaattctgattataaaaaggtttcttaaatgacaaaaactggtctcaatatgtagagatttgtctaaaaaaatattatactaataacatagatattaaagcttattgaattttatgaacttaaattaatataaattgattgctagaatttgaaaagtttaaacaaattttatcctagatgtcaaatatattttcaccgaaaggatagcaaattttacagtggtcttcataaaatcgtcaatttgaggaaatctataacttgtggaggagcgcgggaaagctattttgccatttgaccttgtgatatatatttttaaataaatccaagatagtctatatatggtactcctatatcacgctacataaatatacaaactaaatttgacttgtataaataaaaaaacaacaaattgaactttgcatgatagtactagattttcaccatagtactagctagatttaacacaaatgttcgtatttagaactaattattatttcaatagtaggcaatatactcgtcaacagcgagatgtctgtaatgaatttattaatttcaatatatactagctcaattttttcaagatactcatagcagaaggatgtatgtgtgggttcataggaatgagtgcacacgtgtcattagcacttatgtttgtaccgcatttctaaataaaaaaacattgcacagtatgtaatatctacccgacgggttggaatttatttcaaataagtccttcttcaaaataattttataaataactcatcggtactaatgacattggcaccatcaccttcgtataagtgaattagctttttcggagacgctgagccaatggcgttggcgcagcgaaaggatccaatcacggaataaacttgtttagggccttgcttgctaaataagttttcacaagggacccaaagtgaaaaatccagtcgtagaagtcgcttcccgtggcaatatatatagtctgatggatgagacgcgaaagaagactgaagacaacgatatcacttcgtcaccttgcctatttccgcaaga

SEQ ID NO: 6149 - DNA, 558 bp, Oryza sativa
tcaaattaaaaaaggaaaaaaagaggacagagtttcattatcaacaaaagtactgtgtcgtggttaattgatggcaaaaaaaatagttttaggaaatttgtggttattgcacatatacagtccaatactccacgtcacatgcaccctgaaagtctgaagattaaatgcaactcttttattcattttgctaactgcactctgttgtgctttagtgcaggctatgaatcagtttggtgagaattgtgatattccacgcagaaaaggactggcagttagtagcagtgtagcacaaagccacatactttaacctgtacagttcatgtgacatgtactctgtcaaaaaaaaaaaaagagagagacaagaatcaattttggagagaagtttttgaagcaggacatgaatagtgcatggctatttatattgccgtgcatgaatagtagtattggtcaaattgatcacaggatagccattttatctgtttgttacaactgatacaatattataaactatatacgagataagattcaatttgttttgcaccctccttcaatctcaga

SEQ ID NO: 6150 - DNA, 676 bp, Oryza sativa
agttcttaagcctccctagttgcattgaagtcagtctctgtttctattggagtgtataaattcgtaggaagaaaatatgttgcgtcacatgcataggaaaatacatggatatgaagtcctctatatgacagctttgctgatttagatccatggaaatcatttaggtaaaaacctcgaaatttagtttaaggtggaacagaaatttcggtatatatagagattaatatgctggactttgaagatatggcttcaaaaagaaattatgttcccttgattgcagaaaccttttttctgatgcagtaaatgatgattatatatataatgcagtaaatgatgatgtgttgttaactcgtaatcttaacaagcgcttaacatcttagtgatgttctttttttttcggaagaagggcaggtgggccctcttaggctcttattaaagagaaggaataaaagcaaaagttctaccagtccaacatcttattgatgatcattttaaaaaaccctgaactttttataagcaaccttgcttcccacttttttttttctcaaatattccgaaatacaacgaaccatttcagaaacccagcatctttgtgtgttcttgttcctaatgtttcataatgaccatgcatggatgtgtggctataactattctttgtgtggttgattcgtgatga

SEQ ID NO: 6151 - DNA, 500 bp, Oryza sativa
tgagtagatggctaattcgctatggagcaaaataatactggaagactggaggttaccttttgttgtttgcatgtaatgatatatgtgacacagaagacctcaagaaaagtttctatgtacggataagggctatggcttataaacatgttcatgttttttttccggtttgcaaattggtattctaacctggaccaggaacctaccatgagttttaatattaacataattgttttgcattggaataatgaatgttatgcaaacattatgcagtctcctgaaatgaatcatccgataataccaaagtaaatgaagcagcaccgcatttatagagaaaaaaatgttttccctaagtagtcctacacttccagttgtaagaaggattcaaactaaagaaaaaccacccttccatttgtattcatgctttaaaattgtaaaattttatcttatattcttttctttttaccaatgctttcatacagtttggggatagacggtggaga

SEQ ID NO: 6152 - DNA, 514 bp, Oryza sativa
gaaaacaataactgcgttaacctcgcatttctgtactacgccctaagttacattctctacaatattgttctctaaatttctaaaagtaggttacattctccagatcaaactaaactacatcttacaattaacactattgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctttcgtttttttggatttttagtgaatataatgaaatttcacaggggaggggctgggctttataggggggaggcaaaaatcgccctcccccagggcggcaagggggccgcctgcaaaattccatgccccctcgccgcccatttgcagg

SEQ ID NO: 6153 - DNA, 1501 bp, Oryza sativa
aaaaacaaatgaattcacaggtaatagcagctaaacctctcaaatgtaataccagcaaaaccgtttaagaaataccagcgaatccttagaagcacctcaaataccaccatactttttatttttcgtgacgtgaaatggttacgttgttgcaaacaaagcatattattttgtctatagtatgaaaatcttgccccagcgatctctataaatactgagaacctctagaaagtactccaaactatcatcagccatcactttcccccaccttatcaatctgccctcctgaccctagaggtgaccatcatggctcttgaggtaattatgtgatctgatttttaatttctactttgtttcgctttcgctctcatggattagtgatgtgtgtagtgttattcatacatccacgcctttttcctttcttgaatcagacaccctaagtccgatttggattccgaccctctttcaaactctaagtagtatttccccttataaaatttcttttatgggataggacatgagaaatttgagtccaattcttaacatgtgtccatgtccttagccggatttggattctaactccctttcgaattccaagtagtatttccatgtataatttcttctatgtgatagggggtatgacattacaaatccgactcgaattcagaacaagtttccatgtccaggtgacacagatcaagagtgttgatgccgtctgttctgatcattcatgtcaactaataatcatcacttccttaacatgtaacttatccaaatcataggaggcagagtggccatgatagggattttttatgaggtccctcttggcattagtcctatgatatgcacgttcttcattggtagcacaacttacttgtgtcagtgagacattagcgagcggcaaatcgtgtcgtaaaatgttttgagtgtcatatcctagaaccctaccatggttacatgggcgaaataccttatattataagaccgacacacacaaacacacacgcacgcgcgtgcgtacatatattagctatgatgtattagctacataagagggggggggagggggttctctaggagccgtgatatactgtataacaacaatatagaattgaacaccctatttatacttatatctttgattgaggagagttattgcaaggaagaaaatgcactatttcaacaaattattctctactaggtttccctggatagcttccatatacatcataaactttatgttctacttcaattttcttttctgaaatataactaatatttttcttctaagttctccttccagtcaaacttaatagtttagttttcccaatgtcaaatattttttcctggagtagttttgaacaaaatgttggattttttatatttgcttgtagaattgtgaagatatttggttactttatttcatagaagcacacatatttgtaactagcatccctttgtttatttaaagtacttaaatttcatgttttcaatgtttactgaa

SEQ ID NO: 6154 - DNA, 1501 bp, Oryza sativa
tcgccgccacttccgcctcctccgccgccgccgcatctttggggtgagagccgccgccgcctctcccttcatcgatctccgatctcgatctctctctccgtcgtgccgcccgccacgagacgccgtgccacaacgacaccgcgccacgccgacgccgcgccacgccgccgccttcgccgccgcgcgcgcaaccccgccgcctccacgccacgccgccgcgcaacgccgccgccgcatgcaacgccacgccgccgccgtcgtcgccacgccgccgccgccgccaccgccgccacgccgccgcgccaagcgccggaccgatgccgccacaccgccgttaacgaacacgtgaacgagaacgaacacgtcaatatacgttgccgcgagaacgtgaacgagaacgagaacgatcgaacgaaggagagcgagaacgagaacgatcgaacgaattaacgtgaacgagaacgacaacgaacgtgtacgagaacgaacgtgaatgagaacgagcgaatgaatgtgaacgtgaaatgcaatatatatatatgttacttcgcatttatcctaatacatattttttgtatcttgcagaaaagacgtgttgtcggagtcgtccctcaagccggagtgaagagctagccctagaaggtattcgtgcaggcaagtgacgtaataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgatttttaatataagattattttatttgtaattagacttagtatataattactgactacggaattggtgcgactcctagcaattgacaatttttgtcttaattagacttagcatatacgacagttacacttagcatacatgactctttcagtcttagcatgtaatattatttgagttttaatataagattactttatttgtaattagaattagtacgtaattattgactacggaattggtgcgactcctagcaattgactattgtagtcttaattagacttagcatatacgcacgaaacacttagcatatacatgactattttagtcttagcatgtaatattatttgagttttaatataatattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtt

SEQ ID NO: 6155 - DNA, 1501 bp, Oryza sativa
ataaaataataaatatataccacttcatatagcggtagtaggagtacagtacatagtatagattaaaaaaacgagaaattctatgagtaaattggggttgatgttgaaggacaaaaacaagagagagagagaggtttggactcacgcaattcgcccagacccctctgaaactgaaagccaaagccctccagttggacgcatccgggggtacgatccccccgtgggacccaccgccccctgacagccgtcagatgcccaacagagcgctcagattccctcggaacgcgagcccccccctccccttcactcgcgtaccgctgacgtcaacgcccccactgctcacgtggggccccactacccgctgacgcgatccactggtcgacggtgcgccgcgctgccgcttttcaccttgcccctctgttttcttctaattaaccatatttactttttttacttcatgggctcactgccacccaaatggagaaaatggaaatgcagcgtgattcatcacccagtcagtacagtgattttttttaaaaaaaaaattccaacgcaatgcagtgcttttcctaatcaccaccacttagttagttgtactcgttttagcttgatcatggcagtagtgctccctccgttattgaagtagataatgacgatgtttaagtttataccttggatgctggtcttgttttactgaaattacttgcaagtatgttatatcatcgaaatgtgtaacgtcttatatataaccatacaactcgtaattacttaggagtatttattgagagtggaggaaataatagtgcaggtattattgagtctttgcgggttatcagaccaatcctgagcctagttaggtttaggttgatatcaattctaagctatattctctttctctaaaattcaaccaattcatacatatctaacaatatgtttacaaaaggaaactcttgatgcacttgttttcttttttttgcctaacccattacacaaaaagcctgtgttatcacgatattattgatatccatgttttaattcttccattcctccaacgcattgtggtctattatcttagttatagctaccattgctgttatgggtcatgttttgccatgctacaaatgtcaacatcgacaaagcatgtggccacgaagaaagataaaccatcttttctcaatatttatcaattttaaatactagcacatacaaaaatatattttaaaacttgcaatgagcttagcacaatttaacaaaaaaaaattgaaaacatacataagtctataatatacattatatatgtatatatcgagatatataagtctattcatggtcaggttaaaaaaatcttaagaaaatcaagaaaaataggaaaatctttcatattctctcttatcacttgcacaaagtagaggtttttttatttttaggctattgacctttcacatgcttagaatggtttgaaaaattagagacttttttcttctattggctgatcttatca

SEQ ID NO: 6156 - DNA, 1501 bp, Oryza sativa
gtgtatatatttatagaggtgagtgtacgcgcgttgtgagcgtcttgcatttgtactgtgttttttaaaaaaaatatttaaaaatcgagaaaatagaagcattctccgccgttgataaattcttccttggaaagacctcgtaacacttccttggaagcgttggcacacaaggtaggtaagcttagctttgagtctttgacaacccaagatcgatcacgaggcaaccgtccaacgtccagtcgtgggggccaacttcttctgatcgaccgtgtggctattttcgtcatttttctaatccgccgttggcctaatttgacaaggaattaaaaaatggatctcacactagagaatgaaataaatgaaattaaaggaggagaaacctcacagatacgccaccgaccaagcatcacaggctggaattccccgaaatgccccctccctcctcttctctgctgccatccacgagttggatgagttgtgaaaccgtgtaccagcacggaatcacgaggccataagctgccattaattaatactatattccaaattaaaactagcccctcgtatataagagcgagtttaatattatagccaactactaactttaaatcatttatatttaatttaatagccgatttatacaataattactacaaatatataatacactattaatacttgatcccatctgtcatacacatatcgtgtcttaagatccgtaatagagctagttataaatttttttaaaatatatttatagctgtcttatcgtttgcaattatgagtacttctctaatgccacagccacaaacgctgctgctctttccttctacaccgggtgttattctaccccaccgctcaccgacatggtggggcccacctaatgatccaagcctggtggggcccgcctatgatctaagcctaacggcgccctgggtcgttgggggcggtgacggtgaccgcgcgtttccagttttccgtggggtgtcgcgggccccaccgcgggtgcgtacccacgaacagcgggtgtaccactagaaaacaaaataaaagaaaaacggcaaatggttttatatttttcttttctccctctaccttatgacctgctaaatctggtttacccaatgagttggcgccacgttggatgcaaaaataaaatctacaggtgtcttagcggatccgggtttttgcgtggcttcgcgggtccaggctccgaactttctttctacagccacacaacacacagcacctactcctagcttgtccccaagaagtaagcttacccaccacatacaaggacaaacggtgtatacatgaattctgaattctgtactctgtatttcgtaaaggggaaaagttacatctttttatactttttgcacgcttaatactaatctttataaaaaaatatgttacgaagtgccgtaccttaaaccaagcgatcgtcgattaaataattatagatcaaacaatggtacgaagtgatgctccctcttggctatcc

SEQ ID NO: 6157 - DNA, 713 bp, Oryza sativa
gccccctcccccctcacctcctcctccaccgccgcccctccctctccctctctgctccctctcccaaccggcgagcagtgtcgcccacgtcgggcggcctccccacgagcgattctccctctccgtcaacctcccaccggcggcatgtgtcacgaccggaaaaataccttttcccaatcgctagtccattgatccccgtcccaggaaaagtcaggtacacataaaaaatcatgatacaaaagacatctttaaagcgataatatttacatatgcttgattggttactaaacagccaccaagtatgatagcatcaagattggtgtcccttagaattttgttggccgcttgcatggttagccgatgcttccatttataatcattatgggtatcttccttactcactgttacatcctttataggacgcatatgtcctttcatggttaagataggtgtagtcactaggactgaaagtcttgcaacttgttcaatgtctttaaccagagataggctagttgattaacttctctaccaacatctaggtcattaagttcaagttgactatgattcatcataaatgaaactctaaatctgttttggttattatcagttgtagagattgttgtacatttgtatcctcaacatgaatcattcataaacatagcaaactcattctttatatatataaataaactcattctttaggttgatatagg

SEQ ID NO: 6158 - DNA, 901 bp, Oryza sativa
cgttcttcgacaaactacaggttgtgccaacacagacgttgcccattagaatggtgctgttgtggtcatgctggtggttaaggttaccctcatcgatgtcctcttaagttttttttttcttgtgatcaagaaactttaaggagttgggtatatgcgtagttgcagttgatttcgtacaacttggctggtagtatagtcatcattttcttaatgccccttgttcacatcacattcttggaacatataactaagctctatggaattattggctactctgttaattaatcctagcaggaaagacttgcatccctttagggatgtcctctcatttttgcatcctatccaaattaacttgtatagaagggctgcgtttgacaaagtaagctagagtgacatactgtgtctatttttagcagtaaagtatccatcgtttgtttgcactctcagcatcatatacttaaaagtaatgacagatggtctaagatatttttcacacattaaatgtacattattaaacagcaggacagacaaagatttgtcacaaggaaggaaagaacaaggacatccaatttgaactttgttttccacgacacatgaaaacagaaactaaaaacaagtgatgacttgcaacaattgggatatggatcctatattcccaaggaaagatgatatatcctaggtagtgcaacatacttatttatagtataatatactattgtctggacctcaacctgtcgttccgtatgtaaatacactgtaaacaagtactatatctagtaatctgcagcagtgacatagctagaaaaatcttaaagcccgggcaaatattactatgttgaatattttctatataatttatattgtcaattcctatcttatataatatcaaatttctacagca

SEQ ID NO: 6159 - DNA, 802 bp, Oryza sativa
cattcatatattagagggtttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcaaaatagcgggaaaagatatttactcccggttggtaataccaaccgggactaaagatcatctttagtcccggttgttctcaacaaccgggagtaaatatcttttctttactcccggttgttctcaacaaccgggactaaagatatctttagtcccggttgttctcaacaaccgggagtaaagatccgggggtatatatattcccggtgcgccctcgtcttcttcaccaacacttagacgttttcggccgatcgatctctctcggcctctctccttcgccgccactgcctagg

SEQ ID NO: 6160 - DNA, 1226 bp, Oryza sativa
atcgtcttcttgctctgcggctgcaggtggtgatgataaggcgagaggaggaggcttgcgcgccgccgccggcaggggagagacgccgccgcagatgtccatgtactcatcggcgacctcgccgtcctcgagtccgcggggcgacgtgcggcgaacggcggcctcgtcgtcgagcatcttcctcagctcgaacagcgcggcgtcttccgtggagccgagatcgatctccagctcgtcgtcgtcgccgtcaacgccgggaaccgcgcgccagctgcaccggcgccgcatgaagtcggcgacgtgcgacgggaggatccccgccggcagcgacgacaggaggccgaccagctgctccttctgggccatggtcatggcctccttgtccttgacgcggcgagggagcgggcggcgcgccgccgcccccgccgccgccttgcgcaccagcgcctccccttcttgaggaggcctcgcaccgcctccatctccgaccggcaccgcttcctgaggagggaaccggagccgccgtggccgcgcggggaggagcggccgatgatctcctccatcgccggggacggtggtggtgacgaagatctcgagagttctcgctcgctctcgcctggtggtggctgagcaagatgcccaagaacgtgtggccggaatgcaggatcgagacaggacaaaagggcgcgcgcgccgatcgttcccgcctttttatggccgatgggctgataccgtctcggagtaagattcgaatcggactctcccaaaaatccgagtaggattggttcggattcggactggacaccaagcctcgcgcgcttgcgtaggatcacaagctagatggcaatgcgagttggcgagttgaagcaaatggatagagtacaaaatgcagaggttgcgttaggagaaatatgcaccatcgctcacaatcttaggcctatgaacaatatccacagtattgagtgtgatcagcgccatgtgcccgggggaatggtccgggcaaccaaggacgagaaaatttcagatgtgacaactgatgaatagcaagcaccacagataagtttattgagcataaattagacggagaagtcctcgcttctatgcaaatgcttgttggatctccattatatgcaatctttatccagctctccaggcagaacaggcacaaaagacagaccatgcaatggtgaagagatggctcaaggccattcatagctaccatggta

SEQ ID NO: 6161 - DNA, 1501 bp, Oryza sativa
ctttcagacatcaggaattcaggatcatccaagatggtcgatttttcttcagaaattcctcccgatggagcatttggtttgtcccagaatagttcatgtgacgatgacaacacgatgcattttactatgcatgagaaaattcgatccatagtatagaaaaaaaaaacggtaccaaagaataacacaagaatttttttttgctttcgatcaacagcacaagccaccggtttttcttcgccccgtagcacttccgtcaggttggagttaacaacgttagatcgaagtatagaaaaattttgttggacccatttgcccttcatcttcctcgccgtaatcaccatcatctcgttctctcgggtcggtgcccacgacgacggcgccggagccgtcaccaaacagccacacggcgacgatccccgtccccagccacgccgctgccatccccatccctagccgcgccgccaccatccctgtctccaagcgcaccgccgagccgaaccgcgccggcaccgcccaccatctgcaacggagaggaggaagacatagaggtgccatcaccaaacagtgacgcaacgacgagggtatcgaggtgggcatcatcgggggcggcgaacgctatgaggaagacctccgcgcaggccacgagcacgcacgcgccgcggttgttctcggcgatgtccttggcgagacggagcgtgctgcagccggtggagcagccgtgcatgtagagggaagcagcggcaagccggcgtggtgcggcgtcgtggcgaggaagaggcagttctccggcggcgagtacggccaccatgggccacatctatccatgccgaagatagggccacccacgtcatcgttgtcgtccttgtcgtcaaacgaccgccggcgtgggtggctcaccctcgatcagcagcgccgagcgccagacggggtccacctcgccgtcggtggcgatggtgagccacgcgtccatgttgttgaagagcgtgcaccgcagccctctcggcggtggcggggagacgaggtggtcactcggcacgctgatggccgccgcaccaccgtccacgcgggagcaaaagaggagacctggtgggggaacaaagggcaaatgagtgcaacgaaaattttctccactcctatctaacgccgttacttcagaatgtgacggaagtgctacgggacaaagaaaaatcggtggcctatgctatagattgaaagtggaaactttttatgttattttttggtaccgctttctttcatgtattatggatcgaattttctctttttaataaggtcaataaccaggataaccaaagcatctgtcatcgagctttgaagccaagggcatctcgcacatgctcatcctctagaaacgccaccgaatcagatccatcagccatgacgtcagcagccgaaagaactttgactcgaactccgaagctactaaagctcaactgacgaggcggcggagcagagcaaaggcaagaagacgccatggccacgg

SEQ ID NO: 6162 - DNA, 1036 bp, Oryza sativa
atatggtcataaaatgagctttctataagccaatttagaaaaacttgcggttcatgcaaaccataccatattcttctttcatgtaagttcagttactccctctttcctattttaaacttagtcatgaatttccatgtcaaattttaatcgttcgtcttatttatttttttcacacgtaaaatactatttatgttttgtcatctaataacaacataaatactaattataaaaaaaaattaaaattagacggacaatcaaagttaaatacgaaaaattatggttatgcttgaaatgcgacggaggaagtacaagttataagaaacagacaaacgcttgatttaaactgtactttccatcttgttaagagcgtcccctgtcaacttctcatcctcccatttgaaaacagagaccagaccacatccgagcgccggtcattatcacgaaaaatttcaaattctaatttcaaatcacatcgaaaacaacaacaaacaacaaaccaacgggttgggaaaagtgcaataaaccaatcaaaagctggtgcgccaccgcaccggcacaccacctgcccttttttggggtatttttttcacctcgccccctacgcttctccgcttttcactttttacccctccccgaaaataaataaacacccctcctcgcagttattcccgcccaccacccgcaacctgtccacgcatttcaaattaccgagccccaccgccgtcactggtaggtgggcccgtgcaccgtgggccccgcgcgtcagcgccgcggaggctgacacgtgtagtacagtcgcctcctacctccctctgcgtcgcgttggcgtctcgctttaaaaactcgcaacgccgtggcctctcgcctcttttggagcaaggccatgtgaagcctctgaccttccgataccttcccctcttccgccgcgtctcgcctccgcctccgcgcgctctcgccgtcgagctcccccgccgcgccgcgtcgcgccgcgcagcgtcgccttgcgggggggaggtggggggagggaagcttcggt

SEQ ID NO: 6163 - DNA, 1501 bp, Oryza sativa
tgcgcgagcgccgcgccgagcgccccctccctttcccctcgctctgcccgcgcgtgcgcaagcgccgcgccgagcgccccttcccctcgctctccttctcctctccctagcaagctccccgctcgcgaagacggcccccgcgcgcgtcgttcgcgcgcgcgcgccgcgtggttccccgcccgagccgcgtcgtctgcgccgtccacgtcgcccggccccgctgctctgccgcgcctgcagccgctcggccccgcgagccagcgcgcgtgcccagccgcgccgcccgttgtttcccgcgcgcgcgtgctgagtggccgaccgcctggtcgccgccgccgtcaccctctgccgcgccagcccgcgcctgtcgcccgtgtcgtcgcgccgctccaaaccgccccgccgtcatcgccgtcgtcatcgcctcggccccgccactcccgcgctagcctccaagggacggaggcagagcctccctcctccctctgccgcgacgcccccgctccctcctccttttcccgaagaggcaaggggacaagcccccttttctctccctcttttcccccttttccctcccgccggcgtcatcctcctccctcctccctgtcgccgctttggccgcgaccgccgagcgctagccctctcctttgaccgccctaagtcggttcccaaaccgacattgccatcctataaacccgagctcccccctttttcctttcctctcccattcacctccgcgccattgccgcccctctgtttcgccgtcgccgttcgtgtcggaagagccgacacgagcaaggacgcggaaggggacttcggccgcgccctctccttcctcttccccggcccgaggccggagagattactcccgcgccgtcggcctctcgtcacagcgccccgacccgcacggtagtgcctctctccattcttcctcctcgctccatctcccccccttagttttcggtggtagcacgagtagcctccccgtagctagccggcgccgccccgaccgttgccgtcgctcgccgtgtgctcgccgccgtcgccgctcgagctccgtagcacccgctcgtcgccagcctcgctcggcgtagctccgcccaatccgacgctaacatcggattcccgtagccgcgtagatgctctcaccgtcgggaatcggcccctcgtgacctcgtcgccgtttccctcttccctccccgccggttgccgccgccgcgattcgccgctgtcaagcttcctccggcgaatccgagccgttggctcgtctcccctcgtctcgtgcaaccacccggtgtgctcgttttcgccggtatcgccgtggttcgctccgccgctcgccgctgttgtccgccgtccgttctggccggcgtcgtcgtctacctcctgccagcccacgtggcagccacgtaggcgccacgtcggcgccagctcagccgaggtcgggacgggccgaccccggtcagcccctcccgtgcgcgcgttccaccgcgagccgtga

SEQ ID NO: 6164 - DNA, 1501 bp, Oryza sativa
tgcccgtcttttcaccgtgacaaagtgcactggacctataggtgtacgcacgttccctgtgacttcctatggattttgagaggtctcaaaaggagagaggacaatcgaaccggtccggtcccatatattgcactatttttgctagctgctccaaaggaaggagtcggcgtcatgcatagtacagtaccaggttgtaaagcagggagaatcttcaggcccacttgccatacacatatttgctgatccatccgtacgataaggatcaattgcgggtttcgtacattggcggactttttatctcctactccatccgtgctaaaaatatatggagttttggttaaagagatacattctaatattatgaatctgaatatgttatctgtttagattcgtagtactagaatataccacattcaaacaaaactttttatattttagaatgaatggagtagttgctagtatgacgtaagtgggtctcaccttaagattccttcaggaattatacagtggacatgctctagtggctaaattgatccgtcatgttgccatttcaggggaaaaaacactgctataggtacttaaaaaaataaagtttcttgaaaaactatcttataaagctcttgtagataattagaacaagttatccatcttttgatttaataagataaaaattacagaaaatttagatttaacatagcatgctacatcagtatttgtaagagttttgagattctttttaaggctgcgttcgatcgaccgttttgaaggcagaattttaaggcacataaaacgagaaaccttattatcacataattaattaagcattaataattataaacttgaaaatatatttatttaaattttttaaacaatttctgtacataaacttttttaaaaaacgtgctatttaacagtttaaaaaatatactaacaaaaaagggagaaagttgaagtttggagttgagaaaaagaaatgagcctaagaacagcttgtttctactcgaaaaattctactccaggagtaccaacttactcctgtatatccgctaggaattaaagtaacattttaaaaaatatactaacgaaaaagcagaaagttgaagtttggagttgagaaaaagaaatgagcctaagaacagcttgtttctactcgaaaaattctactccaggagtactcctgtatatccgctaggaattaaagtaattgaattacgttatctttccacgtaaatgctgcttgtttacactgttctaatcttgtcccttctcccccctggccgtaaaaatgggcccggttcattgccccaggctgtcagtgtcagccgtccgttcctccacgagccgcggacctaaccgtcacacaccacgtcacagcgacgcgtctcccttcttttctggccgcagaagatccaacccccgtctataaattgcccgcgactcctgttcgacagacacgccgcacccgctctcctgtctcgaacgtacacacacgcatcccaaa

SEQ ID NO: 6165 - DNA, 824 bp, Oryza sativa
aattcctgcagccctttttcaaccctattctcgtgaggttgcacaaatgcactcctccttccactaagggtatctctttccttgcggaggcgagatccggccttcacaaacttctcttggccaaccacacgtagatcggtggcccaagaacgacacctagccgtctaggagtccttaacctccaagagtaataaacaccacacaactcttggacaaatcctagtgctcaagatcaaaagaaacacacactaggctcccaaactccaaatccacacacaaagatcaaagtcacaaagaacaagggggatttgagatagagagggagagagctcaaaaattcaaagcacttagcacaaagctctacccaaagcaagattggaatgaaatcagtttgggcaaccctagaaaagggttggtgggggtttatatagatcccccaaaatgtgaccgttggaggggaatctttcagcccacgtcggatagtccgatacaagattggatagtccgatattttaaacctccaaggcaacgagaaacagagaacgaagttacatgaaatttcggactttccgagacatcgaactattttatgttaaatcggagtatatgatattttagaagcaaaaacttcatcctcaaacatcggatactccgacacttagaaaaactcactcgaaaggattgttcaaacaaagacagagagtaaagttctgtgaaaaatcgaatagtccgatacatcggatagtctgatttcaaatcggatagtctgatgttgctcaagtaaaaatgcaataactttttactccgaactccgattttgaaga

SEQ ID NO: 6166 - DNA, 1501 bp, Oryza sativa
aggcatgaatgcccctctaatgggtggaaccatcaaagctttatttatccgctgccttcaagcatgagtcgacatagtcgtgcctctcacagttagtgtggagcataattttaattaatcatagttagttatcggcacccttaaaagaagattgcattgataagtaggaaagttgagcactcttatcaatggtggcctcctctgggcttgcttcaactcaaccatatgtgtgccccctgctatacttgtggtagcatagcaagttctgttattcatgctcggtgcccttcatggaaacaaagagaatatgatgtgatgaaaatagttcttcatttattcccataaaaaatagtttctttatgttttgtatgagacacctttactaattctaaatgtatttattttctcaaaattatttataataattaatttgttgaagtgcagttatagttacatcagtgggctgtttggcgtacatttatcaattatcacttatgctgaacatattataatttctcaagtgtaagaaaatatatcatgagtagttttatggacatgttataagattgttcatttgttaccaaacctatttggcaaaaaaaatgtaaatgaccatattttttgtgatggattaaggagttgtattgtagcatgatcattgcctgtgcatacctatcaaataattctgaaaaatccaaaaaaattaagaatcttaatctcacaaaaattaaaataaagtcagatataattgacaaaacataacgttgtttcattttcatgcatgtagatttcagttagtgttatataattatcaaatgatatttgaccataaaatataatgtgatattatttcaaacattatcatagaattaactattatatgtcacacaaattatttgaaaagtgttttgaattaaattattatatgtcggctccatgtgtggtaatgtatttagcactataatataactatgataagtcatcaacatttgaatacaccttattataagttgactatataattgaaaataatttttaaaaatgggtgtttaaatgcatttagtttgtttttatattaatatagtttaacctgcatatttatctttagagtaataaattttattttatagtatagaaaatcctattctgaagaacatctatatttttttttgaaggttgtaccaacttatatatgtattttttttgggatttatagctttattatcgtatgtacatatgtttctttgtgaatatccggtacacagtttctctcgtatatgcaggggattaagaggaagcgggctaatctaatgatttaaaataatgggtccattatttcaaatgaaagttgacagcaaaattataaagtgccatgtggcggtctaagagtgcttgtagaaacaccacatgatcatatttgtggagtaataaattttgtttttatagtatagaaaatcctagtttaaaaagaccgtctatttttttttctaccgacgtatat

SEQ ID NO: 6167 - DNA, 1501 bp, Oryza sativa
cagtaaaggatgtggatggatggatggatagaggcatcaaagatgaggaagaagggccaaccacggcacaaagatgtacaccaccatccagggaatctatgtactattgtttcattttccaataatacctaactaagctgtacaggaaaaaacaattctaattataaatctaggcacgtatatatctagattcataactagaattgagccttttacgagacggataggtatatatatatatatatatatatatatatatatatatatatatatatatatgtgtgtgtgtgtgtgtgtgtgtgtgtgtgtgtgtgtgtgtgtgtgtgtgtgtgtgtttcatagcaacaccattttttttatttactacaccctaggcctgttctgcaggcggatgctgcaatcaaggtttataatacaacgcggttatcacatgcggtaatcttcttagtttttgaaaccacggtataccttacggtaattgttatattgttgggtggcgataaccacatcctaaatggtttgtgaaccctggctgcaattgtagttgtgcttctggcttggtgtttgcaggctttgagtaccattcgtatttgctgcggcagccaagtagcccagcaaccgcctttgattttaaatgtaaattctttatcttttttaaaggtatcctcaatgtaagtcattttagagctcagacgtttgttttaacttttaactatgatttcatattttccatgaaaatttaaatgctcgtttttcacagtcaaatgatttatctttatcaatgcaatatgcagggtggccaaaatcttttgagttgttttcttaattcttataatatgtctataaaacgacttaaatttgggaaaagagagcgtaatagcccctgaggccccgattgaaaattgtagttaattcgaaaagagaaattagagtcgaaaaatatatagcaaaagaaaaaaaaaagaaaaggctagtccttgaaacagtccaacactcaagggcttttgtttccttttgttggatggggactcatcctagcccatccaaccttgaatagtccattcatttcctgacgtgggccaggaaattgaaaaaaatagcagcccaaacaaaatgggcctacaagttaatgggccgaagttccagctcatccagaaggcccagtttgtactgtctaattaatgggccgtgttttactgggttaacaaggcccacgctctctacccttcacgtctcccttaatctcccacccacgccgccgccgccgccgccgaaaatcctcctcgaaattaattcctcgccgcgcggtggaattcgaaattcgcccaaaacccccgcgtcgcccgcgaaaatttccctccaaaacctccgcgcgctcctcccaaaccgacataaattctacagcgaggaagggggagagagagggagagagagcggacgcgaggcagccgaaccaccaacgcgagcgagagagggagagggagaggaggaggaggagcaa

SEQ ID NO: 6168 - DNA, 1501 bp, Oryza sativa
cgacgcggaacagggtgttggtcaccagcatcggccggttgttgcccatgtacgcgttcagggtgatgttctccgtgctcaccaccagcgcgtacgtgttctcgtgcacctgcatgcgatgcgatgcagttatataattctgtgtaattaagagaacgtactacatacatttccactgataggtactacctccatcccatattaattgtcattctagattgtttaacatggattaaggtttgatgaaaaagaatgatggttggatgtgggaggatagttgagggtagaaaaaagaaaattttgaattagaagtgattgatgtgacaaatagtaccctatagtgacaactattttaggataatatttgaatcctaaagagacaactaatttggggcggagggagtagaagatgattagcagaagttatatgtctctctatctaattctgtctaattaagctcatttgctcagcaactccatgaaatatttgtgagaatattttgtctaattaaaccacgcacactccgatgcatcaacaaactgactaaacaagtaatggtatttcacaaattagttaaaacttagcagaattgatactaatatttcagaaaataatttacgattagcaggggctagctatatctctgtataaattcagcgaatattagcaactcaatgaattgtgaattaatattttttcccttggtcatctctaggaccacacatggagaatgagctggacctccatgaatatgcttactcatgcgcatatggcgatcgacagatcgattaagggcctgtttggtacagctccaactcctaaatataactccaggagttgagtctggagtggagttgtggagctgcctaaacccagctccacaactctagtacattttgtgagagagctccacccaactccactctcagttttggtggagctgaaactgtttggctgagctccagctccaggaggggtggagctggagctggagctgtgccaaacaggccctaaggtacaggtacccatcatttctctctcaaatgtattttttttgacttagcaatttagcatagacatactggcacgcacagttggacatgaacagtatagtggtactgtacagagcagaacaaatgctgaaatttattgcgttttgttgtgcactccatgtgcccattcacggcgctccataaccatatattaagtgcgtgtgtgttcttgcacattggttaaatgcatattgggacattgaaactttcctagttagcctagctgcctgcataaatgtagctctgtactaatcacaaaaagaaaaaagaactttttggtgttttgacagtcagcaagaatatggtatttggtcactaaatagattttattgtcaaatacataaaaagaactatgtatgttccatttttgactgtgcatgtagtgagacgaattacacaattcgacacattctatgctgatttttttttgtcctttttaccttgcaga

SEQ ID NO: 6169 - DNA, 1501 bp, Oryza sativa
actttatccacaccgagatccgcaccacccgccgccgacacgccgggcccactccgcgtgggccccacctgtcatccactggtgcgccgcctctctgcgcaccccgcgtgggcgcctatttttggacccttttctctccccaaaggccatcacctcctcctcctcctcctcgcttcccttcctctcgaatcacttcgattcgatttcgcttcgcttcgcctcgcgttcgccttctgcttcgatttcgacttcgattcggccggcggcggcggcggcggcgtcggtttggggggagttagggttagggttagggttagggtttccgggggtgatccctcccatggtgcagctgccgagctccgggaagcggccggccgagccggccatggcggcggcgtcggcggcgggggctacggtgaagctggaggcggacgagatgctgcatggcggcgaagaggacggcggcccgctcagcaagcgcgccaaggcgggggtccagatgcccgcgccgccgcctccgcctccgcccccgcagcagcaggtagatccgggggggggggggggggtttcgtgttctcgtattccgtttggtgggttttgatcgggggatgaggtggtagcgcgtcggattcgtaatgcttggcggcgagacggcgcgttttggtgctggattgtttgagggaggggaatcctttcttccctggcgtgtttttgacgcgtttgatccgaaaatactgtatatatgtggactcgagatggatggaatagaggggtataggtggatggaatagaatagtacagttttttttttggagtgatttgattgttcggatatggaatcgctagctgatgttgttagagagatcgcatgcacggtttgtgttgtaaatgtactgagaaatggttgttctgttcttagttgaatcaggtagggtcacagtctgcttgttggggttcaagtttatggatatgttttggatgtatctctatgataatatgctgtgcaggagcctggtattattgtgccattttgaggctgatggggcttcattgacgtccgatgatttgctgcagcggcacacttatttatatatttaactttgtgtattcatgtcacaagtcatgtgcatttgttcaatgtaatagggtaatgcctgtttatagtatgtcaaactgctaagttccgtactttgcgtgttataaaaaattttctaggaccaatcatcaatgctaacttccctttgcaagtagtgtacctatttggagcttgaataaaaatttttcgtcagaatccagtaagatgtgtgtgatataatcaataaccgatgcatagcacaccattttgagtgcttcctacttgggcagtaaaatgcgttgttagttcattttttcccaatcttaaataaaatctctagctggtattctttatgaaccatggaataggtgaaatatgccatatgactatcccatgcatgcattttctaacgcttgggagctagag

SEQ ID NO: 6170 - DNA, 1501 bp, Oryza sativa
caagtgtagtgaggcatacacccaataggtatcccaaccaatcatatgcgatatctacatagaacccatcatgccagcttgacaagaaagcgccaccacgccccttcaccagtcgatcggatctcctcttgattattgttcagattgacatgactatgaggcaccaagcccctttagggcccctttgattcatatgattggcaaaggacttttataggattcaaatttctatggatttatttcctacatgtccttttgattcataggaaagaaagtaaactttccatatgattgtattcctatgcttcgcatttcatacgaaaaatagcaagaggtatgacctctttgtgaactttcctttgtttttctcacagcactataaaaggactcctattgtctttcatgtgtttgttgattcctgtaggatttgagaaacctactacttcgattcctgtgttttcctattcctatatttttcctatcatgtgaatcaaaggggcccttagcggtcaaaatatgaacaaaacgccaccccatctaaagagttgttgacctcggtgatagcggcggtgacacctcacaacccactaatagttgattcaatctcattacgcccttcatcaaatcatctggcaatgaaaggcgacggaacatcatcggagaaaggccatgacgacaacggcgacaaaacaaaccatttcctaattcaatttatccattctatcgcctttggtgatgagaactatgatatgcctaatcttaccttggatggagagagagcggcccatcgccatagccccgtcggaggcggcgccagtgacaacgatgagaagattttgggaatggtgatgacaactagggttaggcgcctctgtagttaccccgcgggaggcaacccgagacgacagctagattctaatcctttagatgtatgaaatatccgttacatatatatttttattattttattaaatccattatataccttaaatacttgttacatatctataatataaaatgaacccacgacgactttgtcatgctagtagtagtgtagtacggtggtagtaaatactctaggatgtataggatgtagaggaccagtagagtagtagtgccgtatacgagagtaggttgggtgggaaaacgttttgcacgtgaaagccaaagccctcacacaccatcaacgcagtggcccccacctgtcatccattctagccactgacacccgtccaccaccaccatcacctccacctccacgccccccggccccgccactttatccacaccgagatccgcaccacccgccgccgacacgccgggcccactccgcgtgggccccacctgtcatccactggtgcgccgcctctctgcgcaccccgcgtgggcgcctatttttggacccttttctctccccaaaggccatcacctcctcctcctcctcctcgcttcccttcctctcgaatcacttcgattcgatttcgcttcgcttcgcctcgcg

SEQ ID NO: 6171 - DNA, 1501 bp, Oryza sativa
aataatttcacctttgatggcgcttttgtttgccaaatcagagtaccacatcgtgccaccatgtattcatactcttaatatatcctcattcctaagttatagaacgcgttcaggtacaatccattctaattattatatggatctattgtattgtattgtaatgcgtatgagtatgttactaattttaaaactaattaactcgtgcatcctcttctcacaatagagatttttgaacgccaaactgcagcaatatggagttgccaaagttcaaatattacaggctcaaatgtggaaatatgtccttgctctatcaatacaaaaaaagacaaagcttttgcctttgctagtttgtttttaaaaaaaaaaacattgtggaaaacatgcgaaacgaatgtgatctcaactacaacccagcgtccatgctggtttttttttttttttttttttttttttttttttttttttttttgcggggagcgtccatgctgttgattggattgaatttcagcaacatactgttagaagctggaatttcgtgagagagccgtgtactcctacgcttgctataatctgttttttcttctatacgaaacagcactacgatgcagagagcttaccagatcgaatcccttgttaacacagatacaggttgcttccaagtctactgtaccgataaaacctaacttaatctttaagaacgaattaccagtccggactacggacagataatcagggcaccaaagaaagtcgcattcttcttggacactaattataaatattaaacatggagtattaataaaacccatccatagtcttggactaattctcgagacgaatctattgagcctaattaatccatgattagcctatgtgatgctacagtaaacagtctctaattatggattaattaggcttaaaaaatttgtctcgcaaattagctttcatttatgtaattagttttgtaagtagtcaatatttaatactttaaattagtgtctaaatacatggtctaaagttaagttcctggatccaaacaccaccttctgattagctcagtacggtcactctctgttgcagctttgcttcgagggtggacctgcaggaataccgctaaaaaaaaagctactccctccgttataaaatacaacaatttttagccctcggtatttatcccaaaatataacaactttttcaccaacattatcttcccaaccaatcataatcctccaccattcacttttctcacctacctccattgctcatcaaatcgcaaaccttcaccacttatttctatctactttcttaataaccgtgtttaactctaaaactgcttatattctgggacagagggagtaattattaattaatcacgtgttaatagaccgctccgttctccatgcgcaggagaattgttcccatctcctcgtaacaaactcaaccaaagtagagtatcgaatataaacgttttgaataagtgggaacccacttagtatttgtaacg

SEQ ID NO: 6172 - DNA, 1501 bp, Oryza sativa
actacagaattttggacagccatctgctgaattgtggatacacaaattcgttcccatcagcagttctatctgttaccccattgcacttctgcataacgaatcagatgtgtaatttactatctaaagcattccctctttcgtggatcacatcatgtgtatagagagaaccacctattggaaacatctgacatatcccaagctccctctgggagcagctaacgcttgaaccattttcaatccttcctgctcctgaagtcctgaagcatgaccgagcacgctggtatgttttggctctgaacttgtgatggcaacacaattgtccttactgcattatctattgcaatggtgttttcacatgcttagataatgcaaccgtgcatgtttaaccaggtactatcatgagtcgctgttgctgcagttgagcgatataagctgtcacttcattctaatcaactaaggtcgttgactttttattcgtcctcgtctaatttctccatttggcagctttgggtttgctcttggttgggtgccaactgccaatgacttgacaagttgacattgtatggtcaaagcccaatgggggagtgagctttatcacttgtgtaacgattaacaaatttcttaaaatcattcccgtggtagaatctcgagagaaaccaacactggctccttttgaaacaaaggaattttacatgttcataggaatttgattcgattcacacaaatcctactcaagattcctttgtttcaaaaggaattcacttcatcacctcgcaggtgcaaaagagtacccctccaatgatctcaagcaacacgatgtgcaaaatctagaccgttccacttgattatccatatagcaacctttttgcaaatgcatcattaacaaaagctaatcaacggagctacgaaacggctaataaaaacatatgcaaggacaatcatattactcctaatcaagaggatatttatagtaaactaaattacaccttgtatacatactactatacggtacagtacgtcgctgtagcttctctccatccatccatcgaaatctccactccatccatccatcgaaatctccagtaatccgaaacccatcaacctcaccaccaagagttgataacccgataatcatcgcggcgccagtattcgtcacgcatctcgttttctctttatttgtttcttctttcgcttttttttttagcatttaactattcgccatttttaagatgtgacaattaaaaatttagttatcatgtttctatgacataaagatctaatgataaatcatttatcactaattgtaagagtggtaaatagttaattatttctttttcttcccctctcaaatctcgttttcttctctttccttttcttttttcccttctttttttcttttcatctcaaagcagagagcatctcatctcatcgatcgatctcgatccatttccgtttgcttcttctcctctcctctccaagaagaggcgagctcgcctcctcc

SEQ ID NO: 6173 - DNA, 1319 bp, Oryza sativa
tttaaaaagtgggaagaaagtaacaaataacggtaaattgacgggcaaaatagaaattagacatacctaacattgttttttttttctttggcttgctttacagttacctggaaaacctgaaaaaacctagctgatcaatcaattttcaacggccgcgattgctttaagatttatgtgtggattataatccttttccctccttcctcttctccccatttccacctcagcctgcccgccaagatcttcacccatacgccgctgtgtactataccggcgacgcccgtacaagcgtgtcgtcatcgagccatctcgacgagatttcccagccccgccactcattcgcatctccagcagctctcactcctaacatcacctcctaattatttcggtgagattccactatacatattgtcgtcgcactgcccatgtcctccccacggatgagacaccgccgccgcccgcaaccactgcccatcacctagccgccactgccccgactatttctctctgccccaaaatccctcctatacctacattgtcctcccccaaccccctcctaccttggctcccacgcaatacctaattcggcgtgccaccaccgtcgctgaagaagaacccatgtcctaggaggacaagaggagcacgaatcatagcgcaaaaatcgacggggggaaaatttaatcttttttctcctaatgaatagcaaaggtgtttttctctccttcatcctctttctttcttcccatattgagacctgcgaaggtgattctagcgtgtaaacactcacacgatggctgtgtccggtactggaggatgggaacctatcccctccacacggaaaacggagtggtccattagctcgtgattaattaagtattagctaatttttttcgaaaatggatcaatatgattttttaagcaacttttatatataattttttttgcaaaaaatataccgtttagcagtttgaaaaacgtgtgcgtgaaaaacgagatggaggacttgggaaccggggattccgaacacacccatacgtgcttcctaaccctgcttggtgttagctagaaaacacaccataagtgcttctaaccctgcttggtgttagttagaaatattacggctctattcgtttctgattaagatataaattttaccttgattttcgttagcacgcttttcaaattgctaaacgggtaaaaactttctatatagattttgctttgaattatcatataaattcatgttttagtttgaaataattaaaacctaattaatcatgcactaatggctttctcattttatgtgctcgtacttaatc

SEQ ID NO: 6174 - DNA, 1501 bp, Oryza sativa
ggaggcgaccgacggtggagaggtgccggatccgacggttggcggtgcggtggaggcggcagccgccggatctggcaggcggcggtggggtggcggaggaggaggggaccggcggtggagaggcgcccaaccatgcggtggaggcggcagccgccggatctggcaggcggcaatggggtggcggaggaggaggggaccggcggtggagaggcgccggatctgcggtggggagaggccgcagtggaggcggctaccgccggatctagcagtcggcggtggggtgcgggaggaggagttgaccgacggtcggaaggtggccgggggaggcggcgccggccggtggaggaggaagcagatgccgctgccgaacccggtgctcggcgcgtgtattgagagaagtctgtggagagagagagggagagagagtggataagtagagaagaatacacagaagtggagaagctggccttatctcaagggagaagaaatatatcgggtatatatatagtaacacaactcactcaaatgggttagggcttcaacccgtttgaggtgagtaaacttcacctctgacgggccatccggttgcgacccgtcacaggtagctagtcacctgtgacgggttgaaaatggaacccgtcagaggtgaggtaagcctcacctttgacggttttcacttccggcccgtcacaggtgactaggtcgaaaccggatggctcactgaagacggcatccggtaggacccgtcaaaggtgatcttcatcactgaccaacagtacttatgcccgtcacaaatatgctgtcaaaggtgtgaggatctggcgtaatgcatccatctacatatctacatatctatctgtcgatttattcaataaatctatctgtatgtctatctatcttctactcctatctatttattctataacaattaatagatgtcattaaatgatcttaaaacactagtaggatgccatctctaatgaattaaaaaatcagaaacaaaatcttagaaaataaaagcaaaacatctaacatttgattctcgcttgaattgactgacccaaaatgatatttttatattaaaaaaatcttgcaatattttagtggagaatcctaatatctatgaataaaatgaaatgaactggttttcatcttcacgtagattgcgttgtcatgcaggtcattttttttagaacatggtaaattcattccctcctcaattgaccagcaacggtcaccaggaaatgtggcagttcgtgtgaaaatatggagcgtacaaccaatggggtgtggcaaaacaggatgtacattatcaaagtagagagaggagtaataagagataaatataagctagatgtctccaaagatagcatgatcttcatgatcaaatgaataatttaagagtaacagtatttactactttgttttacatgaaacggaaacgcctgtactggcttttcactcagctgcactactactatctacaaagtacgcgtacgct

SEQ ID NO: 6175 - DNA, 1501 bp, Oryza sativa
aaggaccgagccatgaagttaagcatgaaacgacccccgtacaaccgtacttctcgaatgggtatagacctagcggattagatagccgagcggaggcagtatccctgcatagatggttcacctctgagtgaggcaggtgcgctacgttgggacagccgttgaggtagggccgagaggcgtgccctacatcggtgtcgccattggtaggactgccatgagtgtgtgagagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcaaaaagctttgccgtgacgcgtctcatgtgttgggccgaggctcatgtgttgggcagtcgcggagtgcgggtaaagtgtacatccactgcagtgtgagtaaaccaaatctattcgaatagccgtgctcgcggttattgagcaccgggacatgtattatacttggctagactctaaattctttaacttgtgtgggatgggatattgcatgatgatttttatgctgacggagccacttcctgagaggcgggaatgtggacgtcctcagaaaaccataacgattcaatggcgggaagctatccttgggatcacaatggatggtggacagaaccgtcattgtttaatatgaacactggtattaaaacttgatcaatctatgctaggtcttaggcttgtgaaaagaattacaaaatttgctttgcgcaaaagaaccatagccatcctttgaattcctctgtcatgtgcatcattgctgtggtggcttgctgagtacggttggtactcatccttgcaaatataaaatttatcagaagcggaagatgaagcctcggaggatccctatgcctactatcaggagggagatgaagacgaaggcgtccagtaggtcttagtacggtcgttgcctgtggcaatggcatgccgctgcctgaattccgttgccttatctatttctgcttttggatgtattccggaccgctcggtccgatgatttaagactatgcctgcgggcctataatgtaataattcgtattagacactcgtgtatgtgcacttggtattccagctatgaatccgtgtgtaccaaactacttgatccagggaaatggtactgtttacacgattgactcctgttataaaaacgggggtctacagagctggtatcagaaccatacgactgtaggaaaagaccaaaaggcgccccaccccttttctaagttggccaagggagaaattcccatttagcaatactttcaaaaataaaaactctatgtttacaaaactcggtacacttttcatcttactcttaactatttcctttacaaaacaagttttactctcaactgaccttgggtttttcttaaaattagatggcagattcggattcacccgctacctggaagt

SEQ ID NO: 6176 - DNA, 1064 bp, Oryza sativa
cctcgtcacgacacgacgccgcgccacgacgacgccgcgccacgagacgccacgacgccgcacgccgccgccgcgccacgccgatgccgcgcgcggcgccacgccgccgccgccccgccccgccgccgctccgctgccgccacaccgagaacgtgaacgagcgaacgaacgtgaacgagaacaaggtgaatgaatgtgaacgagaacgagcgaatgaacgtgaacgagccaacgaacgtgaatgagaacgagcgaacgaacgtgaacgagaacaaggtgaatgaacgtgaacaagaacgagcgaacgaacgtgaacgagccaacgaacgtgaatgagaacgagagaacgaatgtgaacgagaacaaggtgaatgaacgtgaacgagaacgttgtcggacgaacatgaacgagccaacgaacgtgaacgtgaaatgcaattataggcaggttaatgaacgtgaacgaacaaacgtaggtgaatgaaacgtgaccttaacgagaacgcgaacgtgaacgatatcgtgaacgaaacatgaacgtcaaatgcaatatatgttacttcgcgtttatccttatacatctttttgtatcttgtagaaagacgttgtcggagtcgtccctcaagccggagtggtagagctagccctcgaaggaattcgcccaggcaagtgacataatatatatatatatatatatatatataggaaggctattatgtactcccgggagtacatactccctaccctcataccgttgattacctttgagatttgtacctgataacgggttagcagtgaaggggacgtgcggtatctacccattagtggatcgtggatggcattttgttttaaaaattgaattaattgactgctcgtgtataactaatccctgaagaatcggtctgtacgcaggtagtgggcggtgaggaatggtatttaaatcatcaaaccacatactgcttcatttgttcagggctgcaggaacttggtttggacctccgtagtccagctcgaggatacgccgccgcgcggcggtgctgatttaggatggataaacaagtgaa

SEQ ID NO: 6177 - DNA, 403 bp, Oryza sativa
  unsure (1)..(403): unsure at all n locations
catggattttgtgtgacagccntttgcanannncnnnnnnnnnntnggnnaaaananncccctcttacacggnccancctttctatatcaattngtcacctgccttttttatttcacgatccaacaatgggaaacgcgatgtcaggccacaagggtaagcagatcctaaatcaacgctatatatatatatatatcatccagtacgtacaaccacacatctctactccttaaaaaattcaaattggtgttggtgatagtgaagccaaagcagatataggatctaacatacaaagcagacatgcgatccaacatacaaaccatcgacacgtttggagcgacaaaaataaaagaagacgtacacgcgatccggaacaaaaaaaaaaatcgtaaaaaacagaaacgc

SEQ ID NO: 6178 - DNA, 371 bp, Oryza sativa
caaacgtttttttagaagggattactatgcgcgaggagtgctctgttttttcctttttaagaacagagtactgcgatacaggctgcgtgcagttggcatttgtgtctatcacaacctcacaagctgtccaccctttctcactgacagtaggccccacggtccccacacgcccatcccggtcacactttctgtctgcatgcgaccacggtccagccgacgcgcactccgcccgtcactgccaggtgggccccacccccagctcacctcatccgtcacttcacttcactcctctccccgaaccccgtggagtaatcaaaaccccagcaacaacccaaccatctcatcttaaatgcacgccaaaaatctcgaaa

SEQ ID NO: 6179 - DNA, 876 bp, Oryza sativa
tcctacttcatgccatggatattccattatggactatagtggacagggccggtcctatgattttgagggccctaggcgaacccatcgcgatgggccctccaagctatatataaaatttattgatatatatagacgctaattttacttgcaaaatgaaaacaaatacatctatatattaaatttaacattcctggtaattatcaagaaataaaatcgaccaaaataacaatatatttgtaacttggaactaatataattatttattaacttaatgaagaatagaaccccgtcatatccattgcttcctatgaaaagatacttcttcgggtatttcttgatgcaaaatcataaagaacggtattaagatcaatagtgtccaagatatccttctcgattgagcacatagccaagccatttaaccttatttgcgacagttgatctcaaatagtttttcaacaacttcaattttgataaacttatttcagctgaagctaccatcataggtaaagttaagagaattcgataggcaactgaaacatttggatagaaatctgcatccataacaaacttcaaaatcttagggaaatcgaagaatctggcaaactcactttcatcacctttaattctgaataaaaatcattgatctcaacatcggatgaggtactagactactagtattaggtgttgccccccaccattatgccccccaccccaccatcatgggcccccggcggtcgcctcggctccatagggccagggccggccctgatagtggatgtggctatattcatataatttatcctataaacaagaaacaacatgtcgtgttgatttcgtgaacgacatttaaatgccactcttaaggtcttggcaaga

SEQ ID NO: 6180 - DNA, 797 bp, Oryza sativa
aaagagaaaagaatatccatatatatatatatatatatatataatgaatgataggtgtgtctagatagatctttttatataaattgtctttcttatatggttgattagatagcaaggagatataattcgtccggttttaaagttcacagatatcgaatgtttgttgttgtagttcatgggaaatcggactacgctcaaagtttagggagtaaatcaaaactgttccttttgaaaattgaggttgaaaaacaaccgtataatgactaaaattggatttcatccttcttaattttgcactatcaaatttctgcattccaagcatgctgcaggccaagaaccgacctatatgcaatgctacttttgattggagatcactcaaaactgggagagtaccatctctacacagctctcccttatctatcatcactctcccttacatatatcgatcactgcgtacatcacttaaatgaatttgaattcattaataaaagggttattttaattccatgcatcgatcgcatggcacgatgcaacgcatccatctaaacgagaaaaaacaggatgttgctttgttctcaagataattgcgtgtgcgcagcaattgttaatgagaaaaaaaacaattagcagatcgaaaccctagctaagctagctctatatatacagttacattatgtactatatggcgtaagcaagatcaaggtgatcaatgagcagatcgttaattagtcgcgtggagcatgcacggccttcgaagcacacaacaacacagcaatgcgtttgcatatagaacgata

SEQ ID NO: 6181 - DNA, 557 bp, Oryza sativa
catacactcccatgtcttacctgattgagttagaaccatgaagagatcatatatacatgcaagcaattttaactctctttttttttaggaaagcaattttaacttctgaaacaacaacaaaataaacttcaaacgttttctcttttcaattatactcctaaaactaaaagacacacatacacatacatcgatcagtacatcaacacaccaaactctaaatgctccgctgtaaaatgttgagagttaggtcagcttgtaaatctgccaaaggggaaaagaagaaagaacattgtatatgctccgtatggtgcctgcacgtaatacttctgcttgtgaataaaaacagtataatttgggctctttttgtagtatatactacaggatgaacacattttttaaaaaaaatatatacttgtgaatcaaaaaaatgaaaccagtacgtaattgacaagtcaagcagcactgccgtttggactataaatagacgtttccaggccagcttaaacctctacataaacatgtatcaacaccatcactaattaccagcgccggacaga

SEQ ID NO: 6182 - DNA, 1501 bp, Oryza sativa
gccggccaacgtggggagtgggggaggagagagaggtgggattcgaaaatcgaatcccggccatctcgggcgcgggcgcgggcgcgagagagaggggaaatgggtgcgggagatgcggcgcacgcgcggacgtggctgacgtggcccggaggaggcggaggcgtggacgcggcggcggttgcgggcgcggcggcgccggctggaggaaggagacgggcccgacaggtggggcccacctgtcggcgtcccggggagagagggaggggcggcttgggccggcccacaatgaggagggcgcgcgcggcggggtggactgggccgacggcccaagaagaggaaaaggaggggaaaggaaaaaaagaaaagaggaaaagaatttccctgggatttaaaatattgcaagctcgattttaaatggttaaaattatttcgagagctctgaaaattccactaaaaatcttgttagtgaatttcgacatgtagaactcaagaaaaattccacatgccaattccgattattatttgcattgatttaatagggtttactcttgctttgcaccggtgttttcttagagtctcttattaattcaattttaggctaggaggagaacttcagggtgtgacaaatatgtacacccggggccattgtaatatatcaatctatcgatcaataatactctcggcgcatcgccaccctcttccctgaggtttttacttatcttccaacggaacttgggcacctgacgcagggatgcatcagctttcgatctccagcgaagggataagtcctacgttctgtcgggccctggtgaatctgtcggctacgttggtgttgttcaaggctgcatcgattcgatctcttggatcgctctagtttggttaatatatttgcctacatgatatctcaattctatctctaattgcattgtgtttagagatgcgtcggtttagttgggactgtctcggttaggtctgatctcctgtcttagccgatatatctctacaatcataatgaggttctaaatagatttgttatatccatcacatttgacagatctatcggctcatcgaatattagattatcatatacaatctcgtgctgcatcggttaggttcgatctactagatcgttgttgataatataagtcttgttaagccgataggttcatgctaatgttttatcggggtgctagccgataagttatctggacattgcatcggctcataaggattacatatatatacaagttggatttagccgatgacaacaaaagtttcactgtttaatctaatctgtggattttatggcatcggaccttcagccaatgtacgctttaaccttcgaatcagtgcttattctatcataccattgctagtcgattggtttctactagactatattattgttagattttatcatcatcagccgattgcctttatatcattatctacattggacatatggtcgattgcttaaaccctatcgctatcggctggtgtc

SEQ ID NO: 6183 - DNA, 1501 bp, Oryza sativa
acagccgatcggctgacaagccgatggagtagttccagccgatagccgataatagccgatgccgacaccagccgatagcgatagggtttaagcaatcgaccatatgtccaatgtagataatgatataaaggcaatcggctgatgatgataaaatctaacaataatatagtctagtagaaaccaatcgactagcaatggtatgatagaataagcactgattcgaaggttaaagcgtacattggctgaaggtccgatgccataaaatccacagattagattaaacagtgaaacttttgttgtcatcggctaaatccaacttgtatatatatgtaatccttatgagccgatgcaatgtccagataacttatcggctagcaccccgataaaacattagcatgaacctatcggcttaacaagacttatattatcaacaacgatctagtagatcgaacctaaccgatgcagcacgagattgtatatgataatctaatattcgatgagccgatagatctgtcaaatgtgatggatataacaaatctatttagaacctcattatgattgtagagatatatcggctaagacaggagatcagacctaaccgagacagtcccaactaaaccgacgcatctctaaacacaatgcaattagagatagaattgagatatcatgtaggcaaatatattaaccaaactagagcgatccaagagatcgaatcgatgcagccttgaacaacaccaacgtagccgacagattcaccagggcccgacagaacgtaggacttatcccttcgctggagatcgaaagctgatgcatccctgcgtcaggtgcccaagttccgttggaagataagtaaaaacctcagggaagagggtggcgatgcgccgagagtattattgatcgatagattgatatattacaatggccccgggtgtacatatttgtcacaccctgaagttctcctcctagcctaaaattgaattaataagagactctaagaaaacaccggtgcaaagcaagagtaaaccctattaaatcaatgcaaataataatcggaattggcatgtggaatttttcttgagttctacatgtcgaaattcactaacaagatttttagtggaattttcagagctctcgaaataattttaaccatttaaaatcgagcttgcaatattttaaatcccagggaaattcttttcctcttttctttttttcctttcccctccttttcctcttcttgggccgtcggcccagtccaccccgccgcgcgcgccctcctcattgtgggccggcccaagccgcccctccctctctccccgggacgccgacaggtgggccccacctgtcgggcccgtctccttcctccagccggcgccgccgcgcccgcaaccgccgccgcgtccacgcctccgcctcctccgggccacgtcagccacgtccgcgcgtgcgccgcatctcccgcacccatttcccctctctctcgcgcccgcgcccgcgcccgaga

SEQ ID NO: 6184 - DNA, 1501 bp, Oryza sativa
tagcaggaaaaaaaagttctcattttgaatggaaataatcagttatctgtctatggtcacttcaaagtcattcaatatttaaacctttgtctgacagtatctggacatccatgagataggaatacacaaactttactgccgcattctgtttcttatatgttggcagtggaagccaactaatatatctatttgctccaaaggatgaaatgagtttctggaagtttaaaaggtaagcccaacacatatctacacctttcatcgtcagaaaagaagtccatagcatgcctatacacgggccaaaatcaatccctccaaccaagtgtaaatgcactaggtcatctagtccacctggaaaccactagtggagaaactttgctagtcccggtcctgttcttcaactatgggcacgtactcttctattaacttaagtaatgtctgcatcaaactcgatacacccacatggcctttgagagtttcctattttttcagctaaaagaaaaagcaatataccggaaaatagtctgaaatagaaaacagaacttcactacaaattcaaaattaacatttctaacaaacactagcattccagtttcttgtgtgatttgcatcagctcaaaagatttgtagtagctaaagaattcattaaaatgaaatgaaattaataatggcagcactgcaagcaatactaacttacaaagtgcatatgctttttgcaagaatttgaaatggtaagccaaaaaaaacaagagttaaggtttattagacaatattattgtaggacattaagattgttatttacatcaagatctctaaaatcaatgtaggacatcagtaaagggaaaaaaaactcctagctagcagcacacacaatgcttcatctgcttcacgaatgtgcttacctacatatttaacttctagaactcataattgtatggaactcttaagccacaaggagaaagacggaagctacaatcagtataaaatttgcaaatatttggaatgttcattgattcttatggataagattaaatatgacctaataattgataagctcacgaatttttttccttaataggaacataaactgtagcataactgccaaagatgtgtttttaaaatattttgaagtatccgatagttcttaaaagaagtaagttctcgctggttcatgaggaatggatgtactcataaggagtggctgtggaacaagacacgtacatgaaaaaggatagaaaacgccatacatcatattatgtatttatatgtacaaagggcttatacatatgatacaacgatatgcacatactctatcaagtacatgatggcagaggcgggcattctagaatacagctgctaactagtgttgagctaacaagagggaaaccagtaaaaaaaaaaacagaacagtagcataaaaagaagaaagctgacagcaactgcaactatatgacttactacttacatctatacatgatggacctgactacaaagccacaaagaa

SEQ ID NO: 6185 - DNA, 1501 bp, Oryza sativa
ttaagagcaaaaagttttgcaatcatataaagatgacatcattctagacaataaggttaaactattgaattgtatcatatgtgaaatacgttggtttttttaagttatagaaagttgctaatcgttattttagtattctgaagttaaattaaaaataaaattgagagtaggtcttataacctgtagctaaattttatcgtgttaagaacttaacaacaaaagtttcccaatcgtaataagatagcatcattttagacaataaggttaaattattgaattgtgtgaactatagttataactaatataatttgaagacgtctagcaatatttgagaagaaaaagacgaataagtaaaatgcaggcttacattaatatactcgctcaatctttacaaatacttttaatcactatatctactacatataaaattattacattctccatttattgaatcaaataatactattagcaaatcaaaccagctcaggctttggtcgttggtaaaaaacgtttttttactagtctggcttcggcttcctgaccagcggtagcgctagcttggtgagtatctgtcccttcaattgaggacaaatttaactattaggtggcaaccctctaaacgcccgattagtgcctctctctccctcttcatctcaccatactacccccttcatgctggtcgtctcaatcttatagccacctcgctagccgttgtagattggtagccaccctaccaattgccggaagcctccctgttaccatgcctgctcattgttggaggagctctagcacaaggtaagcgttgaggccaaataactcgccaggcgataagaggaagtttggtgcaggaggagtccccacttagaagtggaggtatttttttaataacaatgggtctccaaggacaacagttgtgaagagagacctagcggcagaggaactagagggcgtagggttccccaggttaggatgtgacgtcaagctcgtcgccacccaagttccaagatgcacaccttgtctttgtcgagctcaagcggtcacctcatcgtcagggttgacgccctccttcatgttagagctagtttgacaactagcgggtacaacgatagggactttgctatgattaaggtggctgttaggctttaacagctagcgaagaaatgaaatataaagaaattgctaaccttgctatgctagcgggccatgtagataaaagtataacaaaccacctttattggatgataattttgtgaagacaaaattaaaaggaggcatttagctccctctatcaaaatcctcttgcttaagatcggagagacgtggtcgctgacacgtgggcccgatggcaatgggctccacgtgtcagtgagacaaatgactactctcccaaccccgtccccgtccctcccctactctctcgccttctgttcctccccctctcccttccaacttcccaagcgcgcgcggggagacgatcggcgacggcgacggcgaggcggaa

SEQ ID NO: 6186 - DNA, 1501 bp, Oryza sativa
agaaaaaaagaaagtcaccagtgacccttaattaactactttcttgcaagggtccggtaatctgttaaggagttgatgtttacaacctaaacatggatttgtcaagacaacttaggctagttggcaaaattttttgtttcgacgtgtcacatcggatatacggactcacatgtaaagtattaaacattgtctaataacaaaacaaattacagattccacctgaaaactgcgagacgaatttattaagcctaatttatccatcattagcaaatgtttactgtagtatcacattgtcaaatcatggcataattaggcttaaaatatcgtcttgtagtttacacgcaatctgtgtaattggtttttttcctacatttaatactgcatacatgtgtgtaaacattcaatgtgacatgatgaaaatttttgttctgggaactaaacagggccttatagtaagctgaaatttacaagtggccaaataagattcactgaagattcttcagtgaagattcattttcacaagaaagtacgtcatatcagtcgtaccggaacaataagcacatagttgatgaaatctgctagctaaagcaccaacatagaacacttaagtaacagaacttgtttgagtttctttcttgatgccttccaagaccatcatttagtagtatagtgttgcctctacctttacaacggtagaaatggcgttggaactggtggacagtgcataccattactgatctccaacttatatataccagcataagttctcttctataaataagctattccactattcattgtcaacatattctcttgcatattcacattcccggtaatatatatagcttttcgtcgatggactatacctgacaacaatatttatagtgtattggggttgtcggtattaaggtatatatacacgagattatagtaaggagataggaggcaaggatttttatactggttcaagttctcaatataagtaataatcttacaccagtttatctgaatatctctgaaaagtaccacactgattacaaagggggagcaagttagctattctaatccaccagctagaattcaccaagtacgtctcaacgagctgatgttggtgaatagggcttctcttccacctggctgtctctcaatgtgggtctatagctaaggcttgtgattcgatgcgctccccttctagtgttatatttatgcggctagacgtttccttattcaagtagaactcggagaaccctgtcaggatacggggtaaggagacattgccttctccaagttagattcttacgtcttatattcctatgaatgcagtattttattgtgacatttctataattacatatactgtaaacatgaattataattttatatttatattaattttataaataagattaacaataaaacatcatgtcatatatttaaaaggaaaaagtatgaattacccccgaactatcgcggtcgtccgaatttccaccctgaaccacaa

SEQ ID NO: 6187 - DNA, 1501 bp, Oryza sativa
ctcctacttctatggaaattgattcctctcgaatcatagattcactaaatagaacattcaaaataatcaaataataatggcatgctattgaaaaatgtattgaccacatttactctttattctacagcaatgcaaacacgagaacattaaattataacaacatgcttctacttgtatttaacaaatctctgattcaagcggaattacttatcatagaccttgccaccgtgctagtgtgagtaacatttattatccaacaaatacaacggaagctttaaataatcattttgttagtatcatagtgctagtatcatcattttgctgtatttatagcgtaacaaatacaacaaaagtttcaaataatatacactagtaccatcattgtcaccaatgaattaattgaaagccagccacactagagatggttttcaactatagcacacatggagtaagagcatttaactatttaccattatttggcaatcatatctaataacgacaaactattgaaagtcaaagaaagtgacatgttattgggaccgacagaaagtaattttgcttaaacccaaaattcaccaaagagaaacataaaaccacactagtaaaatgtatataaaaaaattaaacccaagggaagagacgttctaaatacattgctttaagataaaaaaaaaatccctaaaagccggttagatgcaccctatcaccttagctacatgccacgaccacggaaaacacatagcgatggaccttttttttttgcgtgagccagtagtgattgagccctcgtcagcggcctcactcgttgggatcttaccatcgtgctatgaacaacatatataattcaacaaatacaataaatgatttttatattatacacctagcttcatcatttatgaaaaccagcaaaaccagatgtggttttcaactgtagcccatagaaaaagggcatttaaacatttaccaatattcggtgcacacacatttactcctcgcatcaaggctctcgcaaaagtgggaagaacagtccaatagaacatcaaccagtgaagtgttagtggcagcggaagaagaaacatgcatgcaacaatagtcaggaatttaaagctagggatttgcacgcacacaggccaaaataccttccaaatttctctgcgagggagcgcgtgaattccacccccatctactgtcctgatcctctcctctcctcgtcgatataaatgacgccctccccctcgctgttgcacccatccctctctgacctcgagttgcagcttcttgtgctgttttgagccagcattcgagggaacccatcggaaaagatctgaaaggtgggggttctaggagggtttcttggtgttcttgtattggttttggtgggttcttgctgggggtgcggagggggagggagattttggtggtcagtcgttcgtccagattggggttttcttgttgctgatcgtgtttgtttttttttttaccaaggggatccaagggacga

SEQ ID NO: 6188 - DNA, 237 bp, Oryza sativa
aaatgaaaatttcccttctagcgaagagaaggagaagcacgcacgcagcacgtgaacttccagctctaaacccttccccctctcttggtccaagcccctcctccccttacccccccgacgacgccgccgtcggcgtcttatcacccgaaaccctagccccattcgccgcggtcgccgcctcacccgaaaccctagccccattcgccgccggggtcgcggcctcaggagcggaggcca

SEQ ID NO: 6189 - DNA, 1501 bp, Oryza sativa
cgcgaatccgccgccggtgatccgccgacgagtcagcgccgcctcacgccggccgccggttcgttcgtccccggcggtgctggtcggagagagagagagagagagggatttccccttggctccgcgtcgatacgatccgagaggaggcggattcgggtcggatcggaggcgggtagggaaaaaaaacccgatccgcttaccctaccctcctcctccggtattttttcccctcacttccgcgactaattttcctcccttggtttggacacagattgagagcaagcagcgtggcgacgcccaaatcgcgcgattcgatcgaggcaaccctccccaattccctcaaatcccctatccgaaatccgccaattggccgcgtccgccacgccaagaggtgcgaatttctcgcttttggatttgggagggggctttccctctccctttattgatccgaatttagtgtgatttatgcctagtgattttggcgttcttgggcgtttgggggggggggggggatcgtttggttctgtatgcgggtgtggagttcgtggatcggggggtatgaaatggtaattccgagcgagtcttttgatttggtggactgtccttcgcttgcgacttggggggagaagaggcgcccgcgctaattggagggaggaattgcggatatgattgggggaattaatgtgaggatcatggtgtgcaattctactcgttagctcgaggataaggtgtgagtgtgtccgcttgttcttaggttgggggaaggtgtttgattttgattccaccaattcacactttctgtttatccaagtgaaggatagtagggggggagaaaaactgtatttgcaaagtaggagtaagttttttcagaatattgtactaagttttagctttgatcggttggttgctgtgaggatgggagatggaaaaaaaaaagtgttggccatgctatgtttctcgagtaataagagatatagtgaaaaaacgatgatcagttgggtcttctgctgccttctccctttctctttgatataaaagttgcatactaaggcgttatagaatgctacagaatgtggtatattgttttgctataccccacagcaaggatatttgttacacaagacaagtttgcttggacttaaagttatcattggtcttattgttatcgggaaggatatttctttgatattttggctttcctgttgtagaaaaagcaactttattaacttcaatttgtataacactagatgttatagaaagcatacacaccaaaggaaatgaatgaaaaataaaagatgatatcctttaaaatgcttccaaactaggcacatacaatggtcttgagttccattaataatccatacttctgtttcatatatgtatgcatgcttttttccagaataaaggaaaacatcggcgtatcaacaagtgaagctgcattttcttagagctcagatgaagcggcctcgaaggcgtctgtggtgggatgactgatgaggga

SEQ ID NO: 6190 - DNA, 205 bp, Oryza sativa
ccgccgcggccggcgcagggggtggaggtggagagcttgaaggaggagaaggtgtgggtgaggtggtggtgggcgtgagaccataggtcgaggaaggacttggagcggaaggcctggttgtactcctcgtcgacgcgagcggtggcctcgccggagtggcggaaggggtggagttgcttctctcgatcatggctccctctgcagc

SEQ ID NO: 6191 - DNA, 265 bp, Oryza sativa
cttggccaaacttggagcatttttcttgaacatcatctttgatatccaaatcaaattcagggtccgtctgcaaataaagtaagtttcaattagtttttattcaaccaaccagaagggatccagaccagtaaagattttttttaaaaaaggtatggactgttggtgaacccaaaaaaaaaaagaatgcagtagtaagaacaaacctcccgggatggatcaaacatatttttaagcaataggcattcactgggtggggctgtctcaa

SEQ ID NO: 6192 - DNA, 1501 bp, Oryza sativa
tgatggatcggctgttgaacatcccaggaccccctttgggcagcatcaaaaatgtagaactagcaaagttcaggagcaggaactttgacagatggtggggtgaatggaagcagcacttgttccaccaatcagcttccatgtacatgacagatctattcccagatgttatccctcaggtaaatccttactttgtcaatcctgtaaaataattgtcagccgatttgtacctttactagtctcatcttctgtcttgcagacaatagaatcttcccatcctcgcaaaagcaacagcggcaaggacatcgagtatgcttcaggcctcttaccaaatggaggtggactaactcccccgtcatcggctaccatgcccccaggacctcaagtctactccaagggcagctaagagaactagctgatgccagtaggaataggaaaactaaggcatcagccgctaatccatcggctctggctccaaagagaaaggccaagaagaagaaatccaagccaaccgatgacttgcctgccttagatccatccatagaacaagccctagatgaagaagagattaaggaagatgtcgaccaagctgcagccgaactgagtgacttaggagaaaaaacatcatcggcttcacgcaaatagactcctccaactcctgctgctccagctcacttctcaaggggaaataacccatcttgatcatctcctgaaaaaacttgcagagttgattggttatcaattttgtatttgtagaaaaaaaaaactgtcgtcaagaaaaaatagcaccagcaccatctaaaccagctccaccggtaaggtttcctctataaaatcctttaaatatgatcataactgatgttaattaacacttgtctttttttcagccttctcctcctccttcgcctcctgtgcagtcgacgcccagtgatcgtactccatcggctgcaggcagccacaatattgaggaggaagaacaacgagctgctcctgccataccagtaagtctttcattgtcataaatcttagatcggctatataattcgctttgaaatttaactgtcttcaattttccttttgtaggctttagccgatctgttcttgtttgacatcaaggattactttgatgaagaggtagaagaaaaaataacaagcaaaactctagtccctctagatgacgatgtcaaaagaactcttgaagacatatctcatcggctagagacatcattagacaacttggtggttgactgcggtacaatccgggcaagatttgcagagattcaatccctaatcccgaatgatctggcaaataccatttctccagctgtatacctcgagcaacatcaattcaaggtagaaaaggccaagcaaaggatagccgatcggcgagagcgaagggatattgaagccactattcaaaccaatcggcaaaccgttcatgaagagaaagctaagctagatcaactcttggttgggccaattcaaactaaaatagatcggcttg

SEQ ID NO: 6193 - DNA, 860 bp, Oryza sativa
tttcttagctttaaatcgaaaatcttatcagccatggtgatatcaaaatcaaatctttcctctttcccagaacttctcacccatgggcatggctgtcacgtcccaaaacgacgctaaaactatatccttaaaattatgcctagaataattaaaatccaagtgaaagcctccaaaattaaaatgtgcaaacttaaaagtcaaataaggcttggaggatttttgtatatttcctaaaagccgaaaaggtgtaaataaattttagtggaattttcagagcacaaataataattatcaagaaataaacaaagtcgaaaaggttttataaaaagaaaaccctaaaaagcctcctccccacaagcgcgccgctgacggacgggcccgcccgccaccctcactgatgagtggggcccacccgtcatccccctcctcccgccgctcccgccgctctttccgcccgcgcctagcgccgccgccaccaaatccgccgcccccgactgttctggcgtgcaattaagaggggggaaatgttccccgtgattccctctccctttccccctattttcccctccccctcccacattcaaacggccggatttgctcctgcaaatcacaccggcgccattgatgccgaccataacccccgcgccggtttccttcccctccggtcgccctctttcactcccaaccctatataaaccctcctcgtacctccctcgtccatttccgccgtttgccgcccctcctccttgtcggattcgcgcccgcgccgttgtcctctctctccgccgtcgccttcgactttcggccgggcctagtcgcttcccgggaccgtcccccgcctcggcgtcatctcctccagc

SEQ ID NO: 6194 - DNA, 388 bp, Oryza sativa
cagtgcagccaagaatccatggctaatgacacttaggttcagggcttccaactgttgattaagttctggtggaatgccgcggacgcaaagagaactgcaatagcctttttgactcagcgcgtcggccaccacgttggccttaccagggtgataatggattcccacatcataatctttgatgagctctaaccatcttctctgctgaagattcagatccgactgggtgaagatgtatttcaaactcttatgattggtgtatatttcgcagcgatttccaaagagataatgccgccagatcttcagagaatggaccatagcggccaattccaagtcatgggaaggatagttgccttcatggggtcgtagctggagtgaagcataagctacc

SEQ ID NO: 6195 - DNA, 168 bp, Oryza sativa
tccaattaataattgcatttattaattagggattcaactctaggttaattagaacaatttctccggacgatttacttaacaaatttttaaagcaaggaaaaggttgaaactttagggcgtgacactctgtctctcaagggccgccccgccctccttccccttggccca

SEQ ID NO: 6196 - DNA, 274 bp, Oryza sativa
actcacaatttgaaaattttgaaaaatttgagtgattttgtgcatttgaaaccatggtgcccgggcaaccatggtgccccatatgagtgtcatatatatatatatatatatatatatatatatatatatatatatatatatatatatatatatatatatatatatatatatatatatagctgggagatgaacatggatgcgcgttaattaatttaaatttgctaatgttcatacgtttcttggtttgatatgaatttgcatgtgtggatgaagg

SEQ ID NO: 6197 - DNA, 1501 bp, Oryza sativa
tgcggaatgccctgtttctaatcagttcactgtgtgcttatgttcatcgattatacatttatactagtcgatattgtagtttgtgttagtcagcagctgctgaataggtagggatgtaagtttttcctagagcttccaattttcagtttcatgagtaggatttttggtcatgccatagacttgatttgcattacaaactgcgatatctggtcaattagttacacttaaaaaaggcatgccaaaacgtttttttttcacgaacgcgaaaaagattgcacgtcaacatattaaaagaaaacaaaatttcaattactcaaagcaatggccggaagccattacaagggtacaagaaataaaactagagcgaagagccgactaaaggaaacttaaaggactaaggctgtgttcgatactagatgttgggaactactacagtgcacgcaaaagggagcaactcattagcgcataattaattaaatattagctttttttgaaaaaatagattaatatgattttttaaagcatttttcctatagaaaaattttgcaaaaaaacacaccgtttaaaagtttgggaagcgtacgtggaaaatgatggagagtgagttgggaacaacggaggaacgaacgcagcctaagacttcggagctagttgagacacgagaattacatgccaaaacgtcaattacatataagtcgaatgcatgtggtgttcttagagcattacaccaagagcagaagagctcaagggaagcatattagatgctgttggtgatgctcttaccttgaattttagggctaacatgggttgctacaccaccaaatttcggtatcataaatttttggtaagataataaaccaaatattaaaacctctcactacccaaaaaagaattgaaaatacctatatattctcctcacattggttcaattttgataccaaacctaaatatttatgaaccctttcagaattagcacaagttttttgatttttttgtcctaaaatggaaatatcttgaaactgaagctaagcgtagtgggccaggagcccattcacgaagcccagtcttcgagcccgcgtaactgctaaaggccatctcgtcgtcgtcctcctccccaactccccccaactgccaccgcctcaaaaccctagacaactagacaacccactactcctcgcttaaaccccgccgtccccgcaccgcatgctccgcgccgcccctcttccccccatccccctcgtagcccaccgtcttccaccccacctctccggcggcggcggcgccggcggcggacgcggccatggcgaccccgtcgtacgcggcggtcaagtgcctcaacacgtcgtcctccagccgcaagcgcttcgtggtaagagcatccgcccctccccgcgcttccagcaatctctctctcgcccccgcctccccacggaatcgagctcgtgggcgcgtttggcggctgctgatgtggtttcgtgcgtccgttgcgtgcgtgtgctcg

SEQ ID NO: 6198 - DNA, 454 bp, Oryza sativa
gatcagtgtaagagagagagtatataacgttacagtgaaccaataacaaattaaaccgtgacaagccaaaatatctaccacaccgatcgagcaccatgctttactggtggaaaccgtggaatactggtacagcacagctgtttgtttgttgcgcttttactccgggcttttgaccaggcgagcgggccccgcagtagggtgggacccacgtatcagtggccgcaggcaataaaagtgggcgccgcggcggcagcgagaagagcgtgccgcttctctctcctcctctctagcgcgctgcaccctgcacccgaacccacgccacgcgaacgcaacaaaacggctttactgcgggctctctctttctccccccccctccgtttcctcgttttaaacgcttcccctctccctgctgcccatcctccactccactccgcctccactcctccgccgcagc

SEQ ID NO: 6199 - DNA, 1501 bp, Oryza sativa
gtgtcgatcaaagcgatcgcctcagccgtacggcgcggcgtcgtgcatgccacgtcgcatatgacggcgagccgcctagcccggttaaggaatctcacagcggtgagcgacatgtcagagaaagatggcgaggttgacttgcgaggtggcgccgcggccaagactagatgggcggaacctgcccgtgccgcggcggaccgcatgatgggagtgtctgcggagctagcggtccggtggcggcaataacgggagagtgggacggcagcggtggctccaaaggtggagcacgatagtcagcaggagcagaaggagtagcatggctgtggcggtggccgtggcaatgatgaggaggtggtggctgtggttgttctcaaggacaaacttgtcttttgtaaaataataaaataatgcgtcgggtatcaaacaactaattaccatgtttttatgtatccatgaatagagacgcgttcttcgggtgtctcacaacaaaaaaaaccacaataaaaaaccacaatctttcaatgtcctataacaaattgtctttaaatactttttttttgttaatcaaacaaattttcatccattgcctcttgtgtgaaaatgattgagaaattcaccatttgttcatctcatgttataatcattacactaacgtgtcaggggcaggagaccgtcatgtcggtcatcggcaagaaccgtgtctccgacaccgtgaaggccgtggatcgggcgtggaggagcctaattgcaaatatgtagtcacgctggactgccatgtaggacggtcagcctggtcagacgtgttttggactgtaatgattcacttaaacaagttcatggatcttaatgttgattttacaatatcgtggacctaagtgacaccacgcaccaactttaaggactggtggtgtattttactcaaaaaataatttatgggtaaacttttatatatgtctccttaagttcaattctagcaagaaactacattgaaaataccatacaatccacttcaaaattgaattttaaaacttaaattttgacattgactcacaagttgtaggaaaaaaaatccgtcgccgatgccgctaccgccgccgtatccgctgcaagagggaggcaagagggagaggaggagatggcgagcgaagcatgagggggcggagggagaggaggggcgggggagagtgagagagagcgagagtgagagagattttgtgtagggtggggagcgagtatggacaaggacgggacgcgtttggctcgtcttagtttttctggtgtcattttttttaaaaaaaaccaatatttataatataggtgtcggttttgtttaaaatcggctcctataattcctgaaatgtgctaattctgtaatttttccaccccccgcataggtgggaaaagttgtacatgtgatggttttaactgtttcgacacttatagtgccgtcatctatgtgtctttttagtggtgttattaggtatatatttgtcctcatgcg

SEQ ID NO: 6200 - DNA, 1501 bp, Oryza sativa
cgacgtcctgcggctggttcagcctcgggcccctgtgcgggaaccagcatttgctcccctggacccagaacgcgacgtcgagccgccgcgacacgaggacgacggcggcgagcatgtagggccgaggagacgacgacggcgtcggcggcgaggcggagagggtggcgaagcgcgcgaccaaggggaactgcttgcccgagggggacacgatccccggcgggagctcgacgcggtggccggagttgaggttgtagagcgcgtagcggtggctggagtcgagcgcgaggacgaaccagccgccgtcggaggagccgcagaagcgcgcgacgcggacgtcgggcgggagcgggagggggtggctcgtgcggccgatccagctgtagaaggagggcgtcgcggagctggggaagatgagccacggcagctggggcgggagcggcgggagctggggcgccggcggcggggggcgcggcccctcccgcacggcggcgcgccactgcctgttgacgcaggccatgcggacgcggtcggcgcggcaggggaggcaggcggtgaagccgaggaggacgttctcggggaggtccccccacttcgccctgtccatggcggccaccgtcggcaaccgccgggccgccgccaccgcgccacgcccgcggcggcggcgatagtagtatctcgtgggctctaacatttttggcgagcgcgggtgggtgactgggtggggtggctaccggttcgatcagataatgggggatttatagccgcgtcagggcgggtggtgccttcgcttgcacgaaatggaacgcgaaccgaagaggcccgaacccggccatcgatggattccgccgcttcgctcgccgctcggactcgcgcggccagcggcctccgcttcgacacggagcagctgcgcgttcggccgctcggggggctcgcggcggtgggtacctagtccggaatcgttgtgtgttgccaagcggcgtggtgtcgccgaatgcgctggcgctgcggcggactctccccgtggagcgcgggctcgccgggaaggcgctcggcgaaatggcggcaaggcgctccactttgttgcaggccggaggctgagactgagagctggttagtcttttgggcctattggttcagatggatatctgggctatgcattgggccggccggtgccgtgataatgtgacatgacatgccagtgaattatgccaagctgccgaccttgcactgaatattccccctttctcccctcgaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgatggcgattttgtactgtgcggggggccgcc

SEQ ID NO: 6201 - DNA, 1501 bp, Oryza sativa
cattaaatctaccggcttataaatcatataagccaataagctgacttaaaagtctaggccaataaacctaagcctaaacaaagagggcttcagaatcttaagctccccaaacggggccctactctattccatgggagagagagcaaggagacgtgtgcatgctttgtggatttagggtgtgtttggctgggtggatgagcctagatgggagatggccgcccgatttttggtgccgtttggttggagggcagggtggttggggccgcccggaatatagaatattctcttaatatgttggatgagtgtatccggcagatttggctggaagaagccatccagttttggtctgaataatgtgtcctattctgattgggtgtggttggtttgattttctgttaagcaagctccaaataatcttaaaccgtttatctaatttatgatttgattacaccattatatttgttacaattaaatctttaaaacaagatcttggatgattatattttgatagaaaaaaatatatgacaaatgggtcccactaacttttggctttactcatacatgctatatccctccaaccaaacaaaaaaatttggtcatacaaaccaaacaaaaaattggattgccatatccaacaaaatatgaatgaacatatcccatatatatatgactgtgaaccaaacacaccctgaggagtcgtttcttcaatggagaaagcatgtaaggattgagttaattagcagcaagcaatgtattcagctaaactcaagtaaatctagtcagtagtatagaaaaaggtattggtgccggtgggaaaccctcttctttgctagatttttcaaccagcatccagcaggcaacactgatgtggaggagaaataggtaccggttcaggtgccggtgccggtttaggaaccaacacatttgagattccatgaataaaaaaaagaggcttggatgcatcggcttaaattgagtagctcacgagtcccacatcacagaaattcaaacccatccatcccacatcacaaaaaataaatcaaagagcttgaatcacagatcacacatccatcatcgatctgccacacaaatcacatagcaccacaaatccacaaatcaagaaattgagtcacagaaattgaataaaaaaaaatcaaaaatcatacatccgccgtgtcggggaagggatgaggcggccaccgctgaaccgcgccgaggaagatctgacgcttcctcctgaaccccccccccctctcctctacggtgaggtgggggaggtggccgggaggggggggggcagaaggaagtggaggttggaggggcggtgctgggtcctaaaataaaaaagctaaaataaatatttgaactaaaataaataagctacagatatgcatatactgaagcagcacatttttcagctatatatgcagagttacagcgccttatgttttggcgtttattcggttggcaacctatacacgcgaatgaatagataacaatc

SEQ ID NO: 6202 - DNA, 1501 bp, Oryza sativa
gaacaactctatttcgatgaagaataagatggtaccatcaaatagtagcatattaaacatcaactaggtctgcaatttagagattctagaatcatactatcatacttttagagttatagacctagttgatatatataacgaggatcatcgatgtattttactctcttttttttttcaggttgccagtttgcaggttctcttcccccatgggaaccaaagttttccatgcgaagtgacagacacagaaccaaatctagcttttaattggtctaatgtttctttctttttggttggtgtagacatcaaaggattttttttaattggtctaatgtttctttctttttggttggtgtagtcttgaaagggtttcttgtcatcttccattagtatccacatttgcttgattaatcattattaaaaaaatattttgtctactatcaaataatctatcaagattttatactccctctatctatgaatatagagtattatgctctctaagtttgtccaagaatataaatgatatttgttatcccaagacaagaagtctagcagcagtcagaaattgagtactaccatccatccctgtcgtaaaaaatatggctcccatcgcatgatccaataagccaaagaataagccaaattttgaattttcaaagttaattttgaggttgattttgagatattttcaacgtagttttttttcaacattggcttttaagttacaaagaacacatatataaaagttttacctacaaatttatttttattccctaataagcctttttggcttattagaaaaaaaagccaaccgatgggggcctatatatatatagagaaaagtacagtggtactactctatagctcccaatctgccaaacatatgtagtttatttctaaatgtgtactccctccgtccgaaaatataagtatcttttgacctcaacacagtcttcgagatactactttaaccaacaatatctataaaggtgagatgatctaaataaaaagagttgcatattatgatagtttgtttgatgataaatctagtaacatcagttttacataatttatcttttttaactttttactattaatggtcaaagtcgaaaatgtttgacttagaaccattttaaaagtgattatattttgtgacggagtgagtatattctacactttattcagtcccttctgttaatgagtgtcttttcacactaccagatgagtcagatgtattttttactcttccttaatttggtatatattgggttatcgacttatattgtgggtgccacacgaaaataaggatggtcaattttggagcctatagagcaaaattctagctcaacttgtcatctgcaccactagtccactacctgcatcttgcagccctcgcccagtggttttctacatccctgtgcacatgctacttgcaaacgagcgtcacttgctaccacgcggcagactagagcgagagagcagtagccaccaaccgcgcccg

SEQ ID NO: 6203 - DNA, 1501 bp, Oryza sativa
gggaggagcaagcagggaagggacccaggctgtaccgctttcaatgcgtgcgacgccccaactgcccctcgccgcattaaatgcggtaggggcagacgtgcggtgccacccgactgacgcgcgtcagtcaggaatgaccggtctgtgaccggcctgtcgccggtcgcatctgactggacgggcgaccatgccctcacgtcgcttctgttcccggcggagtggaggtaggtatgacccgtcccgtcagagcatgattcggagctccctccacgagaaggacggtcgtcacaagtcttcacccatttatgagggaatgacaggactgtcccctgtatcagccggggacaagcgctgggtcccactcaagaacgagctgtggcttagcttccagccgaaggcacggatcaaggtccagtcaaggtagggtgggtcccatacccggtagaagagtaggtagagccggtgtatgtggtatccctttgagctataaaaggaggaccttgcccaccgagaaataggatgactccaagcagacctgagctctagggaaaaagagacgagagcgttctccggagcttaggacccttgtaacactcaaccatgatccctcacacatgagtagggtattacgctccatagcagcccgaacctgtataatcctctcgtctacacacaactagtaacgttcagggcggatacacgatctccaggggcgagccctttcccccggccgaactcacaaaagggggatctcacgatctcctgctagagaggttcactcctcgacaagtatagcttcggactaaaaaaattttgaagccgagtattcctagctttataaatctatatatctaactttttttattacgttaataacatttggatgaatcattttattcctattttagataaaaattaaaatatcaaaccactgtaatttaacatatcaaatctagcatagacataagatatagagttgtgccaaataggacaatagaaagcaatcatcttgaatgataattaatcatgccatgttaacttggttgcactacgactacgttttcatcttcacaaacatcttctttctttttacaaacaggctaaagaaaactcgtatgtaaaaagatttaggagtgacccatatacgaaaattaattttcacaaaaaaaactacttaacaggtatatatatgaaaatatgtttatttttatagacgggcatgctaaaatgctaacatgcccacatgtgaaaatagaattttcataattagtgaattttcgtccacatgagaaaaggagacatcgttttcttctccttttctctcagtggcaagtcctgaagtgatcctctccttcttctcagtcctctctcacccaccacctctcctccccatcttcacccttcccctctccctcatttcctctttctcccccatcacttctctcacccagcggccaacgatggagcacccactacaggagcatcgctgatgaagcgccca

SEQ ID NO: 6204 - DNA, 1501 bp, Oryza sativa
acggaggggcagcaacagtggcgctcgtgcaggggagggggcggcgcttggcgctagtggcgcagggagtgggcggcagggagcagatccggtcagcggtagcagcgcgggggagcaggacctcgggagcagtggttctgccgctggccggccacacccttccatgggagaacgaaggggtggtggcggcactcgtgtgtgggagggggcggcgctcggcagtaacagtgcaggggagtgggcagcggggagcaaatccggctcggcggcagcggcacggggagccggacctcgggagcaaggcggttctactgccagctggccgcgcccttccttgggaacacggatccgaaggtggctatctacccactacttccaaagcgactcgatcgtccctcccttgtcgacctccgcatgcccttccatcgttaggcttccattgattgcaggtgacaagtcacgtcgtaatggatttggcgccggcgagtcgcacgggcgtgcaagctcgtccacggcgggtggtgggcgcgttcatggtgggttggcgggcaggtctggcgtgggcgcattcatggagatgacgacagaggcaagaatttggatttggatttggtaatgcgggactctgttgtggatttgtggtttgggtttggtaatgcaggctctttgctggcggttagagggtaactgcatgcggttattttcaattttttttgtctcaaaattgattatcactgacggctggcttaacataactgctagtaaaatttaattatcgctggcggctggcttgacacagccaccaatgaaaatcgatttcgttggcgtttgaagtcctatttgtgaagagcttacattttctctagcctttggtttcaagtggtttgactagccgccagaaaagacccattttagccagcatggaaaactcttttttagtagtgagttaaaacgggtgttcaatttttttttacactgaatatattacaccgctagtccttatcgagcttacctaccattttagcactctgcgtgttctaaaaccagcggtaatgccgcttggaactggcaaagtcaattcaatattaaaccaactggccatgaacacctatgaacggtattttgtacatgttctggtggtggaatcttctggtcaacttgtaggtagtaacgaatcataaaaatgtcctagtgctgcaacatgcggacacatacaaaatatagccaaaatagttcaaaattgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtcttggttaaggtttctatcttgtaaccctgccccccaacctatataaggagggcagggagccccctttaggggca

SEQ ID NO: 6205 - DNA, 1361 bp, Oryza sativa
agatatgtttattatatctccttaattaacttataattaattcaccatagttcaaacatgagttaggataataattaataggtagtggacacacagaagatgcacctctataagaatatcttagtaggtagtggcaaagctaggatttaattatgagaagatgcacctctataagaatatcttagtaggtagtggcaaagctaggatttaattatgagggggccagcttaacaaatgattacaataaaaaaattgtataaatatatataaatttaaagattttctatagatgattaaaaaatatcagagctaaaagtctataaattgacagtaattagaaaaaaaaacttagcaaaattagcaataggtataattagtttcctaatcatcatggctcaagcgcaagaaaaacacacacctacagctacagctacaaatttagtctacaaatttagtaggaaagtggaaactgatatgtaaactcaaacacatacatatatacttatcacggcagccatgcgtcattagcaaactgataatggtttcttaggatacacatacacatataaatctaacacatctcacaactagatatcaatgatgacgtagctgatgcagaactaattcaggggatcaggcgatcaacacaagtgtgatgctgtatcaattttctttgttttagggggtagggtgaatcggctgctgattgggggaggccaggcctcctcccgcccctagcttcgcccctgctagtaggaaattagcatcagaaaactacaattcatctttacttttatactaatcatattcagtatacacttaacatatacatgcttacaacataggacttagttccaaacacactactgagagaccactcactactggtctcccagcgtggttatggcatttatgtactcttacgtcatacccgaacgtaagagtgcataaaaactctgccaccacttgccgcctacctcactttccgtgaagcacacaacaaactccaagagtagggttggcaacgggacggggcgggtgcgggttggataggaacggccccgcccccgcatccttgcgggttcacacggccctgggcccggagtgaggaacggggcgaaatcaatccctgcccccagcccctccagggcgccgcaccatttccgggtccccgcacctagatgcgagcggcgactgctagcggccggaggaaggaaagaatggtgttgggaacttgcagcagccgggtggaggaagggaataatgatgtggggaacctgcagcagtcgaagggagaggaacggtcggagaaggaggagaacagcacaggcgccgacggctagagaggtaggagaacgaca

SEQ ID NO: 6206 - DNA, 644 bp, Oryza sativa
tttttataatattgagcatacatattcatcaatatatcccgcatcaaatggcatagcatcatttgtgcttgtctaatccatatggagtagaacttatcattgtggtatggaagtatgggttattcgtgccatgctgttctttcgaaaactttctactacctctattgtaaaatgtagctatttctatcacagtaacttatctcaaaataaaacttttttttttttcaaatgccctctcctcttaaccaaccacaaacattccccttcacctactttttttctccaccaatcataaccctccaattatttctatatacttttttaattcccgtgcccatctaaaaaaatatttacattttagaacagaagaaatacatcaacattatttacataattttttttctaaactatttgttcgctttataatatttaatttaatacatcaatatgagacaatattctccatccacgaaagtttggatccatggcctacgccaaaaccccaactgcaaaataatcctggctacagacagatcgagaggcaggcaatgcgacaagattacacgacacacttgaaccaatgaaccaccattgtcactttgccagtcactagctagtatagctagctagcttgatcggatcaa

SEQ ID NO: 6207 - DNA, 1501 bp, Oryza sativa
atgagagaaaaaaaagtgaaaccaacatctcttctttcttttctttcttctcttctccggaggttgccggcggcaaatgggggagaggcggccaccttgagaggctccgttgccgccaccgccgccgcacccgacaacgaggcagagcttccacagtggcgacaacggcagtggatcggacgccgttgatgtcgaaggctagcgccggggacgtagcttgggcggccgatgaattcgaagcgtcgcggtgggcgcgcaccgtcggtcgctgagcgacttcgtggcgttcctcgagggcgggtcattggccccagggtccgacaatggcaacaacgacggcggtgagtagcacgccgtgacgcatacccgttgcttcactgcgtccagctccacagccatgaacctgttggtggcgttgccgtcggtggaggtgttggtgagcccaaggaatccattgtggctatcaactggcggctcgtgggcgctgctctcttcacagccacccggaggctcacctcccttcaccacatcacaaggcggaggcggtgtgacaggtggaggcgttggtgaggccaaggaacccgtcgaggctaacaaccggccgctcacaggcgttgctcccttcaccgcagcagcgggcaagcgcggcggtgggcggaggcaaaggtagctaaggcgggcggaggtggtggcggctcccccgccctgggaatgctgtacaaattcgacgtaaagttgagagacgacggcttattacaaacgaatatgttctgattaattgcagtatttcctgaacttcaagtagcaatatatgagctggccatctatgtttccttttaattgaatattaccagagcttcactttctacggcagcttagcaagctaactctgtcccaaattaacatgtccatactggtagccataatctttttatatattttattttaagacagagatagtataaataggtggtactatattgcaatattaattactttcgtgtacatccctccaaaatattttatattatgggtcggatggagtaacattttagcacaaagggaatacactgatatttatggtataatttattcagatgaatttgctccatgcaaatttgtttcatgcaaaattcctattcggccaatacatactctgcgtatatataactaactagttagatgttggtgtgtttcacgtgaacatgtggattaggtgctagcaagcttcttaatttaatttctatcaactactggatcgatggacacacaagttgttgagcaagttggatatatagttactacgattaatatacgcaaagttctcgatgaacatatatacatatcatcagctcgatcgtcgtgtgtcacgtgttcatatatatgcttgctctataaatacacatcaaccagatgaatctttcaagccgtgcagagatagattaagattaattacagacagagagatcatcaagctaattaagccagctacgtatactag

SEQ ID NO: 6208 - DNA, 1501 bp, Oryza sativa
ctataaggcacaaatgtacaagtatgacatgagaatgtgttggttagtgcattgaagataaatttgatttacccaacaggttatgagctcaaggattgtaaatagcaagggaaaatactttttatctccttttttttacattggttggatatggtcgtggcttttgaagccaaatgttgtccggtgatgggagaaaaccacttactctataccaaggttttgtagctgagatagcgatgatgcgctagtggtagatcaaacactcacgtatatctgatggatgaggattgtcaatagcaaggggacatactttttatctcttttttttacattggttggatatggttgtggcttttgaagccaaatgttgtctagtgatgggaaaaaaccacttactctataccaaggtgttgtagcttactatgtactacatacaattttactatgcatagtcgaccacaagatcaacgagtgaattcgatttcgtttagggttggcaagtggaaaaggaggaagattagatagactacaattaaggtgatgacagaagcatatgtactagaaatagcgatgacgcgctagtgatagatcaaactctcacatatatctggtggatgcgatcgtggtttgttttttcctctcagacaagtggattttagtttcaactagaagtcatagttagcgataaaaagaacggttggtcagagcaatgttttggagcttactatatatacgcacgtcagctagagccatgtctaggacaccctggtattatggtttatttattgttatggatagtgccatagtggaccacaaaattaacaagtagacttcgagttaaggcgatggcgggagcatacatagtggacagtgatgacactagagctagattaaacctgcatatatatggtactccctccatttgaaaatatatggcatatttttttggacaagcctttgactagcagttactttattataatatgttttttatgacgcaaaattgatgttatgagattcatattcaaaagtacttccttatgattgtgctagcttttgtgtcacataaatgatatatctagcaattgttagtccaagtcttgttctaagaaaacaaaatacaacttacatttttgaatggaggaagtatatatgtttgcggaggtgagggatataattagtaaggtggacaacggcttgacatgagtaccatcactacaacaaaaaaaaccccatatagaggcacttttggtagagacacttttttaattggctctaaaattaggagttttatagggtagagactttttagaggcactttgaaaattgcatagaaaacttttactatagagagacactttagagacatttttagtatgtttgattctattttatcttgtagagaaattcttcatgtactgtaaaaattgcatgttatgtaaaagacattttaagctatatagaggcacacctttcaatgttaattcatacttaggaacta

SEQ ID NO: 6209 - DNA, 1501 bp, Oryza sativa
cacacacctacgcgcaaaaatgtaccatatgcaggacatcttcggcgccggcagcgaaacatcggcgacgacacttgagtgggtgatggcggagctgatccggaacccgaaggccatgcggaaggcaacggccgaggtgcggcgtgccttcgctgcggacggggtggtgttggagagcgcgctcggcaagctccactacatgcacctcgtcatccgagagacgttccggctacacacgccgttgccgctgctgctgccgcgtgagtgccgggagccgtgccgggtgctcggctacgacgtgccgcgcggcacgcaggtgctggtcaacgtctgggcaatcggccgcgacgagcggtactggcccggcggctcgcccgaggagttccggccagagcggttcgaagacggagaggcggccgcggcggtggatttcaggggcgccgacttcgagctcctgccgtttggcgctggccggcggatgtgccctgggttggcgttcgggctcgccaacgtggagctcgcgctcgctagcctgctattccacttcgactgggaggcgcccgacgtggccgaccccgctgagtttgacatgactgagggatttggtatcaccgcccgccggaaggccgacctcccgctccgccccacacttcgtgtgcccgtgctcgtgtctggcgtctagctgatgttgccggccggctcggagcggtgattaatattatgtatgcttgccaccatacagatctagtcctttatatgagcttggctctactctcctcttctccctagcgcgtatcccaaactattacacgatacgtcttgtaatagctttatatataaagtttttcttttctaaaattaaacaaattcatttgtaagtttataacagttaattattcatatattactggcattttgcgtgccaccaaaagctcgtgccatccgacttcgaatgagccatacctagtacaaatcaaacaaagttggttacttaggagatgaaccagtacaaatgaacttgcgaacagtagcagatgaacctgatattcttctccaaattatgcagcagaaaggattgataccaataaaactaaaactattaaggagagttatccaagcaattgcgtgacaagaattctgactagatagtctcagctaattaatatagtagaatgtgctgtttgtggctattaatagtacacgactattgctcggatttttaaactaagtggttttttctgtagtcattgacatattccaatttctttaacatataatggaagctttattaaacttagctaattatataaaagtgataccaccgactgagaatactctcgacctctgcataaccaagatacacaaaaccaattccattttggctttaattagttatagcacttgactccttgcattaaacacgtagcaactcttttgcggatttccaaacaaatcgtaacttttaaatatttgttagaaatattgacaattcaccataata

SEQ ID NO: 6210 - DNA, 1501 bp, Oryza sativa
gccgccagccgaagatgggccgggaagacctagcccatggttcggccgaacccatcctagcaccgttggatgcagggttcgatgtggacgtccaggattgcattccaatgacggttggagggcacttcagacaattccccttccacaatcgtcataactacctctatataaggacttcacttctcacttcactcacacacctcaagtaatagctctctcatttctctcaagtttagtttagtagtatctagctaggtaattaggaatagaatagaaatcggagtccggaagccttcagaagagttcgggtatggctctagtagctttcctttcctcttttgtaagctttgcacttttaatagaatactcttctttatacatttatggtgttggaatactttccgagtatatgagtgccaactttacattatgtccatgttatactgattatactgctagcttatcttggagatacataggtacgggtataatgtttgcttatgcaattactctatgtcatgacgatgatattagagtagtatctggtagtttaggcgtggtgtctagattacgggatattattatttggggttatatgctgcggatgagaggtggtccgctgatggtgacagctcagtatgggtattcctccgcgcgtgtatatagtcctaagttaattccctggggagggtactcctccgtatttagccccggttgtatggtaagacgagatgtcgtaaggaactcgacagtcaggagtaacttctcgtagtactaagagggcatcggaaaaagggtattagctagttaatcatataactagaatgtatgtatactatgtatactagaagtataggaatagattctctttctattttctttccacttagcttagatattttagtatgagaatgagtagcttcctgcttgtgtgtcactctaccctttgatttacctcaacccttgcttagactataattattacaagtaacatataaattattagtatagttctctctactatgatttttccacgggattaaataaatacgatacccttggaatactcttgggtgaaatgctacaatggtatatccgcgcgcttgcagatgaaatctgtaaccataatataccaggagtatttctggcgccattggtgggaattatatttctagtaatgtcgttaagaaataccaatatcgttatcaagcgcctgccgcagctataaaagccactagaatagctctatcctttcccgaggcaggtcgcatggcagcgttgtcactaccaccagcaatcaaatcctcgttcatgccatccttctccgccaccaaactgttatagtatatggtagttagacggctagatatgtattaggataggattgatttgtgtggacttttttttcttatatgtaatttttccttatctctatctgtgtatctcctatatataccggccccctaagactcaatataatgcgtccaatattcataatatc

SEQ ID NO: 6211 - DNA, 1501 bp, Oryza sativa
atctaggagggaggggccgggagccaccggccaccgctctccccccgccccctctggccagatctgggagggaggggccaggagccgcgctgcctcgactctcctcgccgctgccgccctacgccgcgggagggaggggcgcgcccgccgccgccaccgccgggagcacacgccgccaccgccccgcgcccggctgccgaccaccggtctcccctcttcgggcagatctggaggggagaaagggaaggaggggagccgccggcggccgccccttctgccgtggggagagtaaggggagaggagaggtgaaggggaggggaggggatgggagaggagaggagagtgaggggagaggaaaggacttagaaaaattttagcccatatgccacatatatataccacgctaattttcgcaggcgcacctcatatggtccgcctgcgaaaatgattttcgcaggcgccacttaagtggtccctattttcgtaggcggacatcaaatttaaccccgatttatatttttgtaggcggttatttagctctaagcgatatgttcgtctgcgaaaataagacccctacgttgggaaaaatgttttttctagtagtgtacgacaagagcaaaacaaaaggaatacactccattcatatgcttctccgctgggagatttggtgtgaacggaacaaagttttcacaaacaacaaactcacaatgtcgcatctagtgatgaaaattgtggataaaatcgagtggggcaaaaggccgaggcgctgttttgtgaggcaatccattagttactacaacaatcgagcttgtttggctgagggccagccgacaaggcccaacttgtgagaaaggaagcaaacgcacgccgtcatcgatgtaggctactggtgggccggctgcaggaaataagcagggccgtaatattggatagaggaaatagtaatcctatttaaaaaaaacaagactttgtctataagtcccatgtgccaacaaagaaaaagatactaatggatataattttaccatgtgcatcctcagtaaaaaaaatgttttgtaaatagacctttgatacctatctacgtaacgtttcccgcggaaagaaatatttacacgttcatttggaaaaaagaatatttacaagtacctcattgacttatatttacgagatctgatagccgagagaattaggagaaaaatataaaattgtgcatataattttataattcacacttgttaatcatgactatcttacaaataaatttcattaagcttcaggtcattcaaagtatatgatgaggatgttaggtcccgatcttccaataggtactgataaacagtcgatttgggcgaagtcgcgatacaactcaatccggcttctgaactaacacactacttaggcccgcaatcacagcactacgtctcctctggttatcaaccgtgttgaaacccgattgacctaaccaagaaggctaatccctgcatgcgaatcgaagagcaca

SEQ ID NO: 6212 - DNA, 196 bp, Oryza sativa
aaaagatcgataggctctgcataatatttttcttcttgttctattctgtttggcacgtacgtacacatcccaattccaccaaactctctgtggatttataaataccctgcaaattaagagcaagtaatttggacatccgagacacacagattgggagccaaaacatctcaaagaatatttccaaagcgatcgacca

SEQ ID NO: 6213 - DNA, 527 bp, Oryza sativa
taattagtgtcattagcagttaattaattaattattttttatttaattaacatcattagtaattaattaatcattaattatacgttaatcatgatccatgtcaggccatctcgcacgctgctcaagcgagatcgcttcttgttttgctgtcacgctggtcccgtgtcctggtgttgcgagaccgtgcggtatcgctccaacaacctgtgagaccgtggtctatcgtcacgctatcgttactttcgctgaatgaatcagcgatattgttttgctttcgcactttcaatcagcgactatggtatatttgtgtaaaaaattttacatcccgaatattaatgaaaaaaaaatgaatgaatggtatattttaaaattgattcttactttctccgtttattttcacacaattctttatttaaattcattaacacctatataaacacctatataaagaacatatataatatacgaaacacatatatgcatccgttcaaaatgtagactggaatttatagtgcaaaaccagggaa

SEQ ID NO: 6214 - DNA, 1501 bp, Oryza sativa
gacaacagcagcaaccgccccagcagtaccaaccacccagtagcagtggccagtcagccaattggccctcggcactcaacccgtggaacggtacgctccagatgtggccggcattggtcgattttgctccttcccgcgtcaactaccctagcctcctccgtccaccgctgcccaagaacacgcgcattgtcaggggcttcctcggcttggcgggctactaccgttgtttcatccgcaacttcgacaccattgccgcgctcctcacagcgctgctgcggaagtaggactttcactggactaacgccgcgacatcggcgttccggcagctacaacacgcactcacggcagccccagtcctccagctcccggacttggccaaggagttcatcgtggagtgcaacgcgtcgggctccggcctaggcgctgttcttcatcaaggcaccggcctggtggcattcttcagcaagctgactgcgtcgcgccacgccaagctcgctgcctacaaatgcgagttgattggcctcgtccaggcggtccgccattggcggccatacttatgggggcgccgcttcctcatccgcacggaccactacagcttgcgcttcctcttggatcagcgtctctccactgttccacagcatcagtgggcatgcaagctcctcgggtttgactttggcgtgcagtacaagtcgggaatggcgaactttgtggcggacacgctctccagacgggacgaacacctagcggaggtgttcgccttatcggcgccccaattctccctgttcgatgagctgtcccgcgaggtagcctccacacccacccagttccccattcacgaagacatcgccaagggtgccaaaccgccagcctgggcgttcacagacggcctcatcacattcaagggctgcgtcctcgtgccgctgtcgtccgcatcattgccgaccatcctcgagccggcgcatggcttgggacctgaaggaacacaaaatgatggaataagccttgtggtctttggtctttgtggtccttcccttgcttttaggttgtttttctccttttaggatagcatcctttcagttttgcttttagtatctttcagttttacttttagcattttagtacagcatctctgctagcatctcctttatgctttatgctttcaaattttgaattttagactagcttgcagccatccagccagctatggctatatatatatcatatatgtatccaacctcccccgggacggcatggctttgagtttgtgaatggaagaaaaccagaaaattgcccatctagagtgccatcctcttatcaatgagagtaaccattgaaataataacatctggtatcagagctacactttcctgtagactaaatatctcgtgttcctccccttcccaagttcgagggagcattcagccagctgctgcagcagcaccggctgctccttcccctttcccttccacttctccaagaagcagcccccggaggcgtgcca

SEQ ID NO: 6215 - DNA, 862 bp, Oryza sativa
taatgcatcgatggccatgattacgcatgtgcgagaagtccaacggctcttttttttaatgcggcagttccaattatatagataactttgcgtgctgaaaacggattaggtggatacatgcagatcattaaaacaatatgtatagcttccaatgttgactagaaaagtatgatttccacattgcttcttttttaactcccccactagcttggcacttaacttacttttggcatgcggtccataagttaaagagtccttgtaaactaggttgctgactagccaatagagattagaaagaccgacttgaagaccttgctcgcggtgacaaacgggcagaatttgaagtagatatatactagtatatattggctacagggcatcgatcgaccggaccagttcaaatttatgcattgagacccatcagacctgttgagatgggtgacttgttgctgatcaaagactgattactcagtgcagccctgtagagtcatgggttggattgatattatttgatgctgttatatatgatcctaatcttgtccttaggtacttttagtttttgttcttcatatagtgctatatatatactaagaatttataatgagtaatgcaacttttttatatgcaaatgccgcttgtttagatgcaaattgagaaacacctaggggtcttccggctagctccacaaggtggtgggctagacgacctaggttctaagcctcaccccttctaattatttgatattaggtcattccttaatatttgcgtttttttagatgcgaattgtttggatacattttatatgcaaatgatgattctaccatgaatggtgcatcgtctctctttcatcttcttccacaga

SEQ ID NO: 6216 - DNA, 1501 bp, Oryza sativa
gccctgtagagtcatgggttggattgatattatttgatgctgttatatatgatcctaatcttgtccttaggtacttttagtttttgttcttcatatagtgctatatatatactaagaatttataatgagtaatgcaacttttttatatgcaaatgccgcttgtttagatgcaaattgagaaacacctaggggtcttccggctagctccacaaggtggtgggctagacgacctaggttctaagcctcaccccttctaattatttgatattaggtcattccttaatatttgcgtttttttagatgcgaattgtttggatacattttatatgcaaatgatgattctaccatgaatggtgcatcgtctctctttcatcttcttccacagaacccacgagccctggtcggagtgtgggtatccgacaggtgtggagattggggacgttattcacctggtcgttggtttggggctaggggcggggacgttccaatccacctctgccctaccccgttgtcacccctactcctatgtaggttggtggacaaccatccgagctctgtatctacatctgtaattcctatgttccataaaaaattaatttatagttatgaatctagatatatatagcttacatctagatttatagtccgaagttgattttctataggacagagagagtaatgttaattgctctattggttgttgttgatgtatgaaaaaaaagttgtcagcaagccaaaaaaatgtatggaggataaacattggtagcaccttttattcacctaaaacaacttgcttgtaatctttatcaagataaggtacgtaaaataaaacttggaggaaccaagtagtgtcaattgctctgcggactattgttgatgtatgaaaaaaaagttgtctgcaagccaaaaaattgaggatgaacattaataccactttattcacctaaaacaacttgcttacaatgtttatcaagagaaggtaaaataaaacccttatctttaaacccaaagaaaccaaaacccaggttgtgaaacaaccagtagaaagaccttccttccctagctcgcagcttatgtgcaaccatgttcgccgaacgacgaacccaacaacggtattagttgcctagtggatgtggattaggagggttaattatgttctgaaacgaaactccaagtcagattaaatcatgtatgtgaaataaaatgataggagtatatacacataaatgcatgtaaaaacacattaacagtttaacaccactttttctacgcaaaacagtcagttctggatccagatacaacttacccggcccgtcccagttctcatggagtaggattcgaggagaccgtgttgatttgcttagagctaagagacgatgatggcctccatgatgcgtctccctgcccatcagtagctcgacagacttgcttccggtggcgagcgtacatggcagaaatggcataatctgcagtagtaagagggacatcactaggattgcct

SEQ ID NO: 6217 - DNA, 1314 bp, Oryza sativa
ggtggaggagcgacgacggcggggtctcgtcgcgggcgcgcgcgcagtaggcgagcgcctcggcgcgcacggccggggaggcggcggccgcggcgggggaatccgaggcgagcaggatggcctgctcgaggtcgtccatggcggtggcggtggtggcggaggaatctggggcggggcggaggggggaaaggaagaggggcgaaggggaggcggagttggggttgatataggagaggagagggtttgctcctcttcctctccactgcggtgcttttctttcccttcccttctttcttcctgtctaatcttccgtttttgccggatttcgtgggtttatggacggttttggttttgggtttgggtttgggtttttaggtttaggactagggaggggagggtcttttgatatttttttaatctaaaaataaattattttgcattgtcctttgagaaatatctagctctaaaagaaatattaaaggaatattagcaatacttgaaaaaaataacaatgtcgtatacatatgaattgatcatgtgtcactctcagacattattatgcaagtattttttgcgcattacatatataatatgagttttgaagtttttatgcaggctccaagttgacaattgcaatccttagggtttcgactcctcagctggttgggacgttatgtgcatggaataattattgctcggggtatagaagttacgtgtttccttaattacaacataccaaacctatcgtttctatgaaaacattcaagatttgacatgtatttattttggtgttggttaaatcatatttttggacggtcagagattccttgtttgtgcatatcattattgatacatgacacaattagtagggatgtagatgggctgggtcaacccatttacccagtgacccaacccacgatctatggggcaaaaaccatatgggtcaacccacaatttcacctaggctaacatgggttggtggcctcgtgacgcacggaccacgcatggggttgacccatatcttacaccacgtttacgcactcacaggctccagtagatgttggtgggtggaggcgacgacggcgtgcatctgcgtcaacactacagcaaaatcggtagcctacttctcatgctcattacctcatcatctatatctccacctctgctcaccccttgtgctcgacgtcgggctcggcatccaattcaacatgtgtctcttggagctccggtcaccatgtttgtgaatttcacatagagaagatcacgggaggctgaggctagaggctcttagtagtgcttgcttgacggcccagt

SEQ ID NO: 6218 - DNA, 770 bp, Oryza sativa
caagcacgccaaacacatgtttaactttgttggcaggatgctccttgagtggtgattctattgaactgttgtgaacaaactaattattggatgctgaattgatgagtacatacgtatacgtatacgtatataccaacaacctacctcagtacctctaattggcccgttggcttttgtttcagaaatcagaacaacattttctctacatttcaaatctaattcatcagtaaggatcatcaaaatcataatttgtgctaattagtaattttcatttgttttgcatagtagtgccgcatatcgatcagcttttacaaatcattgtgacatatacatttttcagtgtagtataaatatagtaaggcaactacacgattgctattggccagcaaataagagagttttttctcttttttttaataatggtatgaaacatcccggcctttgctcacaagagctatagtccattattacaaaagtagcacactaaaaagcttagtccaaagagttataaggctgatgattcctgcacgttaatgctaataagaaggcagcggaaatcacaccacagccaagctgtattaatgtccaaacctccaaatcgctttgcgcctttcaatttgcaattatttctcttgcctatgttttcattttgcaattatttttgtgctagacaacaaataataaatgaatcaacttctgtctatttataccatttccatgaagtgctcgacaactcacacccatggccatggtgcaatacgtcaccggct

SEQ ID NO: 6219 - DNA, 577 bp, Oryza sativa
tatggtctctatatttataagtgaatatacacaataataaatagaaagataagagatgatctatgtggcgcctccacctcaagatgacgtcaaataaaatgtatttttatggagactttaacaagacaactcaaacagtgctctccgtttgttttttttccttcttcaaatatatatatatatattctcgtgtaataaaaaaatattaatacattcgacttatttttaagcgaactctatttaatagacacttgcccaatcatatatatagccatcataaatacatatatatcttctcgtgtagttaataaaatacttatacactctatattaataaaatattaatacatatttatcttctccctcttcttcactagctagacacctgtccaaccatatagtggtgtattaactatgtgccaatgttctccaagagtccaggttggaagtctctgctgtcactaaccctctccagtgtataaatagccgggtgcatctcctccatggcactcacctcaccacacaccactccaccatcactcacagccaccacccgccgccatggagcaggtctcgt

SEQ ID NO: 6220 - DNA, 1017 bp, Oryza sativa
tgagacaaaatgtggatacccacgatactatcatggtaatgtacaacaccaccagaagagtcaagtgaaatgcagcacaagtagcatgaagtatttcctgcatgcaacaaaggctaacatggtaacaacccataaggccgcatctagcagtattttaccaacggcagttaacacaatcttcatgccaaggccagagtgcacagagttgacactccccccagtcaaaccagcagtgctatacaatgtaactgtggtagaaatgtttattaaaggcgcagtatgctgtgcaaaatatttactccctccgtcccaaaaaaagacaaaccctgagtttccatgtccaacgtttgaccgtccgtcttatttgaaaaaattagaaaaaaaattaaaaagacaagtcacgcataaaatattaatcatgttttattatctaacaacaatgaaaatatgaattataaaaaaaattcatataagatagatagtcaaagttggacacagaaatctaaagtttgcctttttttttttttcgagacggagagagtaatgcagaagcagcagaacgacatgtttactgggacgatgggacgatcgccagaacgacgcgtttcctgggacagaggaagtactacaaacctcagcaaaagtctcacccacaggcccaggaatcttcctttggtcaaacgtagccatcccaccaacagccgagggccccaccccttcaagctgccaggtcatcatcgcccccggtggtggcccccgcacgtcagccactccagtaccccaccccgaccccgacccctcacccgccgcgtgacgttaccgcccacaccccaaacccgaccgttacctcaccgggttcaaaacggcccactcgccgcccgccacgtgtccgacccgcaccccgcccggtcggtccccacgtgggtgagctgaccgcgcccccgagcttgcctttgcgtgcgccgcgcggtgacgagacgacgcgagtagtgcgaggtggagaagacgagccgacac

SEQ ID NO: 6221 - DNA, 428 bp, Oryza sativa
tatgaaatttcatgatggaacaatatgttacctgaaattataaattataagattacgtgatgacaaataaccctcggtattttcaaaaaaaaaaggaaagagagagagaactcgatctatattgtaataatattactctatctcaaatccatgctacaaatcatacgcatgtataataaaaccacaaacttaaaacgtgacacccgacgcgcaaatagatccacggggtgtccatagcacgttttgggcaatcacgccagtcaccacgcttggcatatgctggtaaatattccacgaaactctgctcttatatcacgagcactcaccacgcacaaatccaccaaacacagatttagctaaccaatgctgttcttgctacaagattaatcagttatctgtaggtattgatcagtgatcagttgcagaga

SEQ ID NO: 6222 - DNA, 1501 bp, Oryza sativa
actcgatctacggttttgtttagcacacaaattaaccatcttaagttctttttggcgatggatacatcttctaaactggatattatgattttagtttaactaaaattttaataaaataaaacaaaccgtactaaacatgctcatgccattgccacttaccaaaatttaatgacgccgtaatgtacgcaccaccaggggatcagtgatcagggtccattcctgtccctactgctcggagcatctaacaagagtaatagaaatcggagagagacgcgtcagcaagaaatatatatgtgtgtgaggcagatgaatcatgggcaagtaagaaatctctgagatgactgaggccatgtttaaatcccacctcaaaatttttcaccttctcacatagaacgtttaacacctatctgaagtattaaatataggctaaaaaataactaattacacatattacgatgaatttgcgagacgaatcttaagcctaattgctccatgatttgccaaagtggtgttatagtaaacatttgctaatgacagattaattaggcttaataaattcgtctcgcggtttacttatggattctgtaattaattttttattagtatccgaacatcacatgcgacaccctatataatacctgatatgacacgctcaaactttaccaccctggatctcaacacccatgagtggacattgtatcagcgctagcgtgtacctttaaaaacttatttacaaatggagccttgctcaccttatataacttatttacaaaaggctaaaatttggcatggcattggcagtagttgatccaaaaatattttgaaacccggataaacttcactcactactacatatacgattattccatgcgaccaaaattgatttttacatacggaagggtggcccgcatgtgtcaaaaggtatgtgaaaaatccaattttcgcatgcagttaacgcagtcgcatgtgaaaatccgtttcttgcgtacgggcgcttaagtcgaccgcacatgaaaaggaaaaatcgcgaaaaaaaatccgaaaattaaaaactacaccgaaaccctaaccctagaatccactcgccgccaccgccaccatcgtccttgtcctcctcctccagatgctgccgtcgtcgtcctcctcccatatcgctgccgatggatccacacgggagggggcaaccaccagattggggcgggggaggacggctgccaccggatcggggtgggccgggggagggccacggctaacgaattggggcactggaggacggtggaaacctaacaaatccctataacacattatttaaaattgtcttttacatatatcactatatcgattaatctataccgttactataatttagacacacttcgatctaacatgttaaatctccttctttgtcatccacttagaatgtggaggacacattggttgtttgcatgccaaaactgcacacatattaacccaaattaataaaacaggtttgaccttgaaa

SEQ ID NO: 6223 - DNA, 495 bp, Oryza sativa
tctacgtatttatattcattcattaggtctattcgttatttgtgtataggagtaaatggacatggatacacgcatccatacacacaagtattatagctcacatgtaatatcttgatttgctattggctagaaaatagtggggatggtgtatgtatcgagtttgttatatattatgagagagttattagttttcgttggttttagtgtacctatgaaatatttagatcaatttaaaatggagggaggatcatctttggagaagttgaggttagacgtggctcaatcacgacagccggccgtaataatctcatcgaagacaactcgccgacgagggaaacgacgttaaccataacgttgacgacgttgataccgtgaaaatgaaaataatattttaaagatctatttataaaaaaaaatttgaaaaaaactacaatgtgaaaaatactccgcgggcggtgagcggagtctcggacgacatcgcggcgcttccaaaga

SEQ ID NO: 6224 - DNA, 418 bp, Oryza sativa
caagttcttgtgcttgccatgatgccatctgacatcgagatcaagtagttcttggatcatctggatgatccgtgatgtcacctcatggaagtgtgacgtaccactgtagtatcatacaacaactgattgatcactgaatcgtcgaaagagatatggtccctgaattcccaaccgccttcgtagctagctagcactagcagtcactcacctgtcaccaactcaccaaccaatcatccctggatggagatgtctccctcaatttcccaaccgtttcgccgttcttccaatcaattcagagtttcagaccgccgttcgatccagcctagcttttccagttagagacatcctactgtttttgtgtagttgacaagcacagaggcactcacactgtgtgaatgtaattgccatctttgccagg

SEQ ID NO: 6225 - DNA, 377 bp, Oryza sativa
aattaatcaatattaaccaatcactgtccaacgctacaccacgttgcaacatgcccaaccaaccacctgaaatacaccagttcattaagctaaactaggggtgagactaatcacggtgaacctggttgatcgcccataaccgcgggcacggctattggaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggc

SEQ ID NO: 6226 - DNA, 1082 bp, Oryza sativa
ccagtagctaatgcccatcctgaaccaaatcaagaacccctgacactgaatttttccccctatcttcttgtttctctgatcaaaccaagaaaccatgcaatgcatttatgcatgtatctagagcattagcttgtttagtagatgataatgatagatgctttagggtcaaaatcattatcttaaggctgcggttgtacctgccgaagtgtttatcttcaggtacagagaagaggagaaactagtaacagtcaggaagcaagaagtgcatattgcataggaaagtaagttcagaaagtatgcatatgacgtagaggtcgatgcttagcagtttggtgaggagtctcgtgacatttgatctcttcatggaaagagattgcaaacctacccccgtatctcacgaagttaacctgtccttcacaagtgtttctagaacgtgtcaatttcatcaagctgattaatttcaggtttattgtcattgaggagaaaactaattctaattagatatacggaagatcatgtacggactaatcacattttctttccgaggaaagaaacttacagattgtttttaaaaacgaacttattatgttttttaatagataaataaagctttattgaactcaatgagaactaaggttgttaaaatcatgatcctaaatcagaggtctctgagtaggatcgcaaataaaaaatagtatatgtaggaattgtaaaatcgtggattctatctactagaatcgtagaatcaggttctttaattaggattgtaaagtcgtagaagtgtagagctgaatcaagatttttacaatcttcctgaaaatacttagtaagattgttttgtatcaccttattgtaattggttgaattcaataattatctcattatctaaaaataagtgtctcgattaactgatcacgtggtacatagccaagttgtttctctgaatcattttggctgacagagatcagcatccactgcaaaagtcaaagtggatggaaggattttatattgtatctctgcacacgcattgcaagcattccaaagcatatgcatggaacagttgactgtcatttctgaagcga

SEQ ID NO: 6227 - DNA, 1501 bp, Oryza sativa
gaaagattcgtctcgcggtttccaggcgagttatgaaattatttttttcattcgtgtccgaaaaccccttcaaatatccggtcaaacatgccacgtgacagttaaaaaaaaattcgtgaactaaacaggcccttaaatcctacagatgaacgtggaaagaggaacagaggaatgactagtctgcccagtataaccgctggcactgtgagtgtgatggagacatggaaattaagggcctgttcactttgacgccaaaaaaaaccttaccaaattttggcaatgccaaattttggcaactatgccaaaattttggcatagttgccaaaattttggtaggatttcttatatagttatcaaaatttggcagcaaactaaatagagccacttttttgataactttatcaaaatttggtaaggttggaaatggcatcaaagtgaacaggccctaattaaccttgtcgtgcggttggtggtttgcgtggctcagatttcaggccctgattagataagactaaaacttttaagtccctatcacatcgaatgtttggatactaattataaatattaaacatagactattaataaaacccatccataatcttgaactaattcgcgagacgaatctattgagcctaactaatccatgattagcctatgtaatgctacagtaaatattctttaattatggattaattaggcttaaaaaatttgtcaagtgaattagctttcatttatgtaattagttttataagtagtctatatttaatactctaaattagtgtctaaagacagggactaaagttaagtccctggatccaaaccccaccttccacatgaaccaatcaaattctacgaatgcagcttgcgcattttttctaaagataattgaaatgcgttgcctctatcattgctgaaattaataaggtttgtagagtagctttctttgctgaaaggaaaaatacattagctaaaataatggctagttcaatctccgataaggaaaccagattctaacaaataactcaatagatattagtactacatacacatttcaaaaaaaaaagaaagaaaagaaaacgtcaactatcaattctatgagtgcaactctatagtatagaaccccatttctcctctcatgtaatcatagaccaataataaaattagatgaaagaaaaaaataatctatataaggttagaattttttttttattcttaaaatactccatcatttcagcaacgctagattaaccaacacaacaggctaatcgtaacaaaaatccttttttttaataagttggcatgtacactaccttgagtcaaatcccaaaaatcaattttggcaattgcagcttgtgcatacacctaactcctctctccaatctaaatttcccccactaaattctcatcaaaatttcttaaatattcactcggaaatacgatatgacataagtccatgagctagtagctcctagcaagacacacagacacagtggaagcaaaa

SEQ ID NO: 6228 - DNA, 443 bp, Oryza sativa
tttcattttttacttctaaaagtcctgccaaccaccgtgcttaacggcatgcctgctatcctcatcttaatcgtcatagggactctaaaaatcatatataatcatttttgaggttttatttatagatacctcatcaaccacagccaccctactcatttatgagctcgttgctcctcctcactttattttcatttactaccactatgttttatattgacggttctttcaacattcaacatttttcattcttacttaacttttatactgatggtttttatttataaattgtattcctacttaaattttatttttattttttattctaaatttacatcatattgtatactatatgtgtattgcttcctttaataatcaattttattttgaattctagaaatttcaaaaacctaatcctacttgaactctcttttttattttttcta

SEQ ID NO: 6229 - DNA, 996 bp, Oryza sativa
ctagctagcaaatatcaatttgtgattacaattatttttgaaaataggaacgttaacataataagtgtcaacttgcacctggatggtgtcgttggcggcggcgagggtgggcaccaagccgccgttgcttgtgttgcaagcgatctcgaagcccgcgctgcggaagcagccgccgccgatgccgaacgggtatggaatgtcgacgtcgccgcacctcgcctggcagccggcaggccggccggcgatgcccacggcggcggaggacatcagaatgagcagcactccggccaatagccgcaacgatgccatccgatcgagatatcacgtacgtgtgctaattatcgatctcggttgattcctaattgcttcgttcaatatatatatatgtacttgctctcacccgcgcttgttcattgcctgcagctttattatactccgatcgacgacccagtcaggaatggcagaaaattaacgacatgctagctaattactttcttaagttttctttttagtcttgtcttaaatcaaacgtttatactcgctctgtttcggaaaaaaaacttgtcgttcagagcaggtacaatagcaggctacaagttagctgtaagcacatatggaagagaaaagataggatacaaaaggaaagcgggttacatatttataactaactgcagcatagactccaaaatattgtgtgtatgagaggtgagaccatatattaatgttgtagtatatatttatattgtatgaaagagctattagatttgctatagatgacttggagctggtagctggctatactattaaacttgctcttacacaaaccgcaaaaatgtaaaagattgtggggataatctcattaaatatatcctaattatttttttcaaagcatatgagccaataggagttgtgactgtatttatatatgatgacgagggtagacaggaaatatcatttttaaaaatgctttgcaatgtgacaacgacaaccaatgat

SEQ ID NO: 6230 - DNA, 1501 bp, Oryza sativa
tttacctcgcagttgacgtagtgaggtagcggtgtagcactccagtacccatccatgtattttcagcaagccttggccttttcctggtgcaattgatacgtacacctagcaaaatccaaaagagattaatttgcacttacagatcaagtgttactcctatatgcctgggtttggttgctgtgtagccgtgaaagctctcctgaatttcctgatcaagcactgtttaatatttgttagccctgcatgctacctccccaccgaattaaacaattcggcagaacagaccgccggcgacggccaaaatcgatctacagagaagattaaaaaaattaaatagagaaactatgccgcggtagatcggctgatttcggccaaaaagtttacggccaaaacttgtccccagcggagtcgccaaaatatattgacgcttttttagtcaacacaagatcacctaatgatttgaggtgcaatcaatagagtcgccaaaatcgatagatcaaaaccggctagcagagccgatttcaagattaattcactttcacggaatcaagtgactaatttataagcaaattagcaaggaagataaatatcgtacttacgtgacgacgaacgactagtttccgagcaaactagtaaaggataaccttctcgctttcgtggagaagcacgaccgtttttcagcgcaaaacggtaaagattaacaaaatagaaaagatcagaaagtaaagaataggaaacggtagattgataaatagtagattgaaattgttcggacctctcgccaacgtcggagctgtaaatttatactggcaccacacccggcaccataggtctcccttcatgttcggtggatccatccttccttcctatccgagtcgataccgtaggcatgtaatcaggctaatgatgatcttctataatcttcaccacgtaccagtccacccgattcacctctgtggctatccaaaactcctaatcatccggctgcacctgcatggtctgtatacatatatgcatatctccaaaataggtaaaattctacagccacccaacaaactgcacacacatttgaccaactctcaagcaagccattcaatgaatcgtgaagctaaactacacaatctggcatgcctaaatgaactaattactagccaaattatggcataaacagatgttcgtccccgatccagcatattacagcctatcagagttacaacgacctttgtccagacaccgcgggtagtgtggagattatgggtaccccatacccacacggcgtggttatccgactagttataggagataacttatatctatggaatatgtaacagatcatgacttgggtattacgtttcctttatattacgaaacggcctaaagtcctagtttgataatattgtaaagtagatttaggaaaccgataccgtattggttaaggtttctatcttataatcctgccccccatcctatataaggtgggcaggaggccctctagggggca

SEQ ID NO: 6231 - DNA, 1501 bp, Oryza sativa
gactaaagataatttagcaaaaagaaatcggaatggtagtacaaactgttgttttttatgtataatgaaactatctaacatctattctttaaatgtcattttgctaaatttctatgcagagcagtcttcatttcctttggtttgcgaagtccctgtaatgtctctcacattttgggaaccggcctgttggcatgaagtcaaaaaccaagaaatatattttaattggtgcatttgcattatgttaggcttaatggcttaatagaaatgacatggcttttaacataactccaacaaaatggtatatgtaggtattattcagatcaatatattggcttcgattctggatcaagctacaaagatgtgaagaggacaaggaagccatgcacaccgaatgtagaaatttagagttaattgtcatgcagattttcaccaactttgtataacgatttagcaatagacttgaactttgaattagatgttcatttcttgtgattggtgttggtgtgttggtttttgtcatctttttgtctccctttcttttattttgttatactttacttggactttgatccaagaactaagtggctgaagtttaactcagttgaagcaaagagtgggtttacaactactccctctgtttcatattataagccattttgactttggtataaagtcaaactacttcatatttgactaactttatagacaaatctagttatatatatttacaacaccacactagttttattaaatcaataattgaatatattttcgtattatatttatcttgggttgaaaatataactatttttttatataaacttggagcagtttgattttgaccaaagtcaaaacgacttatgatctaaaaagcggggagtgttatgtaaaacgcataagttcaaagatttaaccaggtgcaatatatatgctaggtgctccacacactatacaaggtattttcagtctctctctctctttttttattacacgcaacaccatactcatatatctacgagtacgtcctctaacacaaactatacaaactataagagacgaaaaccaattataatggacataggaaaaagtaccaatatattatatctgcattaattttccttgattatatatattggccgcttactcttatcactatgtaagcaaaattaaattcatatttcctccgtgccaaaaataaatttatcttagtgttggacgctcaaaacaaatatagtggaaaaaagattaaagagtcattcatcagtaccaaagcagtattattgggtggattggtaaagagtatggaaataataaatttatcttagtacaaagggtagacgaactaaattctagaaatggagttattttagtagcaagtgacagatcgttgatttctgctctccatatatatatatatattccttgactggatcatatcgtcgtcgatccaattgaaatataaatatgcgcgggaagaggtagctgttgcacagaagttgaa

SEQ ID NO: 6232 - DNA, 1501 bp, Oryza sativa
catctgtcactatcgtcagtctcggcaatactgttgcagccactgccgtcaaacttgacctacccattgtagccaccgtcggactcgactccccccacgacgtagctatcgggctcgacccccatcactacagccaccgcggattcgacctccccagctccccgccgctatgaacacctctcagattcgtttcactgaaaaattatacatgatcgaaataccaaacaatagaaggggttttctgataaaacagggccattgcttacgagcaggcaaacctgtccttcttacgtgaatgcttagttggcggtctactcatcatccaactcagcaaaattagatttgctattctatttagtcatagtccgcacgcacctatacaagtttgtgcaccaaaacgagagtttttcaagtttttacactaaattgcacccacctaacaagtttgtgtaccacggacgcaatttactcttaaaaaattaatagcttgaaaggagaggagcattacacgtaacatgcatgccaaattaatcatgcacggcgggaattaattagggaactagttattccacgtcatgcatgtttttcagaaagatagcttttcatgtcattttaaattctcaaatttgcaatacctgagcttttcccataaaaaattgcaataagtgtatatttgaaattggttgaaaatggttcagaaagttgttttgatgccagacctgttttcgaaaaagaaagaaaagggtctatcagaatattttcacaaatcatcgaaaacgaatttggatttattttttctcgacaacagagacacaagaagggcactatctgtcggaaagcaaaaactttccagaaaatttcaccgaaacgaattcaattttttttattggaaacggaaatgaactaagtctgtggtgtgagtcagtgaatgactgtgtttgtgttgcgcatttcctactctataaatgccagttgtcctccgtgagatgttgtattgttaataacttataaatgtgatatgtgatactgagatgtgcacttctgccctataaatatcagtatgagatgtggtgttcttcactttgagattttttttaagggaagtgtttactatctcaaaagatgaaaatttggacttggcaaagtcaactgtgatctgtgatatttccttatgataaagtggtctcgtagtatcgttagttgctaagttttggaatttttatctattgctttagacaaaattttgaagctcagtttatggggttttatattcctataaatattcattaccatgttcgctttgattcatgtttgctttgtgtttgtgtttgatactccatccctaaatgtttgacgccgttgatttttttaaacatatttgaccattcgtcttatttaaaaaatttaaataattattaattcgtcatttgattcattgttaaatatactttatttatgatgatgacacaactagctcggatataaccatgactaccttatg

SEQ ID NO: 6233 - DNA, 1501 bp, Oryza sativa
gagttacgatgaattagttatgaatttctgaagttttaatctatttgcatctggaaaaaaaactggaaaaaggaaatatgacgtcatgctgacgtcatcatcgccggcacgacaccggcgacgacctcgccggcgatagagaggtcggcagggctatctaaaggcatctacacgtagaggacgacgacgcgaactcaccggtactagcaaacgcgatggacgacgacgaatggtggccggcggcgagctctagcggcggcacggctcgggtcgacgtcgacggcagcgctccggcggtcttcggcggctgcgaaggggcggccaggatgctcctcctccgtgcgcacccaacggcggcgaaaagaggcgtcggccacggcgctggcggcggcgcgacgcggctgcacgacggccggcagcggcggcgactaagacgacgcggcggcggcgctacgagcgacgagggaactctggagttggggcaaacgaaaggggacgccaaggagatgctatttataggcttgtattgaagagatcggactccaaccgcgagaaatcaagccgggaaaaactagggttagtttggagagataaactcaaaacgaattcgatttggtttatccgggcaaatttgatctccgaaaccttaggggaaaggaagaggataaggaggagatgatttaccctcaagcaatcggactcgagggcgaccgattgaggcggatttggcggagagaggcggcggctcgggcttggcagccggccggctggaggaagaagaaggtactgtagcgaggggatctaaaacagacttctcctgggcttccacttccaaggactgattaaaggagggacaaaaagcagacttggggaaagagagggaaaggactgcaggatgagaggagactgggccgagagtgagaggacttttcctaattcggcccgaaaaggaaaaggtgaattttaattacttttctaattaaattaatcactgaaatgatctttgaattgttaaaaatacttctattcctcaaataatttcaagaaaaatcttgaaaatacttggaccctcaaagtatttaaaaaaattataatcagaccatttaatgattaatttaatatgtggataattactgaaatgttctttgtatgattaaaattaggaattgagctccgaaaaatccgagaaaattccagagagtataattaaccatggagaatttaataaaaattaaatccagccatgctttatatttaggaaattttatttctcacatttaacttcacttgtaaattaatgaacatttaatataaattctaataatgatttattaaataatttataaatcctaagacgaaaatcaggatgtgacaaaatacttggcaggtaatttcagttcatccttctgttcagtctggcatttctctgaggagttcttctactgttacgcgttagatttaaacttgctagtgtctaaccatgatgtttgtaccatgcagc

SEQ ID NO: 6234 - DNA, 746 bp, Oryza sativa
gtacgcgtcgaatggtcccaaaaattggctcctcacccttgcgcaaatgaagcctctttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcgataaatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgacttatttatggaataaattaaatcattatatgcccataatctcaacaatccaaaaaccttattataggcactgtgattttacta

SEQ ID NO: 6235 - DNA, 1501 bp, Oryza sativa
acttttttctaattaaactttgttaagtttgatcaaacttatagaaaaatttagcaatatctatgttagaggcatgccatgagaaccttcgaccgagcctatcgaaacaagtcaatgcccaaggcgaagtgccagagcgaagtgccaattggtgcacaagcagctacctcagggcaaagctgaaagcatttgccaccaagctaggcgttttcgccatcacaattaaagaacacggggcctaaacaggccaatttgccaaagaaggcccatgtcacggtccactaacaagcctatggccaaattgttacttttacccttataaatatccctattataagggtatttatgtaaatcccctttatatattagtcatagggtgtatgagttcgtattaaagactataaatagaccataagggacatgtaatgggggatcccaaaaattcaatattaatacacattgttttactcttccaccaagagtgaaccatggtcttcgacgaacgttgttgtcattcaacaacaatctaaataccaaattagttttattaaatttagcattgaatgtttttttgatactatgtttatttgtgttaaaaaagtactataatgtttttataggcttgatcaaatttaaagaagtttgactagaaaaaaatcaaaataacttataatatgaaacagatagagcactttagactagaggtggcctgatttttccactttaaccagatgattttacaaaagtttcaagtctttctctccatctctcctctcccatttattttctttttcgatgagaagctagcatggatccaagcaagctggggattccttctctcggctccattctgttaacaccaaaattggtaagattttttagtggattcggtgaaggaaagagcacaattagttggcggaaacttatccataagataccgagttcaagaagaaatcgtgaagactatgacatgacggcttaattctatctattaattaggtagaatcaattagtttcctttaagagtaaatatcacaaaaccccaagttttgggggcatacctatcacaaaacctggttaactaatttttatcacaaaaccccaccctttgaggcatattgtttcattgcacccatattccgttcacctccttctgtgcgtcgttttctgctccggttcgccgtttccgtgattttgtttcctgtttttgcgatgacgataaagtgggaattaccctctccacatcgtcattaggcgcgaagtattggtgctaacctgggccatctcccgccacttctctgccctggccaacaacatactacgtgatttgatctatacccaacgaaggatcaaggagacctgtggagagagcaaattagcctcgttctgaactttgcagcaggtaagaatgccttttcctcacttatttactgcaaatttggatttctaaatgaatcctaattgtgatgatgggtttgaaatttcccctctagttgttgaa

SEQ ID NO: 6236 - DNA, 181 bp, Oryza sativa
gcaatagcattgcaactaatagttttaggaaccgaaaaataaatggtaacagaaataagcgatctagtgaatatccctccgttggattgtgaggcagaattgcctccgttggtgttgtcgatcgaagcgccgcctcctgctccgggtgcacctccagtagaagccatagcgacgacgacga

SEQ ID NO: 6237 - DNA, 1501 bp, Oryza sativa
actgcgttaccatattcgtatccgtatccggagaaaaaatatccgtattcgtatccgtattcgaactatccgaaaaaaatccgctccgaacactatccgtatccgtttttgaccggagcggacggaaactatccgctccgttttcacccctactacacagggatccttgtgctactagcgacagccaataggagggcagtatgtatcaccactgatccgtgccaccacctaatcgaaccctcttagccgtccgatcaaaccaacggcaatcaaacgaccccacgttaaaggctcatgagtaattaagtcggttcacaagatggtaaaccctccctcctgactgcctataaattgccctctttctccgtccggatcaccaagaaacagatcagtagtcggccatccctgaagagcaaagcggttactgccctcgaactgtcagaggtacgagttatcatccattcttccgcacacgttagcttcccaagatctctataaagtttctcttggtgttttatattcttagttctcaattcaaatattataacaaaattagctttattttgacttattgattattcaagcatagttgcttcgtcaatagctctttgatgtgatgcaaagtttcatgcatctttttaattgtactaatttgtagtccctctatccaaaataactctactagtaaaaaaatagtataaaaatggtggataggtaactagacgaagcgatagaggttcatttaattggccacaaataatgaagactaaaaataaacttattttgaaatagatggagtaaatacttttgtaggattcgcctttatcttttctcgacaggtaatgtgtccattctaattttgtgaacgagtggctaattcctccgtataaaaatatgtgacaatattgagtttactcggttaaacttcttaaacttcaacaatctagctctcaaattacttagtttaaaacataactaaaaatcatatgggtagatttttatattttttgctttacttttataatattttttgtattattattattattattattattattattattattattattattattattattattattattattattattattattattattattattattattatgttttgattcaaaaatagtggttaaagttgcacgctaagtaccaaaaaaagttatttaaatatataggggtagtattattgcgaacattgcaaggtcttgggataaggtttataaattcagatctctctcgccattctaacttcactactataaaatctctcatatgtatcggttcataaaaaccgattcatttaaaaccgacatctataaatctcttttcccctccttttcccctccgtgcgatgaaaaaaaagcttgctctccttataagagtcttgaaagccgatgtattactattgtatatagccaacgtgtgaataatgttcttgtctatatatgtgtatgcgtgcgcatggtttgctgcagga

SEQ ID NO: 6238 - DNA, 1501 bp, Oryza sativa
caagcgaagcaaaaaaaaattatgttcggtaaactattaaataatgtattgtggaggtgaaggatatattgtacatgtatagcagcgacgagttgctttctaggcgcctttcctcccgtggacttgcgaacaatctgcttagtacgagccatcctgcagcaaaccatgcgcacgcatacacatatatagacaagaacattattcacacgttggctatatacaatagtaatacatcggctttcaagactcttataaggagagcaagcttttttttcatcgcacggaggggaaaaggaggggaaaagagatttatagatgtcggttttaaatgaatcggtttttatgaaccgatacatatgagagattttatagtagtgaagttagaatggcgagagagatctgaatttataaaccttatcccaagaccttgcaatgttcgcaataatactacccctatatatttaaataactttttttggtacttagcgtgcaactttaaccactatttttgaatcaaaacataataataataataataataataataataataataataataataataataataataataataataataataataataataataataataataataatacaaaaaatattataaaagtaaagcaaaaaatataaaaatctacccatatgatttttagttatgttttaaactaagtaatttgagagctagattgttgaagtttaagaagtttaaccgagtaaactcaatattgtcacatatttttatacggaggaattagccactcgttcacaaaattagaatggacacattacctgtcgagaaaagataaaggcgaatcctacaaaagtatttactccatctatttcaaaataagtttatttttagtcttcattatttgtggccaattaaatgaacctctatcgcttcgtctagttacctatccaccatttttatactatttttttactagtagagttattttggatagagggactacaaattagtacaattaaaaagatgcatgaaactttgcatcacatcaaagagctattgacgaagcaactatgcttgaataatcaataagtcaaaataaagctaattttgttataatatttgaattgagaactaagaatataaaacaccaagagaaactttatagagatcttgggaagctaacgtgtgcggaagaatggatgataactcgtacctctgacagttcgagggcagtaaccgctttgctcttcagggatggccgactactgatctgtttcttggtgatccggacggagaaagagggcaatttataggcagtcaggagggagggtttaccatcttgtgaaccgacttaattactcatgagcctttaacgtggggtcgtttgattgccgttggtttgatcggacggctaagagggttcgattaggtggtggcacggatcagtggtgatacatactgccctcctattggctgtcgctagtagcacaaggatccctgtgtagt

SEQ ID NO: 6239 - DNA, 1501 bp, Oryza sativa
tggtatattttgataaataaacataaagggttgattatattaattaatagatcatgttgagttgaatcgcgtcttatgaagaacgtatatgctaataaagttctcttggaaaagaaaagaaaacgagacatatattaaatctcttttttgcatttaagcaaaacacagcttttgaatatgtttaagctcagggataaactcgactttaatacttcatgatcacttgagaccggccccctttcagaaagacgaaaccaagacgatttatttgagtgcaacatatcaagatcaggcatatcaattgtacacgaccaattggctgcattattgcagatcaatgtcgcgacaataatgtacaattgtatttaacctcatcatcatgtattatatattcatgtacatgtagagctacattatacctgattaattgatcaacgcgtattaattcctccctgtaactattgtacttctaaatcttgctctttttctcttttgtgctaatggagaatacatatacatacatacatacatacatacatacatacatacatacatacatacatacatacatacatacatacatatatatatatatatatacatacatatatagacttccccctccttaccaaggcccaaaacccacctcccacctcggtcaaaggcccctcccaccggtcaaacccgcctactaactccccccaccacccacctcttctcagctctcgtcccaggatggtgcagtaacacgacgaccactgtgcagtaacattgtgtcttacgtgcagtaacaaagttaaaatatagttaaaatatagtcatgacggatctacttttgataagctctttttttctagcatcatggtgcaaacggttttaaaaaaatcttacatcacttgggagatattgttcttcaaagcttgacttttttgcaatttgtctctccacaagtagtaataccattccattacctggtaccacctggctaatggaccgtaccaccatccccttatgaaggtacctcccctgcgtttacctatttttttggggtggggtacttggataaccccatggtaccgggtcccttccgtccagtaccacttttattttggggcagcaacaagtatatggttagcatctgagacttttaacctatatatttttgtttcaattcctaatttactgtaattcaccacaatattactgtcacatcttacacatgcagtaacgctatattggagggaggagaccaattttcttgagaagagggagaaagatcggttcttgaggaggggaatacgtagatgcatcttgaagtttaatcctccatatgcagtaacactataacatcatggtggaaacggttttaaaaaataatacatatcttgtgagatattgcttttcaaagattgacattttgaactttagccctccacatgcagtaacagaatgtgtaatttacagtaacaggggtatatacatgtagtaacatggttttacc

SEQ ID NO: 6240 - DNA, 1501 bp, Oryza sativa
gtgacggcggcgctacaccggctgtggggtagcgatgaggcgagctcagctgggggcagccggtctgtgcggtggcgaggcaacaccgcgctcagggtgttcgccggtcatcctcttgttgcccaagcacctcgctcgcgtttcatctcctcttcgttgacattggcgagccagagccacgacagcgtcggcagcagcgcagggtggggtagaggatgtagcctcaaatccgggtcgacgtcgtgaacctcgaagggagaggaggggagaggcggtcggccacgccggcgagagagggggaagagtaggccaacgaacctaggagggagaggggggagaggcagctgaccgtgcgtggtggagagggggaggaggccgatgaacctgggatggagaggggaagagaggtggtcggcatccatttcacgcccagaaatttagccctaaatttccagactattttgtgtattaaatccctgtccaggaccagccagggtacacaaaatgacaagtaatatacagttccaaacgtaaataaagcgtaaaatacttacagaagaggcacttagtcctcacaccgaaacaaaagccgcagcagcggaaaaaggcgatcctagcggggcttcagctccactccacaggcaaaactcaactggggtctgagccttggtcctctaactccgtcttcagctcagaagcactacacttctgaaaagggggaataatagtaaggctgagtacaaccaccgtactcagcaagccacaccaatgatgcagacgtgcacggggacacaaagaggggtttgtggctatttgcgtaaaggcagttgtaaaacattttattgagcaaaatagtaaaacaattgagtaattaaggtaagattaaatctccactgatcaacgctaaaccacgttgaacaggcccaaccaacccacctgaactacagtgcattaagtcgatttattaggggtgagactaatcacggtgaatctggtcgatcgcccataaccgcgggcacggctattcgaatagttttactctggccagaggtgcacaactgtacccacaagacacaatccaccggcatgtcacagtgtcatcatgtgcccatgatgaacacgtcaccacgtcgagtgattgtgacaagactcttcatataactctcccctaaccatccacaccacgctaaggtttcacccccaccccctaccctagaggtgggcagtcccctcgtgcgctgcggtgaatccggcagctggacaaccggacaccccggccgacccaactccatcacgcccaccctcgccacggtgcctaggaaagggtcgagctatacttcaagtcaagcagttacccactcccgcttgtggtaagtattgtaagtcttccagggtttcccgtgaaccggtccttaattaccatgggtgcgaccagcaaaaccatgcacccacagcccaccattcagtcgcattttagttggataattacgaccatgaaaca

SEQ ID NO: 6241 - DNA, 417 bp, Oryza sativa
cgtacgtccgttcgagagtgatcagtacccttctccgaaaaattcaaatacaaattttaaaaataaattaatttgatatttcaagcaactttatataaattttttttacaaagaatacaccattttaacaatttaaaaaatgctaagaaaaatctatatcttaagtagaattaaatggacaaaggttttgagaagaggagttattaggtagggaaacttgaacggcggaagattattattggttgaaaaaatgatatatatatatatatatatatatatataaactacgtacaaaggagttatattttatgataaattttaaaggtaaaaacttattactacaaatattttagaacggataaatacaaaattgattggatttcacgcgcatgggcgcatgattgcaggggcttggca

SEQ ID NO: 6242 - DNA, 1501 bp, Oryza sativa
atccggatactaaaaattgaaaccaaacaactcatgtgcaactttactctttttttattagagtaaatttcacacgaaccatcatttttctttaccaagataggttatatgcaaacttaatgacatggagtaaattctctcttttttatttgcaattatatttcgatttgagcatttaccagttaccccccccccctcccgggttgatattatctctgtcaagtaataaaaccatagtattctaaaatgataagtagattgcatcaaagtcagactaatacggataaaataattgttatctaaaaacgtactctttaatttaccaatttgcaccatttccaaattagaagtgtttcatgtccgtgtaatgattcatattcatctctcccaaaaccaaatttgtaactaactattcttttgtcattatttaatactccctccgtccaataatataagggattttaagtttttgcttgcactgtttgaccactcatcttattcaaaaaatttgtgcaaatataaaaaagacaagttgggcttaaagtactttggataataaagtaagtcaaaaaaaaataattccaaaatttgttgaataagacgagtggccaaacagtgcaaataaaaactcaaaatctcttatattatgggacggagggagtacaagattagttttgagttttgacaaatgtttttataatcatgtactcctactactaagtgaagataatgaaacttatgaagtgtgatatcattttctttacacaaaatatattctttcaacattatttatttggcaaagctatacatacttttaatatatcaaatattaaaacattttactgttcaagtccctatcacctactccttcccgttcatagttcttcacattttagacaacgacatggctttcaaaacatatatttgactacgattttctattaatatatacaataaataaataaatatttacttttattatagtaccttttaatactaatctataatatgttattttagtgcctttaaattaaatacttaagttatgccaaagttcttaaagtttaaccataaattatccacaacgttaaaaaatatgaaaccgaagagagtatatattactccctccatccctaaatgtttgacgccgttgatttttctaaacatgtttaaccattcgtcttattcaaaaaaaattaagtaattattaattcttttcttatcatttgattcattgttaaatatacttttatgtatacatatagttttacatatttcacaaaggtttttgaataagatgaacggtcacacatatttagaaaaatcaacgatgttaaacatttagaaaatgagagagtatatatataccttgtgcagaatgaagcttagccacccagtgtacaaacacccaccagaaaatcaacaaagctttaagctgacataagacacaaaacacaccccttcttaatctaattatttgacgcgtactaaaagagagaaa

SEQ ID NO: 6243 - DNA, 1501 bp, Oryza sativa
tgaaattagaacaatgtgatggaaaagttggaagtttttgtgtgtagggaagttttgatgtgatgaaaaagttgtaagttgaaagtttgaagaaaaagtttggaagtaaacaaggcctaattaacatgataacatcggacttttcaggcaatcaggctacaggagcaggaagacatctgcaggtatacgtatgttgcttcccgtggatattattagtagctgaatcctatgaaaaaaatatgataagcgactaacattaggaacgatctcatggtagaggggcgggactagaatttaatttctcaaacctatagctggtgtactattatagtttacacataattgtatatttaattatcttcaagcttttgaagtgtacagtataattcaatgggtgtttaggctgtgtttagttcacactgaagtttaaaagtttagttgaaattggtacgatgtgatagaaaagttgtgtgtgtatgaaaggtttggtgttatggaaagttaaagtttagaaaaaaaaaactttaaaactaaacagggcctaattaggttcatgatcgagtaggactacttacggcgcccttaactgtcttattagctaggttaagctaattacgttccgttgtagcagataaagagaagaaatctctcgtgtgttatccacatcttatggagaggcgaacatgggaaacaaaaatcatggtggctcacatgatgacgcggatttcaggtcaagtatacgtactagtatcgatgacgttgtacgtgtacacacaatacaatatatcataagggtagagtttacgtacgtgtatttatataggtgagtgtgtacattgtgagtgtctgcgttgtactgtgtattttttttaaaaaaaattggtgtatgtcacattctcttttagtttttttttttaacggaggagaacaacgccgtaatacgcacctggtccattgtgtatagtacacgatcgacgacgtggcatgcagggaccgcgtgtgcgtgcgtacgtacgtcgcatgtggtggctggcgtccgtccgtgcgtgtctgtctcgaccgcccgcgcgcgcgtggtccacgtgcggtgcggacggcgcagcatcggtcggtcggtcgatcggtccgtccgtacacgtgtgggtggtggtggtgctggtccagtgaacgaaccagttgggctggacctggtggaccagatcgagcgcctgtcactttgtctggctctgccacgacacaacgtgtggagattatgggtaccccatacccacacggcatggttatccgactagttatagaggataacttatatgtatggaatatgtaacagatcatgacttgggtattacgtttccctgtatattatggaacggcctaaagtcctggtttgataagattgtagagtagatttaggaaaccgataccatattggttaaggtttctatcttgtaaccctgccccctaacctatataaggagggcagggagcccctctaggggca

SEQ ID NO: 6244 - DNA, 1501 bp, Oryza sativa
tttataaatttaatttaatttaaaataatttggcttacgacaaacatacgatctgtaggacggataataatgcagccaattgtttactgtatagatatttatagcctatctctcagctcactcatataatggttaactctttaatataatagtccacatgtctgtttcacatgtctgtttcacagattttcttggtttctatgtctaaaccggttctaaacttacagcctgcttctcatctctatcctctcctctctcatccatctcagcattttgccttctcatagattatacttgctctaaacagtaactttcttcaccctggctttttagcaaaaagatattattactagtagctgatactgcaactttttttttactactgttgtaacgttgagactgtgacaagtgtcccaaatctagcagtaaaggctgcatgcatattggattctcctgacttttgaagaccctcatgatactgtattttgaatactttgaaagctcaaagtgagaaaaagaaaaggtgaaattaaggagtgaagagtagggaaaaatcatgagtctttctttacattgatgtattgtgatggtggcacttattgacatttgcatgacactatgacagtaaaagttttgtactgaagtagtactagaagtagcttgaagctgaaaaaatgaagtggagtactcaaagatgtgactgaagctgaaaatgcagggactgtcggcatcatgcatgtcatgccggcgtgatagttccttcaaagcttatgcttatatttataaattaacttttgaattgtaaaatttaattttggaattggttttataggttttcattgtagtttatttaaaaacttttgaatcgctaaagatatatttcctgcattccaaattgatttacatatttcataagtacatcaagaccaagaaaaaataataactctctcctactatatttactctagcaacaaactcgatgtatgcaccatactcattatttcctagcaaatagcaaataaatatattgcatgtgggttataaatacttgtgtgcatagatacatgcatcaatgtctatttactccaatgcacagataacgaatagacttaatgtatgcaccatccccattatttcctagccaatagcaaataaagatattgcatatgggttataaatacttgtgtgcatggatgcatgcatcaatgtccatttactccaagcacagataacgaatagacttaatgaatgaacacaaatatgtatatcgtttaggaataaccttaaaaatatatatgtagatcaatttgaaatggagggagtagtatacagtataaaatttctactcataagttatttaaaaactgttgataagcgattcacataagtataaacaaaagcttaacaataaggtcgtagtcaaacaacctaagctgtcataattatatttctggtttagcaactctgtgtagattaactccctccgtatatgatgtgacca

SEQ ID NO: 6245 - DNA, 882 bp, Oryza sativa
ttcatctccatcttcagaagattcaaataccatcttaggtggtgtttgagccagtttggataatggattaagagaaaaaaaatcacctatcaacatgattctcttttggatattagaggttagtcgatttcttctgccttccattatcatctccctctcactcattttaatattttatcgtaaccctgcactcattttgctaatcacaatcccaaccctcttaacatactataaaaaaaatcatagaacaagtttaataatataataactactagcttaaaaaattaaggcattatatatgaccaacctaatagtttactcatggaatactaagtaatatatagatatagacatattgtatcattaatatctaacacacttatctctctcacacagtatattgaagtttgtgctgtacggttgactataaatttagagctcgtttttcttctctctcctccacataaatacaagtatgatgtgataacttgtacgcctcatttatacttatagtatcagcttattgtacccgctctttttttaaaggttaagcaactgatttctcctttgaaacaacagaattttagaatgtttcttataggactaaatggctaaaactctcgcaaaaatcgtttaaattctgtgcattggtatgatcatgccatgaggctattgagggtgcatgcaaacagggtgactcattagcacacgatcaactaagtattagctataaaaaccttgaaaaatggccggtttaatatgtttttctaaaaataatttctatataaccttttttaatatacaatgcttagatgttcggaaaacgtacgtgcgaaagacgagggagtagaaattaaggagcgtgtactacaaaacacacca

SEQ ID NO: 6246 - DNA, 1464 bp, Oryza sativa
agagtgcagtaacgacctataaatttggcagtaacggcccatatttttcgcagtaacatgtcgtgttactatatcgtgtaactgcagttctgcgataatgttactaccgaatcatagtaacaatgtatgattttctacagtaacataacgggtttgtgttcacaaaatttgaacagatatataagaaagaaaacaataatctcaaatcacaaagtgtcataacgtgaattggttaggaaaatttgttatgaactatgagatcatgggttctagtcttgaattcaccaatttatttttagtttttctaaaaaaaagaaaagaatagaaggaaaaaataagagaaggagggagaagaaaaaaaagaagggacggagagatcgggagagagttatagtcttgaattcaccaatttatttttagtttttctaaaaaaaagaaaagaatagaaggaaaaaataagaggagggagaagaaaaaaaagaagggacggagagatcgggagagagatcgagaggaaggaggcccgccgggagtgggtggggccatgggggatcatgggttctagtcttgaattcaacaatttttttttattttttctaaaaaaaagaaaagaatatgagaaaaaaaataagaggagggagaagaaaaaaaaaaggaaggagagatcaggagagagatcgagaggaaggaggcctaccgggagtgggtggggccgtggagaataggaggaaaaaataagaggagggagaagaaaaaaaaaggagggagggagagagagagagattgagaggaaggaggcccgccgggcgtgggtggggccgtggggtcgccgggaacgggagggagccgggagggggaacgcgcaccaggaagcgaagggagggggcgcgcgtggggactggggagagggaagggagccgggagggggaggacgcgtgtggaggagggagtgggtgggctgggcaagaccgggagttgagggagagggatcgcttccctctcctcctagcgatcacccgtccctcccccctaatattcctttttcatatctcttttctacttttctattacatcataaattttaaaaaaatagtaaaagaaaattagaaaaaaaaatataatactctcattcatgtacatatactttgtaccatacactttgcacgcataaactttatgtataaaaatattttatatataaaatatttgaatccgaatttgaatttaaatcgggtatataaaattttgacttataaacattcgctctataaattttagatggataaattttagatgtgtaaactttagatgtataaacttactaaaaagatgaaaaagatgaaaagaaaaaaaacgaacgctagcagtcgcccgttagccatctcgccatcgagacctacattgctagctaatctggccccacccgtcatagaatcgtcggtctctgtcccctcctgtcataga

SEQ ID NO: 6247 - DNA, 1501 bp, Oryza sativa
gtactccaacgtgacgcgccacccgcccgtgggacccttcaagctgtgctacaacggcgcgttcccgatgctgaagcggccggcgagcatggacattccgacgatccacctggagctggacggcgccacgggcacctggtcgtggttcaacgacaactacctggtgtttgcgccgggggcggcgttgtgcgtcggggttctcgagatgggtcccggcggcatgccggtggacggcgagccggcgatggtggtcggcgtgaagcagctggattggaacctgctggtgttcgatctggacaaaatgctgatgtggttcagtggggatctggcctttcgcttggcgggttgttcatattcttctcaaatcgggttataagatcgacctgatcagtgatcagtcactccgtcacggcctgaacgacgagttgtatgcttcagttcagaaactagtgttgaataagaatccgacagacttgatagtgcttcattatcgaagtgctacgaattgttttgctgggcatagtgatatcttggaaactaccattttacttaatcatgagtaaaaattttggggctgctatataccggtataccgttcggacagtataggcctataagcaatttagccggacaattccttccgttcaattagtatgtcagttatcgtgtctcaaaaggtgtgtcatgtcaccccatcgtttgtcattctgtccacgtgcatacgcaaaaaatcttcatgtgatagctaaactagttcagtatagcaagtagtagcctacctagctaccaggtgtcaaatctgatactaggtaggtatcacatctgataccgggtgagcatcaattctattatcaggtatcacgtctgataccgagtgggtgccatgcctcataacaggcatcacacatgtctgatatcgagtgggtgccatgcctcataacaagcatcgtgtgtgatatcggttggtatcaagtaccatataactggatggccaagtatcatatttgatacatggtgggatcggtcttgataaatgatacctggtggttatcaagtcctgatatctaaccggtatcatgtgtttctgccacgtatcaggtgatacttgcgaggtatcagatgatacctatcaggcatcatgcgattcttaccacgtggtgggtgatgcttgcgatgtatcaggtcctgatacctagccggtatcgggtgacacctatcaggtatcatgcgattctaccatgtatcaggtgatacttgtgatgtatcagatgatacctatcaggtatcatgtgattcttaccacgtggtgggtgatgcttgcgatgtatcaggtcctgatacttatcaggtatcatgcgattataccacgtatcaggtgatacttgcgaggtatcagatgatacctatgaggtatcatgcgattcttaccacgtggtcggtgatgcttgcgatgtatcaggtcctgatacctagccgatatcgggtgatacctatcaggtat

SEQ ID NO: 6248 - DNA, 1501 bp, Oryza sativa
atgttccctttgagatagcttaaagcatcactctttctggaaaggataaaaagaggggatgctaattcacaggtacccaacaacccataacttgccaaggtctgtggcatccttctttaccaggcaagtgaggcaacaccatttcagttagtaatttcaaactttccccatgaaactactggcttcttgacaaaaaaaaaagataaacaaaacttttgcaaaatatttttttaaattttaatagcattcccaacacctccaattcaaaacatgaaactatcatcgtgataactcaaaagtgagaaatgctcaggggtcttccggctagctccataagatggtaggctagatgacctgggttcaaagccccaccccttctcattatttgatattaggtccttccctaatattcgagtttttttgatgactcaaaagctttcctccatgaatttgaattcggtccttttcgtcatgtgtaggttggtttagtacttaaagttggacataggagcaacataagattgcataatcaagcagcagtgtaggattggaaagcaagtggtcctctatatggggctagatgatgagcccaagacagagagatctgcaatgagttgtagggacatggcaggtagaggggaacacaaagttgatagcatctcgcaagatttttatagcacctagaatcccagattatagtttagttcctcgctgatacatactatacattggcataaacttggcatcaaaccgaaaagtccatatcaaattaaagctccgcccacatgacacaccaaagtagactacacgttaaaaaggagaaaattggatatttatcactctaaagattggtgcttaatttggatatttgttgctctaaagattgatgcttttcaaaatgctattcaaaagattgtaatcgttgtgataccactccaaagatgtggcaatttcatattttgccacctttgctatttttgaataagtttagaagcttggttccttctaaaaatgatactcctccatccagtcataaatatttgacatagttgactttgatcattaaatttggccattcatgatattaaaaaaataatgtaattattacatattttgttgtaacttattctatttgttaaaaatactttaagcatgacttaaattttttatgttgacactaaaattttgactaagatgaatggttagattttgtagttaaagtgtatgaaatatttataaccacaggaagtattctccctagcttcgtcattctctaatttctcccatcgccctttactcctttacatatgacacggtcatatgtaaaggagtaaaggacactcaaaaattgtggtctttgctgtgagacacccgaagatcgtgtatttgctcgtggatacggtaaaaaagtggtaattagctactggacactcctcccactattttattattttcgatgaaaacggagagagaaacttaggttaaagacaagtttgtccat

SEQ ID NO: 6249 - DNA, 322 bp, Oryza sativa
ctcacatgagattggttttcaatagtacaaggatcttggatagttctctttcttggccttacaatgcatttatagatgtcccctgatttaagaaaacggtgcacatccttcagagagcgaaattcatatccactgactggatcaatgtagtactgcagagattaaaacaaggcaaaaataagtttaagacacaacattcctggaatgccctgaaggctttcattattaaaggatacaagagctagcaatgcaacatgcattataaagtcaacaaggggaacagtgcccgcctaggctgacaaactgatttttcctgcttagg

SEQ ID NO: 6250 - DNA, 1038 bp, Oryza sativa
ttgctatgagaataaaagaaatttgctcctcaatctcaatctcgattagtggtggctttagctttctctcggagagctcaggttttcgattgatttagtcgcgaggtttgcttgattgctttcgaggaatcgggggcatctgctcgagattgggattaggtggagttcgaggcttggatgcatctggtgccggtagaatctcgcgagctggcagaattggctgtccagcctataattctggagctttattatttttcttggtagaaagtatctggaaatcatctctctttgtggcagtccagatttggatcattcatgccgtggaagaaaataattttgcaaataaatgattagatgattccccactttttctttgtttggtggatctgcattagcatgttattcatagggatgctgtttttttttaattaaaaaaataatccgacatggtaatgagtactttgctccagctatactttattgtcttaaagtacgcggtaacattgttaaacaaaataaattatcttttggatgctgccgcgaaattcacggtggatgctggaaaatcttgtgctttatgccgcggtgatgctatcttaggatattgattttttttaacttgctttctcaattctgtgccttgaatcactggaaagtgttcatgtactcctgcgtactaagttatgctgttttattgtctttccattgcttagtaccactgccaccctgtcatctctgataggactatattcataagcatctttgccaaaatcctcaattctgccatacacaacctgcatcgtttgtaactgtcatctctgataggactacattcataagcatctttgccaaaatcctcaattctgccatacaacctgcatcttttgtaagctttgctgtgctagtggttgataaaccaacgtcctgggtgttgtaaccgttgttgttgaaaatctttgtggtttttatatatatttcactggggtttctatggctgtggaaggatatcgacatagattgcctttttttacttttagc

SEQ ID NO: 6251 - DNA, 1442 bp, Oryza sativa
cgcgcgtgtcccggtcacggatcgccccggcctccagcttgaaccgtgacggcatgcgccgtcccgggcctcccactcccgcgcggcgcgtgcccgaggaagagacgccgccgccgccgccgtcgtcgtccgccccttgcgccgccgccgacgccaccgcgcgcgggttgcccgactgcgcgtgccacgcctgcgccaccgccttgagcagctccacgtcgtcctcgccgcccgccgccgccgagcccttcatgcccgccgccccgcgcgcgcgcgcgcgtcagcctctcgtttgcgctcgcatggatgtcccacttggcgcgttcttttcggattagtgtacgccgtttggcttattcaagattgagccggaacaagcacaacatatttgcaaataaaaaataatttattaataaaatttttatgcatgtattctaaataattttaaagcaaaatctgaaaaataaactacgatgaaaaaaatcccaaaattaacttaaattttaaggttgaaaattcaaattttagcttataagtataagcgaaaaaataggatgtattaggtttttggctaattagtcgcacgttaaacgagaaatatatttagtactccattcgtcttaaaatataagaagttctataattagacacggttattaagaaaataggtagaaatgagtagtgaagggttgtgattgaataagtagtggatgtatgtgagaaatgtgaatggtaaagggttgtgattggttgaaaatagaatgttggtggagatgctgttatattttaggacaaatcctgagtgctaaaagtttattttgggacggagggagtatatgattagttaaataataattattaatttttttaaaaatcgatttaattaattttgtaagcactttttttacaggacatacagtttaactgtttaaaagacgtgttaacaaaaatgaggagtaactaaccttaattagcactttagaacgcgggttgattttgacaaaaagaaaagtcagtaatccgctacaaaaattgtactacttccgttgatgcctgtgagaaaagcgtttttttgagtaaactctgacgaaacacaagaaaaggttcagagttgaaaacacaatcatgtgtaggtccacggtttttcagccatcggaggtggtgtgtgcacacactccacaaacagtggtaatggccactcactgtctctgctgctgacatgaacaccccagattcaagccacagaaatggaagatgctatggggatattccgaagctccaagtgactgtcaagtgtagactctgatgagcttttgttgcagaacctgcatccatggtccgtctaatgtctgctgctagtggctagataatcaaagttttgagaaatttcactattcgatatccaatttgcagtcatttcagtttccctgttctgtcatgca

SEQ ID NO: 6252 - DNA, 1230 bp, Oryza sativa
ccatccacccccatccgggtaacgatcagacgagccctaaaaacaacagcagaaaaatgggtgaaggaataggggaaagaaaatatcactagtcacctcgccatggcggcgcgggcggtgcgtcctgaccccaaccacgatcagcggcgagtccgcgaccgcgagcgagacgcggcaccaccggaccaccccctcccgaaccaagcaggctgctcctcctccctccgaacggcgaccaatgcagcggcggcggcggcggcgatcgatcgatcggcgcggggaggggaggatgcgccccccagcgacaccgcgcctccgcccttatccccctctctattgaaccccccgggattccggggcgctgcctgccgccgcaatggcggtttgctgctgcttttgcctttgctccgcttcctcctttcttcgcaagccacacgcgctccccaagagagagacaccactcgaggggaaatgcaaataaaaaggaggagcgtttgcttcggtagcgccgcgccaccgcgtcttccggtttctgatttgcgggcccattagggcccacttagaatgtgttcacgcctttggggccgtatgggcctgttgtgcggcccactgtaacttgggtatggaatatcggcacggcataacacatggccctctgttcggataaagttaagatctgattattggttggaagccagtttcaaagaatatgataatgttaaaaaaacagaacttgtggtttcttgtttattgtttgaatttttaactatagcttctcgaatctagatgaaaaatttatctatttagggaagtttttattctgaacgaagcaattgccgtaagctcgtcgaaaaggcttgacagaggaataatattgtttccttaaaaaaaaatgaaagacctaaatcatttgtaaatcattggtggtgttttttttttataaccgtataggattaactcatgaattaacgacaggacagttaacttgcacacaattgtatcgaaacaatcacggtagacgcggccgcgcacttagcgtgtggtgcggttgcacgaaacggactgtaaatgacgagccatctcagttaagtgatcagcccattaatctccctttttttacagctgacgcaaaaaaggttaaccatctttcaggttattacactttaacctgcagagaatttcgtagcttttccagtgatccatcacaatcacataacccgtccgccacga

SEQ ID NO: 6253 - DNA, 1501 bp, Oryza sativa
ggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttactttcttcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaagtagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaa

SEQ ID NO: 6254 - DNA, 1501 bp, Oryza sativa
taaatatgtaacttaactcagatttgggggataattaagtaattaagcctcggtcaactacacacttgcgtgataaactacacgggagctgtcaaatcttgtctgatagatatatgagctcccattggaggtacttagctagataagtcgcggttaataatttggtgtaatatactacaaggctgtcaattcttgtattgtgtacttatgtggcagagtctatagtatgatgttatctctgtcagaccaagttgatttgtattactgtgggcagctccatcgggtttattgtatgatcaacctattgcagggaagacgtttagtatgatcaattgggcctaccttaattctttcactgaatcaaattgagagttgtatagggattaacatttgctctacggtttattaaaaaaatgtggttccttaaaataattttttttctactgcattatatagaccatttatttaacttatctctgtgacaagtagataattggtgataataatttgttcagtaatttaaatcaaatgggacagagagagaaagagagaagacacatttttccgatctgtcgattgttgtaagcgttccaccaaaatcttatttactgatcagggagagttggttctgctaatcacgaaatcttatttagtgataaactcatatatattttttcccgctagtctcaaaaaggattattttctataaccaatgaaaaattgctcaagtctgattcgtacttctagggtagccttacgaaggtcaaacataattttctttcgtatatggatcattgacgattaagaatgacccttgaattaaatttgaaaataataaatggttggaaaacacaagcttacaggaacaatatccttaccaatacaatattgttaggcatatacagacactacgccagatcctcacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcaga

SEQ ID NO: 6255 - DNA, 1501 bp, Oryza sativa
ggttaaaatgataagataggcaaaggcaaacgaaattctgatgcacgcatggtcatttgttctttgctgtcatctgcccttttttttttgttcaattcagagtttcaggtggttgataacagcaagcaggatgaactcaagacggtgttgctttcaattcccatttcatttctcaaattctttttttttatttcggataaaatcatttcttaatttcatcttaaatccaaacaaatattgaaggtacggccggcctgaaacctctggaatttcctgcccaacaatatgtcaataacttcgagtatctcgtgagacccttttttttttacagttatcagataaatgctactaaaatataaacatcatatatataatgatgcctttttaattcgaaaagattccaaatactctgatgagctgactctaaataaaaattttaggtgagcaaattctgacctgatgaaaaagagttgttgcaaaaagcagtggccaccattgcttgggtagccaaagcaaagcagctaagcacacacagaaaaacagcaagaacaagcggcatagattaggacaagtcactccctaaagcaaaactgatcatgtacatgcaaatatataggtagctgaataattaaattagctgaatagttatagttagcttattgggtggctaagctgctttgtggggtcactgtatggcctcatgagtctcacactttttttccagaaaagaaaaggaaaaaggcattttccctccaaaggagatgactgtatccatcaattatatgtgttaatgcttatcacactttatgcaaagtttgaccagaagtatgattattgataataggtgaattcaggtaccaataaattgtgtattcgtgactatggaagaaaataagtcaaacttgcctcaaaatatctaagcagatcaaaattgttttttctcctaacaaaatgtcttaagacattgttccaaacggagctactctctccggtttcattttaattgatgttttggacaatgacacgaactacaaaatatatctttgaccttatttttctattataatatatacaataaataaataataaataaatgcatgtttacttttattatagtgctttgaaagacaaatctatatatgttgttctagtttctttaaactaaatatttttaaagttattaatggtcaaatttataaaagtttgactccaaccttgtccaaaacgtcaattattatagaactggagggagtaactctcaattttctcttgatcgtatttcgtaggacaaagatatttctcccctataaatttgtgatacctctaatataaactagcgcaagataccaaaagtatcacaaatcaatattaaaaaggtcatcaattcctccaatcaaatttacttgatgttgggagaaccaagttagtatactccatttgactagagcgagtatattacttcatgttatcttttcaatataaaaaccctcttccgttaatc

SEQ ID NO: 6256 - DNA, 1501 bp, Oryza sativa
gtagctccgtttggaacaatgtcttaagacattttgttaggagaaaaaacaattttgatctgcttagatattttgaggcaagtttgacttattttcttccatagtcacgaatacacaatttattggtacctgaattcacctattatcaataatcatacttctggtcaaactttgcataaagtgtgataagcattaacacatataattgatggatacagtcatctcctttggagggaaaatgcctttttccttttcttttctggaaaaaaagtgtgagactcatgaggccatacagtgaccccacaaagcagcttagccacccaataagctaactataactattcagctaatttaattattcagctacctatatatttgcatgtacatgatcagttttgctttagggagtgacttgtcctaatctatgccgcttgttcttgctgtttttctgtgtgtgcttagctgctttgctttggctacccaagcaatggtggccactgctttttgcaacaactctttttcatcaggtcagaatttgctcacctaaaatttttatttagagtcagctcatcagagtatttggaatcttttcgaattaaaaaggcatcattatatatatgatgtttatattttagtagcatttatctgataactgtaaaaaaaaaagggtctcacgagatactcgaagttattgacatattgttgggcaggaaattccagaggtttcaggccggccgtaccttcaatatttgtttggatttaagatgaaattaagaaatgattttatccgaaataaaaaaaaagaatttgagaaatgaaatgggaattgaaagcaacaccgtcttgagttcatcctgcttgctgttatcaaccacctgaaactctgaattgaacaaaaaaaaaagggcagatgacagcaaagaacaaatgaccatgcgtgcatcagaatttcgtttgcctttgcctatcttatcattttaaccctgagtactatcagggttcaatatttttaaaatttcaggtctatcggttagcactggtaggatgtgcctcctaccaaaaactttaaacaaaaataatgtttagattcccaaacatcaattttttttttcaaaataccacttcttttcttttcagtttcttcttcaccctaaaatcacttcgcgttttgtaattggtttgtttggcacagctacagctccagccaaatagttttagctccatctgaaatgggagcgaagctgagtggagtgctctcacaaaattaactagagaggtggaactgggtttagacagcggcacagctttactccagactcaactcctaatctaaatttaggagttggagctctaccaaacatacacgtaatcctaaaatgttattactttgtgccaaggtttaatctaccgccgaaaacaattgttttcacgatattcttttacctatcgacgtggctcgaaatcaattttcgggagtgatttcgaatggtttttgacaaac

SEQ ID NO: 6257 - DNA, 253 bp, Oryza sativa
  unsure (1)..(253): unsure at all n locations
ccgtccaaggtangactcactcactggnacacnacctcatcatcctccaataaatacacagaaataaatcaagaatttgttttttttttgcctcctttcagtcacgtttagaaaaagcaatggataaaacggcgcgtctattttttcttcggtggcgactggacacgcacatggcggaaagatccccgattccaaattccgtccacttcttccgggttccaggagctgacccacccataaaacttctcccagc

SEQ ID NO: 6258 - DNA, 945 bp, Oryza sativa
cgagttttataatcaagatttagtagggagttatagtgagcgtgttaggccactttatccgtccccataaaagagtttaaaaagcgatttaaggagcaattgaacggtggttatgaatcttaaagcgactaaagacgagatgagcggtaatgtaaccgaagtatagagatatatgcgcgcgtaggctctgtacagaccagtaagacactttatagtaggcacaaattattagaggataatacgctagataaccatcaccgctgaattcgatagaggcccccaatcggtaaaaagaatgtcaagcggtatgcagcaaagggggccaattgcaaatgggcggaagtggggggcatggaattatgcagggaggcccccttgccgccctccgctagggcgattttgcactgtgcggggggccgcctgcaaatgggcggcgagggggcatggaattttgcaggcggcccccttgccgccctgggggagggcgatttttgcctcccccctataaagcccagcccctcccctgtgaaatttcattatattcactaaaaatccaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 6259 - DNA, 1501 bp, Oryza sativa
ccttagccggctggtgacatatttggtgacgcctaacaacaaattcaggtgatcaccctactgttcatcaagacactttagcagcacacactacagtgcaatggcgctgcatcttctctcactacgggagaaaccatctttggtcggtcaatcaaattccacaatagttccggatgcaataaaaaccgggactaacgatattctttagtctcgatcaaaaggttagagctactttttttataccaatcaagactaaagatcaatttttagtcccggttaaaaaacggtaggcggtgtcagacccctctattatctttagtccactaaagatctatttctagtctcggttgctaaacaaccagaaaaaaagattggcatgcgcggagaggaccaggcatgcgcgcgtgatcgaggaggaggcgcatgggatcagttaataagttagtctccttctcctccctcacatttatctcctcctctcctcactcaccccatcttttcctcttcctcctccggatccgccccctcccctctcctccccctcctcctcacatctcaggcggccgggcggtgatggcggtggcctcgcgtggcagcggccgggcggcggcggaggcagcctcgcgcggtggatccaggaggggaggcggccagaccacccccggcagctgcaggcggcggccggcacggaggcgcgcggcggcaagcggtggaggccggcgcggctacacggatttttttcttttttccttcttaaagtgtgattcgatctgtgttgagaatgaactatattgttctgaatgatttatgttgaactatgttgctgtgaatgatttgatataatgggcgtgagatatacaaaatagcaaaaaaaaaaaaagaaaaaaaacttggtcccaggtatttgaacttcgtagtccaggggttaccaaccgggactaaagatcgatctttagtgtcaagtatttaaaccttcgtagtctcgattggaaaaccgggactacagggggttaccaactgggaatacaaagcatttctccaccagtgtatgagaatgatcttttcttccgtggaattgctgtatatctgtcgacagatttcgatttcttcaccgtcaaaatgttctgaacactaaaattaatatatcttcctggcccatgcacatggataggatgtaaaagcacaaaaaaatgagtttgaaaagaaagtataatatatactcgctccacttttttaatgttggaccttaatttgtatatatatttaaccatttatctttttagaaactcacataattattatttattttgatatgatctagtttatttttaaaggtgctttaagcttggcttacaatttttacgtaattgtataaaagttttaaataaaatagcagttaaatgaatgaacaacagtcaaactgaagggagtatatcacagtccgcataggcagaaacaagtgctcaagttttcaacaaacttggatgtgttaatatgcaga

SEQ ID NO: 6260 - DNA, 1501 bp, Oryza sativa
acccttagaagcaaatggggcagggccccatacatcagaatgaacaaggtcaaaaggacaactagtcctagaattactaatagggtaaggaagttgtatctgttttccaagtttacaacccgtacaatcaaaagtagtatcaatagagacatgacctagaacaccctgacgaattaaagttgaaaggcgggacccacaaagatgccccaatctatgatgccattgtggaaaagttgtagaagatgcataacccaaggctgtggaactagtggtggtggagccaaaagatgaaggtggaagactcaagtgatcgagaacatagagcttcccaggagaactactatggcgatggccagtaccaacgagtgctcttgtctgacgatcctgcacgaagcaagaggtattatcaaaacccacaaaatagttcatgtctgtgagttgtccaacagaaatgagattgatggaaagttgtggcacaagagaaacatttggtacagtgagttgtgaagtggaaagagtgccctggtgagtaactaaacaggatgtgccattagctgtctgaacacatgtaccattgataactggttgacaggatgcaagctgagacacatctgatgtcatatgaaaagaggctcctgagtctaacacccatgactgagaagtacctggtgcaggggccaaagaagctgatccattaggttgataagcattcatgtagggctgattggttgaagttgcactaactgaagctgcagtcacagcgggagcagcaagtgtaactgaagtactaggggcacggcgagatgcaccacgcttggccctaaactcagccaacaattcaggatgtagcttgaagcatttctcaacacggtgaccagacctcttgcagtgggagcaaacaatctgagtggaagaagttgctaaggacccatgctggaaagcatgatcaccagacaaggaggttcccatcaatgaagaagcaaggacagtgtgttgcggtgttgtggcgttgggaagtgactgtagacgagtttcctcggcaattaagtctgcgagagcctcagccatggtaggaagagtagaccgaccaagaagctgcaccctaataggttcaaagtctaaccgaagacgcatcacaaaatcaaacataaggctctgctcctcatatttctccttgcatatacactgtctgcacccacctccagcctttggcaccatagaatccaattgtctagacaatgaggtgaaggcattatgaaactcctcaatggtcatgtcgccctgttcaaggctttgcaagctcttgcgaagagaaaagcggagagctgcactgctctgttgatagcgttgttgaagatactcccacatcttcttagcagaagaaagatcaataaaattcattctaatggggacctcagcgctcatgcacaagaaggccatcacacgctcatcattacgccgccaagctgcaattttcttctcatcttccttctcatgaggt

SEQ ID NO: 6261 - DNA, 435 bp, Oryza sativa
tcatacattaaaatacggaggtagtactatgtagctacactatatagcactttgcatttgagatgcctgcagttaatcaaacaacaatatagtttcacgatacatttaaaacaataaataaaaaaaaattaattccagccctagggccttctgcataaatgtgcatgtcctctatcatgacaatgcattggtttcttccgtgatctccatcaacaagtagacctatacgcacaaacatgcatatatatgctcctccccctatcgcccggtctctaaatttgcattgccaccgcttccaaaaatgcatttagttaatacaacttttttttatatatagaacctataggatcacattgaccagaacccggccacagatcaagatttcttgaataagtatacgtatatgtagaagaaaaaaaattaagctcacacaac

SEQ ID NO: 6262 - DNA, 1501 bp, Oryza sativa
aattcaggatttggttttgctgataaaacttgatcggtccctcatatatgggatctctttggacatacataattaaagtgtttcttaattaattaatatctcatatgctatgataataacataataataacatagttgatgatggattggtcgaggagactaggaagtatatatgttaactaccctaaagtacagtcatccacccccttaaaaaaccactcccttcccattcttaaaaaaccgctcaaaaggaaatctttaactacttaaaaaatgatgtcccttctttaaaaacccgtctccctctccttaataaaatattacaaaaaaaattaactcatgataaaaaccagcataaaaaactgaatcatatcatacttctttctcttgatccctttgcaatacacggatatgtaactaattataataaaatgtctgttaatgggtgaaaatagcacggcatcatacttcattattggaaaaactatacatatctcaccgtaaaaacaaatttatacaaattctctcttgttcttcatctctctcattttcggcttttccgcggtgtctttaggccctatttagatctcctgccaaaattttacactctgtcacatcgaatgtttggacacatgtatgaaatattaaatatagacggaaaaataactaattacacagatcgtgtaaattgcgagacgaatcttttaagcctaattgcaccattatttgacaatgtggtgctacagtaaacatttgctaatgacggattaattaggcttaataaattcgtctcgcagtttacatgcggattctgtaatttgttttgttattagactacgtttaatacttcaaatgtatatcgtatatccgatgtgacacgccaaaactttacacctctgtatctaaacatagtcttactaacagttaatctaatgtagtttttttccccgcaaaaaaaatcaaaatcaactgtagtttctgcacccacaaaaaattcttccaaccttcccctctcccgttcagtcaagtgtccacccagttcttgcatgacggccaagaatagccagagcctctaagcaccagccgatcaaggaatacatgcacaaacactactagaaaaagccactgcaattctctagctcacagctccagagacacaggatcaaaaccacaggcgtgtggctcgcctccctcctcgcttcaccgctccctaacaatgggcaccgtcgatgcatcccaagctatatatatactcatctgatccatttcctcctcgcacaggccgagcaatggagctcatcgtcctaccttcacacagctgaaaaaattccctcatatacaagataaaggtaggaggagggccgggagctcgacggatttcgatcaattgtggtttttttttgtggtaaccgtataagagaggagattttgtttaacgtagctagatcatatctgagttgagttttagcaatggaggtgctgatccggtggagcaagctgc

SEQ ID NO: 6263 - DNA, 1501 bp, Oryza sativa
cgtggcttcagggcaatggtagaggacgacaaggggatcatttacataggcacggaagctcgagatcgatcccacaccgagaggaatcaaagccgtaaaactatagggttaggtggagagataaactcgaattcgaattcgatttggataaactacacgaaattcggctccgattcttaggggaaaaggaagaggacgatgaggggataaatttccctcatccaatcgaactcgggagcgacgaccagcggcggatttggtggggaggtggtggtggtcgggctcggcttgactggccggaggtaggggatggccccgacatgtgggccccagatgtcggcggcttagagagagggggaggggcggcttggcctgggccggcagggccgcgtggctcgcgcgcgcgaggggaagagttgggccggaaaagggcccaacagattaggataggattttaaaaattttcctaattaaaataattcgtgaaatgctatttcatttaataaaaatacttcccttgctcaaataattcacataaaaatccaggaaatagataaacaagcaaagtatttaataaaattgtatctatctcaattttatgtgcgattttgctagtttttattagggtttatcttgtaggtttttaaaataatttctaaaaaatgcattaaagaatgaattattaaattaagcgattctgagagtgtgacatgtagggagaatacttccataaaagatgcccgtggtgccttaggccctctttttgcatgtgtatagtattatgtacacattggatgacatggcgttggacctgttcgaaatagtgctgggacagtatgtcaacatcttcattctggtagccatgccctacaatttactcacccaacattgctgcggaattctagaggcactcttaagtttcagtagtcagtatggactgcaaatctctgcccctatacagccaatatcaaattgcctttttcagtacaatgagctccatatcttgaggtatgtatagagattatggataccccatacccacacggcatatatagtctgactgggtatggggtgccatctgtagatagaatatcttttaaagggactcggattaaatttcaaacttgtatgtcaaggaaatatccgggatcctagtcggttacgattgtaacttatctgtaactacctattccgttagggatatggattgtactttgtaatacggacccctcccctatataaggaggggtccgggtgcctctaagggcacgattttctcccagatcatacggtcaataacatactcggcggatcaatccccggacaggagtagggtattacttcttattaagaaggcatgaacctgtataaaattccttgtctctcaacccatccacttttccagcttgatagccacccccttttagtattgccgaaatctcgtttcgacagttggcgtgccaggtaggggtagcgtcaagttcttcgccgactagtgcga

SEQ ID NO: 6264 - DNA, 652 bp, Oryza sativa
cacgaatcttcgagaaaaccacgatcaacgaaaatccggtaaccgcaactatacgcaaacaattaaaaacctacacaagacccaaaataaagatcctatttagactaaataatagtgccattagatagatctcaattttatggaattactggaagtggaacgagatcattcggagttacggatcaagagatatgaattttggcaggtcaattggttttctggacaaggaaatgatttatcggaatttttctggaatacgagaaatggtttatggaatttatagaataatattcccaagaatattattgacatttcaatggcatttgggaccaagggaatgaattattggaatccctggattaagaggaaggatttatggaatttggaataaagaattgatttatggaacaagggaaaaatgatttattgagttttctggattaaagaaatgatttattgaatttgtggaaaagaatactcccaagaatattctttaatctctcatagacatgtggggccaatcaaagggtgagggagaggagcaagttggggggggagcaaacatggactttagcttatgactgtggtctcagggtttaggggagggagtacatataaactttgcctgcttttaagaggccgaggaggggat

SEQ ID NO: 6265 - DNA, 1501 bp, Oryza sativa
actacagtacaaagatccaacaaaattctggagaaattgtttcttttgcgaggaaaaaactaacaagatttgtttgctgctctagtaagataattcttggttttttttctttgtaagggttttctgaaaattggacgttctgtgtaatgaagtgagacagtgtgatgagtggtttagaaatttcatacgagctgccacttctcagcctttggaaatttgagtagtgagatccactttatattgtcggttaatgtagcaatattttcacatttatcattccctttatataaatcttttggtggtttagcgtttcatgtcacctttgttaataaattttgggcctgttcagctgtccagcgccgcggctacgcacgaatagtgccacagtcactgtgcgcagctacagccgtagtcgcagccgtcgcagtcggcctgccgaacagaccctttgtcgactattgaagatgtaaattagctggatacgaaagtaagtagtaacgttctgtactaaaaatatcgccaataaatttaaaggaactagtgttcgacagcgtacttgtaggtgtgtgagtgtagtgcgtatgttcggtagtgtatgtatgctattttagtgtaatcaaaagagagaaaaaaagattatcgatcttattctcggggattgatttcattttccatcaacccatgagacaaacaagaaaaaaaaaaggggggaaaatagcaagaggagaaacatttccagcaggaaatttaccaattcccctgttccatgttggttgtgagctgtcaaagccggatgaagccatggagtattgacgcagtacgggtacaggtctccctctcacagggcggcatcattgcgtcccgctgacaggtgggccccacccccggagggaactttttcctcctctcttcctcttcctcccgatcttcacaaaaagaaccccaaatccacaccttttgtaccactgtccccgaccccttcctattaaaagccatctcccaactagacagaggctagtactagtagtagcactgcgtagcagcaatggtggcttcctcctcctcctcctcctcctcctctccctctcccccataaagccacgcaccacgcgcggttggtttcttggcgtgttcctgggccttcctcgtactacgcggcggcgggcggcggccatggacatggcgacgggggcgaaggaggtggtggtggtggaggcgtacgagtacgagttcgacctcgagaacccgttcaccagccccgccgacgagccgatcgccagcctcctcgacgccgagggccaccactcgccgtccgtctccgccgccgcctccgccgcccgccgcgaggccgccgggttcatctccaaggtatccgggacgcgttctcctcttgggtttgtttccttgggggggttcttcgaggttctttcccctgttttcttgatctgatcgggcgtgtttttgatcggcgcgcccaggtgcggtacgacggcgagctgga

SEQ ID NO: 6266 - DNA, 1501 bp, Oryza sativa
tttgattggaccaatttccctttcagctttggagtgatcgaaaactactgaacctggttttccttgcactggcagtaaaatgaaccaaaatgcttggcaaattaactagagggatgttacatttttacttatgtggtcatatatagccggggcccctgtcatgtttgtaaggatccatctgacggatgtagcagctgatactgtaagatataccccataccccagtactgctcttcaaggactcaagcatgagttgctgacaagggcggagcaacttgtgtctaggaggtaccaggaacccgattccgaaattcttttaatcgatcagttcttctattttcatcctatcatatgtacacctctcagctaaaacttagatacccgtatcaatttaaactcagtccaaaataaagtaaaacaaatgattagaattctctccatttgattctagctccgtacctggttgaagggaacatgtgtttgtgctgctgagcagatgttgatgatgttggaattaatgaataggccttagcccactcgaagattaattctttggaaaatcacaaaagcccacctcatgggatggcatgcatgtggagtttagtaccaccttgcttattctaggagagggggaccttattaaaagggaggatgccctcctagtcacttgaagcatgtgtggtggagagaagaggggaaacacacgcgcgcgctcgctcgcctcgcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcagcacacgcaaaatcaatctagggtttgcctcctactctgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcattcatgctagttttcatctgtaatgtcatgatttatttatggaacagattaaatcattatatgtctataatctcaacaatccaaaaaccttattataggcactgtgattttacta

SEQ ID NO: 6267 - DNA, 1501 bp, Oryza sativa
gcaggaagccatggtgaagagagcgcaaagagtccaatttcactcagataggaatctaatttgaattcctaaaccgtaaaaccggacatatcaaccctctaactatttaaaccaatgaagaataactctcctagtagtattgacgatgattttcagttgcgtggcacgttaacctggtttagccgctaagtcaacatgtgggaccacatgttagtgaccctcctctctctcttttctcttgctttccccactctccttcctttcctcatgtttggggagacaatgagcgactcgtccgagtctagcctcgttgtataaattggataggagcggcagaaggtggaataggaggcatatctagagtgacgtcagtggagacggtgagcgtggctgccacagcatgggggacgacaaataaaccggcgttgaagagaatgtcagcggcagcttaggaagatggcaatcgcaaccacccgcagtgtagggtatgctatgcttatccatatggcttattagctaataaaaaataatttatgagtaaaaattttatatataggtccttattgattaaaaataaatattttaaaataaattatttttaaaacatataatctacttaaaattaagttttaaaaatttaaattttggcacataaacatgaacaaaacgattgcattgatagaccgtatatatagtaggcattgtggatttttaacttgtgagagtatagaattggataaacattacatagactcaaactcaataatattgcacaatattctctaagaatttgtgtcaagagttcaattcatggggtgtgtatcggttgacattcaataaattcttgttgatttgaacaatttaggataaaaacaattctaacatgaatgtaattataatttaggagtataaaatagaggattataaaatacatgatagaccatttgattggatagtagaaaaaaaacaaaaatcgaataagagaggtagacttaaaaaaaattcaatatattagaactcttgttaagttttctctaaaatttctatatggttgttcattccatcgaaacttcacacaacatgacatgatttaatattttgttttaaaagttttcatagaaaattatccaacaggattaaagtggcgcttatgcctttacctctcaaagattcccataattcgtttcatcttctcttgttttcagtctaaagtacccaaaatacccctaaccacgtttgacctggtcagaccccactccccgtcctccccactcctcactcccattccgccgcgatggcctcgccgcgccaaaaccctgcaccggcgccgccgccgccgccttcggtgatcctcactgacgacctcctggaagagatattcatccgcctcgacacccccgccgacctcgcccgcgcgtcctcctcctgcccgcccttccgccgcgtcatcactgacccctccttcctccgccgctaccgcgccctctacccgccgccgctc

SEQ ID NO: 6268 - DNA, 1501 bp, Oryza sativa
cgaagcaaaggaagctctggccctcgagatcgagggggtcgattaggtcttgcggtatttcggtgaggatggcgtagcgccctgagaaggggtcgcagaccgcgagatccatgaggaggacgtccgcgccgtcgtcgtcgggggcgtagtactcctcctcgcgggagaagaggatgcggccgtcgcggacgtcgcggcggcgccaggtgtggcggtcggggaggaaggcgcaggagaggtcgacggcgccggcggcgggggcgctgcggtggggcggctcggcggggaggaaggcatccgcgtcccgggggaggatgccgaggagcggcggcgggtagagggcgcggtagcggcggaggaaggaggggtcagtgatgacgcggcggaagggcgggcaggaggaggacgcgcgggcgaggtcggcgggggtgtcgaggcggatgaatatctcttccaggaggtcgtcagtgaggatcaccgaaggcggcggcggcggcgccggtgcagggttttggcgcggcgaggccatcgcggcggaatgggagtgaggagtggggaggacggggagtggggtctgaccaggtcaaacgtggttaggggtattttgggtactttagactgaaaacaagagaagatgaaacgaattatgggaatctttgagaggtaaaggcataagcgccactttaatcctgttggataattttctatgaaaacttttaaaacaaaatattaaatcatgtcatgttgtgtgaagtttcgatggaatgaacaaccatatagaaattttagagaaaacttaacaagagttctaatatattgaattttttttaagtctacctctcttattcgatttttgttttttttctactatccaatcaaatggtctatcatgtattttataatcctctattttatactcctaaattataattacattcatgttagaattgtttttatcctaaattgttcaaatcaacaagaatttattgaatgtcaaccgatacacaccccatgaattgaactcttgacacaaattcttagagaatattgtgcaatattattgagtttgagtctatgtaatgtttatccaattctatactctcacaagttaaaaatccacaatgcctactatatatacggtctatcaatgcaatcgttttgttcatgtttatgtgccaaaatttaaatttttaaaacttaattttaagtagattatatgttttaaaaataatttattttaaaatatttatttttaatcaataaggacctatatataaaatttttactcataaattattttttattagctaataagccatatggataagcatagcataccctacactgcgggtggttgcgattgccatcttcctaagctgccgctgacattctcttcaacgccggtttatttgtcgtcccccatgctgtggcagccacgctcaccgtctccactgacgtcactctagatatgcctcctattccaccttctgccgctcctatc

SEQ ID NO: 6269 - DNA, 544 bp, Oryza sativa
aaaatctcatcccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccaccttctttccccacagggctacccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgactggaacttgcctgtcttcctcctttgcttccttcagg

SEQ ID NO: 6270 - DNA, 412 bp, Oryza sativa
aaacctaaccggaaggattttctttctttttccaattaaataattattaaatgatgtttgtattattaaaattagcaattaagttctgaaaattccaataaaattccaaagagcgtaactaatcatggagaatttaataaaattaaatttaacaatgtcattttatttctcacacttgctttacttgtaaatatatttaattatacacatacctatttaaaaataccaaatatttcagtgaatttgtattttaattaattgcatatttttttgatctgtgcgcttcccggtgcaacgcacgggcacttttgctagtgtgtgtggctatatatatatatatatatatatatatatatatgatattcctcctcgtttcctcgaagaaaccctaacggatcgatctagcctctcg

SEQ ID NO: 6271 - DNA, 609 bp, Oryza sativa
gggttaaccacgcatgtaagcgcttgcatttgtggatagaaattcttggcgtgacaagttggtatcagagccaccttgcctttagtataagccagatggtaacctttaagtagccttcaaaatattttgaaaaaaagacaacggttctcctcgattctcccatacattgattaagtgggcagcacatgcatgcttatgcgcaaaattaatttgattcatgttgtgctcttttaaaagcaaaaagttgttcttttcagaatgtttcttatattcactctattaaatttcgtttattagtcggcactgtacatctataatggtattcatccgatcatagtagcactagtcctactcatcctttttatggtaacactgaaccgagctaataatagatcataagtattttagtttcactttagtgatttgtcaaaaaaaatattatttgtctctgtccaaaaagttaaatgctaaaaatatatttatagaatggcttagcacgtgtcgtttcttcaatttttcttcctctttggtcgaatcagttaagtgtaaatggtgcagctaacttaaaaaaaaatatgcattaattcctctcctctatgtttcttgaga

SEQ ID NO: 6272 - DNA, 1501 bp, Oryza sativa
atagaaccccaatgacaattagctttgatttttaaaatctcaatagcaataaacaggagggatggcaggtcaggtagtaaaggagtggggtggcgacagttgatggggcatctagaaacttaaaaaaggaaccccaacaatgatcaatttcaatgtttcaaatcctaacgacaataaaaaaagagtggcaacggatgggtcgtaaaggagcagtgtggcgacgttttacggaatttctaatagctataaaagaaaacctggcaagctataaaaaataaggaatattaaaagaatagtccatatagaacataacttgagattaactaaaattcaaaataaaaaataaaataaatttcaaaattagaaaaagaaaaataagagttcaactaggaatacaatttataaataactaaaatttggattaaaaataaagactattggaagggaccacctagaacacatcacgagattaagtaaaattcagaataaaaaataaaataaatttcaaaaatagaaaaaaaatataagagttcaaatatgaatacaatttacaaataaaaaatattggaatgaaaaatatggatttttcaaagaaaaagtttatctagaacacaacgataacaaatgacaataaatagaagagaggcaacagtaccgtaaataattgcctaaagaattagggtggtggcatttgataggacatataaaaactataaacaaagcccaaataaaattgtaatagcgattaaaaggtgggacgacgggcatgccattaagcatgatggtcacagcggttgatgggacttctaaaaagtaaaatgtaaaccccaatattaatcatgttcaattttgaaaatcccaatgaaaataaaaaggggaggcagttggcgggccgtagaggagtatagtggcgaagccgctgatgatttcacgaaacttataaaaagtaaaaagtgaaccgcaacgataattatgtttgatttttaaaatcccaaagacaataaagagagtaggcagcagacaagccgtagaggagtacagtggtagcgtttgacgggacttctaacaattataaaaacaaaacccaacatgacaatgaattctaaaaactacaagtttgattttttaaaggctcaaggaggatgaataaaaaccatggcagatcgagcaacaaaggaataaggggtagtgatcagtgtgatattttaaaactatagaaaaaaaacatagatattaaagctcagtctttcaaagtcctaagccaacgagatagctatttaacaaattttaagtaaaatcatacatagataaaagatattttgtatgggtgctagccgcgcaattgcacgggccacctagccagttactacataactcaaataccactgatctaaaaaaaaacaacccaaataccactgatcctaaaaaaactaggtactaaaacttgtgggcacatgtatcacagtttttgaaacacaaataatatttattattatcgcga

SEQ ID NO: 6273 - DNA, 226 bp, Oryza sativa
ctggacccaccatcgaacaagctttggatgaagaagagatcggagaggatgttgatcaagccgtagatgaagtatgtgatactgaaagaactccatcggcttcacccaaacaaactcctccgactccctctgctccagctcacttctccagggtaactatctctctctgtttcctttaataactatttatcctcaaccaatcactcattaattttgtctttgcaga

SEQ ID NO: 6274 - DNA, 380 bp, Oryza sativa
catttgcaatataggatcaacatgtttaagtgacaagcatgacttgccttgctctggtgcaggaggaacctcggcgactatttcaaagtacactggagcgacaagagagccggaatctaagcaacatacaaagttaacaatacaaacaggctataagactactgaaacagagaacaaaaccatttttaatggattctatgcatttttcttgatttactgagacttgaatgggcttaaacggagctcggatgaattagatatgaattttagaagattcactatgtttttactataaacagaaaaatccttaattgatttattgcgcaataattaaattcctagggagagagagggggcggcgccgacatgcggggcccaca

SEQ ID NO: 6275 - DNA, 152 bp, Oryza sativa
atcgcgcacaaggtgttcgactgacgggcgagggtggttgatggaatggattggtgaagcagagcttcggagttgcggggctatggttgttgatgatcgatgatgggcaaggaagggattggggtcctatttatagggccaaaagtaaagga

SEQ ID NO: 6276 - DNA, 1186 bp, Oryza sativa
cccttggtttttataatctcgattagaattctcgttactatttttgtcctataaatttagtgagatcaaagaatgtattgttgattttcgtcttttaagcatgaattagggggcttctttatagaatgtaagtatggtgttatccgggtagtgatgtgtgtgcgtatgcgtttaccatgtaataaaaaatgtctctaatattataaactcaaatgtaataattacttacaaataactgagaaaaaaaaagtaaattttagaaaaactgtaattatagtgagaaaactattagtttgctgcaacattagcatcatatttcagtttgttgtaattataccgtaggaaatcatcataaaactgtaactttgcgtagtatgtgtaggtgataacagtaagcttgggccacgtaaaagtatagttttgtaataattttgtataatatcattgcaacaaaccgaaaataggttattaatattgctgcaaactgatagttttgcactatagttatagtttttttgaaatttaaaaaaaaaaagatctactatacaccctccgtttaaaaataagttcattcgtaggaatttatatacaacgtttgacctttttcttatttaaaaattatttatgataagtattttgttgccattagacaataaaatacgaataattactttatgtataaattatgttttttaaatattttttataaaatatttaaataagtctagtggttaaacgttagatataaaaaccaaagtgaagatgtttttgaaccgagcgagtagatccaaacgccatcattccctggtgcggccgaaaccggtggtggtggtggaggggaccggtccaaacccgcggatgtcagcatccaccgtttcgcatcgcggattaactgtgttgctggaggcaggcaaggcatatgctgcgattccacgtttttttcttctcccaaataaaaaggcgtcttcgttattgtattggattccagaggtgaaagctaggaacacacaacccacacgcctcgctgcctcgattgattgattgattccttggagaagaagaaggaggaggaggagatcgagcagccgctgacgctcgtcgtctacctcccgatctgatccgaggagcgaagcgaacaggggcaagatgcattcgacgaatctgctgctggaggagcccatcagga

SEQ ID NO: 6277 - DNA, 276 bp, Oryza sativa
acgagatttgagcataccggtaggggccaaatttcggaaatttcgaaccacgggcacacaggcacatgggcgtgacgtgacgtggcgggctctatcctggcttcatctagaatgtcgccttccacctcctgccaccttctccccctttccagactccttccactcctcctgcaccgcccccgccgcctatatacacacccgctcgccgccgcctcatcaccaagaacgagaaccacatcgagcgagcgatccgtcgcgcaccagcttaatctacca

SEQ ID NO: 6278 - DNA, 1333 bp, Oryza sativa
acacggcggcgggcgccaattgaacattgccgaaccgttgacaagcctcgcatcctctataatatttgaagcaatcatcaatcatcttcggccaatagaaccccgctctcctaagcaaccaatttatcttgtgggccgattgatgagttccacaaattccttcatgtacctctcccatagccactttagattgatcttcatctaagcaccatctatatttcggcggtataaatctccatcaagcaatgtgtatttgaacgcttgccgccgaattttccgatcaaccttaagtgtgggatccttcaaatattgaatcaaaggaattctccaatcctcttttgcatcctgggcacaaatgtccgaattcacaattaattcggcctccaaattgattgaaacatgccccccagcgctctgtccaaaccggtcagaccggccacacagagccggtcagaccgctcgggatcgccggtcagaccgacggcgtgcggccggtcagaccgcccctggtcaccggtcagaccgcccctggtcaccgatcagaccggccgtgcaatgccggtcagaccacccctggtctccagttttgctaatttcgcacaaagatttaaaatcaagcaccggctcttctaatattaaaaataatcccttcttcacattatagccagatgcttgttgtgccaagtcatttgctctagaattattatgcctagcaatatgtctaatagcaaaattatcaaaattggcaataatatctaaacatgaatcaaggtacctatttagtgatccgtccaagcatttgtagactccggcgacttgttgcaccaccaattccgaatcaccaaaagcctccacatgtttagctccaaccatctccataacttgtaagccgaacaataaagcattgtattcggcttgattatttgtacaataatattccaaacgaaccgatgcttcataacacatgccattaggtgaaaacaaaactacccctatgccttgaccttctttgcaagaagaaccatcaaaataaatcttccaaggtataacttcaactaagcaaacctctccctcatgagcaatatctatatgatggtctactataaaatcacatacaatttggcctttcatagatttcaatggttcataagccaaatcatattctatcaaagcatatgcccacttgccaattctcccacttagaattgacctttgcaacatgtgtttaataacatcggcttgacaagtaactatgcatatactagataacaaataatgcctcaatttggtacaagcatagtataagcatagacaaagtctctctataaaaaca

SEQ ID NO: 6279 - DNA, 1501 bp, Oryza sativa
aacatttatctgatttttcttcctgtagatcaatgtgattgggattatagttattatcgtgtgattaaatgcaagttgtacatctttatatataacaacataagttaactagagaaacaaaaggtataattgcaataatgtttgaaccttctaccctgcttcaacaccacagaccgaggactgtgatggtgaaccttcgttatctattaacgagttaggagttgcaacgccacgactccttatcacctgaatgcttataaaggtggctgagggttagtccaatgttagtcttagcttgagtggacttatagtccattatccattaaagttatattccataatgagcatagcaaagtttacactctcgattcagcttcattatggtgggttcttgactcgctttacaccatccgttccaaacttaaccaattcctaaaaatttacagccaaaaattgatcatcataggacatagagagtatatagaaacaagttgttaaatctcatatatgcactttacatggggcatgtattaaggtaaagtctaatatgagctctttgttgatacacattattcagagactcctacgatagtcaagacaaaaaagacatcttaaccattaatacacaaaaatagttttttattagctttctttcattttctccctctgcgagcagaggaatttcttttaataaacactaagagtcggctctaagccgatatcataagtagcaacaatgttttctcttcctcccctctatcttccacgtcaccaaatttacttatatgataacagagagagtccgctaataaacaccgttgtagatacctcataagttttccccctcacgctcgcgaaatgttttctactggagaaacacatgtgtgcctacacctgtggcaacattcatggtacccgctccaaccccccccccccccccccgccaaaaaaaaacacaaaccaaaatctctctcatcttttttttttcctttacaagaaaaacaaaaaaacgatgtagaaaggaaggtcgaaaaggaaaggaaaagaaaggaggatgcagcgaccaagagaggaagaaagaggctctctgatttgtttgcgtttgtgcagcgcgtcttcccttccttttgaccacgcgacacatccagcagccaaaaaaataaaaaacccgaacaataaaacgattattttatttttgtgtaaagagaagggaaaaaaaaaacgcgcgaaggagaaggagaccagctgcttcttcgtctccaacttcccttatctctatcaacccccattcctccgttactatacctatctacatataccgttacgcacccagctactaccctgcctttttcaaccacaccactctccaaatccatccatcgatcgagaattcctcttctccctcttcttgttcttcttctcctctctgaatttaacaagaaatcaagaactaggtgtttgttttgactaacaagaactcggtcgaacactctgcgtgcgt

SEQ ID NO: 6280 - DNA, 1501 bp, Oryza sativa
aaactatatatatgtatggtcaggcgatctgctagcccctgtttgctaaatgtacacactgtgccatgaaaaaaattgaagtgccatttaattagtaaggtaactggcatctaccagaaaaatacacatgcatgacatattatccaatgtgccagaaaaatacacccgacaccttgagacaagttgcctgaaaaaaaacactcatctatatatcatatgcatacagatttttctgacttgttaattattagcggggtgcaaaactgtcctcatggacccacatatcaatacacatacagtgcgatacccaaatgtgtaaggctacatgggaaaagtaatatcatccctaaggagatatcctcttatatttttttgctatacaaataattataaaaaattgaaaaagttgataagataaatcaatatgtaataatatatcactctacaaatatacaagtttaaattcaacatatacaagttgtaataagaaaacaaatgtgcatataaatagtacacatattcaaaatcatatgccgaatttgaacttgcatgtttgtgaaatgttaaagtaatatatcacatatatattggtttatcttatcaaacgttttcatatatatgttttcataaatatttaaataacatgtaaaattgagggatatgcctagcttaaagggtgaaaatccatccccagcctacaagagacaaaccatgtgcatccagcagcgattgagataataggaggcatccgtgcatgcacagtgtggtgaccactgatgactgatcgaccagcaggttcattggcctcatctctaattaacattttccctgcctgctagcctgcaattccactagcaagtcagtcattggtgtcctcacaaagcacacaaaagtaactttcaaatagtcttgtgtgttagttggtcctgggttagaaaacacattgacacaacatgcatctatcaaagaattcaaggcatgcaaccactctacatgccctgtccccatccactgttcccttttctcaacgattttttagcattaacatgcctatatgtgaatgatccatattgcctttagccctttatattgcatatattggtcatgcacatttggcactgccacaccacttgggctaatgcagcggttgttttcttctacctcatcatcattcttatatatctaagttaccatgtcgatctgttccaaaatataagggattttgacgatatatctgatatataattaatagattctctcgctatgtgtatatatatagctaggtagctgagcaagcagctggtcatcacggatcaagaagaagattagcttagctagctaaaaagtaagtagccgtgcgaagtcgccggcggtgatcagccggcgatgacgacgtacagggtgtgctgcttcctgcggcggttcagggcggcgtcgaacgagccgtcggaggagctcggcgacgtgttccaggcgtacgccgacggcggcggcggcgtga

SEQ ID NO: 6281 - DNA, 1501 bp, Oryza sativa
acgcggtggatcaccagcccgcggtcgctcccgccgctgcccgaggcgcggccgccggaacctgaaacatgcacggacggtgacgccgaccgccggcgcggggagtgcgtgcgtcctcgaggcatgaagacaccctcaagagcgcgatctcgcgtccacgctctgaaccgagctctgataccacttgtcaggtttccctaagtgatcgacaaacaagctgtggaaaacacacgcgaacacgaggaaacacgctgagttttgtggtgcgatgaagctgcaccttttcggtttttttcttctccttttattatgcaaataacagacttaggattcgatcccacgtcccggttctttcgcgtccatccccgcgatccgagagacgcgttcacgtcccgttgtccaggccagtcgcgcatgcaacaacagaaaaactaacatgcatgcagcaacagaaaggaacgtaaaactagctactactagatacattgtgtaaggtttgtcaggtttccctaagttatcgacaaacaagctgtggaaaacacacgcgaacacgaggaaacacgctgagttttgtggtgcgatgaagctgcaccttttcggtttttttcttctccttttattatgcaaataacagacttaggattcgatcccacgtcccggttctttcgcgtccatccccgcgatccgagagacgcgttcacgtcccgttgtccaggccagtcgcgcatgcaacaacagaaaaactaacatgcatgcaggaacagaaaggaacgtaaaactagctactactagatacatcgtgtaaggtttatttccaacagtgccgttgtcggccggctcggcatgctgaccacgtccatcggtggtaccgccgcctccctcacccgcgctgctcctcccaccttcaacgctgccgccgcaggtgcagaagaagccaccgccgaatgccgccatcttcgagaggatgccgacgtgagtcgcggtggcgagacgcaggcggcccttacgtgttcgtgggcacggcgggagaactgcggaggcaggtgcgtcgtggccggcagagagggcgtcgagcgcagcggtggatagtgcggtggcggggccgagggtggcgaggacgcggccgttctcatggctcgttttcttccttccaacagccaaccttccacggcggcctcgatctccgccgccgccgccgctatggccctcgcgcgcacgtcgctgtcgccgctccagtgccactcccgggtctccgccgcttgcgggctgatgcaccgccgccgccagcaacgacgccgcgggaaaggggaggaggaggctgtggatggagttggaggaggcgccggccaccgccgctagctcccgtccaacgctcacgaagagaaagagagggggaggatatgatttatgtaggccccacatgtcagtgggtcccacctgtacttttggtgaatgacaaatgggtcccacccatattttttatttctaatgacacgtaagt

SEQ ID NO: 6282 - DNA, 1501 bp, Oryza sativa
aagtgggtttcttatggccttatgggccatgatttttggactgggctgatgatgttcaaggcctacagatgactgtgcccagtgggccatttgggtccatgttgtatagggcctgttcactttgatgccaaaaaaaccataccaaattttagcattgccgaaattttggtaactgtgtcaaaattttggcaggcaggatttcttatatagttaccaaaatttggcagcaaactaaatgtagccactttttttggcaactttaccaaaatttggtaaggttgaaaatgacatcaaagtgaacaggcccatatagatagttcctttttttttttgagatgtgttgtatagatagttcaattgcctatctctctgttccacttcctcaaatttgacttgagagtccatggcaaataataaagagcactcctatttgggttcttttgatcaaatttggtttcgttcaggttcaaacagaaatagtgaaacaagtgaagttgtttgacattgcttccaagactgaagaaaaaggatggtagaaaataaagactaagtaaattatgatgaatgctttttgttggttccaagtcaatggtccacaattgcggttagagaagagaaacaaatcaagtggtgataaaatgattcttttttttttctgaaataatccacagacaactctttacattgtttgataagagcaatttttttaagaacagataatttattttgttatttcctaatattttaaaattctaagcagatattatcatataaatatagacatttaatatgtactaatccatcattgtaacctacttcctccattaaagaaaccaaatcctagctatgtgtctggacatacactatatatatagttaggatttttttttcatagcaagagtatactacaacttttgtcctaaaataaagttattttcaacacaacactcggtcccaaaatgagatgtttttcatcaaaatgaatcccaaacattctttatttaatttattcacccactttatttttatcaacaaatcacaactttcattagattattttcacctagtttcttaatattctgtccataccaaaatacttatatttaagaagggagataattataggggtggcgtgtgcacttataggatgagtttgtaatgcgtttcttttatgttaaaaaaagagagatggaggcagtagttttgtatacagcttacaaagtcgtaacaaacttctaccatcgatgatgtcccgttacattatcttcattaattaatttatataaatacctacgttaatggctaaaaacggtggagtatcaaatcaaaacagactactacaaatttatcttttctcgaacgaaaaaaaaaagcgataaaaaccatctcatcgaggaagaaagcaacccacgataaccctcttcttcttctacccatctcgccgtcgccgccgccgccgccgccgccgccgtcgaatcgatcgaagcccagcagcgagcga

SEQ ID NO: 6283 - DNA, 790 bp, Oryza sativa
gatcacccgatttgttccacgagctgtaggggtgtgtttcgttcgctaaaattaaaataatgtacaaaaaagttgaaagtttgtgttagaaaagtttttatgtgattaaaaattaaaagtttaaaaaaaagttgggaactgaaccaagccgtagtatcgctgtttgtataacaactgtctatcagcatgatgcgacgtcgaaacaattaaaaattttcataccacccaattaacgaacaacacaccagctaatactctgctcaggaatctgctagcctagtaacagacgagattattcaggtaaaagtggtaattgaaattatgccaacatggcaacattgaattatgttaacatggaagtccaagagcatgccaagacgtggtgtatacgattcagctctgctaatcaagctcgtaccctgaagaaatttcctcccgaaaaccaatagcttgtggggtggtttagcttccaacgaattcaacatgtacatgtgctgaagaatactgcagcaaaagcatgcgttgttttctagtacatgcactgacctttttttttcctcagtgggagtccaaaagcctgacgaatcaaaccattcattgatttcgcaactaatccggttgctttccacggttgtggtcagtcgattagatgcaacgaccagcagggcgatttgtttccgcaattagcgaaatttcaccgagctgaatcttctcatcaaacttatttggcgggattaggtgcgtaacaaatgagaatatgagattttttttttcaggttacgtttgcaga

SEQ ID NO: 6284 - DNA, 1332 bp, Oryza sativa
catgaataagaatcaacacaagtttgactgctcttttcgaaaagaaattaatcagatacgagaaaacgtacctgttaatgaacaatatatctttcaattaattttgttactctgtggctcacatgtagtcatgaaaagcaagatatatataatataatatgtacattatattcccgacgtcaataaagcaagagaatgtattgtacgacgaggatcttctgatggtcaaacatgccctgcatctgcaactcagattacattctgttagtacatctcagaagcatctctcctttgacaacttgcaataagcatgtccaggttcagtgtattatatagttactcagtacaattctacaacattcagctagaggttaacaaaatatctaataaagatatagagattaaaataatttctgcactaaacatggagctgaaaggtagatctagctagctagctagcaagcaagcttttttagtcggcattttcaggaatctttgcaagtcagttctattgtcatacagaatcaagaagatccaggtgagcgagacattcacggccgtgcgaatattccttctagatacaggttattagcaaccataagctaaaagaattaaagcaattaactggcgaataagagaggaaaaacgatgaaccttttctcctctctcacttgatcatctcgccgtcaccttttcccactgatggttaattaatttacttatgaaaagttgaaccctttttttcttctttggctttttagtaatctatttgaacaaacatatgcataggaatgtgctatatatatattaacttaatttgttttctttcatggatgttatataaagtgtttgggcaacaaaaaataagatcactgtgaaattttaagcgttggaaaacagcatccaattaatgtgatatttgggaaatttaagttggtaatgtaccattcatactacataaacgatttttctatacaagagcccctatagattgcagacagaccataaccaatggcgtctataaaaatcaagctccatttttgcatgcggctccttaagagatatgcgtgcgaaaaatatattttcgcaggcggatatgttaagggaacgcatgcaaaaagtgagcctatttttgcatgcggtcttcttaaaggaccacataccaaaatagattaccttcacagatgttttttctcctctcttttccctctcagacacatcaaaattttcacttctcccctcaatttattactttcacctctctctctcttcctctctctccctctcctctctctctcttcctctcctctcttcctccgatcggacggtagg

SEQ ID NO: 6285 - DNA, 207 bp, Oryza sativa
gcttacaacgacaatagtatattttgagattttgtgcagttattttattgtattttagaatataaataacacttgaattatttcacatgtaggtatcttttatgccatgataacattagatcttcaatactaaggttaatcaattatatctttggctattggaaggatggtgaagcaaggattatagctgcaccattttgtcatagt

SEQ ID NO: 6286 - DNA, 414 bp, Oryza sativa
tgccccagccgcgccgcctcgtggccgtccgatcggctttgggccgatccgggccgtcggttcccgtggaccggcggtggaccgcctcggtggtcccggtccacggtggaccggcgcccttgtgccgctgaccggtggggcccgcttgccggcgccgcccctcccccttgatgacgtcagcgaggtccattttctttgtaaaaataaataataattgcgcaataattcgataataattatagaaatccattaaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgcca

SEQ ID NO: 6287 - DNA, 1501 bp, Oryza sativa
gtgctttttctaaaagttgctttaaagcagcatattaatccattttataaaaaattctaatgtaatgagtcgcttcattttacgtgcgtgggagattagatcctacacccatctaatgaacacaacctaataatatcttgcagctccgcctccgttgggtttaggccgagtatgcatcatggttccaagatccttgcctccttggtggtgattaaatatggactttatactcacccatttgaattcattaatcctttcacagtgcaaattttgcttaaatatttgtagtcagaacggctacattatctaaattttatatagtaaataaaggtaatatggatcttgaattatgatttaataataataaaagttcctttgtaacacaagattgaaaaaaaagaatagaaaaggttcaaatatgataggaatacatgtgtaaaatgagtattgaaaagaacggatgtttcaatgtattgcagaaaaacacaggaaatgaaaatttgcaaataaattgagaaaagtgcatgtaacttgagagtcatggtcatttaactctatgattattattattattattattattatttatatattatgtgttagctcgaaaataagaaaagttggctcgaaaatgggagaggagagtgggatccccgaggatagttggagggttgagggatacgtaagtacgtgtgtgcccacatatggtggggttgggtgtactggaatttattttgagatatctaacagttaaaattagtggggtcgacctatttaaaaagatatgaatggttggattttttttcctttttatcaaaatttttaggattttttcgtcccaacctggactaaagatcgtaactttagtcccggttggtattaccaactggggctaaagatcctggtgatctttagccccggttggtgctaccaaccgggactaaagtcccacccctatatatatgtcttcttcctcctccaactgcccgagcaagcttcaaaatttcttcaaaaaagaggggaggtcatgccaaaatttctattgaatttattttggtgattacatacaaatcggaggtgcctaaagggtttgcaacttcatcctccaatgtttttttttgtcatactacatttgcacctatgttttgcacactttttttgtctccaaaatttagttgtaagttgatcagagagaaaatgtgtgtggggaagaaaaaatatatagaaatttagttcatttgctaaacaaggttttataaaatagttgagaaggaaaactctagtgaaagttaatcttaaataatagaaaacaaactaaaatgaaaattaaaagaagtaaaatacagtaaaattagtttaaaactttacaaatagtttttaagaattatttggtgtaatattttatgatttttgtatgaataaagatatcttataattattgtatgactgtcattattgtaagaataattatttgtgtacggttttttttgactcatgtaga

SEQ ID NO: 6288 - DNA, 389 bp, Oryza sativa
ccatttctgggataagttttttcagggctctatttgcgaaataagtttttcaaaaggaccaaaatgtgaaaaatccaggttataagactttctagtatagtccacgttaatatagatgttaataaatctaaacacatatataaatatctagatttattaacttctatataaatgtggactatgctagaaagtcttgtaacctgaaacggaggaagtataagttaatttattggtttatatgcttaaacttaagtataatggtggagtcgtactttcactcacatcaacgttctctaatgtataagtcaatttgttgatttatatgcttacttaagtttaatggtggagtcgtactttcacttcatcacttcacaacaacgttctttaac

SEQ ID NO: 6289 - DNA, 583 bp, Oryza sativa
catttcgaaacggagggagtagtagatttggcagattttgctgaaactttgagagcgagataggtaggagtacagtacagaaagaattgctttgcttccttactctgaagaagttttacctgttgctgagagaggaaaaatagctcacagtctgatcgtgctaagctttcataaaccccaaaattcaggcccatacaggtactggccctgcgtggcatctgcagcgacacgcgtccttatcggttactcctgcccatgtgggctcctcgcaacggacaaccatctcccataccgcgaacagagacaactcgggccaccgaacctggacgaatgcgaattccggcctaatcaagcagagcagagcacccggtatactgggaaaccaacgcgcggcgcctcctgtttcgccccaaccccgtccttctcctctccacagcctcctgccctcctcctctatataacccgcccctctccttcctcctcatcctcaacacagcatacaatagttcactgcaaaccaaaagaagaaatcacaaacaatccggtccaattctcagcaagaaagaagagatcgatccaatgg

SEQ ID NO: 6290 - DNA, 1501 bp, Oryza sativa
ttggcaagtgtaaatgattgtactaaccgggaaattggtattagctattaatttatgaagttatgtatttatttttcttcatgcagacatgtgctcctacgtatcaaaaccatgtttcattttttacttcccccagccacagatccttgttggtatcctttccaaaacagttaaaaccagcttatcatactagtaaaaatattattattgtcacaaccatctatcaacttcctaattaatggctacctgtagtaaacaaatcaaaatgggtaaaccaaaccataactaattaaaaaacaatttacacttgtctgcatatttttttaaaaaatattcgataatattgagtttgttatagtttatcactatacttttatatactccatccatcccataaagatttcattttttttctttttccaacacttgactacccatcttacttaaattttttatggattttttatatagtcgcatataaagtgctatttatattttatcatctaataaaaatagaaatactgatgatagaaaaattttaaataagatgaaaagttaaatgttatataaagactgaaaaatagagtttttatgggagagagggagtaatacggagtaataatacacaagtttatcaattcttttacgacgtgctattgggatggtatagaatggacttccttttcttttcctacctcacctaacatttgatgaagagaacggtgaaccgggaaaagccctgtgaattttcaaacttacccagtcagtggatgggatgctatgcgatcatgtgagcgacaagttacaagatccaaaccagtcgtggagcagtcaagccgcgcacgcagagagaggcaggcaaggcaacgcaacgaaggcgaagctgcctgcctctgccgcgccgcgccgcgcgagatctgggcggaagggaaggcgcggcgcgacgcgacgcacgagagaaacaaaaggaaaagggaggggcgggggggacaaaaaccttcgccgcacaaagcggttaccgcgtccccccagatctcgtcgccgtgccgtgccgtgccctgcccttgccccgctggataccggcggcgcaccggcgcggccgcgcgatccgatgaggcggcggccgttcctcgaccagcggcggccgtcgtcgttcaagcgccggtggcagcagcgcccgtggtggttccgcctcgcggtcaccctcctcctcgccctcgcctgcctcttcctcctgctcgcgctccggggctcgcccgaccccgacccggtggtgctcccctccaccgactcgtccagatccgcggccaccacctcccctctcctccatcaggtgagcgaatcgcgtctcatatctactttgcttcacatttcgttagctcatttgcatttggcttttgagttgatccggttttaattagttcatgatcatgagtagcgtttgaaattcgtggctcctgtaatgtgcagagatcttacctcgatggcgttacggatgcgt

SEQ ID NO: 6291 - DNA, 786 bp, Oryza sativa
aggaatattagaagaggagactagagttcatatagaaatacaatttagaaatagttgaaatttggaattaaaaaaaaggaatattagaagaggagactagagtccatatataaatacaattaggaaataactgaaattcgaaattaaaaataaggaatattagaagtagagtatagagtccatatagtaatacaattaggaaataatagaaatttggtattaaaaataaggaatattagaagtagagtatagagttcatatagaaatacaattgagaaaaaaaaatagaaattcggaataaaaaataaggaatattagaagtagagtatagagtccatataggaatttaaaactaactaaaattcagaataaacataataaaattaaaagtagagttttgagtccgcataaaaatacaatttacaaataactaaaattcgaaattaagaaaaatatgggaagaagagtttaaagtcaatataggaatacaatttagaagtaactaaatttcgaaattaaaattaaagaatattgaaagatgagtttagagtccacatagaaatacaattagaaataataaaaatttagaaataaaaataaataatattggaagaagagcctagagtatatagaaatacaatttacagaaaattcggaattaaaaaaatatattaaaagacgagtctagagtccatataggaatatatataatttacataactaaaatttgatattaaaaataattaatagctaacacgtatataaaatacaatatgaatattttag

SEQ ID NO: 6292 - DNA, 1422 bp, Oryza sativa
tccccttttgatctccggtgattgccgccgccgcaatccaccgtcgtcggctcctctcgcgtcgattcctctcgccgccacgctcccggggatccccttgacctccccctggctgccccaaggccgtcggccttctcctttgtctccgcgccgtgtcgccgcttccgccgccgcctaacgccgccgtgcgtgcgccgccggtgaccatcgggtcccgcgtcaccgcgtgcgcgtcgcaacaccataccggttcggctaagcccgagcccgcgcacccttcgctctcctcgcgcgcggccacgtcggcatgccggcgagattggccgccgccgccggccgtcgtcgcgcgtcctcttcatgatccgagccgtggaatgagttccccttctcctcctcctgccgccagtgctagccgccccttccggctcgccgccgttcgccggatcccgccgcacaccgtgagccgtcggatcagcctgcccggcctcctctgcctccccatccgacgcggcttccacgtggacgccacctcagtcccgggcccgcttgactgggtcaagtcgcgcccagtcagcctcctccctccgtcttccctcccgtgcgtgcggtccacggcaagccgtgcggctgcacgtgggcccgccgccatccatccacccggcgcgccgcgcccgaaccgcgtgcatccgaaaccctagcgcccgcctccgcgtgcaccctccccaccgtgaacccaaccaccgccatgtgggtcccgcgcggtggaccgcgcccaccccgacgggcctccctctctccccgcgcgccctcatgggccgcctcctcgcgcccgcgccggcccatttggttcggccgagtcgcgttagcttttgggtcgcaccaataccaccgaaacaagtctagtatacatccctccttgatttcctttttccacccttgttccataaatcaattccttattccaaaattccatgaatcattttccttggtcccggattcaatgactgtcaataatattcttgagaatattatttctataaattccataaatcatctctcctattccagaaactccaattaaactttcaaaattcatatcacccaattcgcaactccgattgactccgttccacttccaataattccgtaaattgagatctatttaatggcactactaattagtctaaataggatctttcttttggtcctttgtttaggttttcgattgtttgcgtatagttgcggttatcggattttcgtcgatcgcgggtttcctcgaagattcgtgaagctttgtgaagatcttgagcaaggcaagtcaccctttgatcaattgcccctataattgaaaagtcattattattttgtttacaacttgcattattagaatcacacacttaacttgcttggcctcggtttgcg

SEQ ID NO: 6293 - DNA, 1501 bp, Oryza sativa
taacgttaggcaagttgtggcagccacaaaagtgtggtggataaattgctagccacaaagtgtggcaaagtgtggtggataaggtgccgtcaccacgcgcggtgtttcgtgttcgtgggcgtggcaacgacagacaaatcaatagcctggagatcaacggcaaatcatcaaacctataggaataggattagtccaagcacagcttcatgctccgggccacttacgtgttctgagtcacgattgataaaggctcaaaactctgctcttaaactcaaagtcacgatatgtcaacaaaccgatctgttccggtcggattcggttttcggttccacggaactagccgtgctgccgtggtgacggaatatgcgtcgcgcgagttttaatcatttcttgctgttccacttgtgtccaataatccgtttgacccagcttctgctcttgcctctttgcgagcactgcaaatgtttcggtttcttttgcggtttcgggtaattcgtatcgcgtcgcggccgtgggctgcaggtcgttgtcgatgcttctaaatacttgactttgacaatcacctcctccttcagtccttctcatggcagcagcaacagtgcaagagcgggttcggtttgccactgttcgattcggttcggtttgcggttttttttgagaattaatattatttttatggaaaatcgcaaaagtagtggccaaccggggaaaatcgcgaaagtaggtccctgtcgaacgggtgcaattcgatagggcacctatcgaacgacgggcagtcgacaaacccctgtcgaacggctggcgttcgacacgctcacctgtcgaacggagggagttcgacagggcccaccacccggcgccgcgaggcctgtcgaaccgggggcgttcgacagggccctccaccgaccctgtcgaacaatgggcgttcgacaggccggtttaaagccccgtcccccaggccgcgagttcgatttgttttgaggaccacatcgccagccgccgccgagagtcaccacatcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagagttatttaagtaattgtacggttaaattagttcttagttagtacatattattgatatgttgtgtgttaaaataggtagaaaggtgttatattttatttggattattaaactagttgtttgttactaatagttgtaaattagtacacggcaatatagtataagttgtaatagggtaattatcgaatgattaaatgattaaacgtgagactatttgtcatgttttatcagga

SEQ ID NO: 6294 - DNA, 1501 bp, Oryza sativa
ttacttctcggctcccagagccattccacttgattaatcggcaaccagagcctttttcattttctcggactcccagagtccagctgcccagcagcacaacagtccgcttccactcgggaagcctagtctatgatgcccgcagacatcccaaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgtagaggggtacactttacccacaagatacgaacttattccgaacacccgtcggtatcggaggttcgcaacaaagcctttcccaagccaacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccgacgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggtttttgaaggcttcacaaacccatttcccaagttttcgacaaacaacggtgtatgtgggatatttggtatacgcgctcagagagcacgaataccgaggtaccacaagggtggagcgacaaggaatcagggtagtaagacctacggaaattagtgcgactactgggtaggtccgtcggtttggcacgcaaaccgaggccaagcaagttaagtgtgtgattctaataatgcaagttgtaaacaaaataataatgacttttcaattataggggcaattgatcaaagggtgacttgccttgctcaagatcttcacaaagcttcacgaatcttcgaggaaacccgcgatcgacgaaaatccgataaccgcaactatacgcaaacaatcgaaaacctaaacaaaggaccaaaagaaagatcctatttagactaattagtagtgccattaaatagatctcaatttacggaattattggaagtggaacggagtcaatcggagttgcgaattgggtgatatgaattttgaaagtttaattggagtttctggaataggagagatgatttatggaatttatagaaataatattctcaagaatattattgacagtcattgaatccgggaccaaggaaaatgattcatggaattttggaataaggaattgatttatggaacaagggtggaaaaaggaaatcaaggaggga

SEQ ID NO: 6295 - DNA, 1356 bp, Oryza sativa
cccctatactcaatacactcctccctcctctccccactttctcctccccttcttctcttcctattacagtacaccacacaaattttttttaaaaaataaaaattagaaaaatttatgtatataaatactatattaaaaaatttgaattcaaattcaaatttgaatcgggtatgtaaacttttgacttataaactttgggtctataaactttaggtgtataaactttagatgtatagaaatactatatatagaaaatatttgaattcaaattcaaatttgaatcggatatataaacttttgacatataaacttttggtctctaaatcttagatgtgtaaactttgggtctaaactttagatgtgtaaacttgaggtgtataaactttagggatagaaatttactaaaatagaaaaataatgtggtgccaaaaaaggaaaccaggtggaggaagggagggggcgggggattaatcgctacccccgtcccgaggcgatggatcgccaattaggttttccgccttgagacgtcattgctttcaggaacccgaacccgaacggtgccgattagcaattttcatctcaacaacactaggatcatctttttatttatttattttcaaatcggattgacagagacattctcaaggcacatgtacgcagtacgcctgtgcaaaagcaaagtgtcgaaccgaacccaaacctgcaaccgggtcgcaaggtttctttgcaaacaaaaccaagagacgcacaaaaattatccacagtggggcccaccaagatgaaaaatacatgctctccgctgattaactactggagtactgcaaggcacaaaccgaacccggaaccgaacagctttattttaatgcattctgtcttttttttcgagatgctaatgcattctgttaatccgcatgtccatgtcttcttcttctctctcttttgggagaactactagttgcgagccatcaaagacctgacaagtttgatttcttcaatatgcttgaaacaccgcagcctacaccatgcaaacgcttgttctttcaaatgcgtactagtagttggttgctctggttctaccatgaattttttttagattatgattggttgattgctgctatgatttcgagaaagacaaacaaaagttggaggaaatcctcgtaaaaaaggtagacctgcacaacattcataactagaaaaatgcaagaaaaacatgcaaattgggagccagcacacaaaacgatgggatgaattagcacataattaattacatggtactccctccggttttaaatataacaacttctgggtggacgtaacatatcctaatactatgaatacacctaaacattgttatat

SEQ ID NO: 6296 - DNA, 1501 bp, Oryza sativa
gctccagatcgatgacctctctatccttactacgtcgctctgccagcacctcatctcagtccaattcctagagctttacggagatccatacctttacattcgtggagtcgaagtggcaagactaacggatgagcaagagagagcgcttcagctcctcacgtccttgcaagagctccaattcaagtctcatgacagtcttgtagatcttcctacagggctgcataaccttccttccctcaagaggttgaagatcgataattgcaagagcatcatgaggctgccagagaagggtctcccaccttcgttggaagaattgcatatcagcaattgcagcaaagagctagctgaccattgcagaatgctagaaagcaagctgatggtatcaactgattgatgatgaatatgtggattaattattgggtggcttgataagcacacctttttccaccagcccaaatgataccggcagttcggcacacacctttctaagctatacatttaggagtaagtattttctgttaagacgttcaagctgctatacatatcaccgccgcagtgacctgttcaggaccatttcaaggggaaaatatgtaaggcaaattatatatgtagtgaaaacgtgaaaactaccgttggatccataaatggatgtttgatatttgtccatgtcactaaaagtaaaaaaaaaaaaactcccagattcaactatgagtaaaaattttattgggagtaaaatttgtactattgatgatatggacaaatattagatgttcatttttaaatccaacaatagtttttaggtttcctctgtatacgtggttggcactgtatattttcctccatttcaagtgccatataactacatgttgtttctctggatcaactttttttaaggaaaaatattgtaggagagtatcctacagcgtgtgtgtccatatagtaaatttgtttggtgctccatggtgcctgggcaccatgattgaaattgagtatatacccaattcaaatgagtatgaaatttttttaaatgtttaggtattaacattaactactttactaactagttcaaaacaagtttgaactgaatttaaacatgtttttgttagattttgaatctaggtatatagcatccaaacataaaattagttaggtatgtaagatcattaaaattgtatcttccatatcacatccttctatattttaataatatcttccaactaactttacatttgtatttgaagggatatattttgaatgacttaatttaacggtgttatttatcacgataatatttagaaatgagtaaattttaacggatatatttaaaatgagtataaaagcaatgcaagtaacatctactactatatttattctctactagtactactgctgaactattccttctctcttctactagtactactactctacatcgagggagcggtggcgaggggcgggtcgggcgggagagggacggcgacggcagggccaggcgggtgag

SEQ ID NO: 6297 - DNA, 1501 bp, Oryza sativa
tagaagtatagatatatagttagagataagagtcaaatataaattatagagataagatataatcctaaagataaaatagagtcctagatataaatctactcttgtattgtacttcaatgtactcctatatatagagtcctagagataaatcttctatgtatttttatatatactctatgagagagtcgatgtaatacaatagaatacaacaattagattttctgcaaatggatgcgtatgtcttgcatacatgctttacctcctcgttggacctgatgctggagcctgtggtagtcgatctcgtcgatcgcgtcgtcggcgtcgtagagcagctccctgagacgacggagcgatcgggccagcgacctgttccagatcgccctccccttcacggcagccaccaccccatccaccctctcgatctcagacctgagcttcttcgtgtcatcggcgagcccaacctggcgaatccagtcatccagcttgtcggcgtccaggttctccaggatggtctccgccagccacccgatcccgccctccagcaaaccggcttccacctcctccatcagacgcggcagccggcagaacagaggcagttcctcgatcggcgatcgccgatggcgtgaccgtgtgagcacgacaagaggatggggaaagcggactagcaggtgaagtggaagacagattactgtgcgaggaattaagtacaaggagaggacagattactgtgcgagtagctagcagactagtagcaatgttcatcagctattcggttcgcagcgacgacgcgctaggctagctgaccccggtggctaccgactttgacggaggagtcgtcctcttctggttgatgggctagtccagttaggtcggtgatgggcaagcccagataatcctcatagaattgtcctttgtcaggcccaaccgtccaaaaggagcaacgcaacgcttgggcgataatggcgaccgacgccgcgacggtaagcacaagacagagaggatcgggggttttcggggagaaggcaagcagaagagctatatacaagtttcttcgccctaaaataaaatataagagatgttaggtagatatcacttttactacgaatctgaataattcaaaataacgttcgtaaaaaaaatataattcaaaattccttatttgtaatgttttgaaaatggttggaatgttttgtttgtaaacttgggtaaagttcggtaaatggtgatgagatgatggagagtggtgatgatctaccttaaggggtagatgcgtgttatttattcattcacattacaagttttacttactctatactatcgttataaaatttcgttgcgaaacatgttgtgaactaaaattggcatttatgcaaattaacctatacacagcttatctttgaatatggccaacatgtagtatgctaggattgttttccgacttgccagtacattaatttgattaatgtactgatttcttgctttcttttacttgtttatgctc

SEQ ID NO: 6298 - DNA, 1501 bp, Oryza sativa
agaagggtgatccggccatgcaaaagggtgatccgtgtgcgggacgaggccacgactgcgacggcaaaaaaaaatctcgagagggggaagaaaaaaagcgcgcgaaaaggccaataaaagaggagagagagagagatcgcgggagggcgcaggttacgaggaggaagaggagaagttgaggaggtggcagtggctgtagcctgccacgtaggacgatcggagccaatgacctggtggtccatggcgttgactgtatccgtacgtccacggtcctgcaggccgagagaggggcacggtgagggacaccgaaagtattttacactctcttatcccccataaaaaatcaatctagtgatatattatagtactataatttagatatacctatgttcatatttattatactaaaagatatcatatctagtcgtagattcgttttttcagatggagtgtagataccatgtcacctagatatatgcatgtaatttaaacagttatataaaattttcataaaacttaataagatagactataataagacactatacaaacctacaagtctaaattcatcgacatatgaagaaacaaaaataacaaattttatctacgttataggggtactactcactatctgattttattagttttatctctctagttgtagatcaaatttagtcctacatatttatgtgtagaattatatcattacaatcgatgttactaaatttttttctataactatttaagtatgaaatgatagtcaacatggcatctcggcgtagaaaatccttctccgcacggtgagttgaacgccgggagggtttggggtttactggacgcgcacctgtcagggactgagccatgggacccttgcagcactcactacctttgctcagggcaccatgtcagtgggtcccagtttcattgaccgtgtgaacgtgtaggtgtgcctcatttattgactatccaaatctggttcggcttagaaaaagtttagtataactaaattactattaacatactaatatgtataataagttagctataaacttggttttattttttctctctcactataaattcagtgtaatattttcaagtatatgtatagctaactctaacagcaaagccaacactcataatttttttaatctttgtcacacataagcttatggagtactcaattattatcctcatagagcaagtacaatacaattcagataataaatcagctacaaataaacgtggagaagaaagatagattcggaacgtgctacgagatagtgtttgcgtatgagagatgagccaagtattaatgtatatgatatgtttatatgaaactaatgtacgtatagtataactaatgatgcttttatattttaagacggagggagtactagttaacacatattttaaataatctataactagacattcagtacgtagtagttccatatttctaaattatttaattcacagtaatactgaattgaaattgtaa

SEQ ID NO: 6299 - DNA, 1501 bp, Oryza sativa
aaaatctagggcgagaaggaattgatcaattagctgactagtaccattgcaatggtagttacaagcaattatacatacatacatacatacatacatacatacatacatacatacatacatacatacatacatacatacatacatacatacatacatacatacatacatacatacatacatacatacatacatacatacatacatacatatatacatatatatatatatatatatatatatatatatatatatatatatatatatatatatattacaatttcaattcagtattactgtgaattaaataatttagaaatatggaactactacgtactgaatgtctagttatagattatttaaaatatgtgttaactagtactccctccgtcttaaaatataaaagcatcattagttatactatacgtacattagtttcatataaacatatcatatacattaatacttggctcatctctcatacgcaaacactatctcgtagcacgttccgaatctatctttcttctccacgtttatttgtagctgatttattatctgaattgtattgtacttgctctatgaggataataattgagtactccataagcttatgtgtgacaaagattaaaaaaattatgagtgttggctttgctgttagagttagctatacatatacttgaaaatattacactgaatttatagtgagagagaaaaaataaaaccaagtttatagctaacttattatacatattagtatgttaatagtaatttagttatactaaactttttctaagccgaaccagatttggatagtcaataaatgaggcacacctacacgttcacacggtcaatgaaactgggacccactgacatggtgccctgagcaaaggtagtgagtgctgcaagggtcccatggctcagtccctgacaggtgcgcgtccagtaaaccccaaaccctcccggcgttcaactcaccgtgcggagaaggattttctacgccgagatgccatgttgactatcatttcatacttaaatagttatagaaaaaaatttagtaacatcgattgtaatgatataattctacacataaatatgtaggactaaatttgatctacaactagagagataaaactaataaaatcagatagtgagtagtacccctataacgtagataaaatttgttatttttgtttcttcatatgtcgatgaatttagacttgtaggtttgtatagtgtcttattatagtctatcttattaagttttatgaaaattttatataactgtttaaattacatgcatatatctaggtgacatggtatctacactccatctgaaaaaacgaatctacgactagatatgatatcttttagtataataaatatgaacataggtatatctaaattatagtactataatatatcactagattgattttttatgggggataagagagtgtaaaatactttcggtgtccctcaccgtgcccctctctcggcctgcagg

SEQ ID NO: 6300 - DNA, 1501 bp, Oryza sativa
tagataacatgagagtgaaggatttaaaaataataataatttaatggagaagatgccatagttaattgtatacttgcatgcatgccttatattatggaacatctaagaaaattggttgtgctttatattatgcaatggagggagtgtcttaaaaaatatactccagtttgtaattctaacatattaccatgttaattggataaaaattatatatgttagatggtggtggattgaaattataatggttgatataattatattcgaaacacaaatagcatatgtggagattgaagctataagatgtatttcaaatagaatcctacttaaatctactgtatgcaaatgtatctttggaaaaagctacgaattacattaagaaaatgtattttctaatatacactttctctatcgtaaaatatagctatctatagcatttaaaaattatcataaaatataacaacttctataccaatcacaaccttcgacattcaaattctccacctagtccttcttaaccaaacatttcttttctcatttaattttatctacttttttaatcccttatatccaaacttaaaactttctatttagaatggaggtaattctgtatatagattaccaaaaggtacaagagctaagaatcgtgcatcaaattcacttcggaaaattacataagaaaaacatttgctagtttgttctacataaatctcgagaattttcacaacggaacacgaagctaggagaatttcacattttataaaacttttataaaatgattaaaaaatattgaaaaataaattaaaaaaatctaaagtcaacttcaaattaaaaaattaaaattaaaattttggctaataaacatagcaaaagccgaaagatgagactgaaagctacccagatcaaacagttctatcgctatagaggatccgagcaaaaaacagggccggccggccggcagaagaacacaccacaccactccccagtccccagcccacccccacccccccccctcgtggcactgtagccagtgtactatactgccctgcccttcaccactttcacctccctcctcgagtcttctcctctcgtctccccctctccctctcctctccgccaccacgccaccgtgcttccctcccctttgttcctgtagcgttccgaataaaagcccacctgctttcctttcccgcgaccattaccataaaaagagcttgctcccaccgcctctctctctatctccccgtcgctagctaccagcagcaacaagtacactccccccactcctcccccacacgccgcgtacaactagctaatcagaggagagggagagagagaggggtggggttttgatggaagtacaattctagctatgttcttgatcggggccatgatcgcggatctctagaaagttctagatcttccgtgcgtggtggccgggtgggggtgttcttggtagggtaggtaagtgctgcttcaatggatgaaggaggtgggagtggcg

SEQ ID NO: 6301 - DNA, 1423 bp, Oryza sativa
ataattgtggtaaattttattttaaaaaaagtgcattatttaaatatagtagtccaaagtaaaaaggtccccgggtttaagttatatgatggtagattatttgtttgtaaaattatgattaattatttaaaaatatatccattatatatataaatgggaaaattaagaaaaaaaagaaaaaaaggaaaaaaaaggggggaaaggaggcgtacgtatgtacgtacgtatatactacacctgccaatgtgtgggaagaggataggtgggaccatggtatttagtttgttttaagatcaattttatctaacggtgtataatattggacccaccaatttaagtaaaaattaagggatagatgttttgcttttttcttagaatttctaggattttctctattttattagagcgccacgtggcggcttgagagcgtttatagaaagtttcatggacttttagtatacatgatataattgtgtaaaatttattttaaaatagtgcattatttgaaaatagtagtacaaagtaaaaaagtacaccggtttaagttatatgatggtagattatttgtttgtaaaattatgattaattatttaaaaatatatccattatatatataaatggaaaaaataagaaaaaaaagaaaaaaaggaaaaaaaaaggggggggaaggaggcgtacgtatgtacgtacgtatatactacacctgccaatgtgtgggaagaggataggtgggaccatggtatttagtttgttttaagatcaattttatctaacggtgtataatattggacctaccaatttaagtaaaaattaagggatagatgttttgcttttttcttagaatttctaggattttctctattttattagagcgccacgtggcggcttgagagcgtttatagaaagtttcatggacttttagtatataataataatagaatagatgattgaataactattgctgaaggaggaagaatggtttacagtgctgagctaaacacaaaactcaggcccatgcagacactagcccttcgtggcatctcaagtgacacgcgtcctcatcggttacactgctcatgtggaccctcgcaacggacaaccagcttccataccgccaacagagacgcctcgagatgaggtggatgcgggccaccgagcctggacgaaagcgaattccggcgtaatcaagcagagcaaagcacccggtatcctgggaaaccaacgcgcggcgcctccttgtttcgcccaacccgtcgttctcctctccacaccctcctctatataacccgagttccctctttctcaccagcacagcatcaactactcagcattgcaacaactctactgcaaaccaaatcaggagcaagaaaccacaggacaatccggtcgatcttagcaagaaagaagagagctcgatcaatgg

SEQ ID NO: 6302 - DNA, 813 bp, Oryza sativa
aggggaagagaccttggcctaaccctagaggaaaacgggccgtgtatatggaaagtgggctcgtgtattgatattaatgggccttgatgggccggcccattgctattgctacatcgagaagggcgcgcacaacctagcccactccgccgccgccgctcgtccacagctcgccgccgcggcgcccctcccggcgacgactgatgctccgccccctagccgcctccaccccgccgtccccgagcagctcgccgacgctgaccagagcagaggcccgtacgacggtctccgaactgctcgcgaagtaggggaagccgccaccgcgttgtcgtcgcctaagcttcgccggtgctcgcagggttttggtttggtttggtttggtccggtgagttcctttgctttggtcagatatttcattagtggattagtatgaaattagaggatgctattcggctaatagaatatggacgtatggaaccaatcgtggtgttttgatatcacattttgctgcttgtttactgttatcgatgcagtgagggtttgatcaggaaagtgcttgggctcaagtctgaagctgaaccaacaccggcaatgtgagttatcatgttcatggtatatttaagccattagtatctggtggctggtggagcgatggtattagataagtacattgatattggttgttatgtcgaattgctttgggctttgcttagaatgaactatttggttgcacagagcatcctattaactgtcacctgatacttacactgcgacagacatgacgcttgactcattatatattcactgtcaacttgt

SEQ ID NO: 6303 - DNA, 612 bp, Oryza sativa
catcaaagcagccaccaccgcaagaaccctccagctgctaataaccctccccatgatcgatcgatcgccactaattaattaactttgcaaccgatcgatcgcagtagcagtggactagctgctcgtcgtgatcagctagttcttgggagggattggaattggagggtgagggcgatgaggaggaaggagaagggaggagacgtatttatagctgggatttgcggcgggaaacgagacggatttaaatgggggtaacagaaagatgcgtgcgatggtgtcagattcagctagggagttgggatggacggctgctacgttagcggcgggctacgtgagttgccaatggcgtcgaagattctggccagattcaaatacggatcgatcggtttttgttcatgacttgattgaatctagtgtagctagcttaggtgtgcaattttatggatgctagtactgggttgctgggaagtttatcactgggtggtcgggctacgtgacgtgaggaatggctgctttgctctgtgattgatcgtagcttggctaggacggtattaatggcggtcgtggaggccgaggggctgcgcctgcgcggcgtgtaggaattggttgcga

SEQ ID NO: 6304 - DNA, 1501 bp, Oryza sativa
actagtttagcactgatctctctatctgacggattctgttggcaccacaatcggtgtgctttgtgttagtttatattagttttcatgattactaattctcctagttagccttgcatcccatcatatgtttgatgtactgacaccagcacttgcttgcatggttaactagcaaattctaatgttatcttctctttgtatttactggttgacgtgtggatgataactagattctggtcacgtatgattttgcccttcttgcaggggaagaatctgactgctgtcgtagatctgtttgtgctgttgggctaccagttttgacgatgctgcttttttgttctttctttctttctttcttcttttttggtgatatcaggcctcagattgtagccatctcagaaaagaacaacggaatcataaaagcctttgtgatcttaggtgcgtcattctaggtatcaacaggagagcctctcctgctggattcctgaagggctgaaactgaaagtgattcagaagaaggctgcagccgcatcacagcctagtctgtttaacttgatcaatcctccatatcaagctaaactcaatatcattttttttcaaaaacaaaattagcaacgtccatagaactgcactaagttcgtctaattacgagcaccagaagaattcccgtgggtagcggtgcgtgaaattggagcagcctgaagccctgaaccgtgaaaaactgggctgtgagactcagagcgcgaaccaaatctgtcatggagaagatactccctccgtactcgtaaagaaaatcgtttagaacaatgtttaagtcaaaccttgagaatataaatcatgaataactatcaagttgttgagttttaaaatataaaaattatatgaatagatttgtcttgaaaaataacatacatatatcactttttaatgaatatttttataaaaataagaagttaaagttgtgttttagagaccgtgtcgctgtcctaaataacttactttacgagtatggagggagtaagagctagccgatcaaccgacgtatcaacaactcggtggtctctgcggctctgcctcatcgcaaccaattcctacacgccgcgcaggcgcagcccctcggcctccacgaccgccattaataccgtcctagccaagctacgatcaatcacagagcaaagcagccattcctcacgtcacgtagcccgaccacccagtgataaacttcccagcaacccagtactagcatccataaaattgcacacctaagctagctacactagattcaatcaagtcatgaacaaaaaccgatcgatccgtatttgaatctggccagaatcttcgacgccattggcaactcacgtagcccgccgctaacgtagcagccgtccatcccaactccctagctgaatctgacaccatcgcacgcatctttctgttacccccatttaaatccgtctcgtttcccgccgcaaatcccagctataaatacgtctcctcccttctc

SEQ ID NO: 6305 - DNA, 1501 bp, Oryza sativa
tccgtcgtggcccaaaggagccaggactgggcttacgcccggcaaccagccttgaggggtgagacagcacgacaacgcccttaggagggggaatgaaccatcattgtcggtccggccaaagccgggttaggttttcacccgccgctcaccacctgcgaatccacggctaacgccccgatgatccaccaccacacaagctctgccaacatgtgggacccctgcaccggcgcccctcgccagccagccttcatgcgccgaagaccgcgccacacccaccagcagctcctcctcgccccgaggtcgcctcatccaccgccggccgcgcctctcgcgccaagccggcctccatcttcaccgcccgcgcctttcgcgccgagccggcctccgctgccattggttgcgcctctctgcgccaaaccggtctccgacctctcctccaaacgatgccgcgccagccagatgcagtcgtctgccacgccctcgactagccgtccgaggccgtcatgcctccggtgactgcagtcacattcaccactgcagccgctgttgccgtcaccagccgccatcactaacctcctcccaccgtcgtctgccgatgccgtcgtcaccagccgccgtcggcagtgccgactctgctgctgtcagcccccactccacgcccatcgccgccgtccaaggcccggcatcgccccagccagatctggcccggggaggccggatcccgccgtgtgggggccgaatccgtggccgccctcgctggggcgcgccgccgctgcccgtgcctccatcgaccccgtcgccatcctcgccttgcatccaccgctctgccagctctagctgtagtgccggtctgctcccgcccccgccaggcgcacagcaggcaccatcaccgccactgacgccgacgccggctgcccacccgtcagatccagccggacccgtcgggtccgagcgcggaggctagccgcgccgccgtcgacaccgccgccagcagcaccggtgtcacaccctaaagttctttcccaagcctaaattgaatttataaatcacctagagaaaatatcggtgtaaaagcaagagagaaaccctaataaatttgtcggtgacatggggccgggggtatcgtgactaaaggcttgggtagccgtggtcacccacgtggcctgaccccctcggggggtcgggcccgagggtgacatggccacccctccctctgtctccctgaggggtcgggccgctcccgtttagacacagagggctggggcgccccgaccccctgtggttttggcgccacgtgtgtgggttaggtgagcacagcggcgctcacctaacggcatttatagcgggttggacaagcgcgccacgccgcatttaatgcggcgcagcgcacgcttatccgggccgtggcgggtcgcggtgtgtgaccggtcacagaccggtcagatcgcgggttaggtggcaacaggcggcctgtcacacgcctcgccccgtcccgtcagaa

SEQ ID NO: 6306 - DNA, 1392 bp, Oryza sativa
tgatcgttataaatttgacatggacatgagttcgtttttaaggaacgcaagctgtggatcaatacattaattttaatatgagaaaaagttcaaatacttcatatagacaaaacgaatttaaatatcccggttagaaataaacttttccttttcagattggttggtttcacatatatgtacaggccgtttatttagtcgtattgatctcgaactctttttttactctgattcctaagtacgtttctcctttttactccgattcctatttctagtatgtttctttaagcttccgtggaaagatttctattagctgtacaactctgatatctttatctattagatctgaggtgctaaaatctagatatactatgatctaacggttaatatttttctcctttcctccgattaatgtgggaatttttagcctccacagcgaacgtggtgctttcttttaaggctgttttaataatataatagaagatagatggttcactctaaaagcatttgccttatttgtttctctttatacgagttgtattttagattgaaattttatatagccatagacaacacgattattaaagttcattttttaaaaaaataagttcatgactatttgtttgaaatttaaaacctcgatgtttaaatcaggtttagtgcttcgaatatatatacaatgataaaaaattatgaaaaatgttgataggtaggctatattgtatctattaatcctaccaaattttattgagaaacatgacttacgtagggaaaaaaaaagaagcaatatcattagagaggaaggtgacctgtttttaatagttcaaagtgtaaaataagaaaaaaaaaggtttaagatgttgagtgaagcaatgaaatagtttacggagtaaaacggatttttttttgtttttacttttagaactatatcacgagttttatcttctgtgaaaatatctttcgctgtgtatctcggaaagtacaaaagaacaattattgatcaactaatgtacacgtcccagatggcacctataagtagagtagtagtaataagataatgatcggcgacgcgcgaaacgggttctagacttttcttcacccgcgcggagcttaagctaacgcccgccgtttcgtcgtcatcatcagaagaagataactatcgcacgccagcgaaagcgaaacccgtgtgccggttagcggctaagcgcgctccccgcccaccagaagccgagcttcccagcggccatcgccttcctctcctctccgcatatataaaccccccacgtctcctcctcctccacgtcaaaccacaatccaaccaaagcaaagcaaaggagagagatcccggagaagaagtttgcgtgcaaggcgatcgatccatgagcctgaggcaca

SEQ ID NO: 6307 - DNA, 1501 bp, Oryza sativa
caactaaacacggtctttgagacctgataataacccccatatggcacagcaaactgcatgcgtgctgacgtgccggtgggggcggaccggggccggggacaatttttaacccgcgggtcgatcgggtcggggccctgaacataaccggggccggggcggggatgaaagctgacccgcaggtgaccctatgaggccccaaaagtctatgtctatgttaatatggcccgttactccataggcccaaacggatgaaaggatgtacacatataaggaaacctatgccttatgatttaaaatcaatcatatgccttatcatcaatcaatcttatacatcgatacatgctcaatggtgcatatccagcgaaatcccctcgctcatccgcgtcgttgtgcgccacccgcgccgtagccaacctcccgtccactcccctcgctcgctcggctgcgtcgttgtgtggcctcctcaccacaacacgacacggcgtcggtctccctcccgctcgcctcgtcgctggtccccctcatcatcgtgttgtctcgtcgccggccgcgcgcctcgtcggcatgctgcctcgcggccgcaccgcatcgtctccgcactgccatcgttggtcgttgattcgtcgctacctagtcagtcgttggctcgtcgccgtgctgtctcgttgccattggcggatccagaaaatcgtttcgttggtgtcataacgtgtctattattaatgtcatagtatactaattatatttaaatcatggtgtcataatatatggataagcagtttcttcgttacaagttttgccccattcctccctccagggctagggccaggtgaacctgcacatgagcagggcgtgtgcgcaccagcaacttactccatccgtcccaaaaaaccaaaaaaataaacataagaaaattgtattaggattttataaaataaagaaaattttatttgttttatttgtgtgtgtgtgtgtatatatatatatatatatatatatatatatatatatatatatatatatatgtcggtgacatgggaccgggagtatcatgacttagagacttgaggcagacacgatcacccacgtggcctaaccccctcgggggggggggggggtcgggcccgagggtgatatggccgcccttctctttgtctccccgaggggtcggaccgctcccgtctcggccccgagggctagggcgccccgaccccttgtggattttgcgccgcgtgtatgggttaggtgagcgcagcggcactcacctaatcgcatttattgcggtttggacgagcgcgtcacgccgcatgtagcgcagtgcagcgcgctcgttcatccggtctgtgatcagtcacagaccggtcaaatcgtgggttaggtggcgacaggcggtctgacgcacgcctcgccccatcccgtcaggacgagagcctccaagcacttgtccctagccggagccggcgtgttagctcctggagatggcacgttggtcccggtcaga

SEQ ID NO: 6308 - DNA, 1501 bp, Oryza sativa
agttggaagtttggaaaaaaagttaaaagtttatgtgtgtagaaaagtttttgatatgatatgatgtgatgaaaaattgagaatatggaggaaactaaacacggccttggtgatggcagaaataagtaataaaagaaagaactggttagatggtgacggatgtggttttttttctcacttgtctaaacttcatacatgctttctaaactattaagcatggtgttttttataagaaatttttatataagaaagttgctctaaaaatcacattaatttattttattttttaaaaaagttactccagataatacttaatcaatcatatgtgtcagtgagtcgctctattttaagtgcgcggaagataagtttcaactcaatgaaaaaaacacggcatgagctatcacaaaccgggagaagacggcatggggcagcgacgagaggaagaagatggagtgggttgtgggggctatgaatcgagagtatggggctatgggattgttgatggcacgtctttttcaaagtttccttgttgcaatttaggtacgtgaagatcgaacccggtgatgctctgtctcgtgattactccaaaatattcgaatgctgacaaaaaaaattttaatgacaattttgtcttaagcctgattactgatcaacctcataaccaaatacggccacgcccatcattgctgcccattacgggaatatgactgtgtttagtttcaaacttttttttaaacttataacttttttgtcacatcaaaactttcctacccacaaacttctaacttttccgtcacatcatttcaattataactaaacttctaattttgacgtgaactaaacacagcctatgtatgagtacggtgtacagtctctcataactctagtacagcagaacgaaattaaaagagacggtgttgagcagtgagcatatatacacacgcgacgccggccgcctcttcacattcaattcgacgtacataagctccaattccagctaaatcaacagctaactactgaacagtaacaatcatttggcaggaccaaattttgatatgatcaactcatgaaggggaatgcatgcatcttggtacatgcagtcgaaagagagagagtgcaagtgagacttacatatcaagtaacagtaccatagataacgtgcatccatacatgcctacagctagccccgcctctcttgttcgatcatgatatcatatatctcaacgcaagagctaattaaacagtccagataagtaagccaaaccctccttttttttttcgattcatattgccgacgtttgatgtcgcaatttcatttacatagtatagggatcgttggtactaggatatatgcgagattataataaaagagatgtggacgaggatttttatacaggtttgggccccctgaattgtcaggtaataaccctactcctgttggccgaagccggtcgttgctcttattcaccataatcacaccagtacaatatttggggtagcc

SEQ ID NO: 6309 - DNA, 417 bp, Oryza sativa
agagggtgtaagcattgagcatgctatgtatatattcctactcctttggtcccaatataaatacacttaatgcataatataaatgcacttagtatatgatgtgatatattctaatacacatactccctctatccaaaaaaaaggcaaaccctggatttccgtgttcaactttgactgtccgtcttatatgaaatttttttataattcgtatttttattgttgttagatgataaaatatgattaatattttatgcgtaagttgtctttttacttttttttataattttttcaaataagatggacggtcaaatgttaggcacggaaatcagggtttgtttgtctttttttttatggagggagtactcttttctcaaagtagttgtacctcccaatatgatgatctatgaccacgagaca

SEQ ID NO: 6310 - DNA, 1501 bp, Oryza sativa
cccttgtcagaggtggaagaaggtagtaacaggggtatttttgtccgttcgagcattatagcgtgtagtcttcgattgaaagtggcattttaataaagcccactcccagcgtggtatttggacgaaacccacttttgagaatggcacaatgtcaattttctccttgagagagatactcacgcacaatggttctagacgctaaaagattttggtggtgtcgtgtttggacgaggactaaactttattctgtgccaggatttacattaccccggtaactgcgtggttatcgtggttaccgagcttaccgcgggggtatggtaatataaataccgtgataacctcctcaaattcaaataaatttaaaaaataatttgaatttttgataaattttgcacgattttatacagtttttcacggttaccgcggtaccgcgcggtaaccgtgcttaccgccgaggcacggtaaccctggccccggcggtttgggaaaccctggtaccatgtaggatatttgacactgactacttatataaaattgattatataaatagcagctaatttgcgagataaattttttaagtctaattaatctataattagataatggtggtgtttgaatcttcttaagatgaagattaagatcaagtgtttcacgtaaaacgatgtggtaataacgtgtgattaattgagctttaattactacaaacttgaaaaatggattaatatgacattttagaataactttcatatagaaagttttcacacgaaacacacggtttagcagtttgaaaagcgtgtcacgaaaatccaaaagtttatcctctctttctagaggattcgaacggggccaatgtttactatagcatcacatatgttaatcatggattaattaggctcaatagattcgtctcgcgaattagtttaaggttatgaaatgggttttgtaatcaatttatgtttaatactctaaattagcgtcaaacaggcccagtcccatctttcttttctctctctctttttgttggcacgattaaatttaggatgtgttcgttacttttggagcaactcactcccgcatggaaaatagagtggtccattatagcgtgattagttaagtattagctaattctttttttagaaaatggatcaatacgatttttttatgtaactttcgtatagaaaattgttataaaaaaacacaccgtttagccgtttgaaaagcgtaaaaacgagggtgttagtcgtatgaacgaacaaaaaaaaatcagaaaaatagaaaaaccgattctgataaaaatgaacgtgtaaacttgcctgggtataaccactccctactcaagaaaaggaaacatactacctttcccaccttgttatactatccaggtcttgcaattcccacccaatatataatttttttataggcacccaatatatacttcatataagcaattcccacccaaatcatctttggatggtataaatacatttttaatcatctttgg

SEQ ID NO: 6311 - DNA, 1121 bp, Oryza sativa
ataattgtgctttgagagcctcatctcatcccctttataatctctctctccatgggaagcaaagtaaggtgtgaaggcacctgagaggagagagcttgacaaagagcatcatgcatgatgcccaactaggcccacagtatggatggtgagggcgtgtagcaaaaaagaaggcataacctttttgggtgaaaaagaagaaaaggtcagggagtttgagacaccaatgaaaggaagagaaaggattagtcacttttgaaggcagaaagattgcactactaaaagtcatggggagaaggagaaaagagctcctgtcttttaagatgggctaattgcgaagtgggatgcactctgcagcaaagatgcccctctttgcataaagggagcaccccttctttctgtttgctagggaggggttttttggccacttaggattccttaaaaacaaatgtgaggtgccaagggaaagttggagccccataaaaggggcaaactccggctttgtatgaaaagttcctcaaagcatttttcgcagtggcttccccctttttctttttattagtcaagcataacaatcccttgctttctactgccaacacatttgctcattctttgtactagtaccaaaagaattttatgactgtactgcctctctactgttccatgtgttcataagcattaggtgcctttttttccactcaaggacttgcatgcattgcatgataacgaaaagattctccaattacaaaagaaggggctctgaactgaagtgacatgtgcaaaagcttctttcagcaacgatttgtgtcccatttctgataaacgaaaaacaatacggtccatcataagttaatgactttgtagataaccccttgctattggattgtgtttgctactactaatgaacagcccaacataagaggcagaaacaagataaaggcccagaccatttaggcctcatttggaagggccttaatccaggcccatccacatgtgatgggctgggattttgtgccttaatccaggcccattcacatgtgatgggctgggatttcgtcctatccaaacaaggcattaatttcgtactgtgcaacagagggatcagaaaacacacagaaggtgcc

SEQ ID NO: 6312 - DNA, 1501 bp, Oryza sativa
cgagatgtcgaatgattggtcgcatccaacgatcggagataagaatatcgtatgctactcgatcgtctgtactactgctattatcgcaaaggctaaaagggggattagctagctagcgacatactcacattggggataatgatgctgtggctatagtgcggcagctgctgctgggatgacaggatgagggcagtgggtacaggtgttgcttttgctttctctgcagatcttcttcaatccatcgcgagatctttgccgtgattgtatgggtttgaccctggcgaatttcggttggcaattgcttagacagttcgatcaggatcaattcccttttcatttcggcgacgtcgtcgttgtggatcagatcaaagagtaggttatggtataaaaacagtacggattcattggaccatcctatacttgattagcatgttcaaatcctttactccaggaatgtttggcagcattccggctcagcatgtttcaggccaccaatgccatcgaaacatgggtacttttttgcacagaatacgccatgttatccggggtatagggcttcggtttgttgatggcgatcttatctcttcccgttttgtggcgaactaattgcgaattatatattgcacgcgcgagaccgtaccgaattagaagtccattaagaaaataaccgaagaaatgaagttgttggaacgtaggagtaaatctactttaattcatatctgcaaatcttgctccagaggcaactaccagcacatttctgtgcctaatccataacaatattaaattactggcacacacgtatgcactactaccattgtagacttggtagtagttgttggcaccactactacctttcgttgctgatctgggtcatgaccattctgcccctgagaatgctatacattcacaaagtcaacaggtcatttgtaagtgtacccgtatatattggtcagctcctgtggtctccgttaatatcggctcgttttggcatgactttatcgaataaattaaatcaggtcaaaccaataatcgagtttgctcgaacaaaataggtgtgtgtgtgtgtgtatatgcaggatgcttaggagacaggtgctgggatgcaggctctccttgcatggtctaattggtatttccatgtcgtgcagaaataattgggaggagatcgtacggctccttgcataattgcattgtatattatattgggtactgtactaatttcttcatctagatatataactagatttagcatcgaccaatgaaacggagtaactggactgcacgcaatagctagctactccagcttgtagtttggtcacacaagctaggtgaggaccagggacaaaaggaagcagagagaggacactgcatgcgtgtcttgtgtcgtgcataatttggggttaaacatgcgttcctgctgctatcaatatgcacgaatccaaggcaaaccaaaacagtagcaaccgataactaactccgaccttaaattaccacggcaatt

SEQ ID NO: 6313 - DNA, 1501 bp, Oryza sativa
ttaacaatattatctagtattatctatgctacgcgtctgacaagaatatacttcaatttaatttatactcgcctatacagacaacatatatgacagaagctaaaagattgcaagattttgattctgaaattttgttgaatgtgatttggagcctgccacgccgaataacatattgttttttttttgaaagcaccataacacattcttttggcgtagcaaccaggagtaatttcaacaccaacaataatgatatggtcatgaaagtccaatttaaaacacatgcaacagaacagtgataatctgtaccattataaaaggaagttcgtttacgacttttcattttcacataaacatcatgacaaacaacaccaccatattactatcacccacgtaattcacgttccgatgcagcagatcaaaatatcttgtgaaataggaaagccctagtggtttgctagtcatgtgtgcatgactttacttattcatgattcaaatcctgctacccacaaatattacttaatctatctcattttaagtacaaccatagttttctatacccaattttaattatctattttatttaaaaaataaaacacgtataaaatagcattcatgttttattatctaatagtaataaaaatactaattataaattttcttaaaataagttgaatcattaaagttggatatgaaaacacgtggttgcaattaaaattggaaggagggagtatgcatttgtagataggtttcaacatgattttatcaagaacagatatatgtctcttatagtgtacgtacgtatacgtctgccgtatgattaaaagaataatgggaaaaactatttggaaaaaccgtgcacaagtaatggctctccagtactcctccccatctgtcccacctgccaacagccccggcgttatccacccccaccgtccgtctcccactccgtctcccacccgcacccaaaggtgagaaccgttcggtgagaatacgtctgcagccgcgcgcaccacgcgacgtatccctcccgtaagcgcctccgcgatccccgacgccgcgaggcacgagaagatttcagataaaacccggccgttacacgagagtgagaggggcagccccgtcatttcctccccgtgcaaagattggatggataagcacaccccaccaccttcaccttcaccttcacctcctccttccccttccatcttcctcctctcaactctgtagactctgctgctgcgatatatatctatcccgttcccaccccgcgatctttcgttcgattttcttccaccgtatttatagctcgtcctctcttctctcccaccctcgtccgttcttatccacctccacgcccatcacgcttgcggccgtttccatccttccgcttcatcggagtagttcgccgccgggttgggttttcttcttctcttgatgcgacgtggaggcggcgagttgttcgtcgggtgcacgaaccggtgatttttttttgttttggcga

SEQ ID NO: 6314 - DNA, 1501 bp, Oryza sativa
ggaggagtcgcggcggagggggagatcgggaggaggaggagagaggagaagggcgacgtggtggtggtggcgcgaggcgtcgtcatgtggatgtcttcttggtttggctcgcgatttgcttggtggagagagctcgcttcatctctccgtatacactcccgcggtcgcgcccgctactacgactcttctctcgctacatttcacgtgtgtccttgtcacgcaactgcatccctgccttggcaagttcatgcacatcctcgcgaattccacacgacactacacactactcctttgacagctacctggaaggaattaataaaactagcatggtggcccacgcaatattgcgcggctagcatcattatattttctctcatataatagcatatatattctctcattatattattcaaatatattaaaatgacaacataattttaaattttgctataactttacgaaactactaatgtgtaatattcatattgtattttatatacatgttagttattaattatttttaatatcaaattttagttatttataaattatatatattcctatatggactctagactcgtcttttaatatttattttttttgaattctgaatttttattatttataattgtatttctatttggactctaaactcatctttcaatattttttaatttttaatttcaaatttcagttacttctaaattgtattcctatattgactttaaactcttcgtcccatatttttcttaattttgaaatttagttatttgtaaattatatttttatacgaactctaaactctacttttaattttattatgtttattctgaattttagttagttttaaattcctatatggattctatactctacttctaatattccttatttttttaaattctgaatttctatttttttttcttaattgtatttctatacagactctatactctacttctaatatttcttatttttaattccgaatttctattatttcctaattgtatttctatatggactctatactctacttctaatattccttatttttaattccgaatttcagttatttcctaattgtatttctatatggactctagtctcctcttctaatattccttattttttaattccgaatttcaactatttctaaattgtatttctatatagactctagtctcctcttctaatattccttattttttaattctgaatttcagctatttttaaattgtatttctatatggattctgccttttctttttctccgattaatgtgagaatttctaggccatgagagcgaacgtggagacttctttttctgttcctttaacaatataatagattgttatgcatacaatctaaccgttcgatttatatatgactgaatttgattaacgggtgtaaatagctaccttgtacttctttgattggtattggttgcatatctctagttatataactaagtggcatgtgtagctcaggaattaatcatcac

SEQ ID NO: 6315 - DNA, 1501 bp, Oryza sativa
agcccactgctcttctctctccttatttatcttcttaaaatatgtttacagctgacttatagcctactattatacctactctaatagcgtagtgatgattaattcctgagctacacatgccacttagttatataactagagatatgcaaccaataccaatcaaagaagtacaaggtagctatttacacccgttaatcaaattcagtcatatataaatcgaacggttagattgtatgcataacaatctattatattgttaaaggaacagaaaaagaagtctccacgttcgctctcatggcctagaaattctcacattaatcggagaaaaagaaaaggcagaatccatatagaaatacaatttaaaaatagctgaaattcagaattaaaaaataaggaatattagaagaggagactagagtctatatagaaatacaatttagaaatagttgaaattcggaattaaaaaataaggaatattagaagaggagactagagtccatatagaaatacaattaggaaataactgaaattcggaattaaaaataaggaatattagaagtagagtatagagtccatatagaaatacaattaggaaataatagaaattcggaattaaaaataagaaatattagaagtagagtatagagtctgtatagaaatacaattaagaaaaaaaaatagaaattcagaatttaaaaaaataaggaatattagaagtagagtatagaatccatataggaatttaaaactaactaaaattcagaataaacataataaaattaaaagtagagtttagagttcgtataaaaatataatttacaaataactaaatttcaaaattaagaaaaatatgggacgaagagtttaaagtcaatataggaatacaatttagaagtaactgaaatttgaaattaaaaattaaaaaatattgaaagatgagtttagagtccaaatagaaatacaattataaataataaaaattcagaattcaaaaaaaataaatattaaaagacgagtctagagtccatataggaatatatataatttataaataactaaaatttgatattaaaaataattaataactaacatgtatataaaatacaatatgaatattacacattagtagtttcgtaaagttatagcaaaatttaaaattatgttgtcattttaatatatttgaataatataatgagagaatatatatgctattatatgagagaaaatataatgatgctagccgcgcaatattgcgtgggccaccatgctagttttattaattccttccaggtagctgtcaaaggagtagtgtgtagtgtcgtgtggaattcgcgaggatgtgcatgaacttgccaaggcagggatgcagttgcgtgacaaggacacacgtgaaatgtagcgagagaagagtcgtagtagcgggcgcgaccgcgggagtgtatacggagagatgaagcgagctctctccaccaagcaaatcgcgagccaaaccaagaagaca

SEQ ID NO: 6316 - DNA, 1501 bp, Oryza sativa
ttaagaacaacctatggcacaagaaatcaagcggcaatcacaaaaaagaaagaccagacaatccaatacttaaattactccccagatttcttattgttcagattattgggcagctaatcaagcaaccagagagcaaagctgcaagcacagacacactgacacacagggagaagtaataataagttacacatggaattacggatggaattaagctgtagagcacaagaggatacaataatctaagggttgatttggggggatttttttttttcattcggtgaggcgggcgacgacggggtacttggcctggaacttggtctcccagtcggcgaggacgccgagctccttgtcggagaggccggagaggtcgccggagacgtcggcgtcgtccttggacatcttgccgagcgcgcggctggcctcgcggccggcgaagacggcgtaggcgccgccggggccgtagaagccgcggccggaggtgacgtcgtagaccttgccgcggacggagacgtagatcggcttcgatgggtcgctcccgtcgtacgcccgcagctgcgccgccgtcagctccgccgccatctctctctcctctctctttctctctcctcgcggctgtgtgtggatcagtggaaggttgttgggttgtgggccttgtggctagtggggaagtgaagcggtggagaaaaaggcgatgcgccgatgacgagaatcgaataggatagattgagaaagataggtaaaacgagttaccacctccgtcccaatcactatccgtacttattataaaaattgaagatcttttcacatcttattatctgtgtttgagtcggttataaaaattaaagatgtttttataattcgtcatccgtgtttgagtcagttttaattttatgttttggttttaatctatatctctatctctactattataaaagttgaagatgtttttgccggtattttggtacgtcattcgtgtatcgtgtatgagccatttttaagttcgtttgcttttgaaaatacatattcatatttgagtcggtttttaatatcgttcacttttggtaaatacaaaaggaatcatataagaaatctgtttaaaaaaaaatcgcatgccaacttgagacgattggactcctaactgcagcttatgattttctaaaaatatatatatctaagcaaactctcacagtgaatttcatattaactaaaccatatatcaataataagattaaaatagacttcacccgttgcaacgcacgggcatttttctagttattatgaaaattgaagatgtttttgccggtattttggtacgtcatccgtgtatgagtcagtttttaagttcgtttgcttttggaaatacatattcgtatttgaatcggttttcaagattgttcacttttggtaatatagaaggaatcatataagaaatttgtttttaaaaaactcacatgctaacttgaaacgatcaaacccctaactacagctaatgattttttaa

SEQ ID NO: 6317 - DNA, 1501 bp, Oryza sativa
  unsure (1)..(1501): unsure at all n locations
caattaatcctctcccggtgattgctttgtcggtgacagcgtgtgtgaaagctcgcgcgggcgcggctacggcaacggcgaaggcgtggtgcgttgagattcgtgcagaggacggcgccgggtgcctcgagatgctcgtcgcggagaaagaaaaccgcggagtacgctgcagcgatggtgtcgttaaaactgaaggaaatgctgccgcgcgcgtgctgtgctctgctcgagttacagtgtacactggtgagcttagctagggaatatgattgattaatccatttgattaccctatcatgtcggccagctgaaagagaaaaaaaaagctaactaaatttatgataaggttcatcaattagtgaaatcatatttcaattagtggtttcagttgatactaatactgtacaatgccattctgagatagtagtactgtgatccaagtagactgcatgctccagtggtccgggccggcctgcatactcatcgataatcagcgagccatattttggcacccgtactagtttaccactcatggccgtgtcacagcatacaggccacttgtttgtatttataggacttttgtccccggttggcgacgacggtttgtacgtacgcaagcatgggccggcagctgtctgtgaaagaaaaaatttagtgctccctaattttaaacgcagtcacgagattcttttctagtcttattaaaaaaatataatatataaaatataagttatatataaagtattatttatatttatcatctaataacaacaaaaatactaatcattaaaaatttaaataaaatcagtaattaaaattggacatgaaaacttatggcttcgtttgaaatgtgccggagtgagtactctttaatctaggcggaagtacttttactaccctactgtaaggcggtcacagaacacagctgcggttgcccgtacgattaagagctccgcccgtcagattgctgctggaaaatggaaatttgcttcgctgtgccatgtgcggcctttttactctccgtttttacttactgcaggatgtaggagtacatcagtaccagtactacatgtaatgtatactccctccgtccnnnnnnnnnnaaaaaaaaaaaaaaaaaaaagacaaaccctagattttcatgtcaaacgttcgaccatccgtcttatttgaaaaaattatgaaaaagataaaaaaacaagtcatgcataaagcattaatcatgttttatcatttaacaatattaaaattactaattataaaaaaatctatataagacggacagtcaaacgttggatacggaaaccagggtttgtcttttttttttggatggagggagtatgtaatagtctctccatcccataatataagagaatttttttgtgaatctgacacatccttgttacaatgaatctggacagaccactcaaaatttattgtgctataatatattatattcacttaaaattttttatattatgggacggaagaaatacttgct

SEQ ID NO: 6318 - DNA, 1501 bp, Oryza sativa
cggcgtggccactgcctgaaatgcaccaagaagtagcaatgcacactcttttcgtccttttctagatggattttacccgatcaaaagattgtagcattagacactctttctcctttggtatttctgatggtttgcttacaagatgattacataaataccgactcgagcttttcaaatttcaacacgttgtaaacaagagctcatgtcatcttccattgcaattacagcctctagtttgggcaatctctagcatgttttgtcgacaaggacaaaaaggccgaaggaggatagtatcttgatcatgagcaagcactgcaggtccattgttactgtcagaaatgtgatactgtatgtaaagaaatatcatgagtccattgcaggaagaacagcattacggtatgttcagaaaagaatagttaacttacatatccccttcataaatctgcacaaactctctcaaacctttttgtagaattcacagcctctcggaagagattcaactctgaaccaatccactctgaaccaatcaatgtaaggacaggagactattatatgaagcaatatatatacctttgtttgctccctagttccatctcgtgggcccaaacacgcaagtaatttgacgcgtggattagttacccgatgggcctctccctccagcggcagcctatatgggaggcctccagctgcagtgtgcactcagctcagcgcctcacttttcttgcttggttcaggttcagccgttcagtgaggctttatttagttcctgaaattaggaagaagtttgaggaaagttggtagtttggaaaaaaaagttgaaagttcatatgagtagaaaagttttgaatgtgatatgatgtgatggaaagttgagagtttggggaaagtttggtgtgaactaaacagggcgagtcgatgtccggtgaagttcagtccgatagtcagtctgtgtatatatctgtatcaatctttgctagtccacaggttgtaactgcacagggggtgagggggttaaaacgaaaaaaaaggaacctaagaaaaatcaaatcaagagttggaaaaggttcaatttgtaaaaagaaaaaagggacaatatggagaaaattaatagtacctactttgaatatgttaatttttttttctaaatgtaagtctatagacttcaagacaattatcccctgcattttccttatgcccctattaattgaatgttgtcagttttaccaacagaagagtgctatcaaatttataaataaatgaggtatcgattctaaacgtgtgtcaggaaataaggttattttaaaatttatacaatataaaaagagatggaacatgaaagcaatgatacttgtgcaattacaagacggccattactatatcatatctgatgcaattaataccgggattttctatgtcattaaatgcattgtaatttaatgtttgtatatcttgcattaatcttactccatatctcttaaatagcaccaatgatacctatgaa

SEQ ID NO: 6319 - DNA, 1501 bp, Oryza sativa
ggaagtcgaggaggagatcagcctcaggtgctttgttaattacatgcttcattcaaatgtaaatcatgctgatttcgactcctgcttcttcttgctctgctcagatatgagatatccattccttctctcataatctcttgttgattaaatctcgctagcttcaaattcagtccctttcgaagcttctctgcattttctttcagttttaaaaaaattgtatgaaccatacaacactttgatttacggttttacacctaattactggtaatcttggctacttacaagttagtatcctcgaaatttcctgctgctaaacgtactgtagctggtagcatggaataatttctgagtgagatgtttcgtgggggattaaattattgccagctcactgaatcgatatataattattattccgtacacgttaatcacgcaccggtttggctggtccatttggtgcaagctcatgaggattaagacttagaggcgccttgataactaaactaagaggatgtggcctgcttaatttgcttgtctttaccgccaagattctgaaactgcacctgtcggtgctaggtagcttaccagtgctagtgcgaatatgcttgcagaaacaaatcatattcctctccgtaacttggtactgccttgctttgtggaatgagattttttattggtgcatctggctgctacttcttttgttgctcatgtatcctctatgatttcactgctcttttggtcaactcccaattaagttgcaactgcatctagataattttggtattgacaaagacatagacgaacttgcttggtcgcatacagtaattatggcctcacgtgcaataatttttcccggggtcagagtgtcagattaaatagcatgttgtcgaccttagcagttagcagtgttaaataaggttagggtgtcgttgcatgtggcaatattgaacctttttttttttttgaacatgtgttgttgaccagttagcttaggccttaggccaaagtaaatcaatcagtttttgctcttgaaaatgtaaggcttgtcaatgcatagaacttgcaggagataatttgtttaattgtgcatgttccaaatagttgctgtttttgtaccttgatactttgcttcatcaccaaggatggtctacatatgtcaatataaatacattgagagaccgttcgttggtcttgagctgatgtatgctaacaagttatcaggctgtcatgatagcagaacacactctgaaattaaagaacttccatataatcatgtagttataatgttcacctgtatgcattagattttagctagagaagtgcactgactcttgaatctgactaacaatatgtatgttccagccaatggccggagcttgcaacaagaacttaacaaagaggctgctgatgaacaactgaacaatcaggctcatgaagaggccatgaaaatagatgatgcaaatgcagtaagtactgacgacgatgttcatccagatccaaaagc

SEQ ID NO: 6320 - DNA, 1501 bp, Oryza sativa
gcgtgttccacgccgtcctcgtctccgtgcagccgctgccggctgccctcgtcgcctcctcgccggccccggtcgtcgtcgtcgtcatcctctcgtcgttcccggttgtcgtggcgttcgtccgtccgtcaagccattctcgttcgtcgtcctcgttccgtcaagtgccgcagccccgtcatcgtcttcgtcctcgcctccgcgtcgccaagcattgcgccggccgcgtctcgccttcgtccaaggatcgacgccgaagtcgtcccctcgcctttcgtctccgtcattcccggccgtctccgccgcgcccgttcgtcgttgtcgttcccacgcctcgttgcatggtggtaaggatccctctccctcgctgccccgtcctcgtcctttcggtgtcgcccgtgcctgttgtgcggttgtcggccccggtacccgtgtatcggtgtcggcagtcgttcgcttgttcgtgtcgtgaccgtgttagtgtgtccgctcggtagccgcgtggtttccacgtgtgcagcccgtgtggtgtctagtggagtccgtttgtcggccactgtcacatcctgatttttgtttcaggatttataaattatttaataaattattaaaagaatttatattaaatgttcattaatttacaagtgaagttaaatgtgggaaataaaatttcttaaatataaagcatgggtggatttaatttttattaaattctccatggttaattatactctctggaattttctcggatttttcggagctcaattcttaattttaatcatacaaagagcatttcagtaattacccacatattaaattaatcattaaatggtctaattataattttgttaagtactttgagtgtccaagtattttcaggatttttcttgaaattatttgagcattggaagtatttttaacaattcaaagatcatttaaatgattattttaattgggaaagtaataaaatcctcctcctcagcttgggccattttcggcccattctttcctttccttcctctctcttccgccggcccaacctgagccgcctcctctcctctcagcccagccggaaaagtctactttacctccctggcactgttcatcttccagctctggacagagccgagccgcccgtgctgtgccctgtgcagtcgccgcttcctccgttaaatctcgcctccccgttgctcctttttccaatttagttgaggggaaatattcctcttatcctcctctatctttacccccaaaaaatcggagctaatcgttgagtatcttatccaaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgctgccgccacgtgctccaccccgccgtcgtcgccggccgagctccatccg
